United States Patent 7,560,542 (NUCLEIC ACID MOLECULE SEQ ID NO. 68811 AND OTHER MOLECULES ASSOCIATED WITH PLANTS) - sequence listing, part 5

SEQ ID NO: 25116 - DNA, 422 bp, Zea mays
  Clone ID: cC-zmle189034d01d1
cgggtcgactccacgcgtccgcaagggcaacagagacctcagaacttgtcgaggcaggaattcttggacaggtttaagaggagcgctggactggtcgcttcaggtgttgcgaagaatctaaacaaaacagccaattatatcaaagaaaatattcaggacatgtacaccgatcgtcgtccaccaaagtagcaaccatgccgagtgattgtcgtcaagagctgaagaaatcgcttgctactggaaactttacatcaggactacctggaaactttactccactctcctcacttgttaaacgaaatggagcttttctgggataccaacttccttttctttacctgcataatcttgtaattttgcggctgtatatgtacatgcaaacaacttctttgaagcgaaaaatcagatctcgtttggtgtat

SEQ ID NO: 25117 - DNA, 455 bp, Zea mays
  Clone ID: cC-zmle189034d02a1
ttttagaattatttcggtgcttcgatatggatcttgatggaagaaatggacaaaagaaccaatgcaaaaattgctctatgtacagtctgaagctatcctatacctttacaacaaagaattcaaaacaacgcatacaatcatctacagccacccgttcaatctattcctcgtcactacttgaatcagaatctgcactatccttcatgaagtgcgctggcaggtttggaaattttggcatgaccctctttcttttgctatctgcttcgggtggtttctgagctggtgctgtttgaccatcggtcgctgacgctgtcgctgctgttgtggccgcagccgctgtcacagccgccacggtgggggcagcagctgtgtttggctgcgatgaccacggcgctggtttcttctgctgcacttttctcttgatgtccacacatgcctgatcaaccatacccagg

SEQ ID NO: 25118 - DNA, 531 bp, Zea mays
  Clone ID: cC-zmle189034d02d1
cccacgcgtccgcccacgcgtccgcccacgcgtccggaaattcaggaggatttgcaggaagttgatgaccgccttgaagaagaggagattgatgctgctgctgagagggaggagtacttgactttagagcaacaggagtacaggcagcaggttgatatgttgaagaaacagctagtagagtcgaaagccgcccgtactgctagagtaaatagaaaacctatcggtatggactcggactccagcagtgactcatcgagcgatgaagaggatgacaacacagattttgctgttgattggagagcacagcatttgaaatgatggaaacattttgcaagtggtatgaactattgtggaaagtcagaacctttagtatccagaattctagctcagttcagtttttttacatgtagaaaacactgtagtttttacatcttttatctcattttgtagtatacaccggagttctgagtcttctgactacctggaccgactggtgaatcccttgactgcttgaacgtggctgttgcttaa

SEQ ID NO: 25119 - DNA, 493 bp, Zea mays
  Clone ID: cC-zmle189034d03a1
ggggcagggattattcaatatatatatttcccacaatctatcaaaaaaacctcacactaaaaaactctaaaatctaacctcgttaaaaacaaaaaattaagcctctaccaaaacacttttcaaaaacaaatctaaaagatcacgaaaaaaacaatctcaaagaccgacttttaaaaaaccctcccgcacaaccactctctcacccacccgtccaaaaactcttgttaccacccaaaaaaaacagaaccgcaccacgagaccaacaaaattcccctaaaggagactaaaaaaaacccgacgtaaaaacagccaaccctactcccccggggcaaaaagtaacccctctaactatccaaaaaccaaaaaatcagaaacatcaccggtaacccccgccctccatgaaggaaaaatacccaataaatgggatcacaaaacctctcccttccaagagaaaaaactttcctctcccttcaaaaaaaaaacttcccccccc

SEQ ID NO: 25120 - DNA, 495 bp, Zea mays
  unsure at all n locations
  Clone ID: cC-zmle189034d03d1
atccgtaggttcgagcgaagaatcatggtaggtctgccatcgatgggaagtcgggaactcataatgcggcgacttctgtcaaaggagaaagttgatgaagggctggacttcaaggagctagcaaccatgacagaaggatatagtggaagtgatctcaagaacctgtgcacgacggcagcgtatcgccctgtgagagagctaatccagaaggaaagaaagaaggagctggagaagctgaagtgtgagaaaggagaaactccgtcggatcctccgaagaaggaaaaggaggagaccatcattctaaggccgctgaacatgacagatctgaaagaagcaaagaaccaggtggctgcaagtttcgctgctgaaggcgccataatgagcgagctgaggcaatggaacgagttgtacggtgaaggcggctccagaaagaagcagcagttgacatacttcctctgagcaatatgaaaatcaggcgcannaatgtatgaacat

SEQ ID NO: 25121 - DNA, 544 bp, Zea mays
  Clone ID: cC-zmle189034d04a1
ttttaactgacctgtattctttttcttcataagcatcatggttcatatacaaccctttcaaaaacaaaatagcgcaaggacttcaacatgctgctggttgccgcattcaacttctcgcggatggtaaactactcccaagatttagctgcccttttcaagcaccccaataatttaagcaactcgatcttctcacacaaaaattcctaggccgacttccttcggatcagtttctaccatccaggaaggcttgttcatcacgaaggtacttgtcccttgagatgcacgctcaagaagcagcttccttgcttctatccgtattccctccggctcttccggaaaccaaactcctggttgtgtgttgccctcaagaactgctaaagcaaatgcagcggttgcaaatcccaccgatacagatagttttttatgagttaataatccaatagtattccgaccatttgagcagtccaaatctactctcatagagacatgctctcctgcataccatcaacggtcgaccaaggaacaacagctgaccaactttgac

SEQ ID NO: 25122 - DNA, 593 bp, Zea mays
  Clone ID: cC-zmle189034d04d1
ggggaggatgtgattgcatataacaagggagaagaaatcaaattgaagccctatagtggagctctgaacattgattttggaaagggggtcagaaagaaaaatgtctacttattgaatttgcctgaagtcaagagtgctttcaagatattaggtgtgccaactgttagtgctcgatttggtactgctcctttcttctggaattggggaatgcaggctttcgcaaactttttacctgttgagttcttgagggatagaaataaagttcagaagttggttcagtctgttgatcctttggttcgagccgttgatggtattgcaggagagcatgtctctatgagagtagatttggactgctcaaatggtcggaatactattggattatttactcataaaaaactatctgtatcggtgggatttgcaaccgctgcatttgctttagcagttcttgagggcaacacacaaccaggagtttggtttccggaagagccggagggaatacggatagaagcaaggaagctgcttcttgagcgtgcatctcaagggacaagtaccttcgtgatgaacaagcccttctggatggtagaaactgatcc

SEQ ID NO: 25123 - DNA, 388 bp, Zea mays
  Clone ID: cC-zmle189034d05a1
accaaaaaggtttattcagggcacgagctttttggcgtaattcgtacaggaggtgtgtgcgtgccccttcgatagcccagtacgatggccctggccaacccggcaaccacagacatacataagggacccaggcaagcacaaacgggcgtggatgcccgcccccgggcgggttaattagccctggggaggaagctctccctgcgcttggggacctccccggggcaggggttgaagtcctttttgaacctgggctcgcgccccaaaaaaccctggccgccgtggggaccatggggggggtggtggttggccccggcccctgaaaaccggtctaccttcttgaactttttcttgacaaaatgcctgtggacaccccccccgggggggccaa

SEQ ID NO: 25124 - DNA, 519 bp, Zea mays
  Clone ID: cC-zmle189034d05d1
cagcaatccacacaagcacttcgacgtcacacgggcgctgcgcacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcagggagagcttcctcgccagggctaactgagccgcccggcggccggcatccacgcccgttcgtgcttgcctgcgtgccttatgtatgtctgtggttgactggttgtgcagggtcatcgtacttggctatcgtacgtgcacgcactcagctcctgtacgaattacgacaataagctcgtgacctgaataaaacttcttcg

SEQ ID NO: 25125 - DNA, 365 bp, Zea mays
  Clone ID: cC-zmle189034d06d1
cccacctgtacatggactggatcgcatgaggtttggaatcttcagcgagtattgaaatatacgggactccagggtggcattacaacgtccaatacacgttgcatatctccacgacgaagcaacatactacgctctattttctggcaaccgatacaggatgtgcggcctggtggcgtcggtaaaccatcactcagtgtggaacgataccatgtggggtcttgtacgaaccttatattatcaagatacctggaacctcggcggagggctctatccgaacacacgcaaagcggcagattgcctcagtaagattccatgaagttgagtaaaaacttattgaccaactgtgctctacttcagtcttaatg

SEQ ID NO: 25126 - DNA, 456 bp, Zea mays
  Clone ID: cC-zmle189034d08a1
tgcttcaaactttcctgtccctctttctctaaagggcagggaaaatttacttacaatatttccaataacctaaacctactttgaacctgaaagtcattccaagtccccttccctttttgctctggatctaccagaaaatcaatcccttcacatattccaaggagatgacagatgacttgctctagctctaccctatatattagctcttagggttgatttagtgataaaaggggatcacggattattggggatattgatgagaaatgaactaatttaaatctcaacctcttccaatccccaagatctaaggactaatttggtgtaccaaggattcgcgagaagttccatgtcaaatgattcccattgcttttcactgataccctttcgatctttggtcattaaaccggccctaaaatctatttttgcggctacaacttactgtggcgaacaacaaaa

SEQ ID NO: 25127 - DNA, 458 bp, Zea mays
  Clone ID: cC-zmle189034d11a1
aacaggaaatcgctgtcaccactcaccacggcctggggcagtggtgagctggttgattcaattcaagagtcacacgcgaacagaaacgaactcacaacaagtatccatggttaagtatcgcctccggctcggatagaaacaaacatactacttgttcacaatcgcccacaaacgacaaagccagaactgataacgacaacatttacagccatacgtgctggcccttattgacggcgacgactgatctgatctcctttaggcagacccagacgcaggcgcaggcgcagcatgcttctcgatctgggccaggagcttgtccttcctggcacccacgatggtcgcgaccgtcttgccgttcttgaccaagtggaagggcggcatcgcctcgacctcgtaggccggggtgactttcttcacttcggccacgtccacctttaggaacacgacctgagtgaact

SEQ ID NO: 25128 - DNA, 421 bp, Zea mays
  Clone ID: cC-zmle189034d12a1
ccccaaaaaaccaaagggggcccaaaaaaaacccgccccccggggggaaacccccccccccccccaaaagcggggaccccccccagccagctaaacattttccccccccgcaggcccccccttgccccttcccccctttttgccgcccccgaacccaaacccccccaaaggggttcccccccgggattttagcccccccctttttggaaaccccattttcccccctgccccaagtccccccccttggggcggggcccgcggcccccggaaaacccccggaaccccccccccccttggtgggaaccttggaccccccgcatattttggagaaacccccccccccccaattttcgcccccccagttcttggagacccccaaagggctggccccccggccaaggggggccaaaccccaaccccc

SEQ ID NO: 25129 - DNA, 410 bp, Zea mays
  Clone ID: cC-zmle189034e01a1
atgggatgggttattttctactttttttttatggtattacaaactttcctattttttacaatactattttggaaaaaaaaaaaaaccccccccttctttttttggggaacctcaccaccccctttgtgcaaaaaaaattgggggaaattataaaaccccccccaacagggggacaaataaaattcccgcaaaaatttgccccccctaaaggggaaaaatttttaacacccgggagacgggggaaaaaaaaaaaaaagggggaaggggccgtttcaaattttttaaaaaaaacaagcccccccggggggggaaacatttaaaacctttctctgggggggggggaggaaaaaattctccccctcactaaaaaatcttgcgccacaaccctggggggaaaaaaaccccggggg

SEQ ID NO: 25130 - DNA, 590 bp, Zea mays
  unsure at all n locations
  Clone ID: cC-zmle189034e01d1
cgggtcgactccacgcgtccgcccacgcgtccggtgatttccacaatctgcgaactgaatctctcaagcagcaatacaacttggtcaaggataggacagcggttcaggatacattcagctatggctcccatgtgatgcaatatggttcattggagttgaatgttaagcatctgttttcgtacattggcacaaaccctgctaacgatgacaacacgtttatagaagacaactcgttgccatcgttctcaaaggctgttaatcagcgcgacgctgaccttgtctacttctggcagaagtaccggaaattggcagacagctcacctgagaaaaatgaagctcggaaggagttgcttgaagtgatggcccacaggtctcatgttgacagcagtgttgagctcattggaagccttctctttggctctgaggacggtccaagnggttctgaaagccgtccgtgcagctggtgagcctctggtcgatgattggagctgtctcaagtccacggttcgtacttttgaggcgcaatgtgngtcgttggcgcagtatgggatgaagcacatgcggtccttcgcaaacatctgcaacgctgg

SEQ ID NO: 25131 - DNA, 247 bp, Zea mays
  Clone ID: cC-zmle189034e02a1
atattcttcccttccggggtgggtcgtctttattcatcattttaacctattttctctcttacttcataaattaattttaaaacaaaagcgggtccacccaaaaaaattccacgcacccccgcctccgggattcttcaacacctttctcacaccgatacaaattacagcttgcccaaaatcagaacacatcttttgcccagcgtaatattcccccccctaagactccccaccctatacattcccacaa

SEQ ID NO: 25132 - DNA, 505 bp, Zea mays
  Clone ID: cC-zmle189034e02d1
caagagtagtagtcggagccgtccgtagtagctagcgtacgtacgtgtgagtttgtgaccaattcagagaagcctcgatcatcgttcgcttcgcttcgcttgtgtgtcgatatatatggcgagatcgccgtttgttccgatggatcaggggaaagagcaaggcgccggacgaggagcggccggcaataataaggagcggcaggaggaggaggtgctgctggtgcacagccaggtgcggcggatcaagaaggaggacgaggaggccttcagggagcgcctcctgaagctgcgcctgctggagacccggcccaacaccggcgccggcggcgtggcctggcgagccccgcgctccctgtcgccgctccgccgtgccggcagcgccatcatcccggtcccggtgagcgagtgactagtagcgagcatccgtcgacccgcggttctctcggatggccgcgcgcccgcccgcggttgtagatatcgctaggcgcgtacgtagcgagcgtga

SEQ ID NO: 25133 - DNA, 316 bp, Zea mays
  Clone ID: cC-zmle189034e03a1
ttttggaacaaatgggtatctgattccatactaatctgcaatccatcatttacaataagcttatgatacaaaaccactaattcaccaatgatctctgataatgagaaccaagtgtgtatgaactgtagtgtactgacagctaataaggatacaagttctactcttccacaggaataggaagacctataggtacgggattgtattggtatgtatacgatgactatgcttttttctcgccctcgtactgtccagaggagcagccacaaaatcaaacaatagcgctactggcaccatacgaaatgaatgaacgaatagt

SEQ ID NO: 25134 - DNA, 437 bp, Zea mays
  Clone ID: cC-zmle189034e04a1
cacttctctctttttctttctttttcttcttccttttttttttttttaaaaacccccccccgcaaaaatgaaaaccccccccccccaaaaagttcccccccaaaacaaaatttccccaaccacaaaagccccctcccccaatattccccccccccccccccaaaatatttaaggggccccaaatccccacccccgcccgtgtgtttaaaaaaagggaaccccaataatcccccgccccccccgtttcacccccccgaagggccccccctgaacaaattccccctttcccccccccccgtgtgaccccccccccccccccgcttccccaaaaaaggaaccccccccgggaaacccaaaaatccccccctctctggaaagaccccccctcggaccccccccaaaaaaggggccaatatgtgcccccccccccccccccc

SEQ ID NO: 25135 - DNA, 583 bp, Zea mays
  Clone ID: cC-zmle189034e04d1
tccggaatttccggggttcaaggggatcgtccacaacggcatcaagatcggtgcgtccctctccatcgcgcagcacatcccgtggctacgctggctggccccggtcgacgagcaggccttcaaagcccacggcgaacggcgcgaccgcctcaccgtgaagatcatggaggagcacgccagggccctcaagcagcgcggcgcccagcagcacttcgtcgacgcgctcttcactctcagggacaagtacgacctcagcgatgacaccgtcataggcctcctctgggacatgatcaccgccggcacggacacgacggtgatctcggtggagtgggcgatggcggagctgctgaggaaccccagagtgcaggagaagctgcaggaggagctggaccgtgtcgtcggccgcgaccgggtcctgtcggagacggacttcccgaacctggccttacctgcaggccgtcgtcaaggagtccctgcgcctgcacccgccgacgccgctgatgctcccccacagggccagcgccagcgtcaagatcgccggctacgacatccccagggcgccaacgtcgtcgtcacgtgtggg

SEQ ID NO: 25136 - DNA, 429 bp, Zea mays
  Clone ID: cC-zmle189034e05a1
agatccaaacaattcaaaaccacaatatcgatacactgctcattgcggcagacaaagctgaccacctagagctgtttattgcaaatataagcatgtgacacattacaatagcacaggtttatgtggcataaataattaggcttggctgcttcacaagataaccagtggcagcaactctgaatctgatctatcgtcgaccacatcagcatttcatcttctttacatctctttcctcgctctcatccacagcatcagcttcccagggagcatcactctctgagcgattcttgacaatgtcaccagcgaagtcatgcaggactgacctcggcgacccatgggtcgtttcggccgtaacagtgaagctctgatagatgagcaagccaccaaacggtagcacctgcttaacccacgcgttcgcggacgcgtggg

SEQ ID NO: 25137 - DNA, 429 bp, Zea mays
  Clone ID: cC-zmle189034e05d1
cccacgcgtccgcggacgcgtgggttgagcaggtgctgccgtttggtggcttgctcatctatcagagcttcactgttacggccgaaacgacccatgggtcgccgaggtcagtcctgcatgacttcgctggtgacattgtcaagaatcgctcagagagtgatgctccctgggaagctgatgctgtggatgagagcgaggaaagagatgtaaagaagatgaaatgctgatgtggtcgacgatagatcagattcagagttgctgccactggttatcttgtgaagcagccaagcctaattatttatgccacataaacctgtgctattgtaatgtgtcacatgcttatatttgcaataaacagctctaggtggtcagctttgtctgccgcaatgagcagtgtatcgatattgtggttttgaattgtttggatct

SEQ ID NO: 25138 - DNA, 162 bp, Zea mays
  Clone ID: cC-zmle189034e08a1
aaatatataggggagagggttatttacaatctcatattccttacttatccaaaattcttctccatcctcactttacaacatttcaattacacacaacaccactatatcttcaacacacctactactttaaaataatcaatccttaaaaaaaaaaaattaatc

SEQ ID NO: 25139 - DNA, 240 bp, Zea mays
  Clone ID: cC-zmle189034e11a1
ctggccgtcgcggtcagccttggtcgcagccttcttcttgatggacgtggaggagggctacgccgacgcccgcacggccgtcgtcgtcatcctcgccgccctcggctgcaggggccggagcgacgacacgccgagcggcttcctgagcccgggcaccgacagcggcgccccgacggctgatagagacgcggtggcggccatggcgacacggtaacgcccacgcgttcgcccacgcgtccg

SEQ ID NO: 25140 - DNA, 487 bp, Zea mays
  Clone ID: cC-zmle189034e12a1
ttttatcgacccaattcacacaaatacattagctttctgttagcaattatatcacttaaaatatccaacatcgttgcataggtggcaacaagcactgtcgcatgaaaagtccttgaaaagcatgttcacactcacaacccatttctactgatagagaagagacaacatactacctaagctctatgatactgccaaacagtagtgtttttggagcatgatgtgctcgcttaacttgtctcggtcttctctagggtgttgtagttgagcaacttctcaatgaggtcaacatgtgtcatgagcattcgcctgcagcagtagcggaacaattccaaagcatccagagcatccccttctgagtagtcggcctggaggaggtcgaggtatagatcccacttgttcccaataaccttgccgcaggtgaagcagcgcactgggataatcatcttcaccgccgccgcggactcccgctggagcacggagctaggga

SEQ ID NO: 25141 - DNA, 337 bp, Zea mays
  Clone ID: cC-zmle189034f01a1
aaaacaagtccatccaatgggctgggatattaattaattattacaaaacagcatgcagattgtacgatgtttattattacaatatgtataatatgccaagattttccacttggacttgacaacaagagtgaatataaagaggcaggaaattacatatgcatagggaaaacagacgctgccagtttggcttttccattcaaaactgacaaaacgccaccatccggaagctgattattggggggcactctgcaggtgagtgaaaaaaaaccccctatccagtgttctgcatgccggcggctatgccctttatggtgaggatgagcgtgttttccaggcc

SEQ ID NO: 25142 - DNA, 522 bp, Zea mays
  Clone ID: cC-zmle189034f01d1
cggacgcgtgggcggacgcgtgggcggacgcgtgggcggacgcgtgggcccagaccgacgagatcgccgacgtcatcggcgcgttccacgtcctcgcggagctcccgcccgacagcttcggcccctacatcatctgcatggcgacggccccctcggacgtgctcgccgtggagctcctgcagcgcgagtgcggcgtgcgccagccgctgcccgtggtgccgctgttcgagaggctggccgacctgcagtcggcgcccgcgtccgtggagcgcctcttctcggtggactggtacatggaccggatcaagggcaagcagcaggtcatggtcggctactccgactccggcaaggacgccggccgcctgtccgcggcgtggcagctgtacagggcgcaagaggagatggcgcatgtggccaagcgctaccgcgtcaagctcaccttgttccacggccgcggaggcaccgtgggcaggggtgggcgggcccacgcaccttgccatcctgtcccagccgccggacacc

SEQ ID NO: 25143 - DNA, 514 bp, Zea mays
  Clone ID: cC-zmle189034f02d1
cggacgcgtgggcggacgcgtgggttttttttttgagggtcaccggataaaaccaacaacgtaaatggaaaaaggcattgtttattacaggcctagaaatactaccacgcacgctccaacaaatggcaggcatccttccgctccctccatcatcattattccaagctccgagacataggactgtcctcgaggtacagtgttcctttggcatcaacgacgacagaaaaaaaactcagaccgttgttagctcttaaaagctcttggcagctgcaatgatgctctccacggtgatgccgtactccttgtagatcgtcccggcaggagcactcgcgccgaacttgtcgatgccaatggccttgccctgggctccgacgtacttctgccagccaagagtggacccagcctcaatgctgatcctcgctgtgacggcagcagggaggacgctctccttgtactcatccgactgctcatcaaagagttcccaggagacgaacgagacgacgcggaccgtctt

SEQ ID NO: 25144 - DNA, 509 bp, Zea mays
  Clone ID: cC-zmle189034f03d1
ctatatcatatctaaatagaagggaaatcaaaaagaagggaagtggggattacattggatgaatccttaaggaagacatatcacaaaagaaataaaggctaaagtaagcgctccttgcctttggtttgagcaaaacagattcttgtttcaccgaggaaaagagagaagttctggataaattgacaatgtcaacttgaattgactaattcagttccgcctattccacattaatgggagtacatttatgtttctgctttacgaatatgatattttttggacatttctaataatagcaagccttattcctattttggtattttggatttcaggacttttagccccggttagtgaaggaccagagaagctttctagttatgaatcgggtatagaacccatggggggggcttgggttacaattccgaatacgctattacatgtttgcgctagtttttgttgtttttgatgtggaaacagtctttctctacccttgggcaattgagttcgacgta

SEQ ID NO: 25145 - DNA, 417 bp, Zea mays
  unsure at all n locations
  Clone ID: cC-zmle189034f04a1
aaccagcaggaaacaagaaaccaccactattgcacaaacatggttcatcttagtgtacaacgccaacttatcatctcgacttgcctatgcaatgcaacgtgaaacaaaagacacacatgcatttcgcagcatcaatcaatccacgtacgtacaccctttccgatccgaaagacaatgaagttgcatagcatagccgttgagcttagttgccggggaccaagttggtggcgtaggcccatgcgttgttgttgactgggtcaacgatgtggtcagcgaggttctcgagcgggcccttgccggtgacgatggcctggacgaaaaagccgaacatggaaaacatggcgaggcggccgttcttgagctccttcaccttgagctcggcgaaggcctcggngtcttcggccaggccgagggggt

SEQ ID NO: 25146 - DNA, 569 bp, Zea mays
  unsure at all n locations
  Clone ID: cC-zmle189034f04d1
cccacgcgtccgcggacgcgtgggctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggagggtgatccactcccgctgggccatgctcggcgcgctcggctgcgtcttccccgagctgctctcccgcacggcgtcaagttcggcgaggccgtctggttcaaggccggctcccagatcttcagcgagggcgggctggactacctcggcaaccccagcctgatccacgcgcagagcatnctcgccatctgggcctgccaggtcgtgctcatgggtgccgtc

SEQ ID NO: 25147 - DNA, 427 bp, Zea mays
  Clone ID: cC-zmle189034f05a1
ctgccgggcgccttttgttttctaccttctcggggagtctacccgtgcaagggcaatgttggggacgacctcaacgtgatggtgaactccctcacatacatcgacaccgagatgcccttcatttactacagcctccccttgggcgagccacaagacggtgtcaaggacagcgccgagaacctctgcgagctccttatgggcgaccgcatcgagaactcgccctaccggttccgaatgtacaccaacgagtcacacgtgttgctctgacgttccccagcggggggcgcctaccccttctctgtgcacaagaagcgcatagacgagatgtaccacgtcaacctgatgctagacaacctaaacgccatgcgctacaccaggaaagacgacttcattatgccgctggaccgcgtaccccgtaaggatccgc

SEQ ID NO: 25148 - DNA, 456 bp, Zea mays
  Clone ID: cC-zmle189034f05d1
cccacgcgtccgagcaatccacacaagcacttcgacgtcgcacgggcgctgcacacagacacaccaagcgtcggcaccaatggcttactaccaggaggtggactactgctcggaggaggtgaggtcggtggccccggccggcttcggccgacacggaggcggcgtccagcagcacgtcgtaaaggagaagatcgaggaggtcgacacggtcttacgcgccggcgccaaccaccaccaccaccaccatggtcaccacggcgggcacggattcgtggtgcgcgagaccagggtcggggaggacatcaacacctgcaccggcgaggtccacgagcgcagggagagcttcctcgccagggctaactgagctcgccggcggacggcatacacgcccgttcgtgcctgcctgcgtgccttatgtatgtctgcggctgactgggtgtgcagggtcatcggact

SEQ ID NO: 25149 - DNA, 415 bp, Zea mays
  Clone ID: cC-zmle189034f06a1
aaccagcaggaaacaaaggccaccactattgcacaaacatggttcatcttagtgtacaacgccaactcatcatttcgacttgcctatgcaatgcaacgtgaaacaaaagacacacatgcatcttgcagcatcaatcaatccacgtacgtacaccctctccgatccgaaagacaatgaagttgcatagcatagccgttgagcttagttgccggggaccaagttggtggcgtaggcccatgcgttgttgttgactgggtcagcgatgtggtcagcgaggtttttgagcgggcccttgccggtgacgatggcccggacgaaaaagccgaacatggaaaacatggcgaggcggccgttcttgagctccttcaccttgagctcggcgaaggccttgggggtcgtcggccaagccgagggg

SEQ ID NO: 25150 - DNA, 367 bp, Zea mays
  Clone ID: cC-zmle189034f07a1
gcccctgtcccttgcgtttcgtttcacgacgctgagcctcatgcccggggcggacgttggcgccgagcaggagccggccgtcgcgagggggcaagaaacagactggtcccttcttcacggtggcgccgctcaccattttctacggtggcagggtggacaagatcgaccacttccctgttgagaacgcatccgttgtcatgcgcctcgcagctggcgccgagcgccctgctgtctcggcccccggcgactgcgccggctccgcgctacgacctgcccattgcccggaaggtttcgttgaaaaggtttctggccaagcgcaaggaccgtcttgtggagcgcgccccctacatccgtccgtttcccatcc

SEQ ID NO: 25151 - DNA, 383 bp, Zea mays
  Clone ID: cC-zmle189034f10a1
aaaatatccaaacctctacctgaaaccaaacctacaaaccccaaccagaatacacaccaaaaacccacaaacacaaatataaaaaataacccctctcaaaaataaaaaacccaaaaaaacccacaaaaaaaacctcccccaaccataaacaaaaaaaacaaacccccccaaaaaaaaaacaaaccaaaaataaccgccaaacacaaaaccccaaactcacagaaaaaaaatcgggccccccccacacaaaaaaaaaccaccacccccccccgcaaaaaacaaaaaaaaaaccccccccccaagggtaaaaataatatcccaaaaccccgggaaaaaattttttttccccttatacccacccccagtaaaaaaatataaaacac

SEQ ID NO: 25152 - DNA, 500 bp, Zea mays
  Clone ID: cC-zmle189034f12a1
ataatcaattcaattacaacaagtcatctatcaaacagttcataaacaagctagttgatgtgattattaccacatttttgctgaaatattttatggaaaaccccaccgatgagaataataaaacgggccgcagtatcagaaacacatgctaatgtaaaaaaaaatcaatacttttaggttaagagaattggccaggtgcacgtgaatgtaatcttttcctttcaaagtcaatcactttcttaacgcgttcgtttgctgcagctgttcctccactaacattttcaggcaggtacgggctgcgtacacgaacctccttcattacaacaatgtcagtcttgtcccactgcaccggaagcgtcttggacagcgcatcgaatatattttgagcttctggggtgacaccaacaccaattttctcagcttcaatctctgcttgcctgagtgcagcatcctcccgggcataaatggagttaaggtccaacatgcaaccggcaggatcg

SEQ ID NO: 25153 - DNA, 461 bp, Zea mays
  Clone ID: cC-zmle189034g01a1
ttttgcttggtgatgtaggtattagtattacgaagaagttttattcaggtcacgagcttattgtcgtaattcgtacaggagctgagtgcgtgcacgtacgatagccaagtacgatgaccctgcacaaccagtcaaccacagacatacataaggcacgcaggcaagcacgaacgggcgtggatgccggccgccgggcggctcagttagccctggcgaggaagctctccctgcgctcgtggacctcgccggtgcaggtgttgatgtcctcttcgaccctggtctcgcgcaccacgaagccgtggccgtcgtggtgaccatggtggtggtggtggttggcgccggcgcgtgagaccgtgtcgaccttctcgaattttccttgaccacgtgctgttggacgcccccgtcgtggcggtcgaagcctgtccgggccaccgaccttaccttcttcgagcagtagtcca

SEQ ID NO: 25154 - DNA, 526 bp, Zea mays
  Clone ID: cC-zmle189034g02a1
gcagcggaaataaattctttattacaaaatgattacaagttacatcaggattttattatacatcatcggagtgattacaaaagaaaatgattcaaaaagaatacaatttgaatgtataaaacatttataagttttaaaatatatgctagcttaagtgacaatcctcaataaagaagttaaagatgggatatacttatataagaaggccgagcccaccggcacttagcagcattcacaacagaacaaaattataacctgggataaacactatgttagtgttgttaattgacgaccacttggtaagtatcttccatcctgacacttggttgattcatccattttagcttcgtccatcaacatcacttggagatcaattccactcgtcttccatagcacgtgatcaattaacgtacctaaatgatatgcataatgcatatgtatgaacataagaacctgtacaatattatttgaagttttatggtttaggattaaacatttttaccaagcattataagcaagcataagt

SEQ ID NO: 25155 - DNA, 489 bp, Zea mays
  Clone ID: cC-zmle189034g02d1
ggctgagatcgcctcggacgtggacctgcccgttgacaagttcaccggcctcgccgagatgatcccggaacgcgccaggttcaacgacgacggcatgtaccgttccatcgacatctacttgaaggcgcatccgtatctgagcgaggccgagcggaaggcggtgtgccgggtgatggactgccagaagctgtcgcgcgaggcgtgcgcgcacgcggcgcagaacaatcggctgccagtgcagacagtggtgcaggttctccaccacgagcagcggcgcctgcgcgaggcccctacgtcgtcgttctacggcggcgagtccccgaccccggcgccgagcctccagggccggcacggccggagcgtgccggacgagatgtcacagctgcagcgggagaacgaggagctcaagatggagctgctgcggctgaagatgaacctgagggacccgtcggcgccctcgcagcccagcgacgctccaccatcggggcg

SEQ ID NO: 25156 - DNA, 434 bp, Zea mays
  Clone ID: cC-zmle189034g03a1
tttttgttgccaacaatcctatatttgcataatcaaatcataattccagtataaatctgtgacatcataatttattgcgtcaaatcaaaagacaatctgaaaagagggcaaaattccctaacaagatatcttgtgctcttgctgtactctacttggaacttggttaaataagtgagatggaactggaggtaatctcccatgcgatacatgaaactacagcatgggttgtaggtatcaatcatctaatgcctaaccttcacactcaatgatcttgacaacagaagaatcaccaatcttttcaaagattatcaacctgtcgaaaggcttcactatgccaaccgaccgaccatagctcatcgcaagttttatcccatactcttcctttgttagcccaccagtttcggcctcatcagtactccccatcaaagggtaca

SEQ ID NO: 25157 - DNA, 564 bp, Zea mays
  unsure at all n locations
  Clone ID: cC-zmle189034g03d1
cccacgcgtccgccaagctatagtcccacctcaccgtcttacactcctggctctcccacctacagtccaacaagcccgaattactccccaaccagcccgacgtactcgcctaccagcccatcgtactcacccacatctccgagctacagcccaacatcaccaagctacagccctacatcaccaagctacagccctacatctcctagctatagtcctacatcaccaagctacagccccacctcaccagtttatagcccaacctcaccagcatacagccccacatcacccgcttacagccccacatcgccatcctacagtccaacttcaccatcttatagccctacatcaccttcatacagccctacgtccccttcatacagccctacctgcccctcatacagccctacctctccctcctacagcccgacatcacctgcttacagcccgacatcaccaggatacagcccaacgtcaccgagctacagccctacatctncgagctacagtcctacatctccgagctacaatccttcatcagccaagtacagcccttcacatgcatac

SEQ ID NO: 25158 - DNA, 350 bp, Zea mays
  Clone ID: cC-zmle189034g04a1
ggaaccataatttgccacaaccagaagccataactttggcgttctgatggattcgcgttacacaggccacaagttttttcagtcatgtagtttgggtgcagccgaaaccaacgtcactgcagttgcttatttgggtgtaaggtggaggaagcaaagaagggtaaaacaaacatctctcagcaggagatggactctccagctcgtcatgcctaactgggaaaagcataaataaacgcttaaaatccaaaaatggaacttgtacagggttgaacaagcaagaagcctccttatgaagcagactccttggcaattttctcagccttagcaatgactttctccggacgcgtggg

SEQ ID NO: 25159 - DNA, 350 bp, Zea mays
  Clone ID: cC-zmle189034g04d1
cccacgcgtccggaggaagtcattgctaaggctgagaaaattgccaaggagtctgcttcataaggaggcttcttgcttgttcaaccctgtacaagttccatttttggattttaagcgtttatttatgcttttcccagttaggcatgacgagctggagagtccatctcctgctgagagatgtttgttttacccttctttgcttcctccaccttacacccaaataagcaactgcagtgacgttggtttcggctgcacccaaactacatgactgaagaaacttgtggcctgtgtaacgcgaatccatcagaacgccaaagttatggcttctggttgtggcaaattatggttca

SEQ ID NO: 25160 - DNA, 194 bp, Zea mays
  Clone ID: cC-zmle189034g05a1
aatctaattaaacccaggagggggcaaaatttttccctttgtgacagaccttccgatttcacaaagatcttgcatctcagcgggtatcaaaaggaagggcctggtaaattccataacttcacaacaacaatctccgtgggggtcataaacccccttacaaccattggcctatagttgcacgtccccatatatgt

SEQ ID NO: 25161 - DNA, 533 bp, Zea mays
  Clone ID: cC-zmle189034g05d1
gccgcacgaggactacacgttcagcggacttgcgtggctgttctcgggaggcccgacgagcgacagcctgctgtacaaggaggagctggagaagatgaaggagatggcgccggacaacttccggctggacttcgcggtgagccgggagcagacgaacgcggcgggggagaagatgtacatacagacacgcatggccgagtacagggaggagctgcgggagctgctgaacaaggacaacacctacgtctacatgtgcgggctcacgggcatggagaagggcatcgacgacatcatgctcaaccttgcagtcaaggacgggatcgactggatgcaggacaagatgcagctcaagaagggcgagcattggaacgtcgaggcctactgatccatacttacggtgacgactgccgagatcaactaaagtcgcggttcggggccgtgcgcgagtctgttagactcaggtctctatctgccgacgtacatataccttacgatgatgacagacgctctctatgtatcaatgcacctacata

SEQ ID NO: 25162 - DNA, 478 bp, Zea mays
  Clone ID: cC-zmle189034g06a1
ttttgatttaattcatgttggcatgctgcactatacaagggccaattattctgcagttgcactacttgtccaaattaaccaaactttgatcggatacatgacaagcacacgcacacggctgtctgtagagtacatccccgacgaccgctcaaaagaagttggggtcgtatccgttgctggaggtggcgaggatgtagtaggcgacgatgtggccgagcgagccccaggcgaggacgtcgacgaggttgaagcccacggggtcgttggacttgagcagggccgcgaactccttggcgcgctcgtcgccggcgataaagtgcgttttgccgttctgcgcgggcacctgcttcgccacgttcttcccgctggaagttgaagaagaccaagcggcccatgaagagcgacacgcccgtgctcatgctgatcaccagcgccgagcttagttccgcgcgcgcccgcactgaccgtcgcgccgggg

SEQ ID NO: 25163 - DNA, 544 bp, Zea mays
  Clone ID: cC-zmle189034g07a1
tttttaaacccagaaatggaaagctgcattaatatttgggaccttgataaaacctttccatcgctttaaccagaacattacatacaagaaacgaatgcagctgataccagaagcgcgacagcatgtttcgttcatatatatattatattccaatgtttgttggaacctaacaataattgctgcccgactttcctcaaactgtaagctgcaatcagttgtggggcgcatcatcttggtgctctccgcagcacagcaattttgtggcgcggcatcttcacttcttcaggcaccagcgaagaagacacgtgctcatcaacatgtatacgtcatcatacaatgaatccggcaccaaattgcttgtcagcttccagaaaacccatccaaaatcatatatataaacctatccgtcaagcttaggcctcttgtagtcttttccatcctgctcagggcttcctacaggttgaggatgatcacagctcttttggtgtttcaatgtgtcatcaagctgctgtgacttgtgctcaaaaacatcattttgcttatg

SEQ ID NO: 25164 - DNA, 407 bp, Zea mays
  Clone ID: cC-zmle189034g09a1
ttttaacttctaatgatgacaacacatgaattgtactagaaagaaacgcaacaattccagactccaagaacaacagcacgactcgtttccaggctctaagttctatcgacttccaccgattttttgtctccagaaacagatacccatgcatggcaagactgcaggaccagcaggtgaaaacaattgaatcatagccaactcctgacaaggataaacataatgatgataccgcgaccagctgtagatcttagcagaagcccagattcgggaccaagaaaatgatatgtgcctagccctgtaacccatctggctggcttctccgacgatatcatttgtcaatttgcccaccttaatataccttggatatacaactcaatcctgtacaatgttctcacgacccccacatg

SEQ ID NO: 25165 - DNA, 337 bp, Zea mays
  Clone ID: cC-zmle189034g10a1
aacaggaaatcagtgtcaccactcaccacggcctggtgcagtggtgagctggttgattcaattcaagagtcacacgcgaacagaaacgaactcacaacaagtatccatggttaagtatcgcctccggctcggatagaaacaaacatactactagttcacaatcgcccacaaacgacaaagccagaactgataacgacaacatttacagccatacgtgctggcccttattgacggggaccaccgatctgatctcctttaggcaaacccaaacccaggcgcaggcgcaacatgcttttcgatctgggccaggagctcttcctttctggcacccacgatg

SEQ ID NO: 25166 - DNA, 504 bp, Zea mays
  unsure at all n locations
  Clone ID: cC-zmle189034g11a1
ttttggttaccaatatcacattaaaatctggaaatgtagcttcttatttctggttggccacatacatcatccaaaaaactttattattgaattacaactaataagcaatctaaaagagggcaccaccaatgatgtgttgttggtaggaggccgctgggtctgtcaaagcaagttggacaaagggcaacaattgttgtagttgtaagagggttgcggggttagccgcaaactgctggtagaaaggcaccaactgttgctgtgtcaagaaggaagcacggtttgctgcagctagctggctaaatggtagtagtatttgctgctgcaaataagcagcggggttcagtgcggccaattggttaaatggaagaagttgttattatgtgttgagttttaggggttgttcatgtgaaattgtagtatgacactctttcgcccagtgaatttgcataattcatgacntctcccaaatacagggactttaacttttccagggcaggaagtttt

SEQ ID NO: 25167 - DNA, 418 bp, Zea mays
  Clone ID: cC-zmle189034g12a1
aaaaccaaaattaaattttttttttttagagggtaacgttcctataaattctttccaggggaaaaaaaacatttccccaatttttcccccccctggttttaatgggtccaacccccccaaaaaagcaaaaaaaattttttttggggggggaattccccccccccaagcctaagaaaaaaaaaaggggccatggttttgttaaaaaacaaattggttcagaaaaacaaaaataaaacgggccaaaaatttaaaaatcattgggtgggggggggccaaaatttttttttaaaaaggcaaacttggaaaaaatttgggggtttcttttaaggggggagggaaaaaactttttgccggggaaaactttgggtgtattgccccccttgtcccccaaaatttttttaaaccccaacggggcccc

SEQ ID NO: 25168 - DNA, 388 bp, Zea mays
  Clone ID: cC-zmle189034h01a1
ttttgaataaagtataacgtagcttcttatttatgttgaagtgcgatagctacacatctttactcacgacttggccattcaatcaatcaatcaacgagtgtttttttacgttcattgagtgaaatagccgtcaagaagattcaagatgaaagaagccggctatgagcatgagccaattccaattactagccgatggagtgcctccgatccttggtcctggacggcttggtgcgcactttggcgccacccacggtgtcaggccgcaggaacgggttcagccgcccgagctttttggacacgttgttaatgaaccccccgctgccgcctgccgtcttttttggcagcgggcggcgccccgatggtggagcgtctctgggcttgcggggcg

SEQ ID NO: 25169 - DNA, 558 bp, Zea mays
  Clone ID: cC-zmle189034h01d1
ccggaatccccgggtcgactccacgcgtccgggctgagatcgcctcggacgtggacctgcccgttgacaagttcaccggcctcgccgagatgatcccggaacgcgccaggttcaacgacgacggcatgtaccgttccatcgacatctacttgaaggcgcatccgtatctgagcgaggccgagcggaaggcggtgtgccgggtgatggactgccagaagctgtcgcgcgaggcgtgcgcgcacgcggcgcagaacaatcggctgccagtgcagacagtggtgcaggttctccaccacgagcagcggcgcctgcgcgaggcccctacgtcgtcgttctacggcggcgagtgcccgaccccggcgccgagcctccagggccggcacggtcggagcgtgccggacgagatgtcacagctgcagcgggagaacgaggagctcaagatggagctgctgcggctgaagatgaacctgagggacccgtcggcgcccccgcagtccatcgacgctccaccatcggggcgccgcccgctgccgaagaagcggcaggcggcagcggggg

SEQ ID NO: 25170 - DNA, 226 bp, Zea mays
  Clone ID: cC-zmle189034h02a1
cgggttgggtttaaacacattgccagaacgattgatacatccttccaaattactaccggcccctgcgggcggggcggctcttctcctatactagatcgagtaaaaaattgcgataaacaaggaaaagtatatcgccggggagaatttgattcttatccacatacaatctccaaaaaaaaagccgtaaagaaaaaggtaaaagactggcgtcgctacaaagggacca

SEQ ID NO: 25171 - DNA, 570 bp, Zea mays
  Clone ID: cC-zmle189034h02d1
agcgactcagcgagcgagagcagcacacactgcacgcagctagctaggagcagcagcagcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccctctccggctaaggatatccaatgcatgcgcttcttgcgattcgtcatgtaaaatcagggtgtctgtctataatctagcctccatggatgctcaaccttcgtcatgtaacaataatcagggctactct

SEQ ID NO: 25172 - DNA, 470 bp, Zea mays
  Clone ID: cC-zmle189034h03a1
ttttccaatcatcttttttccttatatattattccttgccatttcaatggttcattcaggtcattgctcacactgccacccatggtgatgggtgacactacgttactcatcgccgctaaatgagtaaactagcgagctaggtagctagccagcggctccattacattattactacagtacatagtttcctcagtagtagacaccgccggcagctgcgttgcaagggcagggacctggctgctgcagctgcaggccgcacatcgccgtcagctgctgcgctacctgggccgccatcagcgccgcgagctcgccctgcggctgctgctgcaggaaggactgcaagaccacaccgtatgtcgcctggtaccggtgcagcggctccacctgcctgatctggtggcagcactgctgctgcagcgcctggcactgtggcgagccgtatggcgtccacgccgggctgcactggtgcc

SEQ ID NO: 25173 - DNA, 511 bp, Zea mays
  Clone ID: cC-zmle189034h03d1
gaaggagcatcccaagttcaagagaaagggcgatgacctcttctacgagcacaccctgaccttgactgaatctctgtgtggcttccagtttgttgtgactcacttggataacaggcagctgctgatcaaatcaaatccgggcgaagttgtgaagcctgattctttcaaggcgatcaacgacgaaggcatgcccatgtaccagaggccgttcatgaagggcaagctgtacatccacttctcggtggagttcccagactcgctaagcccggagcagtgcaaggccctggaggctgtgctcccgcccaagccggtgtcgcagtacaccgacatggagctggacgagtgcgaggagacgatgccctatgacgtgaacatcgaagcggagatgcggaggcggcagcagcagcaccaggaggcctacgacgaggatgaggacatgccgggcggcgcgcagagggtgcagtgcgcccagcagtaggcagcagcttggtagcagtgataaaagtattga

SEQ ID NO: 25174 - DNA, 399 bp, Zea mays
  Clone ID: cC-zmle189034h04a1
agcaatgataatattttggttgggacaatgtaaacggatggtaaaacagcatggtgaacttcccaccaaacacccatttgtctgcaatcactgggaaacagatgttttttatttttaaatcaagcaggcaactactcagatacccttctccagcatcgcccggacccgtgtcggtaggccgtacagcctgatgaacccctcggcgtcagcttggttgaagatctccccgttcttaaacgaggagatattttccctgtacaggctgtaggggctctttcgggacgcgacgttcacggaacccttgttcagctttagggtcactgaaccagtggtcgtcgtggtaacctttttcatgagggattaaaggactgccggagcgggtcaaaccagcgggcagca

SEQ ID NO: 25175 - DNA, 472 bp, Zea mays
  unsure at all n locations
  Clone ID: cC-zmle189034h04d1
gtccctgaccctggacagggagaccatgcagtggaaggacatcattgccctcaagtacgccgagctggtctatgctggccgctggtttgacccgctccggcagtcctttgatgccttcatggagaaggttaccgcgacgaccactggttcagtgaccctgaagctgtacaagggttccgtgaacgtcgcgtcccggaagagcccctacagcctgtacagggaagatatctcctcgtttgagaacggggagatctacaaccaagctgacgccgaggggttcatcaggctgtacggcctaccgacacgggtccgggcgatgctggagaagggtatctgagtagttgcctgcttgatttagaaataaaaacatctgtttcccagtgattgcagacagatgggtgtttgggnngggagttcaccatgctgttttaccatccgtttacattgtccaaaccaaaatattatcattgct

SEQ ID NO: 25176 - DNA, 475 bp, Zea mays
  Clone ID: cC-zmle189034h05a1
agcatgatgaacaaagcaatgtgtaatcgtccaaaacatggagacagtttcgtacatgctactacacttgaacagcttttcgtgtatacagaaaaagaatcggcatcctcgttttttctctattcaacaggggcaacaacggcagagagcaaagatgcgcatactatccgaaaagaaaagggacaaggagctgggcctcagttttcggaagaaccagatgattacgctgttctactcttgtttgctgctcttaacaaacagtgtgtactgatcccatggattgctctggcacaagatatttagttagattttgttatttctgcgtacggatccatggacgactcagttttgttatttctgactaaaatttggacaaatagctcttctgcacgggaggaagacccaaccaagggttcggtagcaacatatcggaaacccaccgatctccatactcctttcaaaatggaacttttgg

SEQ ID NO: 25177 - DNA, 531 bp, Zea mays
  Clone ID: cC-zmle189034h05d1
catcggccaggaaccagcagcggcaggaacaaggcaggcgatccgaagaaaccaaccttgctatcatcgccggcctaatatcaaccccctgttttacccctggccacggcagtcgtccagctggtttgcctcccacacaaagggtaaaacggccggaacgctaaaatctcacccctccgcttggaagttggaacccatcgccgcctccatcgctacacaccacgacgcagcgcccgattccgccggccagcaacgatgcagagctccctcgcccggccgccggtactggccggatgcggcgagagacggggcctggcagccgtggcacggtgccgcgctgaggcggcggcgcccgtgtggacggcgtccagggcgcctgtggggccgtacaccgggagggacccggaggtgaagaagcccgcgtggctgcggcagcgcgctgcgcaggggagaagtacgctcgcctgcgggagtccatcggcgagctcaagctcaacaccgtctgcgtcgaggcacaaatgccccaacatc

SEQ ID NO: 25178 - DNA, 548 bp, Zea mays
  Clone ID: cC-zmle189034h06a1
gccactggaccagcgtctcgtggcgctccgtgcgctcggcgccctcgcacgccacgatgttgcagatctgccggccgaggtacacctcggacatcacctggtccgtgccggccggcggagaggcgtcggtgggctggccggagccggagccggagccggagcctgagccggcgccctcgagggagtcgaacatggtggagtagtagtgcagcgactccgtgaagcggtcgaggaatgtgccggagttgtggttggcctcctgctccaccaccgtcacgatcctcggccgcaccgcgcgcacggtgcccaggaccttgtcgagtgtaccgggctgcgcgagcagccggtgcagctcgcacaccgagtttacggcgatcacctcgggctcgtcgtccgtgtcgccgccgccctccggtcgcagcatgaacggctccaggtcagcgagcgtggcggcgacgaggccacggtactggaagtcgacgcggatggtgtgcgcgaactgggcgagctttcagcccacctgctgcaaggcgtcggtctcgtcgggc

SEQ ID NO: 25179 - DNA, 434 bp, Zea mays
  Clone ID: cC-zmle189034h07a1
gctctgaaatcgttctcaaatacacacaagggatagatagaggtacagttgagttatacaaaggtttcatcaagtttcttaaagtacagcagagcttccatttcctacatgaccagatagccctagcaaagcatgcagctcctacaccaaaagccatccatgtttccccacgtactatccaagcgcccagctcggcagcagcaatatatatgcacagtgcaagcaggtgaacaagcgcagctagtagtagccgatgtccttgtcgtcgacgacgaggtccccgttgatgagctcgcggtaggcggcgacgggccaaatgaaccccctggggaggaggcgggtggcgagctctacgtcgatgatgatctccctcatggcgggcttcttctcgccgctgatggcgatgaggtagctcctgccgacccacccgatcc

SEQ ID NO: 25180 - DNA, 322 bp, Zea mays
  Clone ID: cC-zmle189034h08a1
aaaccccccacaaaaaggggggggaaaataaacctgtgggaagatggcttaattaccaacagggaaaaacttaaaacccaccccacaaccacaatggggggggccaaaacccccaaggggggggggaaaaaaaaaaaagaaaaaggcctcatttttcttctagcccgtccaatacaatacaatccccagggcatattacaggccccacaacagtccttgtttaacagggggccatttccaaaacccaacaacccgggcgggcaccgggcgaaaaaaaaaacaaagaccccccgacccctgggtccccccggaaattccggac

SEQ ID NO: 25181 - DNA, 524 bp, Zea mays
  Clone ID: cC-zmle189034h09a1
ggaaaaagcaaccatgttttaattctgaactctgaagtcgcctttacaaacagcactgcaacgcaaaaagctacacaagctacaccagacaaggggcaacacaatctcgtcatctggtgtagttatgaacaactctaactcctatcgtcccaccatgcacaatgcacttattatcactcaataactataataaaaacactgctatctgaactttcagtatctcaaacacaaacagaggggcaccaagctgaggccagacaggagagaagccatggcgctgcctgcagcctgcatcctatgtggtgaggatgggcgggaggtaatccgacttgttgccgaggacgcgggcacgggtgtcagggaagttctccatcccgggcagctcagtaacggtgccgtcggcagtgacaccgatcgggtagctgaggaagtggcccgggaggtcctgctccaggtcatcactcgagtacaggtcccagtacttctcggggatcttgttaccttctgcacgcacttacgctttc

SEQ ID NO: 25182 - DNA, 397 bp, Zea mays
  Clone ID: cC-zmle189034h10a1
ttttgcatgaatggattatatattattgcagaggaaagcggaagcaagatcgaggcgagtacgtataatcataatgtatcaacactacacataaatatatgatttttctccacactcctcacacttgcctacgtcagggatgtaactctggtcgccggaggcagcagcagtggcgcatcatctcttgttagctccggctactgcagttgcttcatctcttgttagctcaggctcagcagcctcagctcgggccacgggttccttcagtactggtcgggccagaggaaggcgcccatggcgaactttcgcttgctgtcgagttcgccgtcgacggagaggccgtactcgcggagcaggcaggcgacgcgccactccggcatgctttcgtagtcagcct

SEQ ID NO: 25183 - DNA, 422 bp, Zea mays
  Clone ID: cC-zmle189034h11a1
ccttcaaaaaaaaggggaaggattgtttatttgttttattatatattcacccagttcttgatcgatccgatccatttttgttgccaacagcctgcatgcgtggtttgtgctcaagagcaccctttttttcgcctttccgacagaaccacccgaatccagatcagcaggggcgaaattccaaccactggaatgaaaccctccacttcccaaacacaagacacaacacaggcacagttgtggggaactgaaaaggcgaaccatatcaaagcaaagggcatggtccctttggtggctggtgataacaacaacttgatgtgcagatccaaaagcaaaccgagaaaacacactgaccgatctggaaagcagccacgaacacatgcagtgtcttgagaccatacacacacagtttatacacgcccatg

SEQ ID NO: 25184 - DNA, 439 bp, Zea mays
  Clone ID: cC-zmle189034h12a1
aaaaaaagggggaggcataagccccattattgatacgtccagaggtaaacattattagcaagctcaagctagaagtggggggcaggcaaaacagtttttgttcctgcgcaaaagctactagcttacatagcacagttgagcaaaaaaaaagtttgttcgccttcagcgtatcattttaagcggacttcacgggggccgcgttgatgatgtccatgaactcaggcttcaaagaaactccaccgacaagaaaaccattgacatcagggtgtgctgctagctcctttgcggggcgcagcagatacagagcctccgaagatgatcctagtagattcaacaacctcagggctggcattggtttttatccaaaccctgagggaggcgtgcacttcctgagcctgagctggggtggcaactttaccagctccaataacccaaactg

SEQ ID NO: 25185 - DNA, 461 bp, Zea mays
  Clone ID: cC-zmle189035a01a1
gatgttaaacatgaaatttggggattgggtggcagcatgttcaaaatattcttcgaatcgatcatttcatgccacgcagtacaatcgaatttttaggataagcaaccgtcccgagtttgtctaaagagacccaacaccactatacgagtgacatcggttgaaaaaatatacaggggaaagcaaaagaatgctgacatgagataattggttgtgaattgcagcacaccgattgcagactcattcaactcccccatgttcctccttcacagcatttcctgagacctgcggacacattgcctaaccttcttcttgaactcatcccgcttctttctccaatccttggcagcttcaatatttgctggagactcgtcattcggactagagagcattgaaatgatgcttaaaactatacttttaaccgtgtgcactggtgtccaccgttcgcttgcaagctcataacc

SEQ ID NO: 25186 - DNA, 339 bp, Zea mays
  Clone ID: cC-zmle189035a03a1
tttttgagtttcaacacgatgcttataatagggggattggcacacggaacaggggggaagtctaataaaaataaaagcgacatttattcgttgggcatcatatcacagagcattgcccggcaggaaacacagttacaggattattccatgcacacttgacagaaacgcaaacagagacgacggttcggtgtatcagctgtccatggcgacgccaggcaactggaaagggtcgtcgccctggttgagctgctgcttgagcatccacttattgaaggggtggaagaggatctccttggagcatgtgtactgctgctgcgcggggcagtcaatgaacgtgcc

SEQ ID NO: 25187 - DNA, 448 bp, Zea mays
  Clone ID: cC-zmle189035a04d1
gagaaccagaaggccacccaccttccaaggcaggggaggggccatggacgaccccgtcgagcgcttgaaggacgggttccacaagttcaagaccgaggtctatgacaagaagccggagctgttcgagcctctcaaggccggccaggcccccaagtacgtggtgttcgcctgctccgactcccgcgtgtgcccgtcggtgaccctgggcctgcagcccggcgaggccttcaccgtccgcaacatcgccgccatggtcccagcctacgacaagaccaagtacaccggcatcgggtccgccatcgagtacgccgtgtgcgcgctcaaggtggaggtcctcgtggtcattggccacagctgctgcggtggcatcagggcgctcctctccctccaggacggcgcacctgacaacttccacttcgttgagaactgggttaagatcggctttcct

SEQ ID NO: 25188 - DNA, 405 bp, Zea mays
  Clone ID: cC-zmle189035a06d1
actcgatctcgcacctagggtttcgtctcgtcgctctcgtcactccgttaagatgccgaagaacatgggtaagggagggaagaaccggaagcgaggaatgaacgaggctgacgacgacaagcgcgagctcgtctttaaggaagacgggcaggagtactcgcaggtgacccggatgctcggaaacgggcggtgcgaggccatatgcgtcgatggcacgcgccgcctctggcatatccggggtaagatgcacaagaaggtctggatcgtggctggggacatcgtccttgttggactccccgactactaggacgacaaggccgacgttattctcaagtacatgaacgaccaggcgcgcctgctcaaggactacggggagcttactgacacgctcaggctcaacgaggg

SEQ ID NO: 25189 - DNA, 190 bp, Zea mays
  Clone ID: cC-zmle189035a08d1
ggtcgacgccacgcgtccggggaactactggcagcccaagtgcgccgagccgtgggtggaggtgaagttcgaggacgacaagcatgggaaggtgcatgtggtggcctcgacgctcattcgccttaccaacaagcccaacgtcacgatcgaggacatcgggagtcccgagaggctgatctccttgctgggt

SEQ ID NO: 25190 - DNA, 347 bp, Zea mays
  Clone ID: cC-zmle189035a09d1
ggcgaggagatgatgatgttcatcaacgccttcccagaaaccgggctggaagcagctgcctttgctgcgcgggtgcctaacagtgcatagaaggttctcggcgaagtgatcgaggaaataatgggagaccatgagatgctgacaggaaaggactccaaatgagaagaatttgaagcacggacatgcctatcaagaaaattgtcactttgcattctgatatatggcatttaaatctggattcaaattgccgaaccaggagccgggtatgggaaaaactgttcaagatagtgttgaaaaacaaacatcagcttaattttttcttttgataaatacgggtcctttttcat

SEQ ID NO: 25191 - DNA, 356 bp, Zea mays
  Clone ID: cC-zmle189035a12d1
cccacgcgtacggggtactccaagcagggacaacctgtttatgtatttggtgtgggtcttagtactttcgacagggcctcggtgaactactatgtgcaatcacacatacagatgaatgaatatcgagatcgtgttgtcctgccggctgcatcaaagaagtttgggagacagattattacctgcttgaaggttatggatatgactggcctcaagctgtctgcactgagccaaataaagatgttgacgatgattactactgttgatgaccttaattatcctgagaaaacggaaacttattacattgtgaatgctccatatgttttcttagcgtgttggaagggtgtgaactcactttt

SEQ ID NO: 25192 - DNA, 341 bp, Zea mays
  Clone ID: cC-zmle189035b01a1
gggaatgggaacaaaacttttttcttttcatttcaattgttcattcaggacattgcttacactgaccctgccacccatggggaatcctgacacattttttctcaattatcgcccttaaatgactcaaccagctagctagccagcggctttactacaacccatagtttttttagggggggacaccgcccgcaccatcgtaggggcatggaatctgctgttgcaggccccacatccccgtcaggtgctgcgctttttgggccgccaacagccccgagacctggcccttttgtggctgttgttgcaggattgactgtaggaccaaccccaatatcgcctggtac

SEQ ID NO: 25193 - DNA, 389 bp, Zea mays
  Clone ID: cC-zmle189035b02a1
tttttacaccaaccattacatgatgtacccccggcagaagttaaatggtaattataataattattacatgaagcaaccagatacatcgttatcttgctttggcaaccagccaaacagcagagcagtgtgactgacctgagcgacacatcaggcggtgtcacatcttcaggtatcggcaggcaacacctaattttgctatacaattaaaccaaacaagcatcaagcaaccaggaccacactgctcttcttacaacagaaccgggttgtcatcgatgcacctttccgcgctgagttgagcgaggcctttggcaaaacacatgccatgtcgtttagatctttgaatggtgtgagttgcttgacaacttcatccatcgatgggggagacttac

SEQ ID NO: 25194 - DNA, 375 bp, Zea mays
  Clone ID: cC-zmle189035b03a1
agttatcccgtattttttttccttttagagctgggtacagatatacagatgaatttacattatgttagtacagtgctgcaatcagggaggaagcaaggaacatcctcaagccgctgtcgggtcaccaactggtcatctgttgtcgtcttgtaggacggtgaagtggaactcgatctgcagccgccggtgcggcgcgccgtcaccgtcgacgccgacggcgccccttctctcgatctccagctcctccctgagcgggatggcggccaagaatctcttgatgaactccctgcagcactccttcccggtggcgatgacctcgtccgtgccctcagcctgcatctgggacgagccgtcgaacctcagcatgtaggcctt

SEQ ID NO: 25195 - DNA, 589 bp, Zea mays
  Clone ID: cC-zmle189035b04d1
cccacgcgtccgcccacgcgtccggccccgagagcgggtttagttagaggctacgggcggtcgggcgcggcggcggcggtggccatgagcagtgggagcgagagcactaccgccagcaggtggcccgagctggccacgctgcgcgcgctggcgcgcgacgccgcggagcagctttggctgccgcgggccggcacgtcggcgtcggcgtcgtcgccgtggcgcgggcgcgaggaccacctccacggccacggcaagacggccaaggtgatgcacctgctgctctggggacccaagtgaagcggtgagaggccaccgtaccgccgggctctcccgctggcgttgctcgttttgctctgcctgcaatccgccccgcacggactgtactgtacctatatatacacctacatactacgacgtgcacctgtactacgacgtgctgctgtaccatactaaatactagtgcgctgctgctcccttgcctttctgctagcaccagccactccgcttttttgctcgaacgatcgactgctcgtgtcgcgtcgggccacggtcggtcgtcagtttgggtgtgttcactccactgtaaagc

SEQ ID NO: 25196 - DNA, 127 bp, Zea mays
  Clone ID: cC-zmle189035b06d1
tgctagaagccatgcaaacaccctactgcatgcaaaacaacttatgaatttcatgaattgctagataatggtatggatggttacttgaatgcaagacactttatggcgcgatactgcgatgaattca

SEQ ID NO: 25197 - DNA, 446 bp, Zea mays
  Clone ID: cC-zmle189035b07d1
cccacgcgttcgtgctccacaaaatgcaagcgcgcacacacacgtagtatgcatcgcggcaatacacacacagacacccacgcgcacgcagcagtacaagcctagactagactagttttaggaccggccgggatgctggactgggcgcccgtggtggtgggcgtcgtgctcttcgtgctcctctcgccgggcctgctcatcgagctccccggcatgcaccgctgggtcgacttcggcagccttcgcgtcaccggcaaggccgccaccgtccacaccatcatcttcttcgtcctcttcctcattgtcaccatggcgtgcaaactccacatttacaccggcgcctagctgatgtatacctcagctcgctacctgtgggcaactagctgagctccccagctaatctttaccgcacgcaccgtacctgttcgtcgtcgtctatgcgtcaa

SEQ ID NO: 25198 - DNA, 596 bp, Zea mays
  Clone ID: cC-zmle189035b10d1
gcctcttcggtcaaaaatatccttgtacctgcatcttgacctcaccggcgtccggcggtggtatcacgatggtggcgttgctgggccggcggatcggggtggctgcggcagctgccgcgttcatcgccctcgtggcgttcggatccgcctcatcctcgcccaagtccttcgtgaagtccaccgtctccgcccacgacgtcgtcatcttctccaagtcatactgcccgtactgcaaaagagcaaaggccgtgtttaaggagcttgagttgaagaaagagccatatgttgtggagcttgatcagcgagaggatggctcagagattcaggatgccttacttgagatagttggcaggcgtactgtccctcaagattttgtccatgggaagcacctgcgtggttctgacgatactgttgactcctacgaaagtggaaaactggctagacttctaaacatcggagtcaaggacgacctttgagtgacatgctacatcggtcagcctgttcgtttggtttcaattccgaccggcttctactacttctataattgtttttgtctctatggattacagctacaacagtctcaatagctgatttaa

SEQ ID NO: 25199 - DNA, 581 bp, Zea mays
  Clone ID: cC-zmle189035b11d1
cccacgcgtccgcttttttcttctctgtgctctagaagattagtattgtagggcttctgtgcagcacccaagcaggaattcataaagaatgcctggaagcatccacatctcagccactcaaccaccagtcatcacccctctgtttctgcaagtcactgtgggcaacagagaatacagtggaaacatagaacaagatgctttatctttccccgttacatcacttcgggagagtatggtaataatgctgtacagtgcagacggggcattgatatcaaaatcagagctgaagacaaaagagattgtggagtcaggaactatggacacagtatttgctcttgatagcgggggagaaatagttcttcagattcagatcttgctcaacgatgatgaccgcaagcgaatccaagaaatgagaaattctgtgatgaagatgaagcagctagggctgcttggggatggcaatgaactcaatttttcagacagcgcattgtctatacggctgacggagacgattttcaacatccgaagcaaagcagctgaacgatctgagcttcagaagagcatgttactggatgatttgc

SEQ ID NO: 25200 - DNA, 494 bp, Zea mays
  Clone ID: cC-zmle189035b12d1
acgcattatacgtactgctgcgactatgacttgagtgacatgcctttatgcactgatactttcgctcggcaagagggggcactgtgctgctatgacatgacttctaatccagtggcagacggaagcaagacttgtgaagataatgctggacacataagttaatattcagttaattttggaaatgaacatagcgaacagggagcttgttttgaatgtctgaatggaggacatatctgcgactacatgatgaatcacaaaaaggacacctgaaatcaatgatgtgaaccatggcatggtgcatgctgatgtatcaaaacagggatagttttcctggaaataagaaagaccagtctgatcctgatggtagctgctgtcaaatggataaacttgggatgggagaaactaaataatgctgctccccttctattataaactaatggtcaagaggtgctgtgcttcgtatgctttgcacctgcgaatactgtgcccctcca

SEQ ID NO: 25201 - DNA, 322 bp, Zea mays
  Clone ID: cC-zmle189035c01a1
aatcttaatttttattaaaaaaaaaaaccgcatttttaataacaacctcaaccgggtgggaaccccatttttccccaaacaaaaaaaaaaaaaaaacccccccccccccatttttttaaaaaaaaacccccaaattttacaaagggcccccccccctaaaaataaaaccttttttaaaaaaacccccaaccaatggggccttaaatttaaaaaatccccttttaaaacccccccttccccctgtgggggggggcccctttaaaaaaaaaccccccaaaaaaacacaacatgttgtcaaaaacacccttccccgggggaaaaa

SEQ ID NO: 25202 - DNA, 557 bp, Zea mays
  unsure at all n locations
  Clone ID: cC-zmle189035c03d1
tgttgaatgctgagaactatcattggcaatggacatcattcttctctgctgcttctaccgccttgtatgtgtatgtatactctatatactattatcatgtgaagacaaagatgtcaggatttttccagacaagcttctactttggttacaccttgatgttctgtcttggattgggaatactttgcggtgctgttggatatttgggctccaccctatttgtgaggaggatctacagaaatatcaaatgcgactaaacttggtctaggctgctagcatgtcttgtcacaatatggtgcagagtaataccttgagcttttgattgacttcggaaattacacaggaggttgctctccctttcgttactcttttcatcttttttggcctatcttcctggacgtgtggaactgcccatgataaatgtataccttagttggagaattagtcagagtactggaaagtacatgtaggttttttttgtgcggtctctactcggtcaatgtaggagtacatngatgaatatactgcagtgcagattccatgggctagaatcgcccttt

SEQ ID NO: 25203 - DNA, 505 bp, Zea mays
  Clone ID: cC-zmle189035c04d1
ctatctgacatccccttcatcatcgcttagatccccatgatgttgaagacgcaccacgggcagtgcctcgctatgctgctggcccttgtcgtgtccttcgcgctcgggcttgcctactgtctgtaccaggttgttcagccttggattcagaggaggaagctcgcgtactcgaagcacaagcacgtgatctccgggatactgtggcacgcccatatgcattcactcggccgcctgctgaacgactaccgcacgcccaatgaacaagtcatcataaagctgttccgcaagatcgacatggacgagagccggtccctgtcctgcgccgagcttcacgccctcattgactgcattaacttcgaggaggtcgacttcaacaggacggacgcggtggacaaggtcatggacgacttcgacacgtaccgtaacgacgttttagatgaggaggagttcctgcaagggatgaggaagtggctggacgaggctcagcgcagcgtgcccgtgggcg

SEQ ID NO: 25204 - DNA, 339 bp, Zea mays
  Clone ID: cC-zmle189035c06d1
gtaagtattctcgtactcctgcagcgccttcctgaaggtcacgtatttgtcatgggtgacaaccgcaataacagctgggattctcgtgcctgggggcctcttcccgttgccaacatcgttggaaggtacatgacatcatttacaagatcctcttttcagaactggggttccactcaatgttcgtcctcataaatcaatcatagttagagagttgtggagccaggccgctgctatcttgtcaatttgtagcgatgttatgtgtatatgattctcacttaatttggacatgcatgattgtgtacttgtgttgttataaagtaagcatgttttcgttgttgt

SEQ ID NO: 25205 - DNA, 473 bp, Zea mays
  Clone ID: cC-zmle189035c07d1
gggtcgacccacgcgttcgcccacgcgttcgccgagttcaagaggaagcttgacaggatggttgagatcaaccagaagatcattgccgtcggagagtgcgactaaatccccctagtgaagaacctgaagaggattcctcttgtcgcctctctggtgtccgagatcatcgccgcataccttatgccccccatcgagtctggctcggttgatttcgccgaatttgagccccggctcgtttactgattctgtacaaagatttatccttgagttattcaccctgaaagacaagctggtggtgctatctgcctaaggggccttgaatgaatggtgaaaaccgctggatggttagaggatctgcatcttcttgtgttcttctgtaagatactgagacttgggcagcataaaaagcttggcaaattttctgttgtggggcatctcaatgtaagttacagtggactgtatcataagcgagc

SEQ ID NO: 25206 - DNA, 254 bp, Zea mays
  Clone ID: cC-zmle189035c08d1
gtttcttggtatatttgcaaacgctacatctgtgaccatttctacctaatgtttacagcgctatctagcgttcggtatttcggcgtacctctgaccaacggagggtgtggtatgcgaaaaccgaattctatggcccttcttgtaccaactggccattggggttggcatcgcacctttataacgcgggtgccttcaacattggtggcctctataacgatagtcctttgtggtttttttcccgcatttttcgttta

SEQ ID NO: 25207 - DNA, 395 bp, Zea mays
  Clone ID: cC-zmle189035c09d1
gtaattggaaatgacatcaaagcctttcttatttttgtttctttttttaaaataaattaatctgcctggagcttgagaaaccatgcacctttccagttagcattgggaagcggatcggatataatgattttaatgttcgcccagtcctcagcctgtaatacaggcagcttgggccttttttctcattaacgtgtctgcgaccggcagcatttctattgcacttttagctgtttcttacctactgatagagtgatttgatactgccggatactattagcttcatatatcctcttcggattcggattgggaacctctattattaacttgtgtctggtaaaaaagttagatttgtatatatattggtctgtaaatatccatctttgagggtacatatt

SEQ ID NO: 25208 - DNA, 377 bp, Zea mays
  Clone ID: cC-zmle189035c10d1
accacgcgttcggtatccttcccttggtaggtttgctgtccgtgacatgaggtacacggttgctgttggagtggtcaagagtgtggagaataaggacccgaccggcgccaaggtgatcaaggcggctggcaataagaaatgatgcgatcctgcgcctgctttagcaatacctagttttaatcatcacacgttttgtttgtgatcgttgctgttatcgtgtgaactgctgagatctgttagcatgtgcacttttatctatttatttggtaccatgttgctattttacctttatcaatacaagaatgctctaagacctatatgtgaaccttttggcattgttgaattgattttacgaaagttgtatagttaggtgttct

SEQ ID NO: 25209 - DNA, 424 bp, Zea mays
  Clone ID: cC-zmle189035c11d1
ggccccgttcttccgcacaatacctcaaaacctgaggagcttttgggaccatccgtggctgcccatcacctgagcctgctaaagtactcggaccagccggggatccaggtggaatggggtacttgttctatcgatagacgacaccctaccggtggatcctgcgtaacaggtgggggactcagccacaatggtcgatgaatctatagacatgcaagctcccatggacaaagggtatccatggtagacttctatctgacaaactgtgaatgaggtgctggacagatagatgttctatttgcaattgttgatagtcatggcggaggtaaagaagcagaggctgtataaaaacacctgcccaacaatcatgaatggtctccaaagtatataagtggaactaaaggctccttatacgaggcttatcaaa

SEQ ID NO: 25210 - DNA, 517 bp, Zea mays
  Clone ID: cC-zmle189035c12d1
gatgatgtcagcaccatctgctgcatcagtacagccttcattgactaccactgctcgcagagataatcaaagcagtgggtgggctgtacctgcacaaatggcgaacacacctggccagtctcagataactggaaatttaacctggggaaatacacctgaaggtgacgcaggcttatgttggggaatggagggacagagcaatatgaatatgccttgggtagcatcagctcaaggcgcttcaggctacaacatgggtgtagccatgccgacgcagccaaatgcagttccaaacatgggctggttaccaaatccaggaaacaccagcatgaacatgatctgggctgcaactcaaggccaggggactccaaatgcggctcctatgatgggaggtcagatgcaaggagttccaatggccacttggggtggtgttgcagcaggaagtgcaaattcttatcctgcctggggaaaccaacatgctgggaacatgaaccaaaatgttggctggagtgctcctgtg

SEQ ID NO: 25211 - DNA, 217 bp, Zea mays
  Clone ID: cC-zmle189035d01a1
atatataatttttatttttcatttttataattatcaatccattaattctattttatactcctacaccacacaacaatccactcaactcatccacacaaaaaaaacccaacccattcccatatatccatccaattccccacacacttcacaaaactaacaatcctaacacacaacccacaaacctcacacaacacaaaaataataaaaacctaaacac

SEQ ID NO: 25212 - DNA, 553 bp, Zea mays
  Clone ID: cC-zmle189035d02a1
ctttatatattttttttttttttttatttttattttttttacatggttttggtaaatttttaatttcatcttcctaatttaatatcacataaacaactaataaaaacacacacaaaaaaaaaaaaaccaaaaacaaaaaataaaaaaaaaaccaaaaaaaataacaacaaaaaaaaaaaaaaaaaaaacaccaacaaaaaaaaaaaaaaaaaacactccttttacacaaaaaaaacaaataaaaaacacataaaccaacaatatccacccctaatctccaccccccaaaaaaaaaaaaacaacacaaaaaacaaaaaaaccactccaaaaacaaaaaaaaccctcacaaaaacacaaccacaccctttataaaaaaaaaaaaccaaaacccccctataaaacccttaaaaacaccccaaaaaaaaaacctcacctaacaaaaaaaaaaaaaactcccacaaaaacaaaaaacaaaaaccccccctctaaaagaaacccccataacaccataaccaccactctaaaaaaaaaacaccacccccaccccacaaaa

SEQ ID NO: 25213 - DNA, 467 bp, Zea mays
  Clone ID: cC-zmle189035d07d1
cgaataatattctgcagtagtttctcgagctcctgtagcaagaaagaaaccatgtcgggggtatgggtgttcgaggacgggatcgtgcggcgtgcggacagcgacccgtccagtggcgccggcgccggcgggtcccggtcgaacaaggtgctggtgcacgttcccagcggggaggtggtgacgtcgtatgacgtgctggagcggtggttactcgagctcggttgggagcgctacctctacgacccctgtctgctccagttccaccagcgctccaccgtgcaccttatcaccgtaccccgtgacttctcccgcctcaagctggttcacatgtacgacgttgtcgtcaagatccgaaacgtctttgaggtccgtgacgccgcccctgtctgatggtcttctgggtgacgcaagctgctgctgtgtgcctattatctttgtgcaagcatggtggaccggctggtactgga

SEQ ID NO: 25214 - DNA, 484 bp, Zea mays
  Clone ID: cC-zmle189035d09d1
cagcaatccacacaagcacttcgacgtcacacgggcgctgcgcacagacacaccaagcgtcggcaccaatggcttactaccaggaggtggactactgctcggaggaggtgaggtcggtggccccggtcggcttcggccgccacggcggcggcgtccagcagcacgttgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccactagcgcagggagagcttcctcgccagggctaactgagccgtccggcggccggcattcacgcccgttcgtgcttgcctgcgtgccttatgtatgtctgtgggtgacttggttgtgcagggtcattgtacttggctattgtacgtgcacgcactcagcttctgtacgaatta

SEQ ID NO: 25215 - DNA, 433 bp, Zea mays
  Clone ID: cC-zmle189035d10d1
cggactcgtggtcggacgcttgggcggagaacacgaatactattcaataggtggaacagtcttccctggctcaggtagctgcgaattatcatgtccacaggatggtggtattgcaatctacgaggggcctgatatggtgtcaccacagagcctaactgatgctcggatagaaaacattcattcagatgttgctgatacagatgaatgcaccaagactcagaaggccgttctagcaggcacagagggagaaaattgtgctgaacattctggtgtgcctgtgtctgagatggacaaatgctaccagatgccgaaggatgcttcaacacttacagcagcatgtgctaattctgctgaagacgaatcttttctgaaagacctctttgtgcatacagagaacaaggctttttttgcctcctcagctcctgatgatcct

SEQ ID NO: 25216 - DNA, 375 bp, Zea mays
  Clone ID: cC-zmle189035d11d1
gaattttcgggtcgacccacccgtccggaaagtggattagtacataaagggtgtctagggtgcaatcaattttttccttagcaagctgaaggacctccagggttctgttggtgagctcatgaaggatgatgcgtctgtggtattcgcctattacatggatggtgccacttaatccgacatttcctctattacttctcatggtcttaattgagatcaagttctaggcgtgctgcgaaattaggtacccatgttgggtactatctatgtactattactatatccaaaactataggtgccctggctgaattgaactcaaaagggtttgtttgagaaaaaattgtcccaagattggtttgcttgttaaagctcaatctt

SEQ ID NO: 25217 - DNA, 532 bp, Zea mays
  Clone ID: cC-zmle189035d12d1
cgggacgacctacgcgtccgcccacgcgtgcgaacatgttgacaagtatttgcaagagaaagaacagagccagcaggtgaaatctgagccctccgagaatgaaggtgtgaatgtatctggccttagccactcttctacaaatacttgcaaaggcggagaacctatcgaagaggatgtggacatctgtggcaatgcctcacctatcatgctagacaaagatgcacaaatcaggaatagcaagtgtggtagtccaagtaggtccagcagcgactctgaatcatcttctagcgattctgattcaagcagtgactctgaaagcgaatcataaaaagttggcagccctggaaagcttgcgaaggggactaagaaacctgatcagctgcgggagcaagacaagagtgatgttattagtccatctgatgccaaccgccctgctgctattgaggggcttcatggggaggacagtgtgtcaaagcctgcaccagggggggaaaacttagaacccgatacacaagtcttaccagacaggcta

SEQ ID NO: 25218 - DNA, 516 bp, Zea mays
  Clone ID: cC-zmle189035e01a1
gatgaaaatcgttttttttttggcgctgggggcagcagcttttctgggtcaatttacaaaaataagtagagagaattacaatccaagacgacctttctgcagccacacgaacgccaacggtgcgagcttttcaggcagcgacgtgcccatcccgcacgtcacccgcatcatgcacggcatgaacgcgccactgagctgccgcgcgcggcaacagagtaaccgactgccccgcgcacgtacgcgaacgccacacgcactaattaacgctactatcagagtattgctgagcttcacgcggtgagaccgagccgctggaggtgatggtcagtgtcctccgggtggtcgtcgagcaccctctgccgcgggggcagaacccaccggccgtcctccgtcctaccaatgccttgttctccgcctggaccacacgggcggaccatgtggtcctcccgaggaaggcgggggacttgtcaccagcgcggggtccctcccgcgggctcgaccccgcgccggagccgg

SEQ ID NO: 25219 - DNA, 429 bp, Zea mays
  Clone ID: cC-zmle189035e02a1
gaaaaaagagtgggagaaatccccccccaccccctataccaggcaaagtaaacagcctccccaaccaaaaaaacctgggatcggaagggcccaaatcaaaaaaagggcctggaacccccccccccttggcccccatggccatgaggcccccccccacccgcggggggggcttaaaccccagctgcagcttgccccgggtttcaacccaggggttcaccaaggccccgggaaacaggcccccctgcgccttgtacaccaggaccccccccctcacccaatggagcacgccccacacaaaccacacccggggggggggcccctccgccccccaaagaaaacccaacccccaccaaaatacccaccgggggtatacggggaaaaaaaaagacccattttccccacccccccccacttggactaggccaaaaa

SEQ ID NO: 25220 - DNA, 229 bp, Zea mays
  Clone ID: cC-zmle189035e03d1
ggtacggagggccaatcaccagccctatctttggggccggaattggttcaaaccatgacggcacacgctctgcggccgctcccgctacctgtgatcgaacaagtcgcctgtggcaaaccttgctccctactctgcgccaccaacagtttgcactcattggacccactgcttacactgggccctgctggtcattgctgccaacaactcttaccattgagccaggtctgta

SEQ ID NO: 25221 - DNA, 236 bp, Zea mays
  Clone ID: cC-zmle189035e05d1
ggcgcccatctccctggccctggcttggatcccgctaggcgccctgtactcctgctccccttgccgcattagacctgccgatttacctacacggcaaactcccctgcgagcaacagcttggttaatcatccccttgccactcggctactagcctatttcctctgtgcgctctacccacggataacgtgattaagctttgctatggcgaattgtgaggttctgagtggcgctgcatg

SEQ ID NO: 25222 - DNA, 52 bp, Zea mays
  Clone ID: cC-zmle189035e06d1
ataaaaatataaaactaaaacaacaaaaaattattaaaaaaaaattatatac

SEQ ID NO: 25223 - DNA, 576 bp, Zea mays
  Clone ID: cC-zmle189035e07d1
cggacgcgtggggttgttcgagaccttgaggctctactcgcctgctctcttcatgcaaaggaagaccctggccgacatgaccgtggggccaataaaactgcccaaaggcactgcaattgtgatacccatttcgatcatgcatcgagacaagcaggcatggggcgacgacgcagacgagttcagtccgatgagatttgcgaatgggatcacgggagcagtgaaagtttctcacggcctgctggcgttctcgatggggccaaggtcttgcatcggccataacttgtcgatgctggaagccaagttgacgctggccctgatgctccgcaagttcttcttcgctctcttccttgactacaggcacgcgctcgcggatctttttacttttaacctaagtttgggcttccgtcattttgaggccactggataatgttttgaattgagttgggcattatagacaacacgaagtaacttaggtacatataaaatttgctagctggtcaaaacgttatatgatgttataaccctcccgtgtctattatcgtgaaaacaagtttttaatttaggtgcgcgttggtt

SEQ ID NO: 25224 - DNA, 416 bp, Zea mays
  Clone ID: cC-zmle189035e09d1
atacagtacaggtatgtaccggtgtgatgattcatggttattcccttgtgaagaagctttgcgcagagtgacaggatttcatgagagagcacaacttttcatcaattgaagagtttcgaggggcctcgcttccgtattttacgacgcacacagatctggttcaccggcaacaagaggcggtcaggcagaggaaggccattaagaagggccttcaatcagacaaggaatggacgggtgatgggttcgttaaggagaccgaaagcatggtatccaactgatgcatctctgccaccccccaccgggccattccttacaccatgctccaacttcatctttttaataaacgcgcaccataaatgccacacaccaagcatctagtcctcatctgtacatggttctgaaccttgggcctttag

SEQ ID NO: 25225 - DNA, 362 bp, Zea mays
  Clone ID: cC-zmle189035e10d1
ttaaaacacgaccaagcaaactgttgttgcctaggcaacatgagctgctgctgatgctggagaagcagacgggggagggtttttacgccgtaacaatgtaacatgtggagcggctttcatgacttaacttccttttttttttggttgttccacggactatcgacccggacggtgccaacggcttgaagactaggagataacaagtaggacgatgttgtaatttatctaccacgacgcggtggctctggcttgagtgtaaagaaatccttcctttcaactcgactggtattgttgttgctggtaaaattgttgtaggaatatcatctgcgctccatttttcttttgacgacttttttttataa

SEQ ID NO: 25226 - DNA, 599 bp, Zea mays
  Clone ID: cC-zmle189035e12d1
cgggtcgacctacgcgtccgcccacgcgtccggctagaaacttgtgacgatcagcagagggagatgatcttaacaaggataaagacacacttgaacacactcaagaggtacacatacgggaagcacatagtagcgcgtgtagagaagcttgttgctgctggagagaagcgccttgggcttcaaccagcatgcaccgccgcctgaagggcaaactctctaagttgtacagctaacagttgctaggtttgcctcatgtttttttctctactaaaaaccttatatgaaggccccttttggcctcgccaggaaaaaaaataaatactgtatgtttgcggggaagagtgtacattaattctgtagcagaaagaccccctacccatgtggcggaatcaagggaggagtgatgcgtgtgagtccgatcgatctgaaggctgctgtaaagaggaagatggaaggggaaggagtgagaagcatgtcagttactctgctgctgtacaaattaaacttagctcttagagtgaggagaaagtaagctgttagctgtctgcctaaggaaagaaagggaaaaaataagaagctggaggccattggcaccctgt

SEQ ID NO: 25227 - DNA, 430 bp, Zea mays
  Clone ID: cC-zmle189035f01a1
attaatattcctatttttcaaaacacactcttacatttcaactaccccctatacttttttttcccccacccaaaaataaaaaaaaccccatcttccccaaaaattataaacccaaaaaaaacccccccaacccccaaaatttaataaaccccccgaaaccaaaaaaaaaaaaaaccctccccactcccccctttaaaacccacccacaccacaacacccccccaaaaaaaaaaatattttccccacaccccacgaaaaaaaccccccctccaaaaactcttcgtgtcccaacaaccccccccaaaaaaaaaaaaaagaacccccctttttctcatacacaaaattttcaaaaaaacaaaacccgtgtatatctccccttataaataaatccccccaacaccccgaaaaaactttttaacacccccccccc

SEQ ID NO: 25228 - DNA, 300 bp, Zea mays
  Clone ID: cC-zmle189035f02a1
cccgaaaaaaatctcatccaaatatttgttttttcttaggaaacccccccttgttggggggcccccttttcggtcccctcttatttttaaccaaaaaaagggcccccccacccgggggttgcccccccccccagacgggtttcttcaaaaaaaactggttgtttggcaccattcttttcttctttaaaaagggcgccccccatgggttccccccccccaagggtataaacacccgtggcccttgtggggggccccccccaaattttcaccaaaccatttgtttaaaaggaaccccctttt

SEQ ID NO: 25229 - DNA, 243 bp, Zea mays
  Clone ID: cC-zmle189035f03d1
ggacggttatgatatgttaatatgggaaatgatcccaacagattagtgaataggtgtggaagctataattggaagtcaaccaaacatcgaatgtatgggaagcattggtttatacaggcctgttacttctacactatacggatacttattctcgctatcttcttgcgacaacacacctaaggttccgactacgaaatgcgatggttaattgaagcaagaaatgcccgggacgggagacttttt

SEQ ID NO: 25230 - DNA, 191 bp, Zea mays
  Clone ID: cC-zmle189035f04d1
ttcggacttcggtgggggaaatggaggccgccgccgccgccgatacggggctcgcccagaaaccggttgtgctgtacccttcgccggggatgggccacctggtctccatgatcgagcttggcaagatcctcggcgcgcggggactgtccgtaataattgtcgtcgtcgagcctccctataacacgggctct

SEQ ID NO: 25231 - DNA, 270 bp, Zea mays
  Clone ID: cC-zmle189035f05d1
catatgctcattcattcctaactctattcatagagacatgaaattaaaaaataataatgatctaattaatcaaaggaaggaacccttacctgatttgaattccatcctccttaaaatatgatatgctctaagtcttcccatactttcctataatgactgcaacgattattctccattttgcgaattcctattctatttgaagtatattactatcatatacattatctcaatcgatccactttaaataaaatataaaaaattgtaagaaaa

SEQ ID NO: 25232 - DNA, 547 bp, Zea mays
  Clone ID: cC-zmle189035f06d1
cccacgcgtccgggtactagtactaccatatcatgtgacgtgcatgctgctgtgatgcacaccaacccagccgtggccaaggcagctcctcctctcctcgccgccggcagccgcactgtcatcacagcgcatcagccatcgtctaggaaaggcgccgctggcgcaggttagttctgcagacgcgtcatcgtcagcaagcgcgccagggtaacagcgaagctcggagacggagagctgaagcctgcaggcaagcggaagttcatcaccaaggaagaggagccagaacagtactggcagaccgcgggggagagggagggcgagaaccccatgatgacacccctgccctacatcatcatcttcggcatgttcacccccttcgtcatactcgccatcgccttcatcaatggctggatcaagttcctgtgcgatgaccgtaacgcgaaagccagactggatcataaatgctgacctcgaaagcctgcatcttattcatcgtgtgtactgcgaggttgccccttcatttatagagacagggattcttgcttgt

SEQ ID NO: 25233 - DNA, 478 bp, Zea mays
  Clone ID: cC-zmle189035f07d1
cccacgcgttcgcgctcttcgacgccgacgagcccagcttcgccgaggtgcggggcgccttcgccgtcttcgacgccgaccgcgacggcttcatcggcgccgaggacctgcagggcgccctggcgcggctcggcgtcaggcaggacgccgccgcgtgccgcgccatggtcgtcgcggtcggcggcggccgggacgcccggatgagcctgttccagttcgtcaggttcctcgagaacggcctgtgctgaagccacagagggggcagagaagctgtcccttcatttattttcttcttcttcgttcttcttcgtttgcctcggctgctcgtggcaggagatgagacagtgcaccattcggagaggtgttcactggctggcgcgcgtgtgtttttcccttctgacatgagctttgggggtggactcaactgtgcgcaattaacgcacttaattccaactaagaactactatgatttaatgga

SEQ ID NO: 25234 - DNA, 438 bp, Zea mays
  Clone ID: cC-zmle189035f08d1
gaaggagattcggtgctacaagggcatccggcacaagcttgtactcccagttcgtggccagaggacaaagaacagctgccggacacttaagggaaagagggcttcacttgccaagatgaagtcacccgccttccacgatgaataaatcgtattgccatgtattgaagctctctctctctctctctctctctctctctctctctgtgtgtgtgggtgtgtgtgtgtgtgtgtgtagcgctactactgctgggggttttgattcgagcttttatgctgccattgacaaatcatggggtagccatcagctgctgcagatttgtagcaatggcatactagctcatatgggtcggttctataaatgaagatcaacttcttgtttacatcctatataagaaccaattgggttgaagcctggcgcgctagattcgggctttattc

SEQ ID NO: 25235 - DNA, 478 bp, Zea mays
  Clone ID: cC-zmle189035f09d1
gcgctgtaatcagccacgtgtagttgctgatcgtgccagcggatgaggaggaggaggcgactacacctgcgtgggtggccgtggtggctccttcttcggcagcggctatggccctgctggctctgacgtcctcactggtgactggtactgctcatgccgcgcacacaacttcgccagccgatgcagctgctttaagtgctccgcctacaaagaggaggccgctgcgaacagaggcgctggcggttttgacggctacataacacgctcacggagctacagcttacgcaacggtgctgctggagcttgagctggcagtgaccgtactaccaagcgcaccggttggaagtaccgaaactggatctgcaccagattccggatgtagcgagcacaatattttacagcatgatggagtggttcatgtgccaacgcaccggggactttggtagcgctgtcattacctaggaaaactacttgcact

SEQ ID NO: 25236 - DNA, 443 bp, Zea mays
  Clone ID: cC-zmle189035f10d1
ggaattatcgggtcgacccacgcgttcgcggacgcgtgggctaccccataaggtgactggttttctacaggggtttatacgactggaaatccttatggggtaggagaggatatcgtgttcagcatgccatgcagatcgaagggtgatggtgattacgaactagcttgagatgtgttgatggacgattttctctgggaacggattaaaaagagtgaagctgaattgcttgctgataagaaatgcgttgtccatcttacaggagaggggaatgcattctgtgatcttccggaagataccatgctaccaggagaagtgtagcttagttacagaagcaacagcagcggaatgcatttgccaaatcattagctgagacttgaaacatctgtttggtgatgcagcaactactttatatatatatgtgggtattcaaaaattgcgccaca

SEQ ID NO: 25237 - DNA, 542 bp, Zea mays
  unsure at all n locations
  Clone ID: cC-zmle189035f12d1
cccacgcgtccgcggacgcgtgggcaacaactgggatgacatggagaaaatctggcatcacaccttctacaacgagcggcgtggtgggcctgaagatcaccctgtgctgctgaccgaggcccctctcaaccccaaggccaacagagagaaaatgacgcagattatgtttgaaaccttcgaatgcccagcaatgtatgttgctatccaggctgttctttcgttgtacgctagtgggcgaacaactggtattgtgatggattccggtgatggtgtgagccacacggttccaatctatgaaggatacacacttcctcatgctattctacgtttggatcttgcggggcgtgacctcaccgaccacctaatgaagatcctcacagagagagggtactccctcactacgagcgctgagcgggagattgtcagggacataaaggagaagcttgcctacgttgcccttgattatgaacaggagctggagactgccaggagcagcttctctgtcgagaaagctacgagatgtctgatggtcangtcatcac

SEQ ID NO: 25238 - DNA, 172 bp, Zea mays
  Clone ID: cC-zmle189035g01a1
gccgaaacatatataaatgtggggagtgaggaacaaacaaaaaggatcacacgctgataacttgttccacggaggaaccctacactggctcactagtaactacaactatctactggcacatgacagaccatagtaaggaatcacagctgctatcattccggacgcgtgggtt

SEQ ID NO: 25239 - DNA, 324 bp, Zea mays
  Clone ID: cC-zmle189035g02a1
aaagaacttgtacacactcaagggctgaaactcctcacactacatgcgattatatttactagctattggagctagagacggggctcttggcgctcctatcatctcaactagacctcttctctctctctcactcatcgaacgaatcacatgacttgaacagtgacaagggtggtcacactagcaacaagaagctaaacaaaagcactacaggtattacggtagacgacgatggtaacagcagtaacagtaacgctagctaacagtcaaaggcacaagctagctgctagctgggaaaagcctacggtgcgctgggtcgtccttcgt

SEQ ID NO: 25240 - DNA, 460 bp, Zea mays
  Clone ID: cC-zmle189035g03d1
cccacgcgtccgtaaagcgcgcgcgcgcacgcggagaggctcggagagctgagtgagatggcacaagccatggcgtccatgaccggcctctcgcagggcgttctgcccagcaggcgcgccgccaacagggccaggacggccgccgtcgtcagggcgtccgccgaggcgcaggcgcaggcgcaggcgggccgccgcgccgtgctcgggctggtggccactggcatcgtcggcggcgccttgtcgcaggcggtgcacgccgagaccgtcaagaccatcaagatcggagccccgccgccgcccttcggtggactccccgggactctgaactctgaccaggcgagggacttcgacctccccttgaaggagcggttctacctgcagccgctgccgccggcggaggcggtggcgaaggtgaaaacttcggcgcaggacatcatcaacctcaagccactcatcgaca

SEQ ID NO: 25241 - DNA, 366 bp, Zea mays
  Clone ID: cC-zmle189035g04d1
atttacgggttgacccacgcgtccgggccaaagctcagagcaataatatacaccccaagcagaactcttcataacctcctgttaatcaacctgatccggaggtggcccctccaacaattgatgtccctgaattgacattggatgattcgaaacacatgactgatgattttggatcatgggctataattggtgatggatcttattgacgactattcatgcctcttttagacgatggcaggcaacccgcactttaaaaacctgctgcatttgaaaactgatcctaaagatgaggtcctcaaacaggcctcactggattaaatctgaaacatgactactttcttgtaatgtttcgttattgtgtggaag

SEQ ID NO: 25242 - DNA, 409 bp, Zea mays
  Clone ID: cC-zmle189035g05d1
tctctgtcctcctcccgtgtgtgtgccgtgcaacttcaaagccgttagcttcggttgcgctctgactctgatgcatccgttcaaatttatgtacccctctgtctggaatggagttgggggggggggggggggcattttccttctgtttctgtctttttctgtgggcaacatataatacagtgcatccatatttcacgatgctttatcttttcccgctacatataattgcctagagtgtacgtaaatattgtcgcacagtgtatacagcgtatttttatcaaaattccatctgtagtacaaatagattgtcgagtttgagagctatggacacaaatatttgctctttttagctgtggggaaatcgacctttatatttatttcttgctcatcgataatgaccgcacgctta

SEQ ID NO: 25243 - DNA, 227 bp, Zea mays
  Clone ID: cC-zmle189035g07d1
gggcacaagtcatactcactttctcatcgctgagaactgctggacgaatgataatgctacagttggctacatgaaacgtagatgttcacgccgttcgacccagatcactagtagctgttctgtgctaagggacgcgtttgactaccttgcgaaaatcatgggtttacatgaaaaaaacataaaaagataatggttttatctccctttcataactctttttatttatg

SEQ ID NO: 25244 - DNA, 520 bp, Zea mays
  Clone ID: cC-zmle189035g09d1
cgtgttctccttcgccggcccgcgcgttgggaacgtcttctttcggaggcggttcgagcgggagctgggcgtgcgggcgctgcgcgtcgtgaacgtgcactacagcgtgcccaaggtgcccggcgtgttcttcaactagtcggcgttcccggagctcgtcctgcgggcggcggacaggctgggcctcggcggcgtgtacacgcacctgggcgtgctgctgcagctggaccacaaggtgttgccgttcctcaaggagaccctggacctctcgtgctaccacaacctggaggcgcacctgcacctgctggacggcttccgcggattcggcgcggggttcgagccccgcgggagggaccccgcgctggtgaacaagtacaccgacttcctccgggaggaccacatggtgccgcccgtgtggtaccaggcggtaaacaagggcattgtgaggacggaggacggtcggtgggtgctgccgccgcggcagatggtgctcgacgaccaccccggggacacttgacca

SEQ ID NO: 25245 - DNA, 238 bp, Zea mays
  Clone ID: cC-zmle189035g10d1
cccacgcgtccgcccacgcgtccggtccgcgcagaaccgtgtctagccggcggcggcggtggcggcggcgaccagcagccatgtgtaaaaaaaaaatcaggagcaaattgaaaccgagctgaagttacgtgcttgcctttttcagtatgttgtcgtgtatcacgtttgaggtggatcgtatttgccggtcagtacgcagtgtttgggcaaatacttggctacttgggagtcgcaaaaa

SEQ ID NO: 25246 - DNA, 333 bp, Zea mays
  Clone ID: cC-zmle189035g11d1
tggtcaaagacatatggaatatttttatttctccaacttgttatactgtaccgcgacatggacagcgacatgatcaattcgtagggttgtgaggggcttcaaaagatcatctgcctgctgtacatgtatttgttgcatgtcttgtgaacataacatgtcttggttgtttctcaactggaggaatggtgttaacctgctgtatcatttccttgaatggcttacgtgagagggaggaggacctgagcagcagctcttgcaatctttgtctaattttcttcggatggtgaaggccatttcgcctgttctccgaaagtatattggctgcattattcg

SEQ ID NO: 25247 - DNA, 521 bp, Zea mays
  Clone ID: cC-zmle189035g12d1
cgggacgattacgcgtacgcaacgttactttatcctctcctcgtgcagccaagaccgggatgaccgccctcatcccctcggctccctgcccgtgcccgtcatcgcgtgggcaccatctcctcatattcatggccgcccttctcctatctcactgctcgcccctgcctttgcttcattgagccgcgcctccctggagtgcccacgccgtccgtaagtgctcgcgtgggaccctgtctcacacgtcggtgctcgccctagacactgccgggtcctcatcccctatagtgctcggattcggtcctcgtctcacagtctcgacccacctccagccgatgcctcctccctccatatggccctctacaggtcgttcctcacttagtcctacgccttgtctcctgaccacgctactctttgtgcatcaccactggtcgtagatctgtcaaccttgctggtcgtcgtccggtgagtcccccaccattcttgccatggctcgcatttcttgtgcgcaattaaatgtgtga

SEQ ID NO: 25248 - DNA, 374 bp, Zea mays
  Clone ID: cC-zmle189035h01a1
ggaatcaatctctgaactgggtattactatgattattgcgccgcggtgacagatgatgcatggggtgggtacggtagcaaaacacgactgaattcaagcaactacatacagcacaagtcggcattaggcatatgaacagacgcagatacagagacatggatcgtcgtcggcaaggatgactagctagttgttcttggtgatggcgtaaatggcgtaaatgatgccggggatttatccgaggaaggtgaggaggaggcaaatccagaactcgtggccgcacccgtacttgaggaacacccccagcggaggcaggatgatggcgatcaggatggccacgcagttggcagtcccctccgacatgctgccgatgcttc

SEQ ID NO: 25249 - DNA, 548 bp, Zea mays
  Clone ID: cC-zmle189035h02a1
caagcaaacatcgggggctcagctgattttattaatggagacaagagtgggaatggcttcccttgggcatcaccttgctcaacataaacatgatgccaaaaactaggagcagagacagagtagcacgcaagcaggacgaacaaaatcggcaggccgtgcattagtctatctcagtgaaatgtacacaaggtccagccgctagacaggtccatctttatttcacatgatcaaacagccgaaacccgcgcgcgcagatgtgtattgtccgttaagacaattcaagcaagaacattttcgtacacctctccagcatatttccagttcatcaccttccagatgttgttcaggtaatccggcctaacattcttgtactgcaggtagtatgcatgttcccaaacatcaatccccaacagcggaaccaagcttgcacctttagtcaccagaggatcctgattagctgttgtttcaactgaaaagctttttgcctttttatccaaagctaaccacacccatccagacccttgaaaagcaggccttttgtttcattt

SEQ ID NO: 25250 - DNA, 528 bp, Zea mays
  unsure at all n locations
  Clone ID: cC-zmle189035h03d1
cggacgcgtgggcggacgcgtgggcggacgcgtgggcggactcgtgggcggacgcgtgggcggacgcgtgggggcaagctcactggtatgtccttccgtgttcctactgtggatgtctcggttgttgacctcaccgtcagaatcgagaagggggcctcctatgaggatatcaagaaagctattaaggctgcttccgagggtccactcaagggtatcatgggttatgcggaggaggatctggtttctaccgacttccttggtgacagcaggtcgagcatcttcgacgccaaggccgggatcgctctgaacgaccacttcgtcaagctcgtctcgtggtacgacaacgagtggggctacagcaaccgcgttgttgacctgatccgccacatgttcaagacccagtagaggggtttattccccctgcttctcatggatggatgctgcttgtgtatgccgagaataaatgtggatggcccgtgcctctgtgtccccaggtttatgctgagtctggacatgntttgcactttt

SEQ ID NO: 25251 - DNA, 145 bp, Zea mays
  Clone ID: cC-zmle189035h04d1
attactgaaaggatttataatgggacgtcagtttaaaaaaatgctcgacacaaagttttaactacttcaaaagggtggggtactttcaactactttcaatcctatcttttctttttaatcatcaaaaatcctaattcttacaaac

SEQ ID NO: 25252 - DNA, 371 bp, Zea mays
  Clone ID: cC-zmle189035h05d1
ttcagactttcgggggggaaagggacgccggctgatgacgattgtctgggatcgctcacaaacccgttgtgctgaacccttacacctggatagaccatctggtatccatgatctggcttggtaagatcctgcccgcgcggtgactgtctgcaataagagccgtggttggccgtcattaacacgggcgctaccgcgccatttctcccttgggtttgcatggccaacccgtccaggtgcttccactgtctggcgacagacaagcgcctatcgaccgtaacgaccaaacaccgttacgcgctcaccatggacgtcactcgcggggacaaacggaactctagagagttcatggccgccgacaccccagacgtgct

SEQ ID NO: 25253 - DNA, 451 bp, Zea mays
  Clone ID: cC-zmle189035h06d1
gttcgggaatgtgtgcgggcacaatacgatatccaatcgctttgatgggattctgctggcgaatatatccctagtgcggtgaagactgggctacaatatggtcattcaggggtggacatgatggtgaatttctgcatgaattggatcgtagcggatatcaattccactcgggtgtttgacacccaacttatcagtcattgctagtgagtggatgttacgagtctttggaactttgggacatatgggagaagatcaccatgaccttggacagtgcgcatgacgggttggttgcagacctggcatcatgcagtgctacagggaagggtgccgcagtgagacatgatataactctcgagctctggaaatgactttatcatatcgatcggtgggaagacgagtttttatcacaaatgacgacatgacgcacatgaggaaaaggtggctgtcacga

SEQ ID NO: 25254 - DNA, 511 bp, Zea mays
  Clone ID: cC-zmle189035h07d1
ctcagcaatccacacaagcacttcgacgtcacacgggcgctgttcacagacacaccaagcgtcggcaccaatggcttactaccaggaggtggactactgctcggaggaggtgaggtcggtggcctcggccggcttttgtcgtcacggcggcggtgttcatcagcacgtttttaaggagaattttgaggaggttgacacggtctcacgcgccggcgccaaccaccaccaccaccatgttaccacggcggtcacggcttcttggtgcgcgagaccagggtcgaagaggacattaacacctgcaccggcgaggttcacgagcgcagggagagctttctcgccagggctaactgagccgtccggcggtcggcatacacgcccgttcgagcttgcctgcgtgccttatgtatgtctgtggttgactggttgtgcaggggcattgtacttggctatcgtacgtgcacgcactcatcttctggacgaattacgacaattagctcgtgacctgaataaa

SEQ ID NO: 25255 - DNA, 192 bp, Zea mays
  Clone ID: cC-zmle189035h08d1
aggaatttttgggacgacctacccgtccgcgcaatgatattaccgtatcatttagaatagagatcttttattctactagtatcaccaacttactagtgagggaggttgattacttgtctaggactggggggccgtgatgactgtagtagcatgagcttcatcgggtgacgggagctgcgcatatggctgtat

SEQ ID NO: 25256 - DNA, 407 bp, Zea mays
  Clone ID: cC-zmle189035h09d1
gctgttccagctctacttctgcgcggcggggaacggcacgttcatcgactgccccgcgccgcagcagtacacctgctccaaggagatcctcttccaccccttcaagaagtggatgctcaagcagcagctcaaccaggacgacgaccctttccagctgcctggcgtcgccatggacaactgatacaccgtaccgtcgtctctgtttgcgtttctgtcaagtgtgcatggaataatactgtaactgtgtttcctgccgggcaatgcactgtgatatgatgcccaacgaataaatgtcgcttttatttttattcgacttcccccctgtaccgtgtggaaataaacctattataagcatcgtgttgaaactcatgataaaaaaacaatacgctataataataaataaatgg

SEQ ID NO: 25257 - DNA, 65 bp, Zea mays
  Clone ID: cC-zmle189035h11d1
acggaatttttgggtcgacccacccgtacgcaattgactctgtgtatctctactgcgaacttacc

SEQ ID NO: 25258 - DNA, 169 bp, Zea mays
  Clone ID: cC-zmle189035h12d1
gccgacccacgcgtacgctgtctaatttatatatgtgattttttacaatatagtcaagttctttaactgaaataaaaaattaaaacggacaaggggggagactaaaatcacaaccaccccaaaactactcacctctacccctaccgactcaccctgctcacccccatct

SEQ ID NO: 25259 - DNA, 349 bp, Zea mays
  Clone ID: cC-zmle189036a01d1
cgtcgaaagattagtgatgtcaaacttcagggccatgtagattttgctcttatggtgcaacagcagagatcagtggctttgtggcgtttaagagatgccgttctgttgcgccatgtatcaaacgagaagatttctttatctactgcgagggcacctgcctattgatcggatagtcggttctaatccagcatccatcttttgtagttgtggcctagctaatgagttgaaccagtcgttggttctattcgatgaagataactcttcattgcagtcttgcaggaacctcctaggcaatgtgcaatgatcaaaaaaaaaaaaaaaaatgaaaaaaacaaaataaaatataaaa

SEQ ID NO: 25260 - DNA, 639 bp, Zea mays
  unsure at all n locations
  Clone ID: cC-zmle189036a02d1
ccggaaccccgggcaccacgcgtccgcagagagcttcttgcttgcactgcaaatggcagccgagggaggtagcccatacttcaggcttggttacaatagcttgggtgcgtttgccaccatcaatcacctccactttcaggcgtactacttgtcagtgcctttccctgttgagaaggcagctacccacaagatcccactctctgaggacacgaagaagaatggggtgaccgtgtccaagctgataaattatcctgtgagaggcctggtatttgagggagggaacaccctggacgacctggccactgtggtttctaatgcttgcatttggctgcaagacaacaatgtgccttacaatgtgctcatttctgactgtggcaagagggttttcctgttcccccagtgctacgcagagaagcaggctctgggtgaagtgagccaggagctgctggacactcaggtgaacccagctgtgtgggagatcagtggacacatggtgctgaaacggaggatggactatgaggaggcatctgaaacctccgcgtggaaactcctcgccgaggtctctctctccgaggagcgcttcgaggaagtgaaggcgtacatcttcagcgctgctggcctggntcaatatgatgagga

SEQ ID NO: 25261 - DNA, 110 bp, Zea mays
  Clone ID: cC-zmle189036a03d1
cccacgcgtccgctgcttgccagatgcagcaactacttttatatatatatgtgtatattcaataattgtgccacacgaatttgactatgatgcaaacctcttacacaggt

SEQ ID NO: 25262 - DNA, 570 bp, Zea mays
  Clone ID: cC-zmle189036a04d1
cgttatacttgtttgcgaggagtccagggaagtcaggatcacacttcaacccaggcagtgatctgttccaacctactgaaaagaatgacatcataacatcgacggcgtcctggctggccatggttggtgttctggccggtctcacctttctgatgggtcctgttccgatgctaaagctctacggagtcccatacttggtatttgttgcttggctggatatggtcacatacttgcaccatcatggccacgaagacaagcttccctggtaccgtggaaaggagtggagttatctgcgtggaggactgacgacgctcgaccgggactacggatggatcaacaacatccatcacgacatcggaactcatgtcatccatcacctcttccctcagatcccgcattaccatctcatcgaggcgaccgaggcagcaaagccggttcttggcaagtactacaaagagccgaagaagtcgggtgctctgccgtggcacctattccgggtgctggcacagagcttgaagcaagaccactatgtcagtgatacccgagatgtggtctactaccaagctgagt

SEQ ID NO: 25263 - DNA, 87 bp, Zea mays
  Clone ID: cC-zmle189036a06d1
catcaccatgggtggcagtgtcagtgtgagcaatgacctgaatgaacaattgaaatgaaaagaaaaaagtattgttccaaattaaaa

SEQ ID NO: 25264 - DNA, 409 bp, Zea mays
  Clone ID: cC-zmle189036a07d1
gaacaagaagactgtgacgatccagccagctgcaaaggactcggctgtggtcctctctactaccaagaccaagaagcagaacgcacctgcgaagctcagccacaagtctgtgatgcgcaaggagttccgcaagatggccaaggctgtgaaaaaccaggttagtgacaactactacaggcctgatctgaccaagccagctcttgctaggctaagctcggtgtaccgcagcctccaggttgccaagtccggtgtcaagaagaagaacaggcagtcctaagcgctaagtttgtgttctgtcagggggcatgttggtgctcgtagtcccagcttatatttatctatgttccaacagttgagacttgttagaactgagcaaaccatgttaagatgctgctgtgtgtcattcctt

SEQ ID NO: 25265 - DNA, 392 bp, Zea mays
  Clone ID: cC-zmle189036a08d1
cccacgcgtccgagttatcgcgcatcttgatcacaagagcttcaagggctggcagaagaatgctgttacatgcttcttgcaggagcagaacatcaggataggaaagcctagcgatttcctgtgacgtgctacgacagtgctggacaggacaggtggagaggctgtgaatgcttgagctgatttccctatgcgcacgctgaataaatatgagacataggggctgtttggttcgtggctaaatgtgtcatactttgcctaaggttagtcgttcgaattgaataactaaccttagttagaaaagttagtcaaaatgtggtaaattaggctcaaaccaaacagccctatagtaagactcgatccttaatgcggttcaagagcttgaatttgccgtt

SEQ ID NO: 25266 - DNA, 588 bp, Zea mays
  Clone ID: cC-zmle189036b01d1
acgcgtccgggcggagtgctccgtcgacctcaagctcggcgggctaggcgagatttgggcggtggaccgcacaaccacgaaggagcgggtggctgcaaccgcagctccgtccgccaccccgatgaagcgcccgcgcttgcggcccggcggcgccggcggggcacagtgcccgtcgtgcgcggtggacggctgcaaggccgacctaagcaagtgccgcgactaccaccgccgccacaaggtctgtgagacgcactccaagacgcccatcgttgtcgtcaccggccgcgagatgcgcttctgccagcagtgcagcagggttctatattcataagcatgttgttgcaccacacaacctttttgttttatatgttgtcatctgatctctggtgaaaaggagggagatgagctacggaggaaatctgatgttatggaattctaagaaaagtctagatttccacaggtccagtggtgccactgatgtcaagtcagcagaaacgattcttgagcatgagtatgcgtcgatgctctatttccctgaggcaatgctactcctatgcacagtgatgtagtagcaacggagaactgtca

SEQ ID NO: 25267 - DNA, 504 bp, Zea mays
  Clone ID: cC-zmle189036b02d1
ggtgctgaagcgaaaagagccagagtcaggttgggatttgtacccacgtcgttgagcgtgagcctgaaggtttgttgcagtcgcaatcgattttgtcccactctcttaaaaaggatatgttcaatgctccgtttatggcggcaccttggacattgtattttagggtatttctttggcacgggcccagttctactaggtctgaagacatacacggagaactgaataagagatcagctacaggtagatttgacagatgttgacatggcaaggacattgttagctgctggaaaccacctcgtgtagatctggttctttgtgaatgtattagctttgttttagttgacataatatagccaaattgctctctagggagctaaattatgtaaatcatcatcgtataactcatagatgaaatgcatccctttttatctatctttatttttccagtgttggtgcaagttgtactgtgatcaactatattgtatatatgtcattgtttggaaa

SEQ ID NO: 25268 - DNA, 578 bp, Zea mays
  Clone ID: cC-zmle189036b03d1
gtcgacctacgcgtccgctcgttcgttccaaacggagaagaggatcaggttcgttccaagggaaaggagattagggtcaggagagagagagagagagagagagagagagagagagagcccttgctcgttcgttcaccaccacagctccgatcgatccgcaaggcaggcaagatgtacaacgcgccgtcggcccaggagatgtcctacttggagcacgtgcagaggcgccacgaggagaagggctgcctctacgcctggtgagctagctagacctccgtctccgtctccgtctgctctgcctgagttgatcagagaagaaaaagagatcggaggaggggtttcggtccgccgccagctcagtttcagtttcagttgccatggcgttgccttgctccttgtcgatcagtttctttgtcaccagcacaaggccgcgcgccgcttcctgctggagtgttgaactaactgactgctgctcctctgctctgttgttgcgcagcatcttcactgcgctgtgctgcttctgctgctacgagacctgcgagtgctgcctcgactgcctctgctgctgctgcaactag

SEQ ID NO: 25269 - DNA, 685 bp, Zea mays
  unsure at all n locations
  Clone ID: cC-zmle189036b04d1
gcttctcctcccccaccggttcgtgttcaggttctggttcgtgggcgagagggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgtggaggcggcggtggcggatacggtggcgggcgccgtgatggaggcggctacggcggtggcggtggaggctacggcggtggtcgtggaggctaccgcggcggtgggggatactgtggtgcaaaccgcggcggcggctacggcaacaacgacgggaactggaggaactgagcggtggggtccgctgaggcctagttatcttgttcgcttctgtaccgngtcaccctagtctagaggggttatcttcgctgggtcgctcgtgtcgatgttcgttcggtcgtgtgtgtgccatcggttttgacgagtcctcttgagtgtaggagctacatgcatccagctgatggctcacgtattattgct

SEQ ID NO: 25270 - DNA, 513 bp, Zea mays
  Clone ID: cC-zmle189036b05d1
ctacactaccaccgtttcagtgctataggataggattttcttttgacggccatgaaaccccctcagctgccggccggggagcgctcctgggctcacgaggtcaagcaggccctccgtgagaaactccggcgctcctacggcgccgcctccgccacaccggcggccggtgaaccgagccgtggcgccgactgccgtggctcggccgccgaggaccccataaggagagtcatgttcttggctccctggggccacacataaaacacagacccagatctgggcttgcaagagcatggccggatctgcagagaactgctcaaccatacttaaaaggaactggagcttgtcttgtaaactatggagcatgctgcttgcaccacgaacatgaacgcatggctggttaactaggtagatatatgggtgtggatggggacgagagaaaaaaacaaggtatgtagtccaccgacgtctctgatcttggatggagaggcatgagatcttgggatgctcatgcat

SEQ ID NO: 25271 - DNA, 464 bp, Zea mays
  Clone ID: cC-zmle189036b06d1
tcgtcgtcttgcagccccgcaacagtcgttagcttagagcatcgtacctcatcgttccaccgtccgtccgtccgctcgttcgcgtgatctgtttgagagttggggaatggaggcctacgtcctgttcgcgcccgccaaggaggtgatcaggttcgaggagcaggaggaggacatcggctgcccgtccgagtcgtccgcggcgcgttcaacgtcgtcgtcctcctcctcgtcagacggggtggacctcgccgacgacgccagctcgtccgggtccagctgtcacttcgagatggcctccctcatgacgcagctcccgatcaagaggggcctgtccaagttcttcgacggcaagtcgcagtcgttcgcgtcgctggcggcggtcggcggcctcgaggacctgcccaagccgccggcgaagcggctaagacgtcgcggagctgcggcgtcggcctcgaggacgcgca

SEQ ID NO: 25272 - DNA, 546 bp, Zea mays
  Clone ID: cC-zmle189036b07d1
ggcaagattgctgatgtttggtcatgtggtgtaaccctctatgtaatggctgttggtgcatatccttttgaagacccagaagagcctaagaacttccgcaagacaattcagcgcatcttgaatgttcagtacgccattccagactacgtgaacatatctccagagtgcaggcatctaatttcgaggatttttgttggtgatcctgctatgcgaataacaatcactgaaatccggaatcatagttggttcctgaagaaccttcctgctgatcttatggatgatgatagcatgagcaaccaatatgaggagcctgatcagccaatgcagaccatggatcagatcatgcagattttaacagaggccaccataccacctgcctgttctcgcagtataaatgttctagctgatggactggacatggacgacgacatggatgatcttgactccgattcggatcttgatgttgacagcagcggtgagattgtatacgcaatgtgagtaaccatctcaccagtcaaccaaaaccaatcaggcatgggacaccct

SEQ ID NO: 25273 - DNA, 557 bp, Zea mays
  Clone ID: cC-zmle189036b08d1
cccacgcgtccgatcgccgtcgtgctgggcatcaaggtcaccgaccactccgacaacctgggccacggctgggccatcatggtcgtcgtcatggtctgcaccttcgtctcctccttcgcctggtcctgggggcccctgggctggctcatccccagcgagaccttcccgctggagaccaggtcggcggggcagagcgtcaccgtctgcgtcaacctgctcttcaccttcgtcatcgcgcaggccttcctctccatgctctgccacctcaagtacgccatcttcgtcttcttctccgcctgggtcctcgtcatgtcgctcttcgtcctcttcttcctgccggagaccaagaacgtgcccatcgaggagatgaccgagagggtgtggaagcagcactggttctggaagcgctacatggacgacgacaaccaccacatcgtcaacggcaagctcaccggcgcctccgtttaactactccatctgctctggtcatgcatcagactcacttgatagtactacagtactactactgcaacaccgcaagtccgcaaccgcaatcc

SEQ ID NO: 25274 - DNA, 453 bp, Zea mays
  Clone ID: cC-zmle189036c01d1
cgaccccgcgtccgcggacgcgtgggaaaaaaaataaaaataaaaaaaaaaaaaaaaaattaaaaaatttaaaaaaaaaaaacaaaaaagagggggtggggggggccttttttgtggcccctaccttgcttgcgcgtgccttgcttgttgttcgcttttttcttggggggcttattttcagttgtctgcccgggacttttgcacggccctcctgggaaagccctgtggtttccaccccttttcccctgtgctgggcgtccccctttagccgcctgaggttgtcccatccggcctcgccacgcgcgtctttccctaaagtggcccagccttattgtcatttgggtcgcgctgtgtctcggggccttttccgcggcggttgtggttttttctctcagtgggaccggtgcatttgccagtgccgttgcatccgttcctttcgttttttcccttctt

SEQ ID NO: 25275 - DNA, 401 bp, Zea mays
  Clone ID: cC-zmle189036c02d1
cccacgcgatcgctcgcggtctcgactgcactcacgaccggggattcatgccaggggctataccgggggctcatggggggattcaggcatgtcatacgccaactctgaccgatgacttcggagatcattccggagtacaaactggaggacgaacttgaggacatgctcggggagctgcacctggtgcagcagctaaacaagcgggtgtacaagcctgtgtccaagctcgcgaccaagggcgcgatcgtgctgaagaaggcaatgcaactatcaaagcaactggcaaacggaccgctgcacgagccacatgtagggagatctggaaggagagcaactaagctggggtcaccgcggcggataccaaagcataaaaaaaaaaaaaaaaaaaaaataacaataac

SEQ ID NO: 25276 - DNA, 494 bp, Zea mays
  Clone ID: cC-zmle189036c03d1
gcgtccgcccacgctgacgacattgctgatgacttcttcccgctctgcgacattgacggcgtgatcgtccacatgtacctcccgagggaccgctggactggctactcgcgcggattgtacttcgtcagggacaaggaccaggacgaggcacataaggtcgatggtagactcgatggcagattggtaatcatgaggcagatcatggtgcactgtgccaaggccggaccaaatgctgaacggattattatggggccaattatggagccagtggcaaggcccagaggtcgttctacaagacggaggccccgacaggagtatcgtgatgattatcaagatgactaccatgataggcattatcgaaagcgaagccgaaatcagtgcagacatggctactcccgtgacaggtactgccatcgggattaccggcatcgtagcctgagtcctagactgactactgctcgaagtagccgtagtcatagtcgcactcgcggtta

SEQ ID NO: 25277 - DNA, 590 bp, Zea mays
  unsure at all n locations
  Clone ID: cC-zmle189036c04d1
ccgcgccatcctcgaggcatcgccggcgccgcaacttcgttcaggaggaagcccgcacccggccccgatccgatggccaacagcaacctcccgcggcgtatcatcaaggagacgcagcgactgctcagcgagccagcgccggggatcagcgcgtcgccctcggaggagaacatgcgctacttcaacgttatgatccttgggccggcgcagtcgccctatgaaggtggagtttttaagcttgaactctttttacctgaggaatatcccatggctgccccaaaggttaggtttctgaccaagatttatcatcccaacattgacaagcttggtaggatatgcctcgacattctcaaggacaaatggagcccagcacttcagattcgaacagttcttttgagtatacaggctctactgagtgcaccaaatccagatgaccctctctccgataacattgcaaagcactgganatccaatgaggtagaagctgttgaaacagccaaggagtggactcgcctgtatgcgagcggtgcatgagagcgcagtgctgttctttgtgtaataaccccatcatacttcagtcctaatcccgt

SEQ ID NO: 25278 - DNA, 541 bp, Zea mays
  Clone ID: cC-zmle189036c05d1
gcgcttcgtcgagtacttcagatcggctacaccggagaccgagtacgggaggatgaacatcggcagccggccagccaagaggaggcccggcggcggcatcacgaccctgcgcgccatcccctggatcttctcgtggacccagaccaggttccacctccccgtgtggctgggagtcggcgccgcattcaagttcgccatcgacaaggacgtcaggaacttccaggtcctcaaagagatgtacaacgagtggccattcttcagggtcaccctggacctgctggagatggttttcgccaagggagaccccggcattgccggcttgtatgacgagctgcttgtggcggaagaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaac

SEQ ID NO: 25279 - DNA, 522 bp, Zea mays
  Clone ID: cC-zmle189036c06d1
ctttctaatttatatttgttatttttttcaatatagtcaagttcttgaactgaaaaaaaaaaaaaaaaaaaaaaaaaggaaaaaaaaaaaaaaaaaaaaaaaaaaaaaaaaaaaaaaaaaaaaaaaaaaaaaaaaaaaaaaaaacacaaaaaaaaaaaaaactacgtcccctcacactagacgcaaccatagaaaaaatgtaaccaaaaaaaaaaaaaaagggggggggcgtttaaaaagacttactctatcccgcgcgccttgtgcgaaataatcttctttttttagggggcgagaaaacaaaaacgccgggcccgtattatcacccgactgtatggaaaaccccggggtccactcaatataatcctctgaaaaaaacatccatctttgcccggtggggggaataaaaaaaagggtacatcacttctccccccccacacagggtgaccacctttatggctaaggggccccctccttttggggccgcataacaccggggttgagggggggtccccccggggg

SEQ ID NO: 25280 - DNA, 579 bp, Zea mays
  Clone ID: cC-zmle189036c07d1
cctatgttctctccgagtcaagcttgttcatctatcctctgaagattgtcatcaagacctgtggcactaccaagctcctgctcacaattccaaggatcctagagcttgctgaagagctgtctatgcctcttgctgctgtgaagtactcccgcgggacgttcatctttcctggcgcacagccagccccccaccggagcttctccgaggaagttgctgtacttaaccgatactttgggggcctgaagtctggtggcaatgcttatgtgattggagatgcagcaagaccaggacagaagtggcacatctactacgccactgagtacccagagcaaccaatggtcaaccttgagatgtgcatgactggtctggacacgaagaaagcttcagtcttcttcaagactaatgctgatggcaacacaacatgtgccaaggaaatgacgaagctctctggtatctctgaaattatccctgagatggagatctgtgattttgacttcgaaccctgcggctactccatgaatgcaatccatggctctgcgttcttcacgatccatgtgacgcctgaggatgggttcagct

SEQ ID NO: 25281 - DNA, 577 bp, Zea mays
  unsure at all n locations
  Clone ID: cC-zmle189036c08d1
cccacgcgtccgcactgctcagctagcgtccacctccacttcctatcgccatctctccccctttcgtcatccttctctctcctctgccatcgcgtccgccgccccaccgccatccgcgccgaagctgaagtgcggcctccgctacctgtctccgcggcggagtcagagccccctgacgccggcgctgtggaagccgaaggtcagggacccgtggagctccgcgctccgacgctcttctcgactgatgacaatcccaccccgctccagactgccaccagtctcctcctcaccggcgccatctcggtcttcctcttccgcgccctccgccgccgcgcccgccgcgccaaggagctcagagtgcggtcgagcgggttgaagaagcccaacaatctcaccgaggaggccctggagaggctgagattgatgagcgcctcaccgatcgagaccgagaaggcaacttcgcccatccaggctctgctcggcgggattggcggcggggtcatcgcactcatcctctacaagntcagcaccacagtcgaggctgcgctcaaccgtcagaccatctccgacagcttct

SEQ ID NO: 25282 - DNA, 590 bp, Zea mays
  Clone ID: cC-zmle189036d01d1
cccacgcgtccgcccacgcgtccgcccacgcgtccggaattcttaattcatgagttgtagggagggacttatgtcaccacaaacagaaactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtatttggtttcaaagccttacgcgctctacgtttggaggatctacgaattccccctgcttattcaaaaactttccaaggtccgcctcacggtatccaagttgaaagggataagttgaacaagtacggtcgtcctttattgggatgtacta

SEQ ID NO: 25283 - DNA, 486 bp, Zea mays
  Clone ID: cC-zmle189036d02d1
ctcatgcgtccggccactcgaccgggggcggctgttccagtacaatcgtgggagcactcgcagtcacctgtcacagcgggccacggccccaccctaacggtctaacctcctcccgctacacgcacgcgcccacctacccataacgaccgtgcgcggggccctgctgcgcgggagccatcatcatcatcaccttggcggaccataaccacgactatcggaagctgatcagctcccggccccagcaccgcgagctgccacggcaatggacccggtcgtggccggaactagcggacgcggtggacccggatcgaccgcggtcaccgggggaggctatgagtgcgctcaggcagggactaacgggggcgagcggccggaccggcatcagcgcatcctgggggactgtgtgcgcgccaagggtcggaggcctagctaccacgacgccgctcgtcacctgcgcagggatcttgaggagaggggcatagacct

SEQ ID NO: 25284 - DNA, 450 bp, Zea mays
  Clone ID: cC-zmle189036d03d1
cgcacgcgtgggcgcatgcgtagcttccacaagcagctagggtgtgtacatgactaccgacgcgcgccccacctgggcgcccggcatggacgacaacaagcaggggggcacccgtatgtttgggccgtcccagaaggtgttctaccaggagctgggcacgcacacctccctgaggccaagaaaagacggtcaacagacccaacaggagttacagaaaacgaatctcacggaggaacttgaggaacgtgagcgcaagcactactcttgcaaggataaatactatgccgataaaagagaccggcggaaaagctatagccatctactgttagaaggttcatatggagagacagaggataagataggttcacgagaaatcgatgctgctgactccgatgtggagcctaaaagcgatgacgagagctatgaatatgataatgatgacaacacctg

SEQ ID NO: 25285 - DNA, 504 bp, Zea mays
  Clone ID: cC-zmle189036d04d1
cccacgcgtgcgccgacatcgttccttcgtccccacgagcaaccgataatccgccggcgttgagatgctggtttatcaggatctcctatctggcgaccagctcctgtcggattcattcacctacaaggagctcgagaacggcgtactgtgggaggtccagggaaagtggctcacccaaggttctgttgatgtggacattggtgccaatccatccgccgagggtggtgaggaccaaagcgttgatgacacagctgtgaagggggttgatattgttgacacattccgtctacaggagcaacctccttttgacaagaaatcatttgtgtcttacatcaaaaaatacatcaggaatctcactgctgtgttggagccagagaaagcggatgagttcaaatagggggctcagggtgctaccaagtttctccttagcaagctgaaggacctgcaattttttgctggtgagtccatgaaggatgatgcgtctgtcgtatgcgctattacaag

SEQ ID NO: 25286 - DNA, 359 bp, Zea mays
  Clone ID: cC-zmle189036d05d1
aaaaaaaaagaaaaaaaaaaaaaaacaaaaaaaacaattcaaaaatttaacaacaaaaaaaaacaataaggggggaagggggaaagtatacaccattgtgttggccccttttatgacaccagtttctttctttgtgtactgcgcgggctcctgtctattggggggattttaggttcttttccgggctccatcctttgaagctctggcctggctaatgacttggaccaccccttttgtctgtttggtgaaaattcctctttattgcggccttgttagaacctcctaggccctgtgcactgctctgccaaatggtgcccctttttgattggcttttgtagccccccttttggtgggttttt

SEQ ID NO: 25287 - DNA, 445 bp, Zea mays
  Clone ID: cC-zmle189036d06d1
cggacgcgtgggaccagacactccaaacacttgcgccgccactgccttacaggtaaggccgtcatggtctccggcttgggcgtgtgtgcgaagcgcatcgtggtggacgcgcgccaccacatgctgggccgtttctcctggatcataggcaaagagctgctcaatgggcagaaggaggtcgtcgtacgctgtgaggagatctgcatgtggggcggtctcgtccgggagaagatgaagtaccttcgctaactccgcaagcggatgaacaccaagccgtaccacgggctccatccacttacgagcccccgccaagagtcctgggcgcaccattcgcgggatgattcctcacaagaccaataggggggaggcggttctggcgaggcttaacacttacgagggcgtcccggcgtcttacgacaagaccaagcgtatgggcatccctgac

SEQ ID NO: 25288 - DNA, 583 bp, Zea mays
  Clone ID: cC-zmle189036d07d1
ccctggatcttctcgtggacccagaccaggttccacctccccgtgtggctgggagtcggcgccgcattcaagttcgccatcgacaaggacgtcaggaacttccaggtcctcaaagagatgtacaacgagtggccattcttcagggtcaccctggacctgctggagatggttttcgccaagggagaccccggcattgccggcttgtatgacgagctgcttgtggcggaagaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcgagtacccgccccggctggaagacacgctcatcctcaccatgaagggcatcgccgtcggcatgcagaacactg

SEQ ID NO: 25289 - DNA, 610 bp, Zea mays
  unsure at all n locations
  Clone ID: cC-zmle189036e01d1
attgaccttgaggaccgggcagaggagttgttggtgtcgcttgatccatccaaggcaaatcctaagaagctcccaaccccacctcccaagaggcgcctgggaattaacatgcttgatgggaggaacaagctagtagagtacaggctgccaccaaagattgaaaagaaggtggtcaatgagcagaggtatgtcccagacacaagatatgtgctccatgacattgaccaggaggccaaggaacaggcattgctgtaccacagtgagaggctggcaattgcttatggtctgattagcactccagcaagaactccacttcgtatcattaagaacctgaggatatgtggtgactgccacaacgccatcaagatcatgtcaaggatcgttgggagagagcttattgtgagggacaacangaggttccaccacttcaaagatggaaagtgctcctgtggagattattggtgataatggattaaagccgctcttctatcctttatatggagctgctggcagccatggtttcagttgataataagcaatatgaaggtatccaatgggtgttgctagtatnttgtcatccttaaatattcttaagatacttagctgcaag

SEQ ID NO: 25290 - DNA, 441 bp, Zea mays
  Clone ID: cC-zmle189036e02d1
cggacgcgtgggttctgggcgccgtggtgcgggccgtgccggatgatcgcgccggtgatcgacgagctggccaaggactacgccggcaagatcatgtgctgcaaggtgaacacggacgacagccccaacgtggcctccacctacggcatccgcagcatccccaccgtgctcatcttcaagggcggcgagaagaaggagagcgtcatcggcgccgtccccaagtccacgctcaccaccctcatcgacaagtacatcggtagtagctcatgagcgcgcgagagaggcagcccatgtctcgtgatgtgcccccgagctgcatctgcatgcatgggatactgggatcgatgatacatgtgcccagctcgcgcataaacaccatgtatctctagccttgcccttgcatatatatggatggatatatgatatgaaaaaaataaatat

SEQ ID NO: 25291 - DNA, 528 bp, Zea mays
  Clone ID: cC-zmle189036e03d1
ggtcgacctacgcgtccgcccacgcgtccgcggacgcgtgggcgatcagagatagcaacccaagtcaccttttacatgatcccagccctgcttcttgcctccaagaacagcataagtacctcccttctggtcggcgccgtgttccatcaagtatacatgttccacaaggagattcttctggactacgtgcaccatgatatcaccagaaagtgggctttgatttacttcaagctgcttttgctggtgatggcgaaggacaccatcatgtacttcaatctgttctaagctcaccttctcagtttctcaaatatccagcaatgcatccgtctctgcactcgtagaataatgatgatggatgaattatgcagccttcgttcttgtattctccctaatgagcttgcttttttccagctgccagtttcactcttattaagtatatcagtctggatgggattgatagtgaccagtcagatgatatccctgattctgcacctcattaataatatgattaatgtcaattgtgcaaaa

SEQ ID NO: 25292 - DNA, 473 bp, Zea mays
  unsure at all n locations
  Clone ID: cC-zmle189036e04d1
cggacgcgtggggtatgtggcttggaggagaaactttccggtgttggagggcgaagagctcgaagttctaaaggtaacgcctgccgggtgcttggtggaacgtctcaaccggaggttgttgtcgatctctcgaattcgaggcgatttagttgtggtacgttaattaatcacgtgagttggagggcaagagttggattaatctcaaggtgaggctgacgattgaacatgaagatttgatgatctagtcaaataccaggaggagagatgctcaccaagtggtcgtcatttaacaacactaacgtagtgtttatcccaggcaagccctggtgtatttgccacttccttgttgttttaaaacttttatcacttatatgctgcattaggtgataggagttgagtgatgaaacagttgatgcattgccattccttggaatttgattatcttccttgatacctcttttataaaanaaaaa

SEQ ID NO: 25293 - DNA, 429 bp, Zea mays
  Clone ID: cC-zmle189036e05d1
cggacgcgtgggcgaccccttggctcgacggcaagcacgtcgtcttcggccaggtcgtcgagggcatggacgtcgtcaaggccatcgagaaggtgggcacccgcaacggctccacctccaaggtggtcaaggtcgctgactgcggacagctctcctagatctctctgatctggtctgttcggccgccctccctccgtcatcgtcgactccccctgcgtccgttcctttggatctgaataagatggtggtgatctgagtggtggtcttagtttatcatgtatcgctcgcagtttaatttagcggtttaggtgtggatctgtgaaccccatggcgcctctgcttgattcgtgtttcacctgttatgttctgagattcatgataatgctatgagaactgaaattcccgtttcataaaataaaaattaaatat

SEQ ID NO: 25294 - DNA, 61 bp, Zea mays
  Clone ID: cC-zmle189036e06d1
gacctcttgtattgtagtccagccttgttctgattctctaatgcatgaaggtttgaatctc

SEQ ID NO: 25295 - DNA, 505 bp, Zea mays
  Clone ID: cC-zmle189036e07d1
gcccacgcgtgcgcaccactccgcgctagctgaggacggtgcagcggggcagaggtgcgacgtacgacgacgacgacgcaggcgccacacatggcatcccagctctccgccgccgtgccccggttccacggactccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtcggcgaaccgcaaggcgacggcggggctgaagctggaggcgcgcgactccggcctgcagacgggtgaccccgccgggttcaccctcgccgacacgctggcctgcggcgccgtcgggcacatcctcggcggcggcatcgtgcttgggctcaagaacaccggcgccctcgaccagatcatggggctagatccctacg

SEQ ID NO: 25296 - DNA, 514 bp, Zea mays
  Clone ID: cC-zmle189036f01d1
gactagtgctcggacacgtgggccgaacccgcaccaccccgcgccgtggtcataaggaggtccttaaccgagcgcgcctatttccgtaaggccatcggcaccgtcatcacggtaatggctgacaactccctgcttgccggcggtgccatgggccaggaggcgctgttggacgcaggccacggcaggctcgtcttcaagcccagccagggcaccggcaagggcggcgacaccatcacattcaagaacaacgcacgcttcccgcacaaggtcgacttgcacgaagacgaggtgccgagcggcgtgcacgccaccaagatctaccaggaagagtaccttaacgcgccaggcgagacctactgcgtcaccctcaccgtgccaggaacctacggcttctactgcgagccacatcaacgagcccgaatggtcggtatgatcaccgcaaactcattaaggtaactatcgatcgatatgcagtcatgtattagctgctgctgcctgctatgaactccaccga

SEQ ID NO: 25297 - DNA, 522 bp, Zea mays
  Clone ID: cC-zmle189036f02d1
cgatacagaagaaaaggttaagttgaggctggagacttattaccaaaatatcgagtccttgctatcaacatatgagaacattattgtgaaagtgcaaggagatgccacagtggatgctgtctttgctaagatcgacgagctgctgggttctatcctggagaagaaaaatgaaatggtttccagcacatgagcaaggtaaaaatgattgggtgcagtgcagatccgacaagttcatgtaatgcaagtcacctctcatgataggaacttctccaggggaatatatctgaagcacaggacgacacgtacaagtaatgtaagccagtctcacgtaatggaaatttctccatgtggatgtggtcaaagcataggaatttttttcctccaattattaactgtacgcgaatggaagcgacagatcattcgtaggttgtgagggcttcagagatcatctgctgctgtacatgatttgttgctgtcttgtgaacatacatgtcttgttgtttctcaactggaggaatgctg

SEQ ID NO: 25298 - DNA, 625 bp, Zea mays
  unsure at all n locations
  Clone ID: cC-zmle189036f03d1
caccactccgcgctagctgaggacggtacagcggcacagaggtgcgacgtacgacgacgacgacgcaggcgccacacatggcatcccagctctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtcggcgaaccgcaaggcgacggcggggctgaagctggaggcgcgcgactccggcctgcagacgggtgaccccgccgggttcaccctcgccgacacgctggcctgcggcgccgtcggccacatcctcggcgtcggcatcgtgctcgggctcaagaacaccggcgccctcgaccagatcatcggctagatccctacgtcgtcgttgttaagatcagactcagcagcctcgatcgcgccgtcggccgcaggtgcctgcaggtggtgactatgtaacgtgtgtgcgtgcgtacgtgtacattgcatncatcttggttccaatggacatatagc

SEQ ID NO: 25299 - DNA, 455 bp, Zea mays
  unsure at all n locations
  Clone ID: cC-zmle189036f04d1
ggcggcggcggtggatacggtggcggcgactatggtggcaaccgcaacaggggtggtggtggtgattatggagttgctggtggaggtggaggcacctttactgctggaggtagcgacagctttgccaacagtaactttggttctgacagtagttttggtggaaacggtgctggtggctttgatgcaaccggcggttccacaggcgatgatgggttctctggcacacctgatgataactttggtggtaacaagaatgaagaaaccatggatgatatcttcaaggacgatgagccggacagctacgccgacaagaggagctagtttgtgccctctccaaagagtgctcatcaatacgattccagaacgatatgtattggctagtgtttgctgttaacatcatagcggcctgtatgttcaaataatggagcgagtatttctgatgagtttgngtttcc

SEQ ID NO: 25300 - DNA, 595 bp, Zea mays
  unsure at all n locations
  Clone ID: cC-zmle189036f06d1
catcgatctacacacatacatagtttcttctactacacgacgacaaacatggggaagcctgcgaagatcggagagtggggtggatacgccggcgatcgtcgggatctgagggctactccggaccggctgatcgaggtgaaggtcacggcggacaacagcagctgcatccgctccatctccttcatctacatcggagccgatggcaaaccgtacgaggaggggccatggggtttcggccatgctggcacggagtacaagattgatctgtgcaggttcgacgagagcttgacggagatctccgggaccacgggcccagcctacaacattgacaatctggtcaagtctctcaaattcgtcaccaacaaacgcgcttacggaccgtacggcagggacgagggcaccccgttccgtgtcaaggtgatgaacaacggccacgtcgctggcttctttggccgctctggagattgcctggacgcgatcgggctctacgtgaaccccaactaataactaaaacgatggatcggatcatctgcatgcatgcatatgcagtatgcatgctgctngcctgcctgtaacgaatatgaatgcataaaat

SEQ ID NO: 25301 - DNA, 590 bp, Zea mays
  unsure at all n locations
  Clone ID: cC-zmle189036g01d1
gcgacagcaacagggaaactccccgctccccagccggcaaacgccagccccgcgacggcgccgcgccgtcctctcccgaccgacggcaacggaaaccccggtgacttctgatacaggaagattacttttatctatactccaccttctttcgtggctatggcactagcagctatctataaccttttcatcattaacaaatctggcggccttatatactacaaggactatggttcagcagggaggatggataccaatgacagtttaagattagcaagcctctggcattcgatgcatgctatctcgcagcaactgtcccctaccactggctgtactggcattgatctcttacaagctcataactttgatctccattgctttcaatccctcacagggacgaaatttttcgtcgtatgcgaaactggagctccaaatatggaaatgctgctgaaagcgatttacgagctgtacacagacttcgttctgaagaatccgttctatgagatggagatgccgattcggtgcgagctgtttgatcacaacctggctcangtgatccagaaggaccgtgttgcgcttctggggtcgtgaaa

SEQ ID NO: 25302 - DNA, 514 bp, Zea mays
  Clone ID: cC-zmle189036g02d1
cgcgtccgcccacgcgtccgtccaaataccagaacttcaaggcctcatccagtatcagaatcccccaatcgatctctgtggactggggatcagggaggccatgcacgtcctgaactacgagctcaacaaccgaagaaagatcgtgagatccactggtcgccgactccaggctatgatcatatcaagcgcccgcaccccagcaaggctgactgctgccgtcgagcagtacctcatggaacacggtcttcagtacacgcaggcgcaaccaggcctcttccgcgtcctgctctagtgatggagccggcctagctgttgtcacaaagacgagaaagaagaaaaaacaagttgtacttttgtatatggcaaagatggctatcaggatagaaaccgttagatagctcatgcattcacatatcaggctttagcaaatgtatacatcttaaaatttgcggagttaggtctttggtgctggtggatgcataaggggatagcattttaaaatcatgtgcttgtt

SEQ ID NO: 25303 - DNA, 582 bp, Zea mays
  Clone ID: cC-zmle189036g03d1
cccacgcgtccgatgaaaatgaacagggagaagatgttattgctatcctgccctgggaggaatggtgggagtttgaagtgacaaaggatgactcaaatcctcagattgcactgcttcctttgcatccagatctgcgggcaaaatttaatgagacagcagcttggatttatgcaaaaagcatggaggggaaaccttatgggtatcacaatatgatatttagctggattgataccatcagtgataattatccaccaccattagatgctcatgtggttgcttctgttatgactgtatggagcaagcttcaaccagagtatgctgctaatatgtggaaagaagcccttaacaaacggcttggaactaagggtcttgacctttctgaaatcatagtggaatcagagaaacgtgggataacatttgacaagttactatctgttcctgagaacgatagctgggtctatgaagatggtcagtcagcatcttgtgtggctttcgtccttatgatgtacaaggaggctggactctttgaccctattaccagctctattgaagttactgaattcacaataaaagatgcttata

SEQ ID NO: 25304 - DNA, 551 bp, Zea mays
  Clone ID: cC-zmle189036g04d1
aattctgggtcgaccacgcgtccgcccacgcgtccggctggcgataaaggactacccgtacgcggtggacgggctcgacatgtgggcggcgatcaagaagtgggtggctgactactgcgccatctactacgccgacgacggcgcggtggcgagggacagcgagctgcaggggtggtggagcgaggtcaggaacgtggggcacggcgacctggcggacgcgccgtggtggccggcgatggactgcgtcgccgacctcgtggagacctgcgccaccgtcgtctggctgagctcggcgtaccacgcgtccatcagcttcgggcagtacgactacctgggcttcgtcccgaacgggccctccatcaccacgcggccggtgccgggcccggacgccggggcggaggtcacggagtcggacttcctggcgagcgtcacgccggtcaccgaggcgctcggcttcatgtccatcgcctcggggccgatggggctcaagggcacggaggtgtacctggggcagcgcccggacaccgagcagtggacgcgcgagcggaggg

SEQ ID NO: 25305 - DNA, 449 bp, Zea mays
  Clone ID: cC-zmle189036g05d1
cccacgcgtccgggaagacgccggtgcggatgaaggcggtggtgtacgcgctgtcgcccttccagcagaaggtgatgccggggctgtggaaggacatcaccaccaagatccaccacaaggtcaccgagaactggatctccgccacgctcctcctcacccccgtcgtcggcacctaccaatacgccatgtggtacaaagagcaggagaagctttcccacagatactaaatgggatgtcctccaagttgctgcggcttgtcgcagttgaattttccatgatgggttgtataatctgtcaatgtcatttctttgctcagttttagttcaacccattttcacctttccatatgcatatacggtatctgtgcctggcaaacatattttgaggctagctaaatatgaaccttttgtctcttatgttgttaaataaagcaaattatctgacaaaaa

SEQ ID NO: 25306 - DNA, 536 bp, Zea mays
  Clone ID: cC-zmle189036g06d1
cccacgcgtccgaaagaacatgacagaagcacatgaaccgcgttgtcacagatttcaagaacaggcatcagggttatgggataagattcaatcacccgccggttcaccacctaaataaacagccttatcactaacatgaaatagactgccttagcactcggatacaaagcataagaggagcagttcccttggcaagcacagatacttctacctaattatctatactgcttcaggaccaagacaccatcattgccgccgtcttgatacttagacacgcttgggcggcacatactgcacgttgttgtcttgacaaatcccttgatactcttctggaagctcctccgagacagcaagtgtatagcacccaggaatgaacctgccaattctcaaccaacgggctgcccagctcctactggggtccatcagagagataattccagtgaagttgggggtggtgcagttgacgacgttgtcgtgctctctgtccatctctagaaacgggcagttttcgcagccgttctccctgaactggtcgt

SEQ ID NO: 25307 - DNA, 279 bp, Zea mays
  unsure at all n locations
  Clone ID: cC-zmle189036g07d1
aagcangcagatctaagctccaggcagcgtcgcgacagaatggagctaatgagtagccccaacaacaccaggggcttccttgaaggccgcaaacccaacggagttgccgggccaggcaaggagcccgcgcccaaacttcaggaaaacgggaacaaacccgcaggccgcaagagccgcggcgttaagaaggctgagcataaaccccgggaaaccaaaaggaagggtgaaaagcacaaaccaggcggggggggccaaaagggacggaccgttccggggggg

SEQ ID NO: 25308 - DNA, 584 bp, Zea mays
  Clone ID: cC-zmle189036h01d1
agcaagcgagcggggcagcgcgccaggaaggatcggaggagacgccatcaatcagcacttgcacgcgcgcggtcggccgcaggtggaggaagaagatgggcctgtgctcgtgctgctgccggtgcctggagctgctgtgctcggtcctcctcccgcccctcggcgtctgcctccgccacggctgctgctccatggagttctggatcagtgtgctgctcaccatcctcggctacctccccggcgtcctctacgccgtgtacgtcatctgctccgtcgacccccaccgccaccgcgacaacgacgactacgtctacgtagcatgacaagatggaccggtccccgtggtgctctggtccgtgtctctgctgctacctccgtcctctgtgctgtgtgcatctttttgtttggtttagtaaactaaatccatcctgtggccttctgtaaactgtaaattcgtatgtcgaatctgacaatctggacggattcattccataaactaagatctggtgttgcgggatctgtggagttagttagggttactttgctacctcgttcagttgtgcttgtgaaatgaaactgcagat

SEQ ID NO: 25309 - DNA, 438 bp, Zea mays
  Clone ID: cC-zmle189036h03d1
ggtcgactcccgcgtccgcggacgtcgtgggaaaaaaaaaaaaaaaaaaaaaaaaaaaaaaaaattaaaaaattaaaaaacaaaaattataaaacaaggggaacatgggaaagcattcaaccacttaaatcctccttttttttcccttcctttaattaatttactggcctttttttttctcctgctttcctttacactaccccctttcttcccctcctttgtcttccttaaatccctgccccttttaccttctggctttttattaaaatgcccctttatttatctcctttctcttttatactgtctcctgttttctcctcaccccccctttctactcattcattaatcccgggtggggcgccgtgccctcctctccaaggagcttagattgcggggtctctcacgcccctcccctttccttttcttcctttctttccc

SEQ ID NO: 25310 - DNA, 501 bp, Zea mays
  Clone ID: cC-zmle189036h04d1
tgttctcaaggtcagagcttcgccgaggaggcgaggacgatggcaatcgccgggcagtgctcctcctgctgttatacgtcacccaccctgcagctccagctccaacgacggcacagccacctgccgcggcagccccaagccgcacgaagagcgcgtcggccgaggttgcaggtggccgcagctgccggcagcggggccatcagggcggccacggacgccgagttcttccagccttccgacaccaggccaatcatgctcttcgacggcgtctgcaacctctgcaacggcggcgtccgcttcgtgcgggagcacgaccccaacaggagcatcaggtacgtgccgctgcagagcgagtccgggaggaagctcctgcaaaggtcagggaggtcccctgacgacatctccagcgttgttctcgtcgagaaagacaggtctttcatcaagtctgaagcggtgctgaggataatggagtacctcaacctgccccttcccgcagcttgc

SEQ ID NO: 25311 - DNA, 548 bp, Zea mays
  Clone ID: cC-zmle189036h06d1
ggctttaagattgtttttgatgcgcacacattatagatcagatgttaaccattctgatcaagcgcttgagattgcatgtgatcgtgtctactacattgatcagactctatatgactgtgaggaagtgttagctacatatcgtgaagagggtacctctctcccagtgccgcgtgaggagcaaactctgattggggagcaccattcagaattcttgaaacatatgtcgaatgatcttaaaaccacagatgttctggaccgttgcttcatggagctgctcaaggccataaacagcactctgaatgattcgaagaaactgctgcaaaaaatagaacagcaaaagaagaaacagcaacagcagaagaagcagcaacagcagaagcagctgcaacagaagcaacagtaattgcaaaaacagccagaagattatattcaagctctgattgcactggaaacagaacttaacaacatattgtctatactcggtctgatgccatcttcatctttggcagagggactacagcaatcgaaggacatatcattaaagcgag

SEQ ID NO: 25312 - DNA, 549 bp, Zea mays
  Clone ID: cC-zmle189036h07d1
cggacgcgtgggcggacgcgtgggtgctgattttgacgaggatgaactggaagcggaacttgaagaactggaaggagcagagttggaatctcagcttctggagcctgttgcagctcttcctgtgcatccagtgcatgtcccaggcaacaagcaaccagctcgccctgctccacagaaagctacagctgaagatgatgagcttgctgcactgcaagctgaaatggcattgtgatcaggtttccactgaagaggtgaaatgtgtatatgaattgcgttatgctgaaagctgagtcaagctttattgtatttgccatgtgtgtataatcttggtggatatttggcaactgtcaaccgaagcagcgaaaggccgctacagccggtatttgtttcagtgattgggctctgttttctttccacagacaatttagttaatgtcgcccggttaggtctatgctaactattcaggtcaccaacgtgcattgtttgtcacagtattttttagttacccatattgtttggagccatgcaagaagtgtggaaccgttaaag

SEQ ID NO: 25313 - DNA, 323 bp, Zea mays
  Clone ID: cC-zmle189037a01d1
cccacgcgttcgctagccgccaccagcactcccacgaaatgagaaacagagggctgtgagaacaccagcgcttccttataggagagccgacatggatgcggggtcgcacccacgcccgccgggacagcaccaacgcccgtcgagccgtcttcacaccacctctgcgccttggaacgaccaccgcacccagagggccccgccgacgccggggaagaagagagatgattgggcgccgggatcggaatgatcactcggcgtgggctggtgtatgtaggtgaaaaaggcgcccgggggtagaggagaaggtcaaggggaggggaagg

SEQ ID NO: 25314 - DNA, 483 bp, Zea mays
  unsure at all n locations
  Clone ID: cC-zmle189037a04d1
agagaccaggccgaaggaaaacaatcctgaaaccaagccatgggtctgcaggaggaatttgaggagcatgctgagaaggcaaagaccttgcctgagaacacgagcaatgagaacaagctgatcctatacgggctctacaagcaagccacggttggagatgtgaataccgatcgtccgggcatattctaccaaaaggacagggccaagtgggatgcctggaaggctgttgaaggcaaatcgaaggatgaggcgatgaatgactacatcaccaaggtgaagcagctccaggaggaggctgccgcctcttaaaagtctcttaatagtgttgccaaacagctatttgtcagatgagctttgtgccatttcctcattagaagtatatcattcgatccattggggatctgtgaaccatgtacctgtntatgtaactggttaccaggtgttatccatctatctatctatctgtgaagaactgagtcttct

SEQ ID NO: 25315 - DNA, 368 bp, Zea mays
  Clone ID: cC-zmle189037a05d1
accctttttactgaggaaaaaaaacggtattaaatttcaagtgaatgccggtatatatatatactagaggtatagctgggggtacgtgatttgtctctcatctaggactaccccaatggagtaatttcgaactgggtattatatataatcaattgggaatgatataaaaaagaaatggagatgacccccctctgcttctttacactgaaaaaatgaggcccataaaacatcctaaacaagctgagcatgttcttgcttttgatgtttactaatagggggcataccttagcgtggtttcctctacgtataggtactggtgttgtttattgaggttaaaaattgttttaagatttaaaagggggcccctt

SEQ ID NO: 25316 - DNA, 315 bp, Zea mays
  unsure at all n locations
  Clone ID: cC-zmle189037a06d1
cggaatattccgggtacgactccacgtcgtctcggtcgccccgtgtcagggataccactattncttctccgagcgtagttcnnttggttgacccctcttctcttncttcggaccagcctctcaagggcttcttgnnngtgtagctttggccacctttctcacacacatcaagattttcatgggtctgagtnnntcgacattctagaatcctcaactggnccttcganntcccttctgctgagggccacannggctggggacctcctggctgcggcatgcatgggtcataaggaagctatcgtacanccgtgcgca

SEQ ID NO: 25317 - DNA, 202 bp, Zea mays
  Clone ID: cC-zmle189037a11a1
tttttagaaaggtaagaagcaatgccagctatgttccagtgtatcataagctattatctactgtacgttcggctgaatatgaataattcataaaagacaggtcctaggagtggtaagcctataatgttacagaacaaacttgcatattcacaagtattacaccatgcctaccggggagttactcttccagagatcatgccgc

SEQ ID NO: 25318 - DNA, 369 bp, Zea mays
  Clone ID: cC-zmle189037b02d1
ctccatcgaatcttgtcggcaaagccaataatcaatcaccagcgacatcaattccttgcccgaccgcccggccgcgcgtcgaggaaccgccgcacagttccatgggcaaggtgcgctccttcttctgccgcgcccgcagcggcaagcgcggtggctcccggccaggcttgtcgtcctcgtctctctcgtgcccgtgcccctccgcgaggagggcgtcgccgccggccggggacgagacggagcgcgtcttccgcaagttcgacgcgaacggcgacggccagatctcgcggtccgagctggcggcgctgttctagagcgtgggccacgcggccaccgacgacaggtgtcgcgcatgatggaggaggccga

SEQ ID NO: 25319 - DNA, 519 bp, Zea mays
  Clone ID: cC-zmle189037b04d1
cggacgcgtggggccaggcattccggttctagatgatgagcatgttaaggacgttcatctcgatcctttagctggcccagtagatgccttttgccttctggttcttgatccggaaaaggttgattatttgaatctgaaaagcaatcaaaggttgatctttacaagaagacaaaaggatgatggatccaatgattggatggcagtaaaagttagtccttaagctgctgcaaaaactttatttgtgagcttctcttggtaactagactatcatgattcttctgtgttttcatatcatttgaaatgttaggtgcatatcattatgtatatttgagaggccttttcatagtcatacatttatatattgggaatgctttgtaatctcagggatttgttattttttgttaccctcaaatatagaagataaagactgtaaggtatttaggaaggagtcaaagcaggctgtggctattcatgtttgtcaaagccgctggtcttgagatttgtttgaagatgagcgtg

SEQ ID NO: 25320 - DNA, 293 bp, Zea mays
  Clone ID: cC-zmle189037b05d1
tttttcaaaaatgaatggcacaggccatcgatggattgattcatccactgatgacgatacatgcgtctgtgcttattttacatcggaccgcttacagcaggcagccattgacattgattgatgagcacacatcgatcatgagcatacgccggctggggcaactactacacgcctacaatcggaacaggtagagtacaaggaaaaccctctgtttactcgacggacggacaaacaatgggatggatctgatggtattacacatgtccggcgttgctcaataagtaagttgccgg

SEQ ID NO: 25321 - DNA, 226 bp, Zea mays
  Clone ID: cC-zmle189037b06d1
cggtcgacccacgcgttcggatggttcatgggaaagagcaaggcgccggacgaggagcggccggcaataataaggagcggcaggaggaggaggtgctgctggtgcacagccaggtgcggcggatcaagaaggaggacgaggaggccttcagggagcgcctcctgaagctgcgcctgctggagacccggcccaacaccggcgccggcggcgtggcctggcgagcccc

SEQ ID NO: 25322 - DNA, 210 bp, Zea mays
  Clone ID: cC-zmle189037b10a1
ggtttcttttttctctaaatacaaaaacggatagtttttattgagtttgccattgacaagacactctacatatttaggaattattactgctcctgtacgtatggggggagcacccctttcagaaaggagtccaataatactaatgctttatcagcctgggaagacggaaccatatgaccagcttctctgacagaggcaaacgtgaatcct

SEQ ID NO: 25323 - DNA, 302 bp, Zea mays
  Clone ID: cC-zmle189037b11a1
ttttacaggcaaaacgctagtttgctgctggctgctgactcgtaccaggtccaggttacagagcaagagaaaacagataggaacaggaacaaacagacaacatagtgagtgagtgagtgagtggcaaaaaccaccatgcacctactagccacgacattcaccttactctatttaatgcttagccttcggccttgatccgaagaagataaggggggagaacatagccatgaggtcagagatcattgcaattccggtcgccgccgtaggatgatgggggtttccttgagggtccggtggtgggg

SEQ ID NO: 25324 - DNA, 372 bp, Zea mays
  Clone ID: cC-zmle189037b12a1
ggcagcaccaagaagcaccattttttccttaagattaacttagaataaagcctgacgggggtaacagcatccatcgatccgcagtccatgctgtttgatgcatgggtctgctgaaaccgaggatgaacacagcactaacaactgacacagagcgaccttgcaatcaaaaacacagatgggcaacaacaaacacgacacgaacgaagataaaccctctggactagggtaaacatcacggtagcgaacaggataacttggccgcgcgggccccaccgctcagttcctccagttcccgtcggagttgccgtagccgccgccacggttgccaccgtcgtagccgtcgttaccaccaccgtagccgccgtcgccacc

SEQ ID NO: 25325 - DNA, 449 bp, Zea mays
  unsure at all n locations
  Clone ID: cC-zmle189037c03d1
ggactgggagaaaacaacaaacccgcgttggatcctgtatcgatctggagaaatttctaagtcgtcgtcgtcgtcgtcgttcggttcggagcggatctgaggcgacgatggctggaggcggcgggatctcttggtctgcagtcctgcttcacctcgatggatgatgtctctgcgctgataattattggatcaatttcgataattattagtagatctatgagatatgccgcctggaagaggcgaggtaagctgcagcatgtaaaagtctgcgtgcgtcgacagcaaaaaagagaaaaaaagatgtgacatcctagaggaggcctttgccatgatgggtgcgctcgcatggcaggccaggtattaataaaaagatgattattgtgtgccggnggaggagatcgcacggnggttgatgtttttggccccggngtctcctccctcatcttgtt

SEQ ID NO: 25326 - DNA, 289 bp, Zea mays
  Clone ID: cC-zmle189037c06d1
gtcaccacgcgtgcgcgaccatcacacaagtgcgcgggccttctggcagtcaagcctttggtgcgcaccttcgtgatgatcaagccgggcggcgtccagaggggcctcattggggagatcatgagccgcttcgagaagaagggcttctacctgagggcctctgtgcttgtgaacttggataggtcagttgctgagaaacactacaccgatctggccttcaagcccttcttccagggcctcctgggctacctcatctctggccctgtggcggccatggactgggagggca

SEQ ID NO: 25327 - DNA, 206 bp, Zea mays
  Clone ID: cC-zmle189037c10a1
aatactatttttttttttctatttttttttgagggataaaaaataggcgtgtcataggggcaaaatacaaacagggggggcttcacggaattattgccacatccctaatgggtgactgatttcgaggcttattaatagacatcacccctggttgtaccggacttgcggaatgatgccctccccctgagaccccctaggcccaaggg

SEQ ID NO: 25328 - DNA, 53 bp, Zea mays
  Clone ID: cC-zmle189037c11a1
aattgttaaattttttcttcttgtttttagcaccactgtcaattacattattt

SEQ ID NO: 25329 - DNA, 310 bp, Zea mays
  Clone ID: cC-zmle189037c12a1
aggggatcaaaattatgtaatgaagagtacccctgttttttggtacatgacgaagggtgaccctccatgggggcttaattataaacagaccccctgattttacctgacgaattgcaagaagcgcatgctttggattttcttatccggagagggcgctggtgttttaaacgaggagggcccccccccccaggatcccagggggggggagggcccaaatcaaaagcccaggggttccacccacgtatacctcgccggggggaaaccaatcatccttgttgtaaattgggccggatcccgccaccttcccccc

SEQ ID NO: 25330 - DNA, 275 bp, Zea mays
  Clone ID: cC-zmle189037d01d1
cccacgcgtccgcattggcgtgccgtatcgtgctgttaggatcgcacaacgcgacacagctagatatgcttggtcttccatcttcgccccctgctcaaggaagaaaagacgctccaccagggagaggacaatgtcaggtcgtccccacactactagataaccggatggacaggcttgacattgcctgttgctgctgattctgctatcactgttagtcgtgttcagtgccgaatagacatgaatactgtgacggtcctagcatctggagaaatctg

SEQ ID NO: 25331 - DNA, 298 bp, Zea mays
  Clone ID: cC-zmle189037d02d1
cgtgatcgagatctccatgctcgactccctgagaacagggttttttgtcgacagcacgcgcatgatcgtcgtggggaaggccgtcggttttcggaccgtcatcgtggggagttgggagctggtgtctggggcggacgtggcgttgtagagcatgcacaacatgcacgaggcgctgtcggagctctgggaggttgccctctgcgctggcgattgcgaccgcgtcgactgccgtactctggtgcaccaccgtcgtggatatcacaatgattgcctgagcgatactaccctgtgacattaa

SEQ ID NO: 25332 - DNA, 456 bp, Zea mays
  unsure at all n locations
  Clone ID: cC-zmle189037d03d1
cggaattctctcgggtcgacaccacgtcgtctcgtagttggttgcagctggtggagaattctgtgaagggaatggcatctcgctcgtcttcctgtagaatnnggagaagggctcttgtgtgcctcacanncgggcacagatatnacttgcgtctctttgtcagccaaccctctactcattatattggtctcaggggctctgatgactgggttctgttatacttggtgggacactgacancagcctagtctttgtggaagcagctaccaagggttcccggcatcagtatccgcgctacatgtgaacagcctcactggtgagattctgactggtgctggtgttctttttgctgttcggagcatcaatggggactgccttgctgtggtgaacacctcccaacttccttctgacctcatcttgtctgtgacaagcgcgacatactcagactggcaggaca

SEQ ID NO: 25333 - DNA, 556 bp, Zea mays
  unsure at all n locations
  Clone ID: cC-zmle189037d04d1
tgaaaggtcagtgcttatgtcccagaggaaattggagaaacgctttggtcagtctcctattttcattgcatccacctttatgacacaaggtggcataccaccttcaacaaacccagcttctctactaaaggaagctatccatgtcatcagttgtggatatgaggacaaaactgaatggggaaaagagattggctggatctatggttcagtaacggaggatattctgactgggtttaaaatgcatgcaaggggctggcaatcaatctactgcatgccaccacgaccttgtttcaagggttctgcaccaatcaatctttccgatcgtcttaatcaggttctccgttgggctcttgggtcagtggaaattctgcttagtagacattgtcctatctggtatggttacaatggacgattgaagcttttggagaggctggcttacatcaacactattgtatatccaatcacatccattccgcttattgcctattngtgtgcttcccgctatctgcctccttaccaataaatttatcatttctgagaatagccaatatgctgg

SEQ ID NO: 25334 - DNA, 280 bp, Zea mays
  Clone ID: cC-zmle189037d05d1
ggcccacgcgttcggggacattgtgcaggcgtttgctcccagggatcagggaagtgaactgggactgggaggaagtgtcgacagtcgttgcaattcggacaaagaggaagagaatgatgttgaggatggggacgcagcggtggagggcgagctgaaggaattgaggataggaaagactttcgaggggttcactggaactttttattgtcgacgacgaatgatgatgacgcgttcagtacaaccacggaggccatgttcattattttaccgaatggcaagt

SEQ ID NO: 25335 - DNA, 210 bp, Zea mays
  Clone ID: cC-zmle189037d06d1
gcaccctccacttggtgctgcgtctcagaggtggcatgcagatcttcgtgaagacacttactggcaagacgatcacccttgaggtggagtcctcagacaccattgacaacgtcaaggccaagaaccaggacaaggagggcattccaccggaccagcagcggctgatcttcgccggcaagcaaattgaagatggtcgccacctgggctgac

SEQ ID NO: 25336 - DNA, 293 bp, Zea mays
  Clone ID: cC-zmle189037d10a1
attagcatcttatatttttttttttttttttgaaccggaaacaatcgaggttattaaggccggtaatctgaagaaagacttgcacaaagtcaggtggggttaatccctgaacctttcttaaaatatattatatagagggaacccatctaactgaaaaaaaatggctcggggtcccaacataaattaagacccccacggcactttaaaaatctcaacaaggggggcgagatcccagaatttggtcacgtctcaagggacactgttcctccattgcacctttacattaaggaaca

SEQ ID NO: 25337 - DNA, 435 bp, Zea mays
  Clone ID: cC-zmle189037d11a1
tttttataacaaactggttactgtatagatttgatctcatacatggaagcaggtgacggtggtaaacaaaacgccactcctgataaaacttggaagaacagtccatgacttcggacaaagagacgaactggtatggccgctacatgccttgacagccacgcctttgctttatctctgtgttataattgtaaatccattggtcctgcgcctcatagtggcatcaagcggcaggaaccttcctttcatcttcaatgaagaaaatggccgactcgggtacatcaggccatgtatctgtaatgaactccacaatatcatatgatatgtccccttgcacgttaatctgttccttctcggtcgggcccttaacaacagaagctccggttgcaaacttttttcaagcttttttgaagcatcactcaagtttacaccaaacaa

SEQ ID NO: 25338 - DNA, 223 bp, Zea mays
  Clone ID: cC-zmle189037d12a1
tagtttttttcgtgagcgcacacgacccaataatcgattaaaggggcagggagggagatgaatgattttctccctatcagccaacaacggggcaggataaacggatatgaacctcctgttcctattggagggcgccgagatcatccgacgaatcgtgcgatggcggagccaccctgcaagtatgggttagcctgcccgccgaggcggcaattgttctaggagg

SEQ ID NO: 25339 - DNA, 227 bp, Zea mays
  Clone ID: cC-zmle189037e01d1
cggaattccgggtcgacctacgcgtccgcccacgcgtccgcttttggctaagatcaagtgtatatctgttcttatcagtttaatatctgatatgtgaaccatgtgttcactacgatattaaatttattttttgtgggggagggctcaccacagtagcttgctactgaggtcctcatgtgtcgcttgggcgttgcactactgtccaagcctggcccgcctcaccctac

SEQ ID NO: 25340 - DNA, 377 bp, Zea mays
  unsure at all n locations
  Clone ID: cC-zmle189037e02d1
ccggaatattccgggtacgactccaccgcgtaccggtatcaatcgtaggtctgtatgcgtganntggcaacggcatccactcgatattctccaagaagtttgctcaacaccttagntggctcgcacagatgagaggatcactcgcatctctgatggaagtagactcatagggaggctcttctcgctgtgttgtgacataggacacagaatcggtcttctatctcngtgtccgccgagcctctcgnnncatgtcatgacaananntcttggtgagaaagctaatctgatgtaggcaggtggtacgagatgaatccgtgagggctgatgtncgatggtgatgggccagatcaactacnaggaagtttgtcaaggtcatg

SEQ ID NO: 25341 - DNA, 291 bp, Zea mays
  unsure at all n locations
  Clone ID: cC-zmle189037e03d1
cggacgcgtgggcggacgcgtgggcgaacaggggcacgtgcgtgtcggtccagatgcagtcacggacccagcctttcttgtgaccagaaacatggaggacttcatcacctgggtggattcctcaaagatcaagaggaaggtcatggagtacaatgatgcattagatgattatgatgccatgttctgagaaaataattctgcagaaatttatgtgcccgtcagtagtgtaatcttaagcctgccacatatgggtctnttctgaacaaatctgtgggagttgtcttctgcatg

SEQ ID NO: 25342 - DNA, 431 bp, Zea mays
  Clone ID: cC-zmle189037e04d1
gcgatgcggaacgccatcgagggcatgaacggcaaggagctggacggtcgcatcatcaccgtgaacgaggcccagtcccgctgcggccgtggaggcggcggcggtggcgggtacggtggtggccgtggaggcggcggctactgcggtggcgggcgccgtgatggcggcggcggctacggcggtggcggcggctacagtggtggcggcggcggctacggtggtggtggcggcggctacggcggtggcaaccgtggcgggggctacggcaacttcgacgggaactggaggaactgagcggtggggtccgcgcggccaagttatactgttcgctaccgggttggttaccctagtccagagtgtttatatttcgtcgtcttgcgtctgttgttgcccatctgtgtttttgattgaaggtcgctttgtgtcagttg

SEQ ID NO: 25343 - DNA, 535 bp, Zea mays
  Clone ID: cC-zmle189037e05d1
cccgtccggaatttccgggtcgacccacgcgttcgctttttttttttttttaagatggcaacacagctgttattcaaacagataaggacagtagcaggcaggagtacaattgtacaagtactagtaacaaacaaaaaaaaaacgatctgtgacaaagaccaaattgattgattcatcataatttcggtaggccgcaacttattttgagacaccgtcgacatcaagtaggtgcagtaactcttagtcctaactccagcttacttcttcatctccgcagaggctcggctgcctaagctgatctttccctcatgcagcagctttcgacgcaatcattcctgtcttccgggcgtaggcaaagatccctccggcctcaattacagggccagcatcaccaattggtttcagcttgtactccttgccagaggtgtggttaataaaaacggagttagcaaggtccacggtgaccacatcccctgtcttgcactccttcaggccccaacgtccgtgagctcagagggtcacttcccagtgccac

SEQ ID NO: 25344 - DNA, 366 bp, Zea mays
  Clone ID: cC-zmle189037e11a1
aggcacacgtacggtaggttgtattttctagagcggcacgctttcattatggtttaggagatgacacgggtcacggacgcagtcaataagggggtacatgggtttggactcctgaaaaccgtaacagtgttccctcagggacctgattccgccacatgcaccgtcacgaagtggttgggggtagccaaagcccttagaggtgctgtctgaatgatgtggatgtaacgcacaggatccgaggtggatgcggtctattcagcaaacgacggaggcgttaatgcctacgggctgtgcatgcctattcctgttcgggtcttgactgacgacatttatggctgatggccatatcactgtgctgtgcaaaag

SEQ ID NO: 25345 - DNA, 208 bp, Zea mays
  Clone ID: cC-zmle189037e12a1
agcttggatcctgtagagcggtcgcgggcgctgacctcttaagcctcctccacttcccgctgcgagaaaccaactgggtgggtgatgaatggttagccgtccaccttgccgctgtgcaggaagttgatgcacagagcacacgtgtccttgtaccgtaacacgctcacctagtccaccttccgctccgacgacgacgttagggcaacct

SEQ ID NO: 25346 - DNA, 241 bp, Zea mays
  Clone ID: cC-zmle189037f01d1
gaattccgggtcgacctacgcgtccggctcgctctcttcggttcagttctagaggttccaggatgaaggtaatagctgcctatctgcttgctgttctgggtggaaacacttccccgactgctgatgatgttaagagcattctggaatcagttggtgctgaagctgatgaagaaaaactagagttcctgctcacagaactcaaagacatggacataacagaagtgattgcagctggaaggga

SEQ ID NO: 25347 - DNA, 384 bp, Zea mays
  Clone ID: cC-zmle189037f02d1
ggtttttgtcaaagcggttcctgtcctgtatgacatgttgcatcaggtggattcaacttcggctgaagatgcccatttggaatggcggctgtgccattgtgccttggcctagtggttggggctagtcagagttggggtagtggcgtcgtcctccaaaaccttggttcggtcccattggtctggtctcaggtgtttgtcatgtcagtcccagtcagcagggtcagtccttgtgctgcatcaccagtggtgctgcatggaagtggtcagtcttcaaggtcagccggttggatcatttgggctcttgctcccaccgcctctggtggtaggcatgaagtcgcaggtgttgtcgggagttgggttttgcctccaatatagcatgaatga

SEQ ID NO: 25348 - DNA, 372 bp, Zea mays
  Clone ID: cC-zmle189037f03d1
ggagtatagtagtccaaagctgccgcgctcgtcctgggtgatgatggcgccgcggttagttaataagcaagcagttcggttaagaacaccgggttattagtagcacgctgtctagttcgtggtggtagctagctaatagagctggcactgaacgtaaggtttggtgccatgaagggtgtcgtcgatcgtcctcctgccgtctctccggcgaaaagagcgaagaaatccaacagcgtcaaggaccaaggtggtggtagtgtcatataagctgtctggtctgaatgtgcctgtacatactacatagcaccatgtgctgaatttttcgcaatactcggagaaatatattgatggaacaagagaggtttgtttttt

SEQ ID NO: 25349 - DNA, 486 bp, Zea mays
  Clone ID: cC-zmle189037f04d1
gcagtctcagcagcagacggcgatagtcggggaggagtactgcgagggcgaggacagggagctgacggtgcgcaagacgacgctcttcaccccgggggacgggctggaggcgtacgaccaccgcacgggcgcgctggcgttccgcgtcgagacgtacggccgcggcggggcgtgcgggggcggggccgccaggggggacctcgcgctgctgggcgcccagggggagcccgtcctcacggtgcgccgtcgccgccccagcctgcacaaccgctgggacggcttcctcggcgacggcgccgcgcacggccagaagaagcccgtcttcttcgcgcgccgctccttcatactcggcgccggcacgggcgccgccgccgtcctcgtcgacctcctcgcccccggcgccgccggggagttccgcgtcgacggctccttcccgcgccgctgctgccgggtcgtggcctccgccagggcctgggccgcgcccgt

SEQ ID NO: 25350 - DNA, 325 bp, Zea mays
  Clone ID: cC-zmle189037f05d1
tgaagagctcaagcaagcaaggaaagcttttgacgtggatgaagagacgctggctacgactaacatatgatgttttcctagtcgtagaatctgcgtgttactgtaaccagttgtacaatgcactgcatgtgtcggacaattgtttggtgtcgacttgtaactgttccgctacagactttatctattttcttgacagttactgcgttaatggctgtatgccctgctgagtgaagaagtcagctggttccacacattcgcaatgtaaaaatgcacagtttttttttttttgcttgctttggcggaggagatatttggaagttaaatt

SEQ ID NO: 25351 - DNA, 349 bp, Zea mays
  Clone ID: cC-zmle189037f10a1
ttttgatgaacataacccatgacggagatgaaaaatgcgttgtccagggggcttcctcaaccaattccacacttattagagaaaactcggaaagaaaatctaagaactctgcatgagagacgtcaatgttttgtcacgctggtatgctcaggacaataggcatcactcgatgtggttcagctcttctggcctgagaccttgtcctcccaccagtagaggaacctgaggttggccccctgcttgcccatctagtagagctggtaccaggggtcccgcaccttggatcccagcacggtgccggtgatcgcgccgaagccggtcggcagcaggacaccgtgcggcgccttgg

SEQ ID NO: 25352 - DNA, 113 bp, Zea mays
  Clone ID: cC-zmle189037f11a1
gataaaataaaacccacttcggtgaaaaaggaaggatccgagtacagtacagagttcctacactccgggtatgaaaactctcctcatgacaagtacagtgtcggacgcgtggg

SEQ ID NO: 25353 - DNA, 291 bp, Zea mays
  Clone ID: cC-zmle189037f12a1
ccgtccggaatttccgggtcgacccacatcctctgcgcccgttcaggatccacatcttcccgagcgagttcttggttgacctcttcctcttcggaccacctccaaggctcttggtgtagcttgccactctcaccaatcaagttttcatgtctgatctcgacattcagatcccaactgccttcgatcccttcgctgaggccaatgctggggactctggtgcggtagcagggttaaaggactacgtacacgtgcgcatccagcagcgttatggtcgcaagagcctgaccaccg

SEQ ID NO: 25354 - DNA, 402 bp, Zea mays
  Clone ID: cC-zmle189037g01d1
cggaatttccgggtccacctggatcacgggctggacgagatgagacggagtggaagaagatcattttcgatgccgggtttagccgttacaagatcatacctgtgctcggtgttcggtcgctcatcgaggtctacccatagaaatctatgcaactgagggatactgtatgcgtgaataatctgcgtctgaaatcaaaactaggtgtgaagaagtgagtatactgtatgcacgcgtgaataaatctgcgtgtgaaaaactaggtgtgacgaagtgttctgccatgtgcttgcttatttagttgctaaataaatgtatcgcatgtactcttgtctgtggtaaaggaaaccaaattttttttgtgggaacctggattatttgttgtttgatcatgacaaacaattg

SEQ ID NO: 25355 - DNA, 386 bp, Zea mays
  unsure at all n locations
  Clone ID: cC-zmle189037g02d1
cccacgcgttcgcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcngcggcggtgggtactgtggtggccgtggaggcggcagctactgcggt

SEQ ID NO: 25356 - DNA, 453 bp, Zea mays
  Clone ID: cC-zmle189037g03d1
cgaatttcgggtcgaccacgcgtccgctccctgctcgtcgcatccgaccccgagggcagggtgccgctcttctgggggatcaccgccgacggctgcgtcgccttctccgacgacatcgacatgctcaaaggctcatgcggcaagtcgctcgcgccgttcccgcaaggctgcttctactccaacgccctcggagggctcaagtgctacgagaaccccaagcacaaggtcaccgctgtccccgccgacgaagaagagatctgcggtgccactttcaaggtggtggaagggtctactgtcctgacggcgctgcactgatctatcatcatcaggcggaggcgatgcgatgatgatgcagaactctgtacatgcgttggtggatggtggtgtaacatagtggctgccaacaagtcatgctcatgcaaaccgatgaactatctctgtatcatcgatctc

SEQ ID NO: 25357 - DNA, 319 bp, Zea mays
  Clone ID: cC-zmle189037g04d1
gccatcgaggccaccaaggaattctcaagcttgagcgtggagccatgcgacagtgaactgatagtagtcacggttttcgaaatcaaggaggaagaggtcccggcatttattgagagggaacatgagtttagatttcttgcggttgtccctgaaggattggatggggtaccttttacaaatcgagcagttgtctgtgcacgctacagcatggagaatattttcaaaaagattgcggggaacccagggaaatttttacaagtcctttggacgggacaatattgacaaaatatggagagatgatatcttaccatgtcgctta

SEQ ID NO: 25358 - DNA, 95 bp, Zea mays
  Clone ID: cC-zmle189037g05d1
aaaacacaaaagaaaggaaaaaaaactgatactaacaaagacttaataaatgaaaaagaaaaagaagaaaactacgtaaaacttaaagagggggg

SEQ ID NO: 25359 - DNA, 210 bp, Zea mays
  Clone ID: cC-zmle189037g09a1
ttatttttttttttcttttttttaaattttcttacctggggggtttttttgtggtttataaatcctattcattaaaatttaaccccggggttccacccggaaattttggaccggtccctggggggggacaacttttcaataatgtgggtcttattaaacttgggccaaagaacggtaaaaaggaggtccggggtgaaaaatgtttcccct

SEQ ID NO: 25360 - DNA, 583 bp, Zea mays
  Clone ID: cC-zmle189037g10a1
ccgagctgaaaaccgaatgttcttttaaaaaaaacaaattctccccgccccctcgcgcccccccccgatttctccccccctcccttgggggcgtcccccttttcctttgggggagccttttaatcccctggtcctctaaggcccttcctcctcccccggggacaacggtactccccccccctcccccccacctaaacagcccgatgcttaaaatttcttcccccgggcgccccaagggggagcccctccctcattttattgggagcgcgccccccgccccctttccccactcagaaacactccctccccccctttatttaaaataacccgccaccccccgcgggggaggggttcttattctccccccccgggggtttttttctccccgatggaccccccacctttttttccccccccccctcccccgaaaatttaccctcccgcccctcttttcccctcagggcaaatttctttgtggggttcaccggaataatcagcttctccgtttgtctccccccctacacccccccccccctcgttgaatgtccttgcccccccctttttgccccccccggccctcccc

SEQ ID NO: 25361 - DNA, 347 bp, Zea mays
  Clone ID: cC-zmle189037g12a1
ccggaatttccgggtcgacccacgcgttcgcttggttccttgggacaactgtttcagtagaagagaaaccaagatgctggcctagctgacctcccagcaactgtggctgctgtgaagaatcctaaccctaaggtggtttatgatgagtacaaccatgaaagatatcctcctggagatcccagcaagcgtgcctttgcatactttgtcctgagtggtgggaggttcatatatgcttcactgctgcgtcttctcgtactgaagtttgtcctgagcatgtcagcaagcaaggatgtgcttgcccttgcttcacttgaggtggacctctccagtatcgagccagggaccac

SEQ ID NO: 25362 - DNA, 516 bp, Zea mays
  Clone ID: cC-zmle189037h02d1
cggacgcgtgggtttttttaaatgggtaaaccaagacaacgatggatgcggcaatacggcgatgagccgatgatatgttatatacagtgaaatgccaaatcccaaagggcaatagcgtttgcacatgataggctactatggatcagcatacatagaatgatagaatcaccacttttacatacacaaactatctggtctttccctacaatctcatagtggcccagtctggcaggtcactgcgttgtaccagcgtcgcgatctgttagaacaaatacactgatagcctgcaggcaacatagcatggtctctgcgcaaacagttacgaaaacaaactataatatctctggataccacaggattatatgaacatcttgacccaaatacttaaatcagcgtgctgaacagactgtattaacaactggagactgcagtcgacgtgacatttggtcgaagacgatcgaaacaagtacaccacagggatataacgagcataactgttaagatactcacaggtca

SEQ ID NO: 25363 - DNA, 193 bp, Zea mays
  Clone ID: cC-zmle189037h03d1
gctgcatttggtatggtctgtggagggctgtaggcacacctcgtacctggagatgtgtggtgccatggaatgaccattctttgctttttttgctgacattttcttatgggtacgatcctggatataaacaggggaaacatggtatgaaccaccagctcaatgaagctaaaaataccatggttggaaacagcgc

SEQ ID NO: 25364 - DNA, 245 bp, Zea mays
  Clone ID: cC-zmle189037h04d1
gtcgaccacgcgttcgctctggtgatatgatgagagcagagcagctcccctgtgtgaagacaataagagggaggagcctactcatcagcctacttccatcttgcttattaggctgctcaaactgagttgtcgttagctcttttttttatttctccttcctttaaagtttgatctcgatcctctgtaaatttaagctgcagaagaaccaaatacatgtctcgaacagtactatgtgagacgagatc

SEQ ID NO: 25365 - DNA, 200 bp, Zea mays
  Clone ID: cC-zmle189037h05d1
cggaatttccgggtcgacccacgcgttcgcccacgcgtccgcggacgcgtgggcaagatcaagcgcctcccgcctccagcactctaactcaggggacacgatcgccatggccgccacatcgaccgccgccgccgtgctgtccccgccgtccgtggccgggctccgcctggcgccgtctcccggccgggcgcgcgtgtttt

SEQ ID NO: 25366 - DNA, 224 bp, Zea mays
  Clone ID: cC-zmle189037h09a1
ctcttttttttctgtttttttctggggcgcaagaatgcgaacatttcaaatgctgggtctgcaaaaagtactgtacaaaatggccctgcaaaaccgaacataacaaataatactcctcacctttgacaggcaagattctttctttaccattacgaataccatactaagcgagggtaaacagcacctgcaggccgcaagtacctattttgttccaaagagaaaca

SEQ ID NO: 25367 - DNA, 288 bp, Zea mays
  Clone ID: cC-zmle189037h11a1
aggaaacagatttgcacttttatagaggggggacaaggactatcttgtctttgggacccaactgtaggcattgctcatgttcgcactcccacgcatacataaggtcccacttttccctcctggccggaagggctaactaggatggtaagtctgtccttaacatcggaatcccagggatctttccagggataggggttacggcgccctttttcttggccccgatccacatgccctggccggggttgtggtcaacggggccgacagccctctggtaggagagggttaacc

SEQ ID NO: 25368 - DNA, 312 bp, Zea mays
  Clone ID: cC-zmle189037h12a1
ccggaattctcgggtcgacccacgcgttcgaatgacagggatctcgctcttgcaagggtggaaacagagaagaggaactctttgatcaaagcttgggaagagaatgagaagacaaaagctgagaacaaggctgctaagaaagtatccgctattctttcatgggaaaacacaaagaaagcaaacatagaagctgaactgaagaagaatgaggaacaactggaaaagaagaaggctgaatatgcagagaagatgaagacaagggtgcaatgatacacaaggaaccctaaagaagcgagcgaggtggaggcaaaa

SEQ ID NO: 25369 - DNA, 584 bp, Zea mays
  Clone ID: cC-zmle189038a01d1
cggacgcgtgggcggacgcgtgggcgaggacaggctgagcaccggcagcggcgggagcgcggtggtggacgcggacgcgctgctgtacggcaggttcgccgcggcagttgatagcagcgtggagtcgtacttccccggcggcgaggaccactaccacgactgcgggacgatgggccccgtgaatcatggcgccggaggaggcatccagtcggacgacgacggcgccggcagcgacgaggggtgcagctactacgccgacgaagccgccgccgccgccgccgcgttcttcgccggacacgccacccaccaccacgcggacgaggacgaggacgccggccagatcagctggtggatgtggaactagacgttcgatcttcccacgccgatcgatcgaccgtcttcgaatcctgtgtcaacaagaagaaaaaagaatcgtgccgtgatttttctttgcgcaacgctgctgtaagcctgtaatggtgaattttagctatggttatgccgttatgaaggaagaaagtgtatgcatgcatggtagggtaaagagtgggtaattaatatcgttgatcatccagtcactcgtg

SEQ ID NO: 25370 - DNA, 593 bp, Zea mays
  unsure at all n locations
  Clone ID: cC-zmle189038a02d1
ggggtggcagagtactgggcgggcgccgccacccccgctcggtcggcctacgccaggtgctcaccgatttcgggaccttagccggctacgaacactaaccagggaggatgctggccttgtcaagacactgatgcgccttcggaagtcatcattctcatccattaatgtggaggaacatcttcctgacatcgcgaagagaacaaaaacaaatcaggagttgggatgcacagtgctcagcaaatcaggatcaagcttctatagagaaatgcaatgctccaaagaatttaccaatacctgataattcacttctcgatgctcgtattctctattgtacctctcctgccctgggtcataacaaagaagcacacccagaatcgaacaaaagagttcctgtgatagttgatactcttgagaaattggagcttagtcccaagcatcgtggttcacaggttcttgaaattcaaaatttcaaccctgcttctctagatgatngtgcacgagttcattcaagatcttacatcactggactcgaaaggctatgggcagagcttcagatgaaggtctgatattgattgagggacaggaccaacata

SEQ ID NO: 25371 - DNA, 448 bp, Zea mays
  Clone ID: cC-zmle189038a03d1
gatgtttgtggcttcccagaaataagaaagtacatttctaaaaaaaaaaaaaaaaaaaaaaaaaaaaaaaaaaaaaaaaaaaaaaaaaaaaaaaaaaaaaaaaaaaaaaaaaaggaaaaaaaaatttaaaaaaaaaaaaaaaaaaaaaaaaaggggggggccgttttaggggacccaagtttccttccccgggctggcaaggtattaatttttttttggggcccccaaaattaatttcacgggccgcgttttaacaccgtggggacgggaaaaccccgggggttccccaattaaatcgcttggaagaaaatccccttttgcccagtgggggtaaaagcaaaagggcccgacccattcgcctttccaaaaattggcccaccttaatgggaaatgggacccccccctgaacgggccctttaagcccggggggggggggggttccccccag

SEQ ID NO: 25372 - DNA, 379 bp, Zea mays
  Clone ID: cC-zmle189038a04a1
cgattgcattattattgatatagtcttggacaaaatacatcggccccacaattacatcaaggatgaaaccaaaaaagggggccgggaaggggggctgcaacatactatcagatccctccatccagtaaattttataccttcagctacaggacacacggaggtatgatttccagtcctacgacgacaacaacaacaacaggagacacaagaaatagctactacatctattatgatcctatatatacaaaattccatcttgcaggaacttatattaggagcaggagcattcacatgtagccaaccaagtattggccttttcatgatcactacggcacaattataaaattagtgcagtgctgttgtgcaaactttgacttgt

SEQ ID NO: 25373 - DNA, 470 bp, Zea mays
  Clone ID: cC-zmle189038a04d1
accacgcgtacggatcactcactccaacatctgacgagcttgcatctcttgatctcagagagggcacgaacgtggtaacattaacgttctcaactgcaattgttgggaaacagcacgttgattgccacatatatttatggagatggaatacacgcattgtaatatctgatgtggatggaactatcaccaagtctgatgttcttgggcagttcatgccactagttggagttgattggtcccaaaacggagttgctcatttattttctgcaataaaggaaaatggatatcagcttctatttctcagtgcacgcgctatttgacaagcccacatcacaagacagtttcttttcaacctaaagcaggacggccaagcactttctgatggacctgttgttatatctccagatggtctcttcccgtcactctacagagaagtcatcagaagagctccgcatgaattcagatttcgt

SEQ ID NO: 25374 - DNA, 256 bp, Zea mays
  Clone ID: cC-zmle189038a05a1
cccaccccccaacttgaaatttttttttggggggggggggaacccaagtaaaccctcttgggaccaaaaacgggtggtgggcccccccaaaaattttttcaacaagaaaccccattacaaatttaaacccgggtttttttggtaaacatattaaatccccgtttgggggaatttaaacaaatccccgggtcccctcgtgaaaagggccacttttttttttttccaggggggtctcttttttttagggggggggggg

SEQ ID NO: 25375 - DNA, 580 bp, Zea mays
  unsure at all n locations
  Clone ID: cC-zmle189038a05d1
attagagaaggttatcaagagcgaaacatctggaaactttgaattcgcacttttagctatcctcagatgcgcggaaaacccagcaaagtattttgcaaagctcttacgaaaggccatgaaaggtctaggcactgatgacaagacacttataagggttgtggtgacgaggactgaaattgatatgcaatatatcaaggcagagtacttcaagaagtataagaagccattagctgaggctatccactccgaaacatcaggaaactatcggacattccttctttcacttgttggtcctggacattaggttatgtttcgaccatgggacatgatattccacccatccaccctaaatgcagcgacctacctggaaaacttatgatgttgccatttgtcagtggtgactcgtggattcgtctaacttccacatatgcggtatctagtatgcttgactaaagtatccgtgtttaaagttgtatctgggtttcttgttggaaattctgtgcggnggcacaacagctgatgttggtcacagtaggcttgacttgtgtctncatgacatcaataatattatgtcatgttc

SEQ ID NO: 25376 - DNA, 294 bp, Zea mays
  Clone ID: cC-zmle189038a06a1
gaggagggctacatggttaatttaagaggggaattttattatattttgggctacaatccctgtttcacagggcttgaataaggggggagccaaagagcagccgttttttttacagaagcctccccataacaaaaataatatttagaatgcagactaacatttccaggttgaacaaccaattttcccttccatataaaaacaaaaacttggttattaccctggttaaattcccctggggggtccattcaacttgaaacccgcttttatttccaacgagttttttaagggggccca

SEQ ID NO: 25377 - DNA, 248 bp, Zea mays
  Clone ID: cC-zmle189038a06d1
cggacgcgtgggctcggactgtagctgggagactgcacggacggcggcgtccacgagtcacgaggagcccagaggcttcttcacagcagcagcggcaggtccgctgatgccagactccccccagctccaccaaccgcctccccctcccgcgccgccgccggccagcgcaacaccagccgcgccagcggcagcaaatgcgcaacccaagctgactgccgtgaagctgaggatgatcatcaagggcgtgc

SEQ ID NO: 25378 - DNA, 350 bp, Zea mays
  Clone ID: cC-zmle189038a08a1
gggaagcagcagtcatatcacaatcagaatgaaaaggtttgttctccctctcgataattttacacgcgtgggcattgcacatttttcagaccctcacatacagttttttatcccggtaaaaacaaagacggcatgcagcagcgcatgacttggcattgctcggcggcgtggcgttcgtccttacaggctaggcgtcctctcggcggcgccggagatgaccgtgagcaggttgttgccgaaggggtccctgaggtgcttggcgaggttctccacggggccctttgccggtgacgtaggcctggatgaagaaggcgaacatggagaacatggccagccggccgttcttgatc

SEQ ID NO: 25379 - DNA, 586 bp, Zea mays
  unsure at all n locations
  Clone ID: cC-zmle189038a08d1
cccacgcgtccgcccacgcgtccgcccacgcgtccgcccacgcgtccgcccacgcgtccgcttcggcaacagcatccccatcaacctggtggtggccgtgatcgcggaggtcatcctcgtcggcggcgccgagtactaccggatcaccaacggactggacctagaggacaagctgcaccccggtgggcccttcgaccccctgggcctggccagcgaccccgaccaggccgccatcctcaaggtgaaggagatcaagaacggccggctggccatgttctccatgttcgccttcttcatccaggcctacgtcaccggcgaaggccccgtggagaacctcgccaagcacctcagcgaccccttcggcaacaacctgctcaccgtcatctccggcgccgccgagaggacgcctagcctgtaaggacggacgccacgccgccgagcaatgccaagtcatgcgctgctgcatgccgtctttgattntaccgggataaaaagctgtatgtgagggtctgaagaatgtgcaatgcccacgcgtgtaaattatcgagagggagaacaaaccttttcattctgatgtgatatgact

SEQ ID NO: 25380 - DNA, 299 bp, Zea mays
  Clone ID: cC-zmle189038a09a1
cttaaaaaaaacggggggaagcccgcccttggccccacttgcccttggccaaaaaacaacccccccttgggggtggggggggcctatgcaaaaacccccccttggggggaatttcccccccttgttgccccccggggaacggggaggcatctcggggtttttttttctggggacaggtgccccccccccgggggtcgccccgggattcccggcccgggccccgggggggtccccttttttccctttggggggccttttaaagcttgggcaaatcctgggaatccttgctttccggggga

SEQ ID NO: 25381 - DNA, 331 bp, Zea mays
  Clone ID: cC-zmle189038a09d1
ttttccttaagatgaacttagaataaagcctgacgggggtaacagcatccatcgatccgcagtccatgctgatagatgcatgggtctgctgaaaccgaggatgaacacagcactaacaactgacacagagcgaccttgcaatcaaaaacacagatgggcaacaacaaacacgacacgaacgaagataaaccctctggactagggtaaacataatggtaggaaacaggataacttggccgcgcggggcccaccggtcaggctctccagttcccgtaggagttgccgtagccggcgccatggtcgccaccgtcgtagcctttgccaccaccac

SEQ ID NO: 25382 - DNA, 359 bp, Zea mays
  Clone ID: cC-zmle189038a10a1
ttttttttttttttttttttttttttttttttttttttggtttttttttttttaaaaaaaaccggggtcttaaccccaaataaatcaccccaaatttgggtttgggaagtttttcttaacccacggggtaaatttacgggcccccgggaaaacaatttcccccttgggaaaaaaaagttttgggggaaattaaaaacccccccccctgttttttaaaaaaaaggggggggcctaaaaccttttttaagccttttctttttttgggagccttttgtggtaatttgcccaacggggaagggggttaccccccaaagcggggggggggtgggaagtttatcgaacaaccctttttccggttg

SEQ ID NO: 25383 - DNA, 429 bp, Zea mays
  Clone ID: cC-zmle189038a11a1
ttttatatgagagccacgcaacgccattttaattattggatgtatgccaaagagtacacaatagcggaatggcaaatataccaaattatgaacagcgtaacaacaagatagagagatgatccatgacgattgcgacggatcgaccggcgctagcagtacaaagcaagctactagaccatgcaaatggagaagctgagcttagatcttgccgcgcgggcccggctgcggcggctcctgaggtcccttcttgatcggcaggaggtccggtgacgccgacgcgctgacgtaggccagaagtgagccgccgcccagcagcaggaacttgagcagcagacctctcttggtgaacggagccgcgaacgtctcgaagaacttgctctgtatcgggttgtaaggcgagggcgcgtcatagccgtagaggtcccactg

SEQ ID NO: 25384 - DNA, 59 bp, Zea mays
  Clone ID: cC-zmle189038a11d1
aatttttctttctttcctttaacaaccttcccgggggaacctaaaatctttttactctc

SEQ ID NO: 25385 - DNA, 355 bp, Zea mays
  Clone ID: cC-zmle189038a12a1
ttttagctagcagaaatttgcatccaatgttattaagaagtgtcttacttttggttctcatgagcaacgacagattctgatcaatgaaatgattggtagttggcacaactgatgagaacgaaccgttacatgtttgttttcaacaatgattttcagctcacctttttcttttaaaatcagtagttggcacaaccagtctatagcacagctcaaagcacagaaacatacgcctaagaaacataacacccgccggtaccagcgcagcgtgttgccggccggtgacacaatgacgcgcaagacattatggtgtcggctaccaccttctttggacatctttagggaacgggtccatgtt

SEQ ID NO: 25386 - DNA, 536 bp, Zea mays
  Clone ID: cC-zmle189038b02d1
cgaccatcgccgccgacttctccgttgacgcccaatcgctcgtctcccttaacgggcccgagccgaggacgcagcaggtcggcgagatactcgtgccgctccgccgccaggtgccgggttggctgcccccaatcgtgctccgaaacaacgcctccgcgacgccagcggccccgccgtccttggcttctcccaacgcgaccgtcgtgagaaacgaccggaacggggtcgtgaccgggcttgccgtcgggctgggcgtcgtcggcgcgctctggctgctgcagatgctgctgctggcctgcttgtgcagacggctcagggcgaatggacgaccaggtgacgcagtgctaatcggcgacggcgaccagggcggcgtgttcgctaagggtttgtccgtcgctgctgccggcggcggtgagaggttcctggtcagcgacatgtctgagtggctggacaagtacagggtgttcacggtggaggagctggagcgcggtaccgtggggttagacgacacacacctcgtcaacggcagcgtgtac

SEQ ID NO: 25387 - DNA, 77 bp, Zea mays
  Clone ID: cC-zmle189038b03d1
cctggctatgtgggatgaggtcacgcttcccttcaaaactacaagtatacatggttccataccaatttaactggaca

SEQ ID NO: 25388 - DNA, 148 bp, Zea mays
  Clone ID: cC-zmle189038b05a1
atagcgtgtttttggattatttctaaacaattttattgtctttatttttaaacatttgccgttttggcccctaccaagattgtttctctgtgcccatcctaaaaaagaagtatttagcccagtctcgcgcccgggatcccactgatcc

SEQ ID NO: 25389 - DNA, 196 bp, Zea mays
  Clone ID: cC-zmle189038b05d1
tttgggtcgacccacgcgttcgttctatggcagcaatgagaattcatagctcctttgtttatgatcggtcggacgagcctatgctccaagaaaacaccgtccgttccgggccgtcggtatggtggcggcaatcgacgtggtgttgtggggctgggaattctggcggtcgtggccatggacaacaagaggtcttatt

SEQ ID NO: 25390 - DNA, 225 bp, Zea mays
  Clone ID: cC-zmle189038b06d1
cccacgcgtccggtggaactcttgcaccgactggggttcttgttgcagggaccaagtacatggtgagccaaggtgaacctgcaaccggcatccgaggaaagaaagccactggagggattactatcaagaaaactggcctgtccttgattatccggatctatgatgagccaatgactccatggtctatgcaatatggcggcggagaggcttggcgattaccctgat

SEQ ID NO: 25391 - DNA, 91 bp, Zea mays
  Clone ID: cC-zmle189038b07a1
tcgacctttatttttttattaatttttttttttttaattttttaattatttttatagatttttttgtaagattaaaaaaaaattttattaa

SEQ ID NO: 25392 - DNA, 514 bp, Zea mays
  unsure at all n locations
  Clone ID: cC-zmle189038b07d1
cacacagcaatccacacaagcacttcgacgtcacacgggcgctgcgcacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcagggagagcttcctcgccagggctaactgagccgcccggcggccggcatccacgcccgttcgtgcttgcctgcgtgccttatgtatgtctgtggttgactggttgtgcagggtcatcgtacttggctatcgtacgtgcacgcactcagctcctgtacgaattacgacaantagctcgtgacctgaataaa

SEQ ID NO: 25393 - DNA, 366 bp, Zea mays
  Clone ID: cC-zmle189038b08a1
ttctatttttttctagaaaataaatgtaccaacgatgtcattcaaacagcaatgcaacagacattgcacccaaatgtgcgttataccgtagcattccagacattcaagtccccctatatatcgaaaccatcactctagcaaatcccacaaacagaagttaaaaggtacccagctatgcctgggtagcattttttatgttgcagcaaaaaaggatacattccccgcttgcgagggcgattcagcttcctatttcccagctcggcgacagcaaaaccagagatcactcccatgctttaagggcaccacccctcccaattgccttgatgatagtctgcttactggtgcgcgcactgcactctttgggct

SEQ ID NO: 25394 - DNA, 468 bp, Zea mays
  Clone ID: cC-zmle189038b08d1
agatgaatgcgaggagacgactatgcatgatgtgaacaacatcgaggaagagatgcgcaggaagcaagctcacgctgcccaggaggcgtacgaggaggacgacgagatgccgggcggagcccagagagtgcagtgcgcgcaacagtaagcagactatcatcaaggcaattgggaggggtggtgcccttaaagcatgggagtgatctctggttttgctgtcgccgagctgggaaataggaagctgaatcgacctcgcaagcggggaatgtatccttttttgctgcaacataaaaaatgctacccaggcatagctgggtaccttttaacttctgtttgtgggatttgctagagtgatggtttcgatatatagggggacttgaatgtctggaatgctacggtataacgcacatttgggtgcaatgtctgttgcattgctgtctgaatgacatcgttggtacatttattttc

SEQ ID NO: 25395 - DNA, 366 bp, Zea mays
  Clone ID: cC-zmle189038b09a1
gggaagaacaaatccatgttcccccgccgttggcccacttgttcaaattaaccaatccttgggcattaaaattttgggtcaacacacacgggggagaattcaggcagggttaagaacatgcccgcagccggccggttaaaaaaagttggggtcgtttcccttgcttgagggggcgaggatgttttaggcgactatgtggcccaccgagccccaggcgaggacctctactagggtgaagcccacggggtttttggatttttgccggcccgataacttcttggcgcgcttcttcccggggtttaaatgcggtttgccgttttgtttgggcaccttgttctgcacgtttttccgttggaagttgaaaaa

SEQ ID NO: 25396 - DNA, 227 bp, Zea mays
  Clone ID: cC-zmle189038b09d1
gcacacaagtgaatgcattggttgatcactggttggatcatatattacaaaccaccaagtcccagcggtagctcttctaattaacgagatccccatttacaaaggatcgttcttgccatcctttttctcccactcatcacaaaacgagaccacgcacgacgggttgatcggactcctgggcggacgcgtgggcggacgcgtgggcggacgcgtgggcggacgcttgg

SEQ ID NO: 25397 - DNA, 446 bp, Zea mays
  Clone ID: cC-zmle189038b10a1
tttttgaactctacctagcattcaatatttcatcggcaagcgatgttcagagcaagtattcatggacaacaacaaatttactgtgtcgaatcacttcgttcaaagtcactcttcgatggtactcgccagaaatttattctgctcggaacaagcacattgctggcaaatggcacaagaaactagtccctacccagcgcagcaaagtgtgaaatgacataagacataaccgggaagactcatctttacgccttcacttgaggaggagcatcgccttggagggcgggatctgatttgacggcatctagtgtcttgaagaactcctcaggaagagcaacgggccggtgctgaggaacatgcttaagaattggggtgtcgtcttcaatcacctcacatttcgtagtcatcaggggacacccccacgggatccccatttcaatcatttttgg

SEQ ID NO: 25398 - DNA, 400 bp, Zea mays
  Clone ID: cC-zmle189038b11a1
ttttggatatcaacaattaaccagcaggaaacaaaaaccaccactattgcacaaacatggttcatcttagtgtacaacgccaactcatcatctcgacttgcctatgcaatgcaacgtgaaacaaaagacacacatgcatctcgcagcatcaatcaatccacgtacgtacaccctctccgatccgaaagacaatgaagttgcatagcatagccgttgagcttagttgccggggacgaagttggtggcgtaagcccatgcgttgttgctgactgggtcagcgatgtggtcagcgaggttctcgagcgggcccttgccggtgacgatggcctggacgaagaagccgaacatggaaaacatggcgaggcggccgttcttgagctccttcaccttgagctcggcg

SEQ ID NO: 25399 - DNA, 157 bp, Zea mays
  Clone ID: cC-zmle189038b11d1
cttgttcacatttctttttggttttggtttcttgggcaagcaaccaatccatgttgggcccaaattcaaactggatctctctttgtgggggcaggggatcttactctggctgcttattggccgtggttttacttaaacccttggatagcacccccca

SEQ ID NO: 25400 - DNA, 280 bp, Zea mays
  Clone ID: cC-zmle189038b12a1
ttttctctcacacagtataagaagcttggcagtcaattgagtggtcaaaagttcagccctttacaacaggtatagattttcaactaattttacaaccttaagcctccggatcatgtaaagaccgaaatccccacgagacgattcagactacagggagaagcattgtctactcaaacttgtatgttttctggtggttccggacgcgtgggcggacgcgtgggcggacgcgtgggcggactcgtgggcggacgcgtgggcggacgcgtgggcggacccgtgg

SEQ ID NO: 25401 - DNA, 247 bp, Zea mays
  Clone ID: cC-zmle189038c01d1
ccaagggcgagtggctccccggccttccctccccctcctacctcgacggcagcctggcgggtgacaatggcttcgacccgttgggcctggcggaggaccccgagaacctgcggtggttcgtgcaggcggagctggtgaacggccggtgggccatgcttggcgtggccgggatgctcatcccggaggtgctgaccaaagccgggctgatcaacgcgccgcagtggtacgacgccggcaagttggagta

SEQ ID NO: 25402 - DNA, 575 bp, Zea mays
  unsure at all n locations
  Clone ID: cC-zmle189038c02d1
cggacgcgtgggtaaactctgtccttgaagtgtgctttggcccatccctccttccaaaaagcattagcgatgtgaagtacctggttgattttgttgaaacagtcatggaggctcttcctgcaaactatcgcctgggcttggctgttggtggattcgtagctaagcacttcacaggttatggcgcagcctccactgggaccaggttctgggcaagctctgttctgatcaatgccatctttcgagctgtacctgtcgcaccggaatcagtatggctagaaggtgcaggcctcctggagaaactgcatgccacagagattttgaagaggttctatcagcaggcggcatcagtctatcccttctccttcaagctgtggcacgcccatctgaattactgcaaagccagtgggagcaacactgagagcatcctgnagagtgcgaggcagcgtggcatcgagctgaatctgtcaccaacatagtgtatcccttggatccaagctgcatgatgttttgccagtcggagatgttggtagtgcttgtgttactggagatggcgtgtagatatatcggtgatcatg

SEQ ID NO: 25403 - DNA, 479 bp, Zea mays
  Clone ID: cC-zmle189038c03a1
tttttgatccttcaaaataaataatatttcaattatttgcctttccaaaaatataaaacataaggaaaatacattttgaccaaaaaaaagtttgatagttgcatgatgcttaaatcatagtctacgagataaggttttaaagcagtctatcgggctgcttgacaagcattaaaatacagcacacaacagattgagttttaatgaagcactgcattgcaagatctgaagtcctatagcagcttagatgtaaatataactttgaagaaaccaattatgtggatgcttcgttatcaagacgaattctcttggtaccaaccatgtcgctagtcggcacccggtttttcttcgcttccacagaaacatttcttggatggtttgaagcctgtacggcgcgattttaacttcaggtgcgacaattcattgggaaaggaagccctgggctcatccattgtgtggagggcatcatgaatcaatggctt

SEQ ID NO: 25404 - DNA, 503 bp, Zea mays
  Clone ID: cC-zmle189038c03d1
tgatgcagtgcaactgcaaccaagatacgtacaggtcattcaccaacatgtcatccacgttctccagcatgcttgattccacgttgttgacaaaccctgccatacatgcagctgccaggctcgcagcatcatactggccagcagctgaaggtaacactcctattgatccgaatcaagaaaaccctgcagatggcgtacaaggaaggaacataggctctactccaagcatggcttctattgtagcagctacagttgctgcagcatctgcatggtgggcaacacaaggtcttctccctttcttcgctccacccggggctgttccatttgtaccagctcctagtgctgcctttcccacagttgatgttccacgaccttcagagaaagacagagattgcccagttgaaaatgcacagaatgaatgccaagaagctcgaaaacaggtacagttcgaaggtttaagagttgctgcttcttcagagtctgatgggagtggaaaaggcgag

SEQ ID NO: 25405 - DNA, 375 bp, Zea mays
  Clone ID: cC-zmle189038c04a1
ataaaccaaaaaatttttttttaaatttgggggccccccctcggttttataaaattgttaaaagcttttcctttccctccaaaagtttttgcttccaaaagggggggttggggttctttttaaaaattataaacccaaaaaagacaaggctccaaaggctttttttttttttaataaaaccttttgaaatttccccgggattttcgggccggttcctgggggggttccccttttcttttttgggggtttttttaaaggcgggggtaaaaatgggcaatagttgttttctgggggaaattgttattcccgttcaaattccccaaaaatattcgggccgggagattataaggtaaagccgggggggcccttttgggg

SEQ ID NO: 25406 - DNA, 195 bp, Zea mays
  Clone ID: cC-zmle189038c04d1
atttcgggtgatttaaagtgttttatgaaaattatagagagctattggagcattgtcttttttggatttattatttttaaagagatcccaatacccttgttttggaagctataactttgtgagttgatggagatgcttttactaattctgaattccgatgctgtaacaacatatctgaagagaattgttttggtt

SEQ ID NO: 25407 - DNA, 383 bp, Zea mays
  Clone ID: cC-zmle189038c06a1
gggggcgatgaatcttcgtttctaatggtctggtatctatgctactctttccttctaaattgtacacatattcttacatatattacttggaacgttcaatcatgtaatcatgctctacgcgagcagccccaaagaaagatcaaacgccatggcctttttacaagtgtgatgcctatgacggtacggagggcatgccgaccaacacctcttcctttttctccttcgagagtgattcctccggtgtcgattcctcgctataaggctcctcctctcgcgcctgattatcgacaacgtcgggattgtcagaaagttcgttcccctgcacaatatcatgttgcgacgcgacagcatctgagccagggccaagtggtcggaagagctgt

SEQ ID NO: 25408 - DNA, 607 bp, Zea mays
  unsure at all n locations
  Clone ID: cC-zmle189038c06d1
gtcaccgaagagcaagcagacgagattcagagtgctggagaggccgctcagaaagagtttgcacaaaacgtcgttggtgtagggaaaggtgatgccgagactcaagcagcttggcaagaagcgcaagacgacgtcgatgaacaagtcgatgctgaaaagacttctgaagaggttgaagcgcaagaagacgagcattcaactacagtcgaagacgttgaacaagacattgttgaagagactgctgaagctgctgaagaagctactgaagactcagatgatgtcgccgaagatatgttggagaacccagcagcctctcaaggccccttgatgggttggacattgactgcccgcagtctggtcaatggaggctatgtcgaccgaccagagcaaataactgaattcgatgactggaagatagaatatcatgtcaaagagatacctgaagagaaacgatggaagctgtacaagtcgctccaagcgcgaaggcattcactcattggacaagacgaagaggccgttgacaggggccttaagcatttaccgcgattaatacagcgctacagcaaaccgcgacgcccgtggagggaggagcangacaggatcaacg

SEQ ID NO: 25409 - DNA, 150 bp, Zea mays
  Clone ID: cC-zmle189038c07a1
ttttaatatctacagtatctcattattgtcatgcaaaatggtaattacagacaggggattctgaaacctggacacaaacttctttctttgttttttttctgggagggggttgttttgagaagggttgaaacctgaccacacactgacgat

SEQ ID NO: 25410 - DNA, 521 bp, Zea mays
  unsure at all n locations
  Clone ID: cC-zmle189038c07d1
cccacgcgtccggtccatcgatcgagctccgtgagagagatagcaagcaatggcgacagcagggaaggtgatcaagtgcagagccgccgtggcgtgggaggccggcaagccgctgtccatcgaggaggtggaggtggcgccgccgcaggccatggaggtgcgtatcaagatcctctacaccgcgctctgccacaccgacgtctacttctgggaggccaaggggcaaaccccggtgttcccgaggatcttaggacacgaagcgggaggcatcgtggagagcgtcggagagggcgtgaccgagctcgcgccaggcgaccacgtcctcccggtgttcaccggcgagtgcaaggagtgcgcccactgcaagtcggaggagagcaacatgtgcgacctcctcaggatcaacgtcgaccgcggcgtgatgatcggcgacggtaagtcccgcttcaccatcagcgggcagcccatcttncacttcgtcgggacgtccaccttcagcgagtacaccgtcatccatgtcg

SEQ ID NO: 25411 - DNA, 392 bp, Zea mays
  Clone ID: cC-zmle189038c08a1
caaaagaaggaagcatattactccatacatattattctcaatagtctctcacatgttacaaatctcaaattaaagttctaggagagagtaccacatgtcccaaccactccttttacatactaagaggaactgtataactcccgcacttgtagccaggttgaaacggcctcttacaatagttggcgacgtacacaaccttttccatgcaccataccttctctacttccttgttaacatatttgcataggcatggaacatttgcccttttccacacagcacaacatgctgccgacggtggcaactttgggttcgctgggaatagctcaaactgcttgcactcttgtttcatgtcttccgcgtcttgtacacaaccagcagccgatgttgtccct

SEQ ID NO: 25412 - DNA, 438 bp, Zea mays
  Clone ID: cC-zmle189038c08d1
ccatggcaaaactactcttgggtttgctccttgcccttgctattctagggacaacatcggctgctggttgtgtacaagacgcggaagacatgaaacgagagtgcaagcagtttgagctattcccagcgaacccaaagttgccaccgtcggcagcatgttgtgctgtgtggaagagggcagatgttccatgcctatgcaaatatgttaacaaggaagtagagaaggtatggtgcatggagaaggttgtgtacgtcgccaactattgtaagaggccgtttcaacctggctacaagtgcgggagttatacagttcctcttagtatgtaaaaggagtggttgggacatgtggtactctctcctagaactttaatttgagatttgtaacatgtgagagactattgagaataatatgtatggagtaatatgcttccttcttttg

SEQ ID NO: 25413 - DNA, 254 bp, Zea mays
  Clone ID: cC-zmle189038c09d1
ggttgggttctttttttttttaaccacgaaaaaatgctttttccccgaagggaaaattttgttcttttatggctccccccctcgggcccggggggggggacctttggggcccctacccatcccctggttccgggggtaacctgaaatttgggggccgaaaagggtacaaatttcccccggtcaaaacaagcccctcacgaacaacactcaacacttgtttggttctcgccctggaaaatgctaagatccccccc

SEQ ID NO: 25414 - DNA, 357 bp, Zea mays
  Clone ID: cC-zmle189038c10a1
attaaaaaaaaagtttgatagttgcatgatgcttaaatcagactctacgagataaggttttaaagcagtctagcgggctgcttgacaagcattaaaatacagcacacaacagattgagttttaatgaagcactgcattgcaagatctgaagtcctatagtagcttagatgtaaatataactttgaagaaatcaattatgtggatgcttcgctatcaagacgaatcctcttggtaccaaccatgtcgctagccggcacccggttttccttcgctttcacagaacatctcttgtatggtttgaagcctgtacggcgcgatttcagcttcaggtgcgacaatttatttgggaaagggaag

SEQ ID NO: 25415 - DNA, 493 bp, Zea mays
  Clone ID: cC-zmle189038c10d1
ttttaaatctgacttgtgcattccttgatcatcatcattgaaatatctacatgcagtatcaaacttcccaacacatccatgtccaaactccaatcctgtagaatgctagacgtttttgcctccactcggctactgcaactagacccaacaactatgtgataccacggctgacaagttcaacaagactgcgacacagtacaagcgaaacaaaaaaggatgaagtgcaccatatgggtaaactgaaacttctctatgacatatatctagtggtctcccccggcaaaaataaactacccatccatcttccattcttcctctaaagccatttgaagaggatgcctccatgggtggcgaagaagggagcaaagacaagggactcgacagccatgagcttgatgaggatgttcagcgaggggcctgaggtgttcttgaggggatcaccgatggtggtaccaatgacagcagccttgtgtggggtctgaaccttttcggg

SEQ ID NO: 25416 - DNA, 432 bp, Zea mays
  Clone ID: cC-zmle189038c11a1
aacaagaacattctcatggagcgcgaccgtcgaagcacgcgcaacgtgaggtggtgctcgctagcacacagtcttgctctatactacagagctggacaacgtttctaccacaacggccgcgaacgggaccatactacacctgcaaggggtagagcggcgggcgctgaatgcgccattcgttaaatgtgggggcgactgttcacacaacagggacacaattttgaggctcgcgagagacgacctttttgcccaaccgttgttcttcacatgaacctggtgggcctggcttttagaaaagcggcccaccgacgtctgggcgccacaatttgtggctgacagttggatggactgtgcctctctggggccaccgggcccaagaccagactcctccgaagacaggggcttgttgcttattattcggcagatgtctga

SEQ ID NO: 25417 - DNA, 317 bp, Zea mays
  Clone ID: cC-zmle189038c11d1
cacatcacggtttatttttacccccagggagctgtcgcattccattaacgcatatgatgacatggtctcatccacagcttaaccatggccccctttggactttattgcatcaaacgagcggacacaaactcataaggggcgatcgggatcaatagcggttataacaggattatggggaactcccgcacctgaacgacggcagggacaaatcttttgaggaaacggacctatgttgaaaggccatgtcactgtgagaccaaatacccgccaaggtaacgcgtgaaggatgttcgcaagaatggactgagttgctgcct

SEQ ID NO: 25418 - DNA, 160 bp, Zea mays
  Clone ID: cC-zmle189038c12a1
cggggggtggtttttttttttttatatttttcccagggcccccgggggggctggtaaccataaaagttctaactctgcaaaattttaaattggggggtgaaaaaaaaaaaaaatggaacaggggccagctcccactttttattttcacccactttaattg

SEQ ID NO: 25419 - DNA, 347 bp, Zea mays
  Clone ID: cC-zmle189038c12d1
acgcactgtggcatattttaaccacaactgatatattttttaaattgccgactgatgtccatcaactttctgccgttcatacttagaaatcactggtgtgggtacttttttacataaaggttccgatttccagaagtagctggcatataaggatcatttgtaagccggagaaatagcccttcacctcttctgggcgttgtttccctccagatctttcctcagctgtaattaaaaattatctttcacatcggggacataccaatcatccttccactgctggacagcttcattgccttcttccttctcattccatccttggtcgatctcgaactcttcgaactcgtttt

SEQ ID NO: 25420 - DNA, 487 bp, Zea mays
  Clone ID: cC-zmle189038d01d1
cggacgcgtgggaggagatcggaggaagctacgggaggacttcaacccaggtggtgctgaactggctggtgtgccagggcaacgtggtgccgatcccgggcgccaagaacgccgagcaggcgcgggagttcgctggcgctctcgggtggagcctggcgcccgacgaggtggaggagctccggtccatggcgcgccaggtcaagcccgtcatcggcttcccggtggagaagctgcgaccacccccatggcactggtatatatcaggccactgtagtagtgtatagtaggactgttggtacgtaaatgggcaaagcataccattttcatcgcgagattggggacaatgttggcaaatttggattggacccaagcgttacgcccggtcaaccaaataacagaaatttgcttgggctaaaggacccgtttgactacttgcgaaaatcatgggtttacatgacaaacacataaaaagataatggttttatcc

SEQ ID NO: 25421 - DNA, 471 bp, Zea mays
  Clone ID: cC-zmle189038d02d1
cccacgcgtccggtgacgggcggctacgacggcaagtgggtgtgggcggagcgcgaggtgctgccgcggcggcggcgcgccggcgaggtctacgacacgggcgtccagatcaccgacgtcgcccgggagggatgcttcccctgcgacacgcgcgagtgggagtgatgcgtgtgaaccaaccacgccagtgacggctgaagcagaagccgaagcagaagcagaagcagaagaaacccaagcgctgaagcttcgactcaactgaagagcctgcctgtagaattgctctagctagctcctccgtgccacgtactgcccttttgggcttgccctcaaaaggtcaccggagaggacgaggtgacagacggagagggagacgactaacagacgctggtgacaaagtggcgcacgagaggagaggagagttccggaccccccttcttcgctgtactgtacatgagctgctgacgtgtg

SEQ ID NO: 25422 - DNA, 115 bp, Zea mays
  Clone ID: cC-zmle189038d03a1
cgtgtaaataatttattataaaaaaccaaaacccaaactaactaccctttaacatatctcataatctaatattataataatataacaaaaaaaacattatataatttcaaaaata

SEQ ID NO: 25423 - DNA, 551 bp, Zea mays
  unsure at all n locations
  Clone ID: cC-zmle189038d03d1
cggacgcgtgggcggacgcgtgggtccgaccatttccttcgcctgcgagggttggcaggccattctttataagcatcacgctgctggtcatgagcgtcggccatgccatcatctcctccggtctccctgcgtcgctctacattgggtcggtgctcatcggcatgtgctatgggtgtcagtgggccctgatgccgagcataacatctgagatctttgggctgagccatttcggcaccatattcaacatggtggctgttgcaagccctgttgggtcctacatcctctcggtgcgcatcgtgggctacatatacgatattgaatcgccaccggacgagcactcttgtgtaggtaagcaatgctttgcactctctttcatgatcatggccggtgtctgtatgtttgggtccgctgtggcatttgtgttgtttatcagaacaaggacgttctatagcgtgtcgtatatgcaaggttgcaatcttttctagacaagtaacangtctttatgtaagatggctatataacttggaataatgtttgtacatgtatattat

SEQ ID NO: 25424 - DNA, 374 bp, Zea mays
  Clone ID: cC-zmle189038d05a1
agaaaggggagttgaaaacccacatttaatattctgctaggctttataccagctattctgccgagtggactgctacatgtgtagaaccctcactcagagggcttttgggttggaacataaaacaaccgccactgactgctttaacgcttactcccaaaccgatcggttcggcctgaataattgtcgaggagccccatatttggaacgtgtcatttttatacgtgcctgcacacctttctcgaggcatcatccaaaaagtatttcgggtaccagggtgctgacagaagccgcctgcacgggaaccacatgaggcagatgtaacggcagagcccgattgaggtgtcctccaggtcctcccagtaagtgagcttcat

SEQ ID NO: 25425 - DNA, 374 bp, Zea mays
  Clone ID: cC-zmle189038d05d1
aacacgcattcgaccacgcgttcggcagaccattacctgttaggctagtacggaaaaaataacatggccttgcaacgagcaggtacagctttctatgcactgaccaacgaccgtaaggagaagagcgccaaagtcgtgctgcgccagacaccaacgggttgtagcatgcggctgaaggcgcatgcgccgaaaccaatcgacggataccactctcatggcggggaagctgagaacgctatggacctctcattctccctgtcagagaacgccgatgtcaaggtcgactgccaccgttgcgagctactaaggatcgacgagtctcatctgacagacgtgatgtagagtgattaagaggaggatgctgtcggaggcat

SEQ ID NO: 25426 - DNA, 423 bp, Zea mays
  Clone ID: cC-zmle189038d06a1
ttttgcgacaagagaaccaccaggttaatgtatcggcggcaattctactgaatttaccaccagattttgtacaagacaactatgtccagcagacaaaaatcaaccaccgtcattcatagagtacagacttttgcctcagcaaccatgcggggaagcggcaacaggattgacgagcgcgcgacaactctgggtgtttaacctattcctctaccatgtacaagaacccaggtctcattcgccgcgcaccgagttgtacttttcggcgagcgcgggggtggccgatatcttgttcatcagattcttgaaccgtatgctgtagtcgctgccgcttatgcggcttaaagaagatattgccctgagagcgctgaggaacatgtcctcgttccgatcaaccttctgcttcactgcataccccttgggttt

SEQ ID NO: 25427 - DNA, 491 bp, Zea mays
  Clone ID: cC-zmle189038d06d1
aatatattatgcgatcctgtgacgattggccaatcaagatcaggatcaggaggtcaaagaatgccccatatcttgcatgagtttggtggtctctacttttggtgatggtcttgaaagagaattaccagcatgccttgccatactcagtgacaggatgggtgatgaaattacccgacttacagctgtcacggcattggcagctattgcgaattcacctgtacctattgatctctcgtgtgtcctgaatcatgttgcttatgacgctcacagctttccttcgcaaggccaacagagctcttacgcaggcgacgttgggaactctaaattctttggtcgtcacatatggtggtcagattggctcttcttcgtatgacacaatcgttgcggcactttcaaccctcataagtgacatggatatgcatatgaccgctctcgcattggaactttgttgcacactaatggttgacagaaaatctattcttaacgctggc

SEQ ID NO: 25428 - DNA, 246 bp, Zea mays
  Clone ID: cC-zmle189038d07a1
ccagcaaccaatgttagagtatagacatcaaatggaacttggcagttacatctcagtaatcaaatggtgttcatgccttttgatacaattccctccaacaattaaggtttgacatgagtcccataactggggctaacgataccggtgaaacagcatacgcaggtttttgcagtgcatgcatgtccaaggagtcagcggaggatcaaggcagtacgagtgaccccactgtgatctgcaaacgtggca

SEQ ID NO: 25429 - DNA, 560 bp, Zea mays
  Clone ID: cC-zmle189038d07d1
ccccactcctgtagtaccgccgccgtgttccggtgatccgccatccgcctccgttcgccgtcccccgcttgtcccgttagtggttttcgtccttctggttcactcgccggcggactacatgctgatcgacgggatgaggtccgtggtcgcgacggtgagcggttaccacggcgacgagcggcataggcttgtaaacctcattgcggagaccggtgctagctacgtaggatccatgagcagatccatcacccacctggtgtgctggaggctcgaggggaagaagtacgacatcgcgaggaggctggggacacgcgttgtgagccactggtggttcacggagtgtctcagggaggggaggcgcctcccagaggacccctactttatggtaagtggtgaagaaacagggccagtcccagagctgccttctcgttcccgtaaacaagtcaagaaaaatgccatcatggaggacagagtttttcaagagttacctgatgatttctgggacactcctcgagctagagccagctataaagttaagcttgatgattctgattttgagt

SEQ ID NO: 25430 - DNA, 416 bp, Zea mays
  Clone ID: cC-zmle189038d08a1
ttacttttttttttctttttttctttaggggaagggagcatattgacaaattctgcagcacagggccaggcgcacacagccgtgttcgcttgacagcacaacatgtgggaaaccaggacagacagatgccatgggggaccaaagtttgttgttgttggcttgttgcaacccgggaacccgccttttttctctctctctctctttggttggacgcttcgacagacaagaggggctttgtttccagagacacatgccttaacaaactttaattattaatcactgacgcatgcattactgccggaatccaaaattcaaagctaaaagctgtatgcacaggccctctatttcatgggggaatttaccgggccgggccaacccattgggcggtgtcttttttttccgcttaaacaaggggt

SEQ ID NO: 25431 - DNA, 546 bp, Zea mays
  unsure at all n locations
  Clone ID: cC-zmle189038d08d1
gcatgtttctagcctcgtcttcgatccagctacgcatcatatcatatatactgacgcacatggcacagaactggcgcccgatgcagtatctaggaaggcatacggacaaccggggcccggggcggcgcaacggggtgcacctagcgcagccacagacgacggacggaccagtccgcgcgccagatcggaagcatcgaagagattctgagcgagagatcggacggcccagatgccacgcgtgcgtcgcctcgccaccccctctcctccgccaccgctccctttttatgcgccgctcctccgcaaaacccctcctccctctctcccagtccccagtccccacccaccaccagtcttcctcgctctccaaatctcgcgacgagaaagcccatctaggaccacaggggcgcgccagccggcaggaacgacgggagaagagggcatggagctcgctgagcggatcgagtcggccgggacggcgctgnngaagcgtacgaggagcanggtgctgccgcgcacggtcagcatggtgaacgtgccgtcggcggc

SEQ ID NO: 25432 - DNA, 313 bp, Zea mays
  Clone ID: cC-zmle189038d09a1
aggacaatgaacacaattattccttggcgattgaacaatagtttacattatggtacaaaccgaaaaccagggggcgcttacatgcatccggacacctaaagggcaccgggggcgcctcccttacttgccggggacaaagttgggggcgtaagcccaagcgttgttgttgacggggttggcaatgtggtcagcgaggttctcgagcgggcccttcccggtgactatggcctggacaaaaaatccgaacatggagaacatggcgaggcggccgttcttgagctccttgaccttgagctcggcgaaggccttgggg

SEQ ID NO: 25433 - DNA, 536 bp, Zea mays
  Clone ID: cC-zmle189038d09d1
ttttacgaaaattatttgcattcatatgatattatgcttgacttggtagcaagcatacaactacacaattttgatgtatacattgtacaatcatacgaaaaaacttaaaaataattaagaaaatatacttgcaatttaacacatctcccgatgaactgaagcccatgttgctgataacaactatgctatcactatcaagcctttctcttatccgtgaaacgtctattttcgtaacttccccggtgaatccgtagtcaataccattaaccacccctcttctcttagcaccaaggaaattgccacttgcaatgctatccacaagaccatgccagcgtccaataacaccatgcctacgaagatttaacattggaggaccaggagaaagtttagcttctattggcaatcgtattctaccagctgcattcattgcagccttttcttgcatcttcatcagtaattgctgtactgaccaacatacttggccttttttcctctttctgacaacagcttaataatatgaatatgtgtttctggaa

SEQ ID NO: 25434 - DNA, 265 bp, Zea mays
  Clone ID: cC-zmle189038d10a1
gaaaactcccactggccgtaggatctatcgggctcggcagtatgtttgagttttcacaatcaggttatgtaagctacagatcaaaacccataagcacattaaacagacagagaacagagcacaacataatgttatgtacatattattcaaatgttgccgattaaaaagcgtttacagctggggataaccttgctacattcaaaatggcgtgtagcatgccttagcaagccaaacatatttaccttacaggaaggatcccattggc

SEQ ID NO: 25435 - DNA, 241 bp, Zea mays
  Clone ID: cC-zmle189038d11a1
ctttattatttttttctttttttctacattacaaaaaagcaagcagctttggtggggtttgaaacacacagcctttttttatgctcgagagcaatacaacttttttttcacagcaccttttgacggaacatgactatgcaggtcaagtttatatagccagcgtctgagtctgacattctttaaatctacgcttattgttcacacaaaggggagtaaattttttccactcggaagagaggac

SEQ ID NO: 25436 - DNA, 353 bp, Zea mays
  Clone ID: cC-zmle189038d11d1
ctgagaataaactgcttatactatactaggcaataagagtgagttttccatatctgatacaaaacactgttacacaagcatgcctgaacaaactggaaacatattccgttgtcaaggaagaaactttttaagttgctgaagtttggatgctactcgaaaaatagtaggatattttttagaaacatgcagttcaaaaacactcgacaaatccttcacaaatcaagggcagacaatcgaaaactaagagcctttagggccttgtcctctgttcccaagttattatatcttgtttttttcaagaatttcccttttgaaagcccgcagctggactttaaaatttcttggtctcttta

SEQ ID NO: 25437 - DNA, 210 bp, Zea mays
  Clone ID: cC-zmle189038d12a1
atacaaaactttatttattattggaatccgcaagggacgacttaaaaaaaagaaggacccaagaagaagaagaagaaacagcatccgggttacagtttttacacaacgctgacaaacaagggtaataagcctgaggcttgctgcgcatggaacaaggattaagtgcagcgatcgctatagggtgtcgttatgagtttgtttttttttttg

SEQ ID NO: 25438 - DNA, 444 bp, Zea mays
  Clone ID: cC-zmle189038d12d1
aaaaccaacaaaatttctggacggtctattgcatatttgcatgtccgagctttacaggatcgctgggggacaaattgtacaatcccttaaattcctgactgcctaaagattgaaaatgaacaaatcatcctatggctcctagcgtacagcatatctctcaattctgtctatgctaacatacaacatgactcggttttgccgcaaggtacttgcattgcatgcactacacattgggagagtattcctacgaccaccgttgttcgccggcagatgcttgcatttcactactgcagatttagctgaaacttcatcctcagtagctcatccattaaaagagaacgatcatgcccacaagagacaatcgatccccatctcaaagtttgtgacaggactttcaccaaaatccttgcttgggttctgtatcccgtaattgtttgcctctgc

SEQ ID NO: 25439 - DNA, 434 bp, Zea mays
  Clone ID: cC-zmle189038e01d1
tccgcaatttccgggcgcgcggcggggggaaggcgaaggcgaggagacgcatgggcgagaggcgggtgcggttcgcggccgacgtcgtcgacaatgagggcgcgacgcgcccggtcaggttcttcccgcccgcgccgtcgtcgtcggcggccacgtgtggggacgcggcgcggtcggaagaccccatgatgcctgccaaccgggaggcgctctaccgcggcatgctccgcgaccgctccacgcaccgggtcacctgctcctactgaccctgacgctcaccgccggagagctcgtttgttcgttgcctctcttcgtttcgtttgttcgttcgctcgccgttagcgttcggtcggtaggcaggctgttaacttcggaggttcatcctcttgctgacggaagattttgttaatggaatttttagtactgtttttttt

SEQ ID NO: 25440 - DNA, 577 bp, Zea mays
  unsure at all n locations
  Clone ID: cC-zmle189038e02d1
caaagacactcgagaacgtacaaggcaaaatgaatcttcgaggagaggtcagggtgtggaagaaaacaacatgcagaataaagggcgttctgatgtacatccacgtgatgacagtttaaacagtgagaggaactccaggcaagaaaaacaaaacaataatcgtctatctggcagttctgatgctcgccatgcaggtagagataggcatagggagagcacaaggaagggcagaggttctgagcttggtgagcatgatctccacagatcaagcaaaaggcgacgtgaagaccatgaaagccatcacagtgggaaggttgaaacaaaagaagtgaatgaacaagatagcagtagaggccatgcaacattatccaagaagagccagaatcctcagccagataattcattggtgaatcaagtggaagaagacgcctcagatgatgaaaatcacgaggattctagaaagggacgctctaaattggagcgatggacaagccacanagagatagaatatagtaatatcgatgatgataatacagagacatttccgaccatcaaaagctgatgtgaagccgatgag

SEQ ID NO: 25441 - DNA, 469 bp, Zea mays
  Clone ID: cC-zmle189038e03a1
ttttgttcaacagagatgaatttggtccttatagattcatccaaaaccagaaaaatatggtacaggagcactccagacaccagcctaaactcagcattctacttcgcagaagttatacaagtacagggtcattttttactggactctccaatcgttttctgccgtctgagcaacttttgagaagttaatcaaaaggtataggaaggcgccagcccccctgggtgccaatcgattctcaatcaattaaaggtcatgtttccgagaccacctgcacatttttgcaattactgaagaaataatcatgtcacctaatcgcggaaatcaggaggcacggtttcttctttgaagtattccttcctcacagtcttggcatcacaaaaatctaccagggaggcatatgatttcaatagaggtttaacaacctgccacattggttgaaaaacaaatgggagcatcgacaaaaagaaac

SEQ ID NO: 25442 - DNA, 595 bp, Zea mays
  unsure at all n locations
  Clone ID: cC-zmle189038e03d1
cccacgcgtccgcggacgcgtgggttgggatctttgatctgcgaggctttcgggttgaaaatggtgatctccagttcctaaagtttttgatggacgttttttactattactacccgaagcggcttggccaagttctttttgtcgatgctccatttgtttttcaaccaatgtggcaggttgttaaacctctattgaaatcatatgcctccctggtaagattttgtgatgccgagactgtgaggaaggaatacttcaaagaagaaaccgtgcctcctgatttccgcgattaggtgacatgattatttcttcagtaattgcaaaaatgtgcaggtggtctcggaaacatgacctttaattgattgagaatcgattggcacccaggggggctggcgccttcctataccttttgattaacttctcaaaagttgctcagacggcagaaaacgattggagagtccagtaaaaaatgaccctgtacttgtataacttctgcgaagtaaaatgctgagtttaggctggtgtctggagtgctcctgtaccatattnttctggttttggatgaatctataaggaccaaactcatctctgttgaaca

SEQ ID NO: 25443 - DNA, 400 bp, Zea mays
  Clone ID: cC-zmle189038e04a1
ataacaatcccctccaatgcatatagattgaaaataaccgaacaaacccttagagtgtgagaggattagccgagctacagtcccactagcgccctaaaaagtcaatgaatagttccttcaccaaacttgccatcaacagaataagcattcttaacttctattgcgttgtcttcacagaatatggagccccaaacaggctcaaaaccataggcacgatactgcacttttccacaagggaactgttgctggaagagcttttcaataacccaaacggtcattcaatgcagtgcgcccatcaccagtttgacctttagggggcacccatgtttcaaagtcttgtctggcttcaaagaaatctggtcttgctgggcccaatacacgttttttgtttcgacttttt

SEQ ID NO: 25444 - DNA, 375 bp, Zea mays
  Clone ID: cC-zmle189038e04d1
tctttcttcaggcagtgaaaagaagcttgaagaggctgcccctgggcttattttacggaagagaaagtctgctgacgagtcagttgccagcgaggcaaattcatcttcggttgaaagtgaagcatcagttgctgatgctgtggcccttctgcttaagcataaacgtggtctacaaacctcagaagaaatggagaatgagactgaaccatattctagcaagaccgaagggaagaagtcgaaacaaaaacgtgtattgggcccagcaagaccagatttccttgaagccagacaagactctgaaacatgggtgccacctgaaggtcaaactggtgatgggcgcactgcattgaatgaccgtttgggttattgaaaagc

SEQ ID NO: 25445 - DNA, 379 bp, Zea mays
  Clone ID: cC-zmle189038e05a1
acaaccaattttttcccttattaataagccaaacggcaccaagcagcatgacaattgcagacaggcatacgatttttttggctccagaaaaacgtgttgtattagggaggacatattgcacttgcacaaacgggctacgatacactcaacatcactacagaaaaaacacagcaacaatgataaaattaaacatcctaccgtctacatgagcatcatgttccatgtggagtatcaatacacagcgtgtttcacaaattaaccacagggcgtgagctttttgttgcctgcgccacgagggttgtcattctttcagtcggtccacgctcttgctttttccttctgggggtgctcattctcttgggccgagctgctgccattc

SEQ ID NO: 25446 - DNA, 381 bp, Zea mays
  Clone ID: cC-zmle189038e05d1
cgcgaccctctcctctgccccgctacactatggttttgcctcagacctatcgctcgcttccggttccgcgagggaactcgatcgaccggtcggaatggtggatgtggaggagaccgggaacaagttgcaatcgcagatgcgccttcacgctgagccggaggacgacgccgacgacctccccctcccggacctcttagatagggcgtggtggcttcacgccctggcctccagctccgctctcgaccaggatgggatccgcacggtggttgacctgctgcggcgctgcgacgacatggtcaggaagctcggcctcttctaccccaactagaccaaggaggacgtgttcacagcacacctgaagtacctactggctccatatta

SEQ ID NO: 25447 - DNA, 446 bp, Zea mays
  Clone ID: cC-zmle189038e06a1
aacacttcaataacaatattgagctttaacaagcaatccaatcttgggacaattttttctcaaacaaacccttttgagttcaattcagccaggacaactatagttttggatataataatagtacatagatagtacccaacatgggtaactaatttcgccgcacgcctagcacttgatctccttaagaccatgagagaaatagaggaatgtcggattagtggcaccatccttgtaataggcgaataccacagacgcatcatccttcatggactcaccaacaaaaaattggaggtccttcagcttgctaaggagaaacttggttgcaccctcgacaccctttttgaactcatccgctttctctggctccaacacagcagtgagattcttgatgtattttttgatgcaagacacaaatgatttcttgtcaaaaggaggttgctcctgta

SEQ ID NO: 25448 - DNA, 575 bp, Zea mays
  unsure at all n locations
  Clone ID: cC-zmle189038e06d1
ccgacatcgtcccttcgtccccacgagcaaccgataatccgccggcgttgagatgttggtttatcaggatctcctatctggcgacgagctcctgtcggattcattcacctacaaggagctcgagaacggcgtcctgtgggaggtcgagggaaagtgggtcacccaaggtcctgttgatgtggacattggtgccaatccatccgccgagggtggtgaggacgaaagcgttgatgacacagctgtgaaggtggttgatattgttgacacattccgtctacaggagcaacctccttttgacaagaaatcatttgtgtcttacatcaaaaaatacatcaagaatctcactgctgtgttggagccagagaaagcggatgagttcaaaaagggtgtcgagggtgcaaccaagtttctccttagcaagctgaaggacctccaattttttgttggtgagtccatgaaagatgatgcgtctgtggtattcgcctattacaaggatggtgccactaatccgacattcctctatttctctcatggtcttaaggagatcaagtgctangcgtgcggcgaattagtta

SEQ ID NO: 25449 - DNA, 236 bp, Zea mays
  Clone ID: cC-zmle189038e07a1
ggggtagcactgtttattggtacatgacaaagggtgaacattcatggggggtttattattaacaaaccccctgtttttacaccactaatcccaagaagcgcctgcattggattttcttagccggagagggcgctggtgttttaaacaaggagggcccccccccctaggatcccaaggggggggacgggccaaaataaaaacccagtggtttccaccccctaaaactttccgggggg

SEQ ID NO: 25450 - DNA, 459 bp, Zea mays
  Clone ID: cC-zmle189038e07d1
cccacgcgtccgcccacgcgtccgcccacgcgtccggcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccctctccggctaaggatatccaatgcatgcgcttcttgcgattcgtcgtgtaaaatcagggtgtctgtctataatctagccttcatggatgctcaaccttcgtcatgtaacaataatcagt

SEQ ID NO: 25451 - DNA, 278 bp, Zea mays
  Clone ID: cC-zmle189038e08a1
aaatatttataatttttttttattattttttttctatgggtaatttttggatctttatttttaattttatacttttttaatttttttactataccggacctgtggggccacccggaaatttcgtaccggtccctgagggggtccaatattttcctaataggggtcattataaaaatggggatattaatggctaaaattgtttcctgggaaaaaaggttttcctctataaaatttcaaaaaaaaattcagccggatataaaataggtaaaaccgggggg

SEQ ID NO: 25452 - DNA, 96 bp, Zea mays
  Clone ID: cC-zmle189038e08d1
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagg

SEQ ID NO: 25453 - DNA, 315 bp, Zea mays
  Clone ID: cC-zmle189038e09a1
atataaaaaaccggctggttttaattcgattcgacttctacaggttttacaatatttttgcccttatagataacaaccgctttaacaatttttttggctctttagattacatatggattcccaccggttctacaattttttgggctctatagattacaacgggggggggcaatccaacgcaaacagcccctttcatttccaacacccagtttgtaaaagggggtgccagtttttttctttttggctcttgatcccagccccccccccactttgggtaagcttttttcagccctacccctcccgggcgcggggggt

SEQ ID NO: 25454 - DNA, 350 bp, Zea mays
  Clone ID: cC-zmle189038e09d1
gtgttgggtttttcttttttttttttgttcttttttcttttgggggctaccaaaaaggtttttttcgggcccgggttttttgggcgtattttccccggggccgggggggtgccccttccaaagcccagttcgatgaccctgcgccaccggtgatcccccgaccttcttttggggccccgggcaaccccaacggggtgggattcccgcccccgggggggtttattaacccgggggggggaaccctccccgggcctgggggccctcccgggggcggggggggaggcccttttcgccctggggtcgccccccccaaaacccggggccccggggggaccaaagggggggggggg

SEQ ID NO: 25455 - DNA, 388 bp, Zea mays
  Clone ID: cC-zmle189038e10a1
ttttgcatgcaaacacgacaaatgcatgatgttccatttatatgggagaattagaattttagaaacaaaaaaaaatgtaccgacgacggctacgaatcaaggcgcgccgccggcagctaatgaatggtaaaacatactatggacgatcgggaatcgggaatccatccatccatccatccatgacggaatctagcttaattcgccttgggagggtcggcgaaaaaagagttgatggaggccatgatctcgggcttttttccgcggacgaacttcctgaggccgtgcatagcgtacctttcgccctcgttgtggttgtacaggacgccggccgccctctttttcttggtcacccgcacctcggggttgcccgtgatgttgcgcacaagct

SEQ ID NO: 25456 - DNA, 426 bp, Zea mays
  Clone ID: cC-zmle189038e11a1
cagcgtcaggttccacgccgactccgacgcgcagctcaccaagggcctcgccgcgctgctcgtgctagggctctctggcgcgcccgccgcggatgtggccagggtgcccgttgacttcatcgagctgctcgggatcaggcagagcctctctccctccaggaacagcggcctgctcaacatgctcagcctcatgaagcgcaaggcgcttgagatcgccggtggtgactcaacgtcaagtcagcaatcagtccaagaggttaccagaccgcgtctagtgaacgggaaagagcctgaatttgcagctttcgaggtgcaagaaaaggaaaaggaaaggccacaggatgcagagaggcgcgacgaggatgaacaattgggtcaacttctaccacttgatgcaaaagtgaatggtgctgcgggcggtgggag

SEQ ID NO: 25457 - DNA, 432 bp, Zea mays
  Clone ID: cC-zmle189038e11d1
ttttagcctttgaatacttggcatgcacataaaccttggccactggacatatgtgtcaggtccaccacatgaataattgcgtcaacaacttactcatatgacgaggaactatctaattcatgtaatacaagcgcagcaacgctagctgttattcatttcaagaagcagaatacaacgtacgtataccactattaggtacgtacttattaggccgtatatttgtatctacatttgtttcaccccttaggtacacgttaattagcttgacctgcgtctgtactacggggacacaccgtgtgccaataatacattacgcatggccccccttggcggccccacctgatttcaggccaaaacaagttatctaaagtttcgaacatttttaaaaaaaaaaagagtaggaaagacgcctgcctgcctggttgtggcact

SEQ ID NO: 25458 - DNA, 280 bp, Zea mays
  Clone ID: cC-zmle189038e12a1
aatcccagaggaagccaggtgccagatccattaaaaagaccaccacagttcaagcgtcagttcatactaaaaacattgcaccttacaaccaagggttaatcctaatccggaaagaaagaatgccagaacacaaaagcgaagggcattttttgttcactagtagagaatctgaaaagacggaatataaagtttttactggcatttatcctccacactccatccacaggaacggtttttttttagaaaacataaccgtaataaatctgcttttttaaaattt

SEQ ID NO: 25459 - DNA, 440 bp, Zea mays
  Clone ID: cC-zmle189038e12d1
ttttaaatgagtccaatctaattgtcgcttctctgtaaggaaaaagacccaacattcaacattagggtatattattactccagggcgatcgactttacgactatggggcagactcaaatgggtcaacatgtgagttgagacttccgatcgagatatctatgaaggggtcttcgttcccaggggcagatcatttgtcctgcccttgctcatgtgacgtgcgggcttgactgttctactggccagattgctgttaccttcatgacatacaattattttcgcttgattgcaggggtttttccgggttatgaacaaaaaaactttaccaagtgctatgtactaagtacagctatctttgtgcctggcagagccgcgcagactgtactaattggctaggacactagggttgaataaaatgggacatcttgtccagtttttttaaa

SEQ ID NO: 25460 - DNA, 503 bp, Zea mays
  Clone ID: cC-zmle189038f01d1
gactatgctgattggggaacagcctactgaaaccgcaggatctatttctgtgatgcccacacgtgttcaaaggcctggtttgatcaattcgggggagcaagacgaaccggtatcaggttctgaacatgcatgcattgaacataatgttggcaacagggcatatgttcgtttactatatgatgtgcttggtggtgaacctatatgtgagacaagagttgctgctgatagtaatggaagcgacccatttgcagatgtatcattccatgaggcagagactaaggagactaatgatctgttctcagggttgacagtagaagagaaatcatcaactaccatgcatgatagatcttcggacagaaatgaattaccagatatctttggcagctcccctgattctttcaaccagggtagtgttactgaccaaggaactgacaatgatttgaatgctggcatgaaccttaatggaacaggccatgctcagtctgcagttaaagcagaaccca

SEQ ID NO: 25461 - DNA, 280 bp, Zea mays
  Clone ID: cC-zmle189038f03a1
ggaaattaacccaaaatatcagtataccatcccagctgtgtatcacatatcatacggggtgcggcggcggcaggtagagaagcattgaggtatagatagcttgatacaaacaagttcattccacgtatgacgcgccgatcgagagtatcattctttcgtagggggctacaaccttcgtccttcatgtcgatggcctatatagctatacgactagctagttgtcgtagatgcggcacttctcggagtccggggtgaccttgcaatacttctcgagcgggtc

SEQ ID NO: 25462 - DNA, 605 bp, Zea mays
  Clone ID: cC-zmle189038f03d1
cccacgcgtccgcccacgcgtccgcccacgcgtccgcccacgcgtccggcactacactacaccacaccacacacacccgacgacgatcacacacacgtagaagatcgagttcgttcgatcgtgaccgtgacgcaggaagctataagctagccaagacaggaataataatggcggcgtcgacggtggcgagcctctctgtcccggtgacgacggcgaccttcgcggcggcggcggcggcgggcggcgccgacgtgctgatcgtcgtcccgaggagggcgggcgccgggcgcgtcgtctggttccccgcggcggcgcgccgcggcggcgggcggttggtcgccgtgcggtccagcgggccggccacgccgtcggagatctccgacaaggtgtcggagagcatcaagcaggcggaggagacgtgcgcggacgaccagaagggcgacgccgagtgcgcggcggcgtgggacgaggtggaggagctcagcgccacggtcagccacgcccgcgacagcctcatggagaccaacgccaacgacccgctcgagaagtactggcaggacaacccggactccgaggagtgccgcatctacgacaactagctagtc

SEQ ID NO: 25463 - DNA, 319 bp, Zea mays
  Clone ID: cC-zmle189038f04a1
aaggaaaaacaaaatggggggacatatatttctccatacatctatgctcattgggggagacgcaactgaccacctagagctgcctacttacttattcagactgatccagcatgtgggaacatcggaagtttacatgcgtacagacgacaaattttcataacaatagcctggcttggctggttcacataataaccaaacgacaaccacgaaattgtgacgatttaaaataaacaactcaaaagcaaatcgacccccgaagcccgtgttactcataaagcactcccgtcttcttcttcatggcatccggttcctcctccca

SEQ ID NO: 25464 - DNA, 405 bp, Zea mays
  Clone ID: cC-zmle189038f04d1
ctcattcaagactaatgctgatgggaacacaacatgtgccaaggaaatgacaaagctgtctggcatatctgaaatcatcccggagatgaacatctgcaaatttgacttgcaaccctgaggctactccatgaatgcgacccatggatctgcattctccacaatccatgtgacgcccgaggacgggttcagctacgccagttacgaggttatgggcttggatgccactgctctgccttatggtgaccttgtcaagagggtactccggtgctttggcccctcagagacttccgttgccgtgaccatcttcggcgggcgtggccatgccgggacatggggaaaggcacttggtgcagaggtctatgactgcaacaacatggtggagcaggagctgtctggaggcgggct

SEQ ID NO: 25465 - DNA, 261 bp, Zea mays
  Clone ID: cC-zmle189038f05a1
ctagggagggatggggtttatatttttgggctttcaaaacaatgaaacgaagaagtctcactgtttattgttccatgacgaaggccgaccatccacgggggctagagtttagacccacaccctgttttcacaagacgaatcgcctgaaccccacgcattggatatccttaccccgatagggcgctaatgttgaatacaaggaggccccccccgtcgaggaacccaccgggggtgactgccaaaataagaagcccaaaggtt

SEQ ID NO: 25466 - DNA, 168 bp, Zea mays
  Clone ID: cC-zmle189038f05d1
atccactatgagagctagagcatcgcacgctgcactcttcttgctgggagcagctgcaattggggcgagggcgcctctcatgacctccttatcacctctggcgatggctccttatggcctgcaggacctctgtcgccgcgcgtattccttgactgatttttggtgcca

SEQ ID NO: 25467 - DNA, 333 bp, Zea mays
  Clone ID: cC-zmle189038f06a1
tttttagctataagagcacccagattctcaacgttgatcctatagagccgactcaagtataattctcgagcctacaacaggtctttcaaccaacaacaaatttccgcacactacatactcagaaagtaaaacaaaaaacaaaaggtatagaaaggacgaggggaatcgcaagttcagaccaccaactctctacggacccaggtatctacgcttatgaggagtactcaaagggttgcggcggttgtggctcgtcgtcaacggccatggcagatgatccggacccctgttggcttgcagctgtggcagtgttgccggtgcttcctccaactgctg

SEQ ID NO: 25468 - DNA, 366 bp, Zea mays
  Clone ID: cC-zmle189038f06d1
tacccgtccggaattcccgggcagcacttggaggaagcaccggcaacactgacacagctgccagccaacgggggtccggatcatctgccatggtcgttgacgacgagccacaaccgccggaaccctttgagtactcctcataagcgtaaatacctggggccgtagagagttggtgggctgaacttgcgattgcccttgccctttctatacctttagtgattggttgtactttatgaggatggaacgtgcggaaataaggtgtgggctggaagacctgttgtgggctcgagaattatacttgagtcggctctataggatcaacgtggagaatctgcgtgctcttatagctaaaagaaaagaaaaacg

SEQ ID NO: 25469 - DNA, 440 bp, Zea mays
  Clone ID: cC-zmle189038f07a1
acagaaacctgactacaaaagccagaggtaaaaccattgttaaactaaaacactctgatagatagaacttgctaagcacataacacaccgcctgagacactttgggcacacacttagtttgtacagtacctaactgacaccaaccacaatcagagcttagacctaaagcaacccatctcatgcggaggccttccgtgccttcttggaggcaggggacttcacggtcttcggcttggccttggccttggcggcgggggactatttcggcttcgccacgaccttcttttggggcactttgcgcttggtcccagcagcagcggccttctttggcttggcagccgctgccttttttgacttggcggcggcggccttggccggtttgggggcggtggtcttggcagcggaggcctttgccggcttatccttggtcttgggggatg

SEQ ID NO: 25470 - DNA, 562 bp, Zea mays
  Clone ID: cC-zmle189038f07d1
acggcgcgtctctgccggccaacttcaagaagatgctttccatccagctccgtgggtccgcagccaagggcaagctcgtgaaggtcaaggcttcgtacaagctctcggacgccgccaagaaggcatcccccaagaccaaggctaagccggcaaaggccgccgctgccaagaccaccgcccccaagccggccaaggccgccgccgccaagtcaaagaaggcagcggctgccaagccaaagaaggccgctgctgctgggaccaagcgcaaagtgcccgagaagaaggtcgtggcgaagccgaagaagtcccccgccgccaaggccaaggccaagccgaagaccgtgaagtcccctgcctccaagaaggcacggaaggcctccgcatgagatgggttgctttaggtctaagctctgattgtggttggtgtcagttaggtactgtacaaactaagtgtgtgcccaaagtgtctcaggcggtgtgttatgtgcttagcaagttctatctatcagagtggttttagtttaacaatgggtttacctctggcttttgagtcagggttctg

SEQ ID NO: 25471 - DNA, 55 bp, Zea mays
  Clone ID: cC-zmle189038f08a1
aaattttaaatttttttaccattttttttactttatgggggccatttcggggaat

SEQ ID NO: 25472 - DNA, 344 bp, Zea mays
  Clone ID: cC-zmle189038f08d1
cttgacggcattgaggatcttttcaagagatacaaagatccagcaatcctctagtttttcattcaccttttttggcgaaaagtagcaatcctcggacaatacaaagcccagaaaacatattacaacctatgatcgtatggtcataccattttgttcatgctgatacagttattgctttgttcttgtattggctctacaggcaataccacagagcagaattatgttttttttccttcactgtgtaagtagaatgcaggttttcactgtgtaagcgttcttttatactctgctagtaactgtatgatgtcttcgacattgacaggtctcaagtggacaggtttaac

SEQ ID NO: 25473 - DNA, 316 bp, Zea mays
  Clone ID: cC-zmle189038f09a1
gggggcgagcttcatcttctttctattatcgaatcagatctcacgacagcagcgaaactttcgtaagaaatgaaaaaaaaaacatctctacaatcctgtctttggctcccatctccatccagcattccagccccaaaggcaggcgtgatcatgaacccatcattagccaattaaatcgcccctgggcgagggcgatccagtaaatcacagcgcgatggggaggcggtcggcttccgtgctgcggagcccgagccaggaggccggggcccagcccgaggccggcttgaccgccttcgcgggggaccaccggcgggcg

SEQ ID NO: 25474 - DNA, 137 bp, Zea mays
  Clone ID: cC-zmle189038f10a1
ctgggcaaatagggtacattttaattatgctgcacccataacaacactcctacacaaagaaaaaataatggggcggtttgctacaccagaaaactcaccagggggggggaaaatacatcatacccggacgggggccc

SEQ ID NO: 25475 - DNA, 260 bp, Zea mays
  Clone ID: cC-zmle189038f11d1
atacaggaaaggaggggctcttagtctttgatttcatggacaggccaaggaacacacaagtgtgctcaaacaggcctggcctaaccaagcttttacttaagggtgcatccattcctctaaaaaaaattacttttttgcacctaaggagaggggctttcactcttctggcgcctttgaaccacctttgtaccggcctgtccttgcaaaaaataacttgccctctgaaaccgtggccgtaaagagctggtgcttgccgccct

SEQ ID NO: 25476 - DNA, 324 bp, Zea mays
  Clone ID: cC-zmle189038g01d1
tttttttttttttttttttttttttttttttttttgtttttttttttttttttaaccccccgggcaacttttttatatggtttattacaggggacaaacatacaggtggaataacggatacatgaacaccctttggctcgctcctgtttatttatgcaactgggggcatgcatgcaaaaaaccccttgggagaaaaaacccctgttattttggtaatccgttagaacgcatgggccccaaggaagggcccaaggggcaaaagatcatttgttccattggtagggttgaatgtttaaattttggaggggggttttggcccctttc

SEQ ID NO: 25477 - DNA, 490 bp, Zea mays
  Clone ID: cC-zmle189038g02d1
aatgccatgatatcaaacatctcattcacttacaggagcatttatttcaagaaagctatgactgacatggatagcaccaacgtgtatgcttacatctcaataatcgctctaattgtttgcattacacctgcattgatctttgaagggcccaagctaatgcaggatggatttagtgatgccattgcaaaagtaagtattgacaaagttcgtcagtgacctattcttggttggactgttctaccatctgtataaccagattgctacaaacaccttggagcgagtggctcctatgacacatgctgtcggcaatgtgtcgaaacgtgtatttgtcattggttactcaatcatcgtgtttggcaacaaaattagcacacaaactggaattggcacgttcattgtcatagctggtgttgctatgtactcttacattaaggcttagattgaagaggagaaaatgaaaaagagcgcatgactgctgtgaataatatta

SEQ ID NO: 25478 - DNA, 382 bp, Zea mays
  Clone ID: cC-zmle189038g03a1
agacacaatcacacaaatttattttgcttcaattcctttatgtgcagtataatacagtcatcacagaaaagtaaaatgaagagaatgaaaatgaggatggtcccagaactcaagctacttcttcatcattcattttgtatgcaaccacagctgcagcgccctgctcattccccttttgttcttctgtgtcgccaccctgaacctcgtcctctgggaccactactgtcttcacttgtgcgacaacaactgtgatgtcatccatcttaccgcctattagtttgcctccaagtagcttcttccaccaggggacatcgaaccccctactccgggcctccattgagtagggtgaatcgaatctgacatccaccgggtgttttcttgc

SEQ ID NO: 25479 - DNA, 382 bp, Zea mays
  Clone ID: cC-zmle189038g03d1
gcaagaaaacactcggtggatgtcagattcgattcaccctactcaatggaggcccggagtagggggttcgatgtcccctggtggaagaagctacttggaggcaaactaataggcggtaagatggatgacatcacagttgttgtcgcacaagtgaagacagtagtggtcccagaggacgaggttcagggtggcgacacagaagaacaaaaggggaatgagcagggcgctgcagctgtggttgcatacaaaatgaatgatgaagaagtagcttgagttctgggaccatcctcattttcattctcttcattttacttttctgtgatgactgtattatactgcacataaaggaattgaagcaaaataaatttgtgtgattgtgtct

SEQ ID NO: 25480 - DNA, 235 bp, Zea mays
  Clone ID: cC-zmle189038g04d1
ggaggaggccaagaccctggaggccaggctcacccaggtcagcgaggagaaccggcggctcaccgagatcatcgcctacatgtacgccagccaggtcgccgcgcagcggagtcccgacggcaggaagaggagcagggacagcctggagccgtcgaattcgagcgacgccaacgctgccgtcgagagcgccgccctcagcgacgagggcacgtgcaggcggatcaagctcaccagg

SEQ ID NO: 25481 - DNA, 337 bp, Zea mays
  Clone ID: cC-zmle189038g05a1
ggcaaggaccaaccaaccaaaagggaatgaacacacacgaaagcaacagtgtttattacacaggctgttatagcacatggcgcagcagcaaatgcaagacaggatgcggccttttttattcgacttggggctccgacgcattcgcgacccaggcagcgcaaggcgaggtcaatccgaggaggagggcggcgggggcaaggggatggcggcgacggtcttctggaacgcggggcgggcggcgatggcctcccaccaggccttgacgtgggggcgggcggcgaccagcccggccttgggggtcttgctgaggtagaacaagtaggactcctggttggcg

SEQ ID NO: 25482 - DNA, 403 bp, Zea mays
  unsure at all n locations
  Clone ID: cC-zmle189038g05d1
cggaattcccgggtcgacccacgcgttcgcccacgcgtccgcgcgatcaaccggtacatcgccagcaagtacgcgtcggagggcacggacctgctccccgcgacggcgtcggcggcgaagctggaggtgtggctggaggtggagtctcaccacttccacccgaacgcgtcgccgctggtgttccagctgctcgtgaggccgctcctgggcggcgcccccgacgcggtggtggtggagaagcacgcggagcagctcgccaaggtgctcgacgtgtacgaggcgcacctggcccgcaacaagtacctcgccggggacgagttcacgctcgccgacgccaaccacgcgtnctacctgctctacctcagcaagacccccaaggccgggctcgttggcgcccccccca

SEQ ID NO: 25483 - DNA, 346 bp, Zea mays
  Clone ID: cC-zmle189038g06a1
ttttagataaatctcaatcaatatattgactagaactgggaaacacacgtgggtatgagggcaccattatcgagcacatctcatatgggattttaaagatggcacctgcaacgatgggctgctgcctcgacaagacaggatttatcaaagagaactggttgtatgggaacaatggctgctgctggaggaaggcggcgacccctggggtagccactaccaatggaggacgttactgttgtcgctggtgtaggggcccatcatatttcgacagagtcaggcggccgaatgggagcagctgttgcaagtaggcaacatggcccgcctcagttagatgagtcagagctgg

SEQ ID NO: 25484 - DNA, 446 bp, Zea mays
  Clone ID: cC-zmle189038g06d1
tatattgagcattgctagacacactgagacaatcgcacttgcaacaatctaacaacagcggctacctagagattagcctttcttgagcgcttcgccctttgtgagaacgcagcataagcggacataaaaacagactgctgactagctgctagagacgatattacacggtgactacgaccaagaaactatagtgggcttaggacaccgtgcttggcaagtctacatgcggcactgagagcgagccgtaagcggattacaacgcccgattggccgattgcaacgacaatacgagacacatctggcaagacaagccatagcatcgcggccggtataactgatactagcagcactgtgcgaccgtagcttgtggaaccgtaccgtctactatgcaaaatcatgtgcttgcagtcaacccactcgctattgctaacgggggagctatacca

SEQ ID NO: 25485 - DNA, 438 bp, Zea mays
  Clone ID: cC-zmle189038g07d1
ccttggcaagggcggggatggcgtctacgtgatcctggtaatgaagccggcacacgtgaacctcacctcttgcatctacacgtacgccgtgctggacacccaggtggacgaccaccccagcggggcgctggtcttccatgagacggacctccgcgccggctagaagatgaccgtccagtacgccagctccggcacgaccgcctccaagatcctcctgcggagcgagggcgcggccatcgcggtctactgactgatggggcccgtgaacctcgcccgcctgttgggggaccccgacttcctcgaggcggcggtgatggacccgacgcatctccactgttaggcgcccacggccaatggcgagaacaaggcgtgcgcctcgtcgctggagtgcatggtggacttgaccaccgccaggctctggaccatgcacgcgagggg

SEQ ID NO: 25486 - DNA, 253 bp, Zea mays
  Clone ID: cC-zmle189038g08d1
atggaaagcaacggtcatatatcacggggcataaaccgaaccaaggacagtcagggccaaaagacccagcggggcaacggggcccaatttaatacagggaaatctaccaaccaaagccaccaaaaaatcctgggaacggggaagtccgacgcctgtataccaagtaccatccccgatcacaggaccccttatgtttcaaagggggggagagaaaaaaactaggggaccccctcctcttaaaggcttggagggg

SEQ ID NO: 25487 - DNA, 363 bp, Zea mays
  Clone ID: cC-zmle189038g09a1
ttttcgtttgtactgaaattaaactttcacacttcattgggactgcttttttgccacatgcgccgagcatccacagaaaacataagaggtagggttcagtcccatttacagatccgtctgtgagctgaaacttgacaagaccccgatttccaagccacgatgaaagcatagcatctagcaaaacgacattataacgtattgccatgtttgaaagttccacagcccccgacaactcaaactcatcagaaatactcgctccattatttgaacatacaggccgctatgatgttaacagcaaacactagccaatacatattggtctggaatcgtattgatgagcactctgtggagagggcacaaact

SEQ ID NO: 25488 - DNA, 265 bp, Zea mays
  Clone ID: cC-zmle189038g09d1
caaagcagggatggttaaaacggccggctttaattttttttttttttaactcccaaagatacagcctgagcacaaactgttaaaaggggaaaaccatggcgggaaggccacagccacaaacatgcaagagctgaaagttaactccgagccggggtggttctctcgcgacaacaacgggtccttttggaatcccgagaaggcgcacaaaaggggcttgtgatccattggaagcattggccccagggagctgggcctcctttggtct

SEQ ID NO: 25489 - DNA, 347 bp, Zea mays
  Clone ID: cC-zmle189038g10a1
aaattcaaacttttttcaaaaaaaagggtttttgtttggaatgaccttaaggaaaaaacccccgggggggggaagtaatttccaaaaaaaacacttttcattaagggaaacggggggtttacatggccaattattaaccagcccgattttaagtacaacaaaatccgggttttaaacaggtgtttccttaagaaaaaagaagcttttttcctccccccgggaaaagaagggtttaaagggctgcaaaagggccttatcaaaatttaggggggggtttaacaatggcgggggcattcctttcccaaagggggaaccgctttttgcgaacttttaccctggaaaagttt

SEQ ID NO: 25490 - DNA, 73 bp, Zea mays
  Clone ID: cC-zmle189038g10d1
ctttacactactatttttgtcacagttttctatgcttctgactttagggccggttgaaacagtgcttgttgtt

SEQ ID NO: 25491 - DNA, 326 bp, Zea mays
  Clone ID: cC-zmle189038g11a1
ctcacattctcttttttttttttttttttccgcccaaaaaaaggggatttctcctcccctttctaaaaaaaaaggcggtcttttttgggactaaattatttcaaacccccccctggggggggattgaaacctaccccccccaaccccaaccttttggtcctccgcccccctggcttttttgaaaaagaaaggggccctcacaaaaaaccccaaacccggccccggggtctttttttttcaacccttttaccaaaaaattctttcctccttttgggaccaaaaacctttttggtgtttttaaaaaaatggccccccccgggggcccc

SEQ ID NO: 25492 - DNA, 369 bp, Zea mays
  Clone ID: cC-zmle189038g12a1
tttttgcagcaccaagaagcaccattttttccttaagattaacttaatataaagcctgacgggggtaacagcatccatcgatccgcagtccatgctgtttgatgcatgggtctgctggagccgaggatgaacacagcactaacaactgacacagagcgaccttgcaatcaaaaacacagatgggcaacaacaaacacgagacgaacgaagataaaccctctggactagggtaaacatcacggcagcgaacaggataacttggccgcgcgggccccaccgatcagttcctccagttcccgtcggagttgccgtacccgccgccacggttgccaccgccgtagccgccgccaccaccaccgtacccgccgc

SEQ ID NO: 25493 - DNA, 90 bp, Zea mays
  Clone ID: cC-zmle189038g12d1
atgacgttgcatgcactgcgtacgtaagtcttggatctctctatgagcggaccgccctatttatttttttttttattttttattattttt

SEQ ID NO: 25494 - DNA, 591 bp, Zea mays
  Clone ID: cC-zmle189038h01d1
atggacacggagttcccgggcgtcatccaccaccctcccccggccgtccaccactccacgctcaccgcgccgcagcgctacgccctgctcaagtccaacgtcgacgcgctgcacctcatccaggtcggcctggccctggcgccgatccctggctccccgcccgcgctcgccttccagatcaacctccgcggcttcgacccgcgcgtgcaccgccacgcgccggactcggtccgcctgctcgccgccagcggcctcgacctcgccgcccaccgcgccaggggcgtccccgcgcgcgccttcgccgcgctgctcgcctcgtcgggcctcatctgcaacccggccgtcgcgtgggtcaccttcagctccgcctatgacttcgcctacctcgtcaagctgctcatgggacggaagctgccaagggcgctcccggacttcctgcgctacgttcgcgtctacttcggcgccgccgtctacgatgtcaagcacatggccagggtcgcatgcgcctcccacggcgaggtcgcgctgctgggcggactctagcgcgttgccgtcgcgctacgggtgcgccgcgcagtgggccaaggacac

SEQ ID NO: 25495 - DNA, 373 bp, Zea mays
  Clone ID: cC-zmle189038h02d1
cccacgcgttcggaggtgggttggcttctcctccccctgcggttggggtacggtgtcgtgaggttttccggggttcgggttcgtgggtgagcggatcgagatcgcggcgtcagatgttgaggaccgctgattggtctgtggtctcgcctgggccacggacgaccactccctccacaacgccttcagcacctacggcgaggttctacagttcatgatcatccttggtcgggagacgcagaggttccgcggttttagcttcgccacctttttcacgggggaggcgatgcggaacgccatctagggcatgaacgggctggagcttgacagccgcaacatctccgtgaacgaggcccattcccgcggcggacgctga

SEQ ID NO: 25496 - DNA, 476 bp, Zea mays
  Clone ID: cC-zmle189038h03a1
ttttgcgttatacacaaagctcgcagatctttatacacacaatacatactaacatacatacatgaacgtgcacgaaagggaaaccctgagcaaggaaaacacccaagaacgccatcagtcgtcaagagcatgcaccagatgtcgccgctcaagaactcgatcacgcaggactgcaacgggaagcttcagaagtagtaggggaagcgcgccctcatggccggcgacgggcaggactcctggcagagggctcgagcttccacccaggcagggcgacgccgtccaccgcgcgcctctcctcacagctgctgcggccggcggccaccgaggacggagtgcccgggcttacgggctccttgcctgccgccgcctttgccgcgtcgactgtgccgtcgacagccaacggccgtgccgccgggacgatggtcacctccggcaggctgctcttcggcttcatctgctggggatctgccttgaag

SEQ ID NO: 25497 - DNA, 503 bp, Zea mays
  unsure at all n locations
  Clone ID: cC-zmle189038h03d1
agagatatcacagggacctcttcaggcttcaaggcagatccgcagcagatggaggcgaagagcaggctgccggaggtgaccatcgtcccggcggcacggccgttggctggcgacggcacagtcgacgcggcaaaggcggcggcaggcaaggagcccgtaagcccgggcactccgtcctcggtggccgccggccgcagcagctgtgaggagaggcgcgcggtggacggcgtcgccctgcctgggtggaagctcgagccctctgccaggagtcctgcccgtcgccggccatgagggcgcgcttcccctactacttctgaagcttcccgttgcagtcctgcgtgatcgagttcttgagcggcgacatctggtgcatgctcttgacgactgatggcgttcttgggtgttttccttgctcagggtttccctttcgtgcacgttcatgtatgtatgttagtatgtattgtgtgtataaagatctgcgagctttgtgtataacgcanaan

SEQ ID NO: 25498 - DNA, 470 bp, Zea mays
  Clone ID: cC-zmle189038h04a1
tttttagttgcgaacaaaaaccttgctcattcttctctggtctcgtttcatagcgggagcaaacaaagggaacaacaggggtaccaacacctaatccaaaggtagaacggacactaacacggtgacagaagcgaacggtaacacgatactatagatagataagataactcggccgaagccaggatgggcccacacatcagtccctccagccgtcgccgccgccgacgtagccgtcaccaccaccctcgggccgaccgacgtagccgtcaccgtcttcgtagccgccgtcaccaccctcgtgccgaccgccgtagccgccaccgtcggcataaccgccggcacggtgcccgtcaccatattcgtcgtcgacgtgaccgtcgtcgaaaccaccgtcgccaacgccaccgtcacgggactgggcctggttaacggtgatgttacggccgtcgagcttcttgccgtttatgttc

SEQ ID NO: 25499 - DNA, 488 bp, Zea mays
  Clone ID: cC-zmle189038h04d1
gttcgacgctatcgagaacatgaacggcaaggagctcgacggtcgtaacatcaacggtaaccagccccagtcgcggggtgcatggtgggggcaagaagaggataccgcggtagtcgcggcagatgacgatatcgtggccgacgcctggactgaagttatagcggcagggtgcgttacggccgacggcgcaagggtggagtgaagcgctacggacgcagtggatgatactgtgggcgggcccagggtggtggtggcggcctacggaagcggcagtggatgttggagggactgatgcggggtcccatgctgggttatggcgcgcaatattatctatctatagcgatcgtgtgaccgtgtcgattatgtcaccgtgctactgtacgttctacctttggattaagtgatggtacccctgttgatccctttgtttgctcccgctatgaaacgagacgagagaagaatgagcgaggtttttgtttgcaggtaac

SEQ ID NO: 25500 - DNA, 206 bp, Zea mays
  Clone ID: cC-zmle189038h05a1
aatccaatcttattaatgggggagggcccaaaaagaagggggtaaaaagggtaaaaaaacacccccaccggggggggggtggaaaaaaaaaaaaagggtattttccgggggggaaaaaaataaaaaatgttttccccgggaaaaaaaaaaaaacccaaatttaaccccccccccggtaaaaaaaccccaaaaggccaccccggggg

SEQ ID NO: 25501 - DNA, 330 bp, Zea mays
  Clone ID: cC-zmle189038h05d1
cggacgcgtgggcggacgcgtgggcggacgcgtggggtagccggatcaacccactcgttcgcctcaaagccaaaggtatcgagccggacttcgggctctacggcctcaaggcgatcaccaaggtcttcaagagcggcatcaacgcgacgccggtgatccagtgcagcaagggccccttcgacaagtacatgctgttccagctctacttctgcgcggcggggaacggcacgttcatcgactgccccgcgccgcagcagtacacctgctccaaggagatcctcttccaccccttcaagaagtggatgctcaagcagcagctcaaccagaacg

SEQ ID NO: 25502 - DNA, 372 bp, Zea mays
  unsure at all n locations
  Clone ID: cC-zmle189038h06a1
cncttttattttttttttttttatttttttttcttttctctacccttggggttttttggggttctacaacaaaaagggggtcctcttttttttaacgaaaaaaaaaaaaggtccaaacggaacccgggcgggaaaaaaaatttatttaggcctttggggcaaattgtgggcttttggaaaaaaaaaatttttttttggccccccccccgagaggctttgggaggaaatttctagggcccaccatccccgggtggtcaaggcccagggggccaaaggctttttacccttctttttgggggaactgccccccggggggggggcgttgaaggccttccccgagagggccctttttgtaaaaactttttaaagggg

SEQ ID NO: 25503 - DNA, 426 bp, Zea mays
  Clone ID: cC-zmle189038h06d1
cccacgcgtccgcgatatgttagaagaagctccgggtccaatcaacttcacccaaatgctcaccctcttcgctgctaggatgtccggcggttccgaccccgacgatgtcgtccgcgccgcattcaaagctttcgacaaagacggcctcatcgacggaaacgacctcaaacacgccctcctcacctggggcgacaagttcaccaagaaggaagtcaacgatgccttcgacgccatggacattgacaaccagggtatgatcgacactgaaagtctcatccagatgctcatcggtggtggtgacgaagaataagttctttattcaaaagaacaaaatatgacaaaaatgcataaataaatttttaatcaagcaagattcaatttgtacattttatttattaacttaataaagagagcaacctcattttg

SEQ ID NO: 25504 - DNA, 368 bp, Zea mays
  Clone ID: cC-zmle189038h07a1
tttttagggctagactagttttttccaggccaccaaagaatgaattttgcaacatctgaacaataattacaaccattagctaaaattatgacaaaattggtttcttccttttctcgtataatatacacacatgtatcgagaaaaagggcaggaattaactaaaaagttggcctatatacacacctatcattggagtcagacaatcctcactgaacctccgcaaatttgtaaaatattagactgctaaatcctgaagcacctccaaaactgtcagaaccttctccgcaaggccaatagaaggtggggagactttaggacaaaagtgctgacctaagcttacactggcgccctggaaagaaaactgagac

SEQ ID NO: 25505 - DNA, 627 bp, Zea mays
  unsure at all n locations
  Clone ID: cC-zmle189038h07d1
agtttagagagtaatcagttgtgaatggaaagggttcacattgccttctcttggttgcatggaagtattatatgtgggtgatacaaatttcaccagcggcaaactgctaaaacgggtttctttaccaagtcatattgctacttttgttgcccggaatatttcttgtagatgatgactttgactagtgccgaactggcaaagggggttcttaccaagaattagcctgcaaatgttaattgctaagtccaacattcttggtttcagtgtctagtgaatgatcaaatccaagtcctcaatgggaatctaatatacatctaccatagtgttcgagggcagagtctcagttttctttccagggcgccagtgtaagcttaggtcagcacttttgtcctaaagtctccccaccttctattggccttgcggagaaggttctgacagttttggaggtgcttcaggatttagcagtctaatattttacaaatttgcggaggttcagtgaggattgtctgactccaatgataggtgtgtatataggccaactttttagttaattcctgccctttttctcgatacatgtgtgtatattatacgagaanaggaagaaaacaattttgcataatttagcta

SEQ ID NO: 25506 - DNA, 310 bp, Zea mays
  Clone ID: cC-zmle189038h08a1
gttaaaaaaaaaaaacccaatcccttgtccaaataaaggggggggttttaattgtttttttcccaagggtacaccaaaaaaggtggaattaccaagacgggggcccccctattttaagggggtggcgacccaaaatattggccctttttttttctgggaaaagggggtggattttcccccaccaaaagttcccccggggtggggggaattcctattttaataaaacccttttggggaattttattttttatgggccttctaagcgaaaggggctggcccaaatccgtctagacccgggggggacccctgg

SEQ ID NO: 25507 - DNA, 424 bp, Zea mays
  Clone ID: cC-zmle189038h09a1
ttttaacttaagtaagtagcatgtctcaggcaccaatggaagcagcagtcatatcacaatcagaatgaaaaggtttgttccccctctcgataatttacacgcgtgggcattgcacattcttcagaccctcacatacagctttttatcccggtaaaatcaaagacggcatgcagcagcgcatgacttggcattgctcggcggcgtggcgtccgtccttacaggctaggcgttctctcggcggcgccggagatgacggtgagcaggttgttgccgaaggggtcgctgaggtgcttggcgaggttctccacggggccttcgccggtgacgtaggcctggatgaagaaggcgaacatggagaacatggccagccggccgttcttgatctccttcaccttgaggatggcggcctggtcggggtcgctgg

SEQ ID NO: 25508 - DNA, 259 bp, Zea mays
  Clone ID: cC-zmle189038h10a1
ttttaactatcaatgcgtattttgtttcataaataaactggcatacacacgtatgagttgagtacttgggaaccccaactgacaatctacctacacagccggggagacgtacaagtaggggtacggacaactccttcccttcatgattctctattcacaaacagagtttccgttctgtataacccatcgccaagctcaggttaaacatgcatgattgatgccaaacagaccatgtaacatttcgtaggggcctcatgcg

SEQ ID NO: 25509 - DNA, 302 bp, Zea mays
  Clone ID: cC-zmle189038h10d1
accttatatttcttttttttttatatttttagtatggaacacaacatgggggggggatgtggacactgaatttttgggccaaaacgattattttgtttctgtaggaaaaaatagaaatttgtgtaaaggtttttaacgctttaaatatttgactgtagtttgaattagttttttttactataaattaaaatgcggggtagaaaaagggaggtaaattgagctttttctgtcaatgatttatcagaatttggggcgggtttggttttttactctaattgtcaaattttggctaatttttatgg

SEQ ID NO: 25510 - DNA, 420 bp, Zea mays
  Clone ID: cC-zmle189038h11a1
tttttattgtgggaattttttatctattgagaatttatacatactctaatccctccaaaccactttaatactagagtatccaaactagtcccacatgtccacgttacacaccggttcgtccttaggtcagtgccacgttgctctgctttccgtcgtggacgaacctcttccaatacggcaataccagtgtttcacccagatgatgcccatggactcgagcgggatgcccttggtctccggcaggaagagcgcgatgaagacggtcatgacggcgacccaggcggcgtattaggcgaaggtggcgtacttgaagcggcagagcatggcgaggaacgactgcgtctgcacgaaggtgaggcaaaagccgatggaaacgttcatggcctgccctgccgaccggatgtccaccgggaatatttt

SEQ ID NO: 25511 - DNA, 283 bp, Zea mays
  Clone ID: cC-zmle189038h12a1
ggccataaagaagggacccgtgccttaacctttttttttccttgtaaacaccaaactcaattaattgtttttcacccaaaataattttaccggttcataattacttggaattttttttcccaaacattaatttaatctccatgcggggggggaacccttttgttttatattgttccaaaataatacaaacatttggttaaattagtattcccctattctttaatctatttatccttaaaaaaggttgtttattcttcccttcttttaatatattatattatat

SEQ ID NO: 25512 - DNA, 557 bp, Zea mays
  Clone ID: cC-zmle189039a02a1
atctgaagcgcgcgagagaaacgcgtatacccaggcggcggttgaggaagaggaggagaagaagaagaagatggcttcctccgcatacgcctcatggtccaagcggtggatccgtcccgaggtacgtacgccgttgctgtttcccatctgatcgttcattcggtttctatcgatcggagaattgggtcatcggggatggatggatggatctgacgggatttgccgatcccggtgtcgcgcgcgtccatggatcaggtgtacccgctgttcgtgccgatggccgtggccttgggcatctgctcgtaccagcttgtgcgcaacatcacgggcaaccccgaggtgcgggtgaccaaggagaagagggcggccggcgtcctggacaaccacgacgagggcgagaggtacgctatgcacggcctcaggaagttcgtccgcgggaagaagcccgagatcatggccttcatcaactccttcttcgccgaccctcccaggacgattaagctagattccgtcatggatggatggatggatggattcccgattcccgatcgttcata

SEQ ID NO: 25513 - DNA, 598 bp, Zea mays
  unsure at all n locations
  Clone ID: cC-zmle189039a03a1
cccacgcgtccgcccacgcgtccgcgatctgcaagtctcgctacgtagcagtgcaataaaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagcttctcgcccgcaacggcgtcaagttcggcgaggccgtgtggttcaaggccggctcccagatcttcagcgagggcgggctggactacctcgggaacccgagcctcatccacgcgcagagcatncttgccatctgggcctgccaggtcgtgctcatgggcgccgtcgagggcta

SEQ ID NO: 25514 - DNA, 559 bp, Zea mays
  Clone ID: cC-zmle189039a04a1
cccacgcgtccggggagagagtggtggggattcggcatggacatcatcacgcagctgcaggaccagctcgacgagatggccgtgctggccgtcaacaccttcggcacgctgcagagggacgcgccgccggaccgcctctccagcagctaccctgacccgctcaaccccaaccctaagcccgaggacgactccaaaccccaggtccaggcccagcccggcgcgccgccgccgccaccggcgcaggcgcaggcgcaggcgcagccgcccgcgcctgacctcaccgagcaacccaaggctatgagccgcgccctcgtcctcgcggccaagaaggtaggtaccctgccccacttctcttctcggtgtccccatcttctggaccaaatgcccgcccggtgattccaaaatatctttgtgtggttaagtagaaagtttcggctcgcttcgtagttatactcgtaagtctgatgctgcgaataagtgaaggaccaactgtttaatatttgcttgcttgcccgcgttatgtggagacaaacaaatgaacccgtgttgccacttacta

SEQ ID NO: 25515 - DNA, 527 bp, Zea mays
  Clone ID: cC-zmle189039a04d1
acgatcctcacaccggttccgtttattcgtacgccttcgtccttcgtcgtcgcttctcagtccgtcttcaccctctggcggacttccgtcgtctcagtgccggcctcccttctccgtttactggagaggatatctacaggttggaggtcttccatatgttccttaggaaatgcatcccgctctgactttacataggcatcctatgtgtgctgagattattgaagaattccagaagtgccatctggatcaccctatcaagaagttattcggagagtgcacagaccttaaaattaagctagaccgctgcttccgacaggagaatgctttgaagagaaaggcaaactttaaagaggagcacgaaatttagagaacagctgcaggcttaacaaaaaggggaaattgctgagaaaaacgaggaataataacttgggaacagagggacagggccctgaggctcttaatttttcattggttgcccttgatttgtgaaaggatttgccagtgttattgaactgcatggttctaaa

SEQ ID NO: 25516 - DNA, 592 bp, Zea mays
  Clone ID: cC-zmle189039a05a1
cccacgcgtccgcgcgcttttcgtgtcctcagaaactgcgggtttgctgaaattctcctccactttcccaagcaaagaacaaagaaccgcccttgttctctgcgactctgcccggccggtctccgaggcgggcggagggaaccagagagcaaggcgaggagcgcggaagggctgagggaaggggcggcggggcatggctcgccggccggcgtcgtgggagcagggcggcgacgagtacgactatctcttcaaggtcgtgctcatcggcgactctggcgtggggaagtccaacctgctctcccgcttcaccaagaacaccttcgccctcgactccaagtccaccatcggcgttgagttcgccacgcgcacactccaggtggagaacaagattataaaagctcaaatctgggacactgctgggcaggagaggtaccgagcaattacaagtgcttactatcgaggagctgtcggggcgttgctagtctacgatgtcactaaagtaatgacatctgagaatgtgaagaggtggttgaaggagctccgggaccatgctgactcgacatagtcgcaatgctcattggcaacaagactg

SEQ ID NO: 25517 - DNA, 530 bp, Zea mays
  Clone ID: cC-zmle189039a05d1
gccataccgttcatacggtcatctgatctatcagaaccatatgcagaagcaaacaataacgagatacagaaaacaagcgaggattttggagaaagtcctgtcacaaactttgagatggggatcgattgtcttttgtgggcatgatcgttctcttttaatggatgagctactgaggatgaagtttcagctaaatctgcagtagtgaaatgcaagcatctgccggcgaacaacggtggtcgtaggaatactttcccaatgtgtagtgcatgcaatgcaagttaccttgcggcaaagccgagtcatgttgtatgttagcatagacagaattgagagatatgctgtacgctaggagccataggatgatttgttcattttcaatctttaggcagtcaggaatttaagggattggacaattttgtcaccagcgatcctgtaaagcttggacatgcaaatatgcaatagaccgtccagaaattttgttggttttaacaaaaatatattcttcccaaaattataaaatttagggcggc

SEQ ID NO: 25518 - DNA, 347 bp, Zea mays
  Clone ID: cC-zmle189039a06d1
agggcctctcttcccctactctgccttgaccgcccatagcctgcctggaagccatggaccgaaccaagacgtacgcgggcgggcgcatgcaaatcgagccgcactacgacggaggcggcgcgcggacggactaacgggggctactactacagcagccggcggaagcgggatggggacgaacgtccaacgcgtaccagtacgagtacagcggggcgggggcaggggaagagatgaagcggaacaagtcgaagcggcggtggctggcgctggcggacccggacatggagcgcaagcgcccggtggcggcgtacaaagcgtacggcgtggagggcaagaagaagggcacc

SEQ ID NO: 25519 - DNA, 496 bp, Zea mays
  Clone ID: cC-zmle189039a09d1
ttctacgcggtgatggactgcttctgcgagaagacatggagccacaccccgcagttcaggatcggctactgccagcagtgcccggacaaggtggcgtggtcagcggcgaccgccgagctgggccctccgtcgtctctctacttcaacgccggcatgttcgtgcacgagcccagcgtggccaccggcagggcgcttctcgacaccctgcgcgtgacttcgcccacccctttcgcagagcaggacttcctgaacatgttcttcagggatcagtacaggccgatccccaacgtgtacaacctcgtgctggccatgctctggaggcaccccgagaacgttcagctggagaaggtgaaggtcgtgcactactgcgcggtggggtccaagccgtggaggttcacgggcaaggaggcgaacatggacagggaggacatcaacgccctggtgaaaaaagtggtgggacatttacaacgaccagacgcttgacttgaagggcttg

SEQ ID NO: 25520 - DNA, 477 bp, Zea mays
  Clone ID: cC-zmle189039a10d1
cgaaactgataaggccagactacaacaattctctgtgatgaacaagttcaagaagcatgcacttagggtcaaagctgaacatcttttagatcaagaggctgctgacataaaggatatgtttgagaagatggattttatacacggatcaaatgcttaatttcgatgagctgaagcttggtctgtataaaatcggtcaccaaattcctgatgcagatgttcatatactaatggaagctgtgagtagacattcttttactccacaaccgaaacttattgcacctctttaatattggaacttggaattttttatcgctaaagtgaattacctatgaatgtattttgttcaaacctgggttaaatgtttttccgaatttccattttaatcaagcatttctttcacgaaggggatgaggttgggcccttttatggttactgttagtgcatgttatgccacgcggatgcctgttggaaaacggg

SEQ ID NO: 25521 - DNA, 398 bp, Zea mays
  Clone ID: cC-zmle189039b02a1
cggacgcgtggggaggggataggggaccccataccaattcacatctcatagtctgatgacacaacatcgctccacgtgacaccgtggcagtacacgccgtcgtggtcagtgctctgtgaatgcgctgtgtgggagcctgctactattacggcaatgtggtagcgatacgaggacgctgccgcgatcacggtagcctgcaagatatacggggactcccctgtgtgcgtgtgcacagctcggggactgggcatgcatcaaggagatgccggtggtgcacgacggcccgccggcgggcggtttcacgcccgggcgcttcgcccggcggaaccacacttcggggcccagcgccaccgacatcttactcacgacctgtggtgctttgcgcatatgggatgttc

SEQ ID NO: 25522 - DNA, 299 bp, Zea mays
  Clone ID: cC-zmle189039b03a1
ggaggggtaaggctggagatagcttaaccagagtggtggtggtgctgtgatctagtggcagaatgtaagaaactggctacaccttttacaagctgcgtgttggagatgtatggggctgtttgcgttggattgaccgctgcagttgtaatctatagagacaaaaatattgtagaagcagttgtaatctatatgtaatctatagagacaaaaatattgtagaagcagttgtaatctatagaggcaaaaatattgtagaagctgtagaagtcgatacgaattaaagccagcctgtttctgat

SEQ ID NO: 25523 - DNA, 451 bp, Zea mays
  Clone ID: cC-zmle189039b04d1
gggttgacccacgcgttcgtccacgcgtccgagcacctgcgcgctcgggatctttttcagcaccctgctcgtaaccatcgagcacaaggtcacggcccacgccggtcgtgacggatggctcgtcgacaacctcgacgacgggaggcctcggctacttctactgggctgctggccgtcgtcagcgccattaacctggttcctctttacgttcgacgtcaggggctacgtttataaggagaagcgcctggccgacgccggcatcgagctcgcagacgaggagtctattgccgtcggccactgatgctgttgccagtgccacaaccctgcatgcatgcgtctttccttctctttttttttttatatatgggtatgaacttctgatggacctggttttggcctgtaaatcggtgggggtcgccaagggggggccatgcctgaagtattttggcac

SEQ ID NO: 25524 - DNA, 519 bp, Zea mays
  Clone ID: cC-zmle189039b05a1
tttttataaaatgctttggcttttctagatatattgttttttctatgtatccagacataatgcatatctaaatgcataccaaaagttatctgtctagaaaagtcaaaacgtcatatacttggaacaggagtagatatgacaaaaagagcatgcaagtgatgttcttacagaagaatatatatatttcatggcaagctagtacctaaacttcagatggagtctttgcatcgattgacagggcatgcaacccggtcttgagctcctcctgcaggagatcatagacagccctgtgcctcttaagcaagctcttcccctcaaactccttggacaccaccctcacattgaaatgtgtctccccattggtcccagccacgccagcatggcccttgtggaggtgtgatatgtcttcaatcttcaactctaccggagaaagtgccctctccaaactctcccttatcctctccttactcccaaccgcccgagcaccattcacttttgcataagtggtagaagttgacc

SEQ ID NO: 25525 - DNA, 83 bp, Zea mays
  Clone ID: cC-zmle189039b06d1
aaaaaaaataaaaaaataaaaaaaaataaaaaaaaaaaaaaaaaaaaaaaaaaaaaaaaaaaatacaaaaaaaataagaaaaa

SEQ ID NO: 25526 - DNA, 437 bp, Zea mays
  Clone ID: cC-zmle189039b10d1
tggacgcgtgggcggacgcgtgggggtctttccatcggcgacgtctacgtcggtggaaccactgggctttttgatgtgggccgtcatcctcgctgggatcctcgtcggtggcgcccttcctcgtttatcaacacacatcgcctctttgctggttaaggatatttcaatgcttgcgcattattgcgattctttcagtgtaacaatttaggggcgtttgtcctataattttaagcctctcatggatgcttcaactttgcgtcatgttaacaaataatcagctgcttactcttttattacataaattcttgtattgcttagaaaaattaataaatatgggcgggcccgctttaataggatctcacagctttacggttacgctgggctgtgtcgaacgtccaaaggctcttttttataggtggttactctaaaattcaaat

SEQ ID NO: 25527 - DNA, 465 bp, Zea mays
  unsure at all n locations
  Clone ID: cC-zmle189039b11d1
gtgccccagcaacaacngggcagcagcagcatggaagcaacgctctggtaatgaaggcacggacgccatgctaccggacctctagcggagaaagagctactctcgagtactgtcccatctctcttgtcgtgagtcccgagatacaagactcactctgcttgcggcttcataaggccaaataggttatgcgaggctccggacctttgcggactcataccggaccttaaaggcgattcaccaaggtcttcaagagcggcataaacgcgacgccggtgatccagtgcagcaagggccccttcgacaagtacatgctgatcagctctattctgcgcggtggggaacgggacgtacaatgactgccccggcgccggagaaagaacacctgctccaaggagatcctcttccaaccctccaagaagtgggatgcttaagcagcagaataaccaggacgacgacccttttcag

SEQ ID NO: 25528 - DNA, 567 bp, Zea mays
  Clone ID: cC-zmle189039c01a1
tccggaattcccggggggctgttggaccggtcggaggtgccggagtacctcaccggagaggtccctggagactatggctacgacccttttggcctgggcaagaagccagaggacttcgccaagtaccaggcctacgagctgatccatgccagatgggccatgctcggtgccgctggcgctgtcatcccagaggcctgcaacaagttcggcgctaactgtggccctgaggctgtctggttcaagaccggcgcgctgctcctggacggcaacaccctcaactacttcggcaacagcatccccatcaacctggtggtggccgtgatcgcggaggtcatcctcgtcggcggcgccgagtactaccggatcaccaacggactggaccttgaggacaagctgcaccccggtgggcccttcgaccccctgggcctggccagcgaccccgaccaggccgccatcctcaaggtgaaggagatcaagaacggccggctggccatgttctccatgttcgccttcttcatccaggcctacgtcaccggggaagccccgtggagaacctcgccaagcacc

SEQ ID NO: 25529 - DNA, 557 bp, Zea mays
  unsure at all n locations
  Clone ID: cC-zmle189039c02a1
cggacgcgtggggaggggattcgcgaccccatcccaattcacaacgcatcgtcgtctcccacaacacgctccactaaccctagcgacagcctcgggtcgtcgtttgatccccgcggggagctctagttccgccaagcgtgcgtaccggcgtccggatccgggaccgaagatgacggagtccctggtgcggaacaagccggggatggccagcatcaaggagatgccggtggtgcaggacgggccgccgccgggcggtttcgcgcccgtgcgcttcgcccgccggatccccacctcggggcccagcgccaccgccatcttcctcaccaccttcggtgctttcgcatatggcatgtaccaggtcggccaggggaacaaggtccgccgggcgctcaaagaagagaaaattgctgctcgcagtgctatactgccgatgctccaagcagaagaggatgaaagatttgtcaaagagtggaagaagtgtcttgaggaggaggcgaggatcatgaaagacgttccanggtggaaggtccgcgagagcgtgtacaactctgggaaat

SEQ ID NO: 25530 - DNA, 476 bp, Zea mays
  Clone ID: cC-zmle189039c03a1
cggacgcgtggggcagggtggtggtgttcgaggacttcccggcggagaaggcggccgaggtcatgcgcctcgcggccggcgacgacctgcccatcgcccggaaggcgtcgctgcagcggttcctggccaagcgcaaggaccgcctcgtcgagcgcgcgccctacgcccgcccgtcgtcccccgcggaggcggtcaagccggcctcgggctcggcctcggcctcctggctcgggctccgcagcacggaagccgaccgcctcaccatcgcgctgtgatttactggatcgacctcgaccagtggcgatttaattggctaatgatgggttcatgatcatgcctgcctttggggctggaatgctggatggagatgggagacagagacaggattgtagagatgttttttttttcatttcttacgagagtttcgctgctgtcgtgagatctgattcgataatagagagaagatgaagatcgaa

SEQ ID NO: 25531 - DNA, 440 bp, Zea mays
  Clone ID: cC-zmle189039c04a1
cccacgcgtccgggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctactgcggtggcgggcgccgtgatggc

SEQ ID NO: 25532 - DNA, 601 bp, Zea mays
  Clone ID: cC-zmle189039c05a1
cggacgcgtgggcaaatgcgttcattattccacaatgctcacttgctcctagtgccattattccacagttcctccctccagttacttcaatgggcttcgaacacccagctgtgcaagcctacaggctacaacaagcgcttgcggcgagcgtctaacaacaaccaattgcccaattgcaacaacaatccttggcacatctaaccctacaaaccattgcaacgcaacaacaacaacaacagtttctgccatcactgagccacctagccgtggtgaaccctgtcacctacttgcaacagcagctgcttgcatccaacccacttgctctggcgaacgtagctgcataccagcaacaacaacagctgcaacagtttatgccagtgctcagtcaactagccatggtgaaccctgccgtctacctacaactactttcatctagcccgctcgcggtgggcaatgcacctacgtacctacaacaacagttgctgcaacaaattgtaccagctctgactcagctagctgtggcaaaccctgctgcctacttacaacagttgcttccattcaaccaactggctgtgtcaaactctgctgcgtacctacaaca

SEQ ID NO: 25533 - DNA, 144 bp, Zea mays
  Clone ID: cC-zmle189039c07d1
gtcgacccacgcgcttgctgacgcgtgggattaatgtgaactataggaaccagagtagtcttgggacgagactaagcatcatagaagtggtggaaattctctaattggaagttgatctgcacccagacaactcctgctgtttgt

SEQ ID NO: 25534 - DNA, 355 bp, Zea mays
  Clone ID: cC-zmle189039c08d1
gaaatcctgggtcgacccacgcgggcgcccacgcgtgcgggacccagtactactaaaaaaaagaaagtacccacgcagagcaagccaagaactgcgggggggggaagcatatcaaagcagcagcaaagctaaccaccggctggcgcccatggcccgcggaccctgaatgggggaagctaatggcggcgcacaagggccagcgaccagagggccaacaggatgcggaggcggcggggctcagagcctggaaccctagggattggcgggacaaaagggcgacgaggcgaaaaggccgcggaagaacagctgcaaaagccgacaacgagacgccgatcggagagatcgtcgaccaggg

SEQ ID NO: 25535 - DNA, 472 bp, Zea mays
  Clone ID: cC-zmle189039c11d1
gttttacgagaggccagagccgaggtccggcatacaccgcatggtgttcgtgctgttccggcagctcggcagggggacggtgtttgcaccagacatgcggcacaacttcaactgcaagagcttcgcccgtcagtaccacctggacgtcgtggctgccacgtatttcaactgccaaagggaggcaggatccgggggcagaaggttcaggccggagagctcgtaaggaatgaagcatgcacagaagaagactgcagcgctttcgcatgcatatgatctatcgtcgtcctgcggaatatatatatagtaaccgttgttatatggaataatgtgcatgaaattggtatcagatgcaccgacccgtacgtacgtaattaatgtttgttattacacgcagacatataatatacatactcattcacatgtatccgtatatgtatctatggcacgagaacaaggattgatatttactggt

SEQ ID NO: 25536 - DNA, 491 bp, Zea mays
  Clone ID: cC-zmle189039d01a1
cgccagtcgccatgctcgcctacctcctccacgccccagccaccgccgtcgccgtcgccgcggcgccctgtgcctcctatctccgctcactcccgccggcgaagaccccgttcctcccctcgctcccgcgcccggtctcgccgaggcgcgccgccgccgctttcgccttctcccccgccgccgcggcggcccccatcgcggcgtcgctgctccagggccccgtgctggtctgggccggccggctctgcatctactacgcgctcctccacgtcgggcttgccggctctccgcgcaatcccttcctgtcccacgagatcggcggcgaggacggcgccggggacagcgacctagggttctccaaatgggccgagaagctccgtggcggcgcctcaggtgaaaaagatgctcagcataagggaaagctaactagcaaatggaagccgaccaccaaaggcacactgaacagaacttacagagtacgatcaacggat

SEQ ID NO: 25537 - DNA, 592 bp, Zea mays
  Clone ID: cC-zmle189039d02a1
gcccagcaggccattcttctcgccttactccctcacagaacccagtaaaatattgctagtcccgccgtcgagatggccccacgccgcctgctcgtcctcgccgtcgtcgccctcgcggccaccgccgccgcggccaacttcggcttcgcggactccaacccgatccgtcccggcaccgaccgcgcggactccgggctcgagtccacggtcttcgccgcgctcggccgcacccgcgacgcgctccgcttcgcacgctttgctgtgaggtacggcaagagctacgagagcgcggcggaggtccacaagcggtttaggatcttctccgagagtctccagctcgtccgctccaccaatcggaaaggcctctcctaccggctcggcatcaaccgctaagcggacatgagctgggaggagttccgtgcgacccggctcggcgcagcccagaactgctccgccacgcttaccggcaaccaccggatgcacgccgccgtcgttgcgctgccggagacgaaagactggagggaggatgggatcgtgagcccagtgaataaccagggccactgaggatcatgctggaccttcagcactactg

SEQ ID NO: 25538 - DNA, 541 bp, Zea mays
  Clone ID: cC-zmle189039d03a1
ggtggaggtggaggcacctttactgctggaggtagcgacagttttgccaacagtaactttggttctgacagtagctttggtggaaacggtgctggtggctttgatgcaaccggcggttccacaggcgatgatgggttctctgtcacacctgatgataactttggtggtcacaagaatgaagaaaccatggatgatatcttcaaggacgatgagccggacagctactccgacaagaggagctagtttgtgccctatacaaagagtgctcatcaatacgattccagaacgatatgtattggctagtgattgctgctaacatcatatcggcctgtatgttcaaataatggcgcgagtatttgtgatgagattgagttgtcggtggctgtggcactttcaaacatggctataccttataatgtcgttttgctagatgctatgctcttatcgtggcttggaaatcggagtcttgtcaagtttcagctcacagactgatctgtgaatggtgctgaaccctacatcttatgttttctgtggatgctct

SEQ ID NO: 25539 - DNA, 474 bp, Zea mays
  Clone ID: cC-zmle189039d03d1
aattatccgggtcgacccacgcgttcgtgattaagcgatgtgcgcttattgacgacaggtagaataaagagtttggtcaggagatgctgatacttttccagatcaaccacaagaacattgtcaagctcgagggctgttgcctttaggtggaagttccattgctggtttacgagtacgttccaaatggacaccttctacgaacgcattcatggcaagaaccaagcgctacagattcccttcagtaccctactgaggatcgtccatgatgcatcagagggcctcagttttttgcactgcgtacgcggtataactccgatcattcatggcgacgtgaagagtgtcacttttctttttgatgggaactacatggcccaagtgtcagattttggggcctccatactatttctcgtcgacaaagagtagtatgtcacgagggttcaaggttcctgtggatacctctaccctgaatacatg

SEQ ID NO: 25540 - DNA, 407 bp, Zea mays
  Clone ID: cC-zmle189039d04a1
ccctactttatggcaaaaaaaaaaaaaaagggaccgttgccttaacctatgtattcccatgtaatcacaaaactcaataaaatgttctgcgtccaacatagttgtacaggtgcagaattacatggaattttgttgcccaaacaataagttaatcaccatgcggcggggcaaccttattgtcttaatctgttccacgaataatactaacatttgtttcaattagtatcccccagttccttgacgaacttatccttcagcaagctgtttgatcctgccattcttcgcgacatcaaattaaactctccgccgtttgggtcataaacaaggccaccggcttcctgaatggctcttcaaattaaagtattatctcaagatgagttattgaaggctcttctggtaacatatgc

SEQ ID NO: 25541 - DNA, 417 bp, Zea mays
  Clone ID: cC-zmle189039d04d1
ccggaatttctgggtcgactccacgcgtccgagctggtgttgctatgtactcttacattaaggctaagattgaagaggagaaaaggaaaaagagcgcatgactgctgtgaataatattatcgggaccttcctcggacacaacatcgtcgacaatcacgacctacttctaataccttgtattggttttcatcttgagttatttcgatccattgtttgttcccagtctggtgattaaaagtctgcaaattctgtttgaggaattggcagcgatacaaatttggcttctttaagtaaatccggttgccggtacacagcggtattaattcacctgttactgaatggaataccgggatgcaaagggcacaacactctggctgactaaaataaaatggtgaaggtttagccttgttgtggttt

SEQ ID NO: 25542 - DNA, 502 bp, Zea mays
  unsure at all n locations
  Clone ID: cC-zmle189039d05a1
gagttcttggaccaccgcttcttcagagtatgagtacccaagccatggggaccaccgggcagcgacatgatctgaagaacatcaagaagtttcttgtccttcaagtgctgactgactctgttgtaaagcgttcagaaattgatgcccagtgctcgtcgtcttggttttctgttcgcgtccatttccttctccaaagagccatgtggccaacgtttcaatctgttgtgatctggtctgtactgtttcaatctgctaacagtaggagttttaaagatatttagtccaaaacagaactccatcttttattcaaagcggcataaactatcccattttattgagcanaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaaaggacccaagttttcttccccgtgcttgcgacgtaatagcttttt

SEQ ID NO: 25543 - DNA, 315 bp, Zea mays
  Clone ID: cC-zmle189039e02a1
cccacgcgtccgagcggattggcggcaggccatatcgctgaagaaggcaatagaagataaaattgccaaagatggtctgattggaataggaattgcgacaactgcggtcggacttctggttggtggaattgcagctgctgctgccaggaagaagtgaggtcaatatattggatcggcagctcattgaactaggggagctcccgtctctgtaattccaacttttctgttgttaccttggtgatattacagttgaattgccactctttatatgtacgaagtaatcgtatgataatgattaaaaaaaaggatgaacgg

SEQ ID NO: 25544 - DNA, 583 bp, Zea mays
  Clone ID: cC-zmle189039e03a1
cggacgcgtgggcagcgccactgtccagtgcgcgcgtcaagcttgcttagctagccgccatggcctccctcgccgccgtctccgtgaagcccgtggccatcaagggtctcgccggcagctccatctccggaaggaagctcgccgtcgccaggccgtcggcccgctccatccgcaggccccgcgcagccgccgtggtggccaagtacggcgacaagagcgtctactttgacctcgacgacatcggcaacaccaccggacagtgggacctctacggctctgacgcgccctcgccctacaacccgctacagagcaagttcttcgagacgttcgcggctccgttcaccaagagaggtctgctgctcaagttcctgctgctgggcggcggctcacttctggcctacgtcagcgcgtcggcgtcaccggacctcctgccgatcaagaagggacctcaggagccgccgcagccgggcccgcgcggcaagatctaagctcagcttctccatttgcatggtctagtagcttgctttgtactgctagcgccggtcgatccgtcgcaatcgtcatggatcatctctctatcttg

SEQ ID NO: 25545 - DNA, 141 bp, Zea mays
  Clone ID: cC-zmle189039e03d1
ccacgcgttcgcggacgcgtgggcggacgcgtgggcggacgcgtgggcaaagttcatcgaactgtcaaaggggagcttggagaatggtgtgaggttcattcatgagtcaactaggagtgcgtgtgaagtttattcttggtt

SEQ ID NO: 25546 - DNA, 325 bp, Zea mays
  Clone ID: cC-zmle189039e04a1
ctttccttttttttttttttttttttttttttttttttttttttttttttttttttgggaaaaaacaaacttttttcataaccaaaatgggtccacagttttttttccatacctacatgctcttgtggggggacgcatcttgaccccctaaagctgcttacttacttattcagaccgatccagcggggggcaccctgggaagttcacatgcttacggacgacaaattttcataacaatagctggggtggggtgcttcacagaaaacccaaacgacacccccgaaattgcgacgatttaaaatcccacccgtccgaggccccgtgg

SEQ ID NO: 25547 - DNA, 582 bp, Zea mays
  Clone ID: cC-zmle189039e05a1
cccacgcgtccgcggacgcgtgggcggacgcgtggggccgagatggccccgccgcggtggcgcggctccctgaccgcgggctaccagttcttcctcgcgctcggggtgctgatcgccaacctcgtgaactacgcgacggcgcacgcctcctgggggtggcgcgtctcgctgggcctggcgggcgcgccggccgtcgccatcttcgtcggcgcgctcttcctcaccgacacccccagcagcctcgtgatgcgggggcgcgccgacggggcccgggcggcgctgctccgggtgcgcgggcccgacgccgacgtggaggccgagctcagggacatcaccaaggccgtggaggccgcgcgccgcggcgaggacggcgcgttccgccggatggccacgcggcgcgagtaccgcccgcacctggtgctcgccgtggccgtgcccatgttcttccagctcacgggcgtcatcgtgctcgcctttttcgcgccgttcgtggttccgaccgtcggtttcgggagcagcgccgcgctcattggcgccgtcgtactcggcgccgcaacctggggttcctcgtgctctccacct

SEQ ID NO: 25548 - DNA, 89 bp, Zea mays
  Clone ID: cC-zmle189039e09d1
atttccgggtcgacccacacgaccgtgcctggatccggagctcgacatgaccctgccgccggggccggtgctggcggtgctcgcaacac

SEQ ID NO: 25549 - DNA, 604 bp, Zea mays
  Clone ID: cC-zmle189039f01a1
aacgacaccaactgtcctcaatccagcagccctcgagtctcgtccccgcacatcagcagagagacgccactaccaccaccgcaagcgacgacggggagatgtttctgcgacggatcctgaccggcggaggtggcctggcggcgctgagggcggcgcgcgccgtgaaggagacgacggggatcgtcggccttgaggtggcgcccaacgcgcgggaggttctcatcgggctctacacgcgtacgctcaaggagatcgaggccgtccccaaagacgagggctaccgcaaggccgttgagtccttcaccaatcaccgcctccagatctgccaggaggaggacgactggaagcgcatcgaggaccgaatcggatgcgggcaagtcgaggagctcatcgaggaggccgaggacgagctcaagctcatcgccaaaatgattgaatgggatccgtggggtgtccctgatgactacgaatgtgaggtgattgaagacgacaccccaattcctaagcatgttcctcagcaccggcccgttgctctttctgaggagttcttctgacactagatgccgtcaaatcagatcccgccctcaggcgatgctcctcctca

SEQ ID NO: 25550 - DNA, 176 bp, Zea mays
  Clone ID: cC-zmle189039f02a1
gtacaacttgcatcaagaatacatacacatcgatgccttccagttcacctggacgcaacatgttcgcgtaattcccgccgagtgtgagctcttgcatgagcactcgcgaaccacatgtggcgcttgtttgctgtgcaagtgcaagtgagtgcagtgaccggctctcgctcgttctt

SEQ ID NO: 25551 - DNA, 269 bp, Zea mays
  Clone ID: cC-zmle189039f03a1
cccacgcgtccgcccacgcgttcgcccacgcgtccgcccacgcgtccgcccacgcgtccgcccacgcgtccggaaccaccagaaaacatacaagtttgagtagacaatgcttctccctgtagtctgaatcgtctcgtggggatttcggtctttacatgatccggaggcttaaggttgtaaaattagttgaaaatctatacctgttgtaaagggctgaacttttgaccactgaattgactgccaagcttcttatactgtgtgagagaaaa

SEQ ID NO: 25552 - DNA, 593 bp, Zea mays
  Clone ID: cC-zmle189039f05a1
caattaagctgaatgcaaaccattgagatggtccaggttgaggacctccatgacacctatgttggtgtgggttgtgccgccccatcgtgaccgtcatcgattgggcctccgagtccaggagaagacctccgatgaagaaagagacatgctgcacatgcacgagggtacttgcagatagatgtcggctctatggacgaacactcgaccaagtcagatgaggagtatgagggcctagccatgcgagacatgatggctaccggtccaacaatgagcagcaagctgtgagttaaagatgaactcacctgtcctggagagcaacatccataggagtgaggcaaaatggcgggtaccaccacaacatggacccgttcctgaagatgtccaaggaggtggtagccgacaccataatgtcttgcgcgtcattgtgtcaccggccggcaacacgctgcgctggtaccggcgggtgttatgtttcttaggcgtatgtttctgtgctttgagctgtgctatagactggttgtgccaactactgattttaaaagaaaaggtgagctgaaaatcaattgtgaaaacaaacatgtaacgggttcgtc

SEQ ID NO: 25553 - DNA, 101 bp, Zea mays
  Clone ID: cC-zmle189039f05d1
aatgcatgatcagacataatccgttcatatcttttcatgctgaggaaattgcatttattggactttcttgtttacaccaagctactcaacagaactgtatg

SEQ ID NO: 25554 - DNA, 131 bp, Zea mays
  Clone ID: cC-zmle189039f09d1
cactgcacgagccttgcctgttgtttcctgctcccagttgcactgatgaccgaattcagtttgccagacgcctgcatgctgttacttcgtccccagccgtccttgaaatccaataccagaatgccaaggcc

SEQ ID NO: 25555 - DNA, 585 bp, Zea mays
  Clone ID: cC-zmle189039g01a1
gtagatgcgggcaatgttcctgaggaggacaatgctaatgagaaggcgaagcaagcctcctgcagcaactcttcagctggtgacactaaccaccgcagatttagaagcaatggaagcacaagtgattcatggaaggaagttttcgaagagggtcgtctggctttcgatgcgctgttcagtagggaaaagcttccgcaaagcttttctcccccacaagcagtagactcgaaggaggttgccaaggaggaggaagatgaagtgaccacagtggcagttgacctcaacaagaatgccacaagcattgatcatgatgacctcgacacaatggatgagcccagggctttctttcccaatgaattgtcgcacctgaagctgaaatcgcgccgtacaggcttcaaaccatacaagagatgttctgtggaagcgaaggaaaaccgggtgccggctagcgacatggttggtaccaagaggattcgtcttgatagcgaagcatccacataattgatttcttcagagttatatttacatctaagctactataggacttcagatcttgcatgcagtgcttaataaaactcaatctgt

SEQ ID NO: 25556 - DNA, 641 bp, Zea mays
  unsure at all n locations
  Clone ID: cC-zmle189039g02a1
ccaagaacaggaaggaaacaccgccgccgccgcgccttccattccagtactcgcggaggaaaggaacaccagccagcgccatggtcacgtcgacgaccgccgccgccgtgctgtccccgccgtccgtggccgggcttcgcctggcgccgtctccccgggcgcgcgtggcgttccgcgcggcgcgggcgcggcggtccgtggcggcgcgcgcggagctgagcccgtcgctggtgatcagcctgagcacgggcgtgtcgctcttcctgggccgcttcgtcttcttcaacttccagcgggagaacgtggcgaagcaggtgcccgagcagaacggcaagacgcacttcgacgccggcgacgagcgcgccaaggagttctcgggcctgctcaagtccaacgaccccgtgggcttcaacctcgtcgacgtcctcgcctggggctcgctcggccacatcgtcgcctactacatcctcgccacctcaagcaacggatacgaccccaacttcttctgagcggccggctgcgggcatgttcttgagcctgcctgtattctactccgtggtgtgttgagccatatatttgatgctcaaggattggntaatttgacaagttgtgcaactgcgcgtgtacatgatttgctctac

SEQ ID NO: 25557 - DNA, 344 bp, Zea mays
  Clone ID: cC-zmle189039g02d1
ctcacgcgtacggccaggcgatcttcctcacagacggacatgggagaggtctgagcacagactgaccttgcacgtgaggggatctgtggtgaaagacccacggctatgctgttccggaggcttacctgacatgcgcaaagacgctcttattttcggcattgcactggagcattattgtacgcaaggggctggcaaaaggatgctacgtggaggcacactgaacacacgtgcatgcaatgcggaaacatgtatcctgtcggctacactacgccgtcctgcattgggtgctgctgatggcgtgcctggcgcctgggaaccgggcctccgtgagtctttctcatggc

SEQ ID NO: 25558 - DNA, 226 bp, Zea mays
  Clone ID: cC-zmle189039g03a1
ggtttgtccaagggacctatctgtcctagcttcaattgaggcagtaatgtaattctgctgcaagttcacctctcagtccagtacttcagtcaatagaccatattaagatggtgaaatatgaaaactggtagcttgcatctgttcaatgttatgttttaatcaacgctgaatttaatatttgtcaagtttgaacttttctggtttccttgccactgcgaggccatgg

SEQ ID NO: 25559 - DNA, 420 bp, Zea mays
  Clone ID: cC-zmle189039g03d1
atcaaggagcataacctgcaggatccctctgatgaaaaggtggtggtttgtgatgagaagctgaaggtcctgttcgcggggcgggagcgagtgggattccttgagatcgccaagcttctcaaccctcacttcgtgaagtgatgaggaggagccaggccacttccaggaatcgagttagcttatatggttggttggttacttgaggctggcctaaagggtgcgcgtgcgttgggtgttggtagcctgagttggctcgctcgactttgcagaatgctgttggtagcttttattagtagccttcagctcgtaacctggtatgcagttagcgagtgtggtgttctgctatggtttaagtctaaccactgtccatagtcagtcaatgttagcttccttgtccttgcaatggatgttgctgtgtga

SEQ ID NO: 25560 - DNA, 553 bp, Zea mays
  Clone ID: cC-zmle189039g04a1
gcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactacctcggcaaccccagcctgatccacgcgcagagcatcctcgccatctgggcctgccaggtcgtgctcatgggtgccgtcgagggctaccgca

SEQ ID NO: 25561 - DNA, 530 bp, Zea mays
  Clone ID: cC-zmle189039g06d1
agagaacctctttgcaggtgcagccatggcgaagcccgtctccatccaggcgtggaaccccagcggcaagtaccgcgtggtgagcaccaagttcatgccgggcacacgatggatccgcctgctcaccgacaaccgactggtcgcccttgagatatgcaccgagcacaagaccatcctctccgtggacgacaacctggcgctcatcggcgatctgctgcgacggcgtcattggacagctcaccgaggactggggggacgtgctcttctctgcgctcaagcgcgccggaggcacggtctttagcaacatggccggcggctacaacaacgtcgatgtcgaggctgccaacaggaatggcatcgcaatcggcaacacgccgggcgttctgaccggagacgaaggttgagcttgtccgcctaccttttgctggggggagccaggaggatcgtcgaggctgaccagttcatgagggctggcctctatgaccggaggcttccacacctgttcgttggcaacctgctcaagggccaaa

SEQ ID NO: 25562 - DNA, 594 bp, Zea mays
  unsure at all n locations
  Clone ID: cC-zmle189039g07d1
cttgcgaaacccattcggtatttccgggtcgacccactcgtccagagtgactcaacgagcgngagctgcacacacgcagctagctttgagcagcaacatcggcggcaacaatgggggcctccatgatcttcaagtcagctatggcggtggcgcctaatggccttgacgtccctcggtcagtcacgccttcttataaaatcgtctcaatgcacaagaagaagatcaagaccgacaagtcctacgggattgggggtggcctgaccgctgatcgtcacaccaacgggagaaacggcaagggcaagggcgtgtaccaatatttctataagaaccgttcaaacgttgtctgattcatatccattctacaacgttgatgactggcttcccacccggcgacttttttggcggtggaaccactgggattttgatctgggccgtcacccttgctgggaacctccgtggaggagcccttctttttctcaacaaccaggcacngaaacggctaaggatatccaaatgctagccctttttgcgattagatgagcaaaaatacggtgtctgcctataatctaacctacatggatgctcaacccttcg

SEQ ID NO: 25563 - DNA, 124 bp, Zea mays
  Clone ID: cC-zmle189039g10d1
cagcagcttatgcttgctttgtgggggatggagagagagagagagagagatctatttgagaggctattaggtggtcctcgaacgaactatgttggcggtgatcagtgggcaagtggtggaggtg

SEQ ID NO: 25564 - DNA, 548 bp, Zea mays
  Clone ID: cC-zmle189039h01a1
aaccagacaagcaaggaatcccccgatggctcatcgcgttctcctcctcctctctctcgcgtcggccgccgcggttgccgccgccgtcgacgcggaggacccgctgatccggcaggtggttcccggtggagatgacaacgatctggagctgaacgcggagtcccacttcctgagcttcgtgcagcggttcggcaagtcctacaaggacgccgacgagcacgcgtaccggctgtccgttttcaaggccaacctgcgccgcgcgcgccggcaccagctgctggacccgtcggcggagcacggcgtcactaagttctccgacctcacgccggcagagttccgccggacctacctcggcctccgcaagtcccggcgcgctctcctcagagaactcggggagtcggcgcacgaggcgcccgtgctccccaccgatggtctccccgacgatttcgactggagggaccacggcgccgtctgccccgtcaagaaccagggttcgtgcgggtcgtgctggtcgttcagcgcgtcttgagcgctggagggtgcgcact

SEQ ID NO: 25565 - DNA, 580 bp, Zea mays
  Clone ID: cC-zmle189039h02d1
cggacgcgtgggcggacgcgtgggcaaggctgtagatgaaattgagccggctctcaagaagcagcttataatttccactgctgtgatgactgttggcattgcacttgtcagttggttagggcttccatatacattcacaatcttcaactttggtgtgcagaagacggtgtataactggcaattattcctatgcgtggcagttggtctgtgggcaggactagttattggatttgttacggagtattacacaagcaatgcatacagtcctgtacaggatgttgctgactcctgcagaactggagctgctacgaatgtcatctttggccttgctctgggatataaatccgtcattatccctatttttgctattgcttttagtattttcctcaacttcagtcttgctgccatgtacggtgttgctgtggctgctcttggaatgctcagcacaatcgctactggccttgccattgatgcctatggtcctatcagtgacaatgctggaagaaatgctgaaatggctggcatgagccacagaatccgcgagagaactgatgctcttgaggctgctggaaatactact

SEQ ID NO: 25566 - DNA, 452 bp, Zea mays
  Clone ID: cC-zmle189039h03a1
cccacgcgtccgtggacacatgggcggacgcttgggctgacctacatcgagaagcctggccaccattttactctgacggcgtcgtttggaagtgtggatgcttcgagctactacacgcttgcggctcctggctgactgtctacaaagtacctggatctgaacaaccaggtcattaagtcggtgaaggacttcgcggagagcgtcaagccaatcgcggcgatctgccacgggcaatagatataatccaatggcagagtgctcacggggaagaatggcatcccatacccacccgagaatctaaacgtgctgcttcggcggcgggacctgactggaggctgactggacccattgttttttcaccgtaggcaaccttgggaccggatgcaccctgcccagagccacccaaagttcgtgtccgaactaatgaaatttttcggtggctagggtttctt

SEQ ID NO: 25567 - DNA, 244 bp, Zea mays
  Clone ID: cC-zmle189039h03d1
ggaattattgggtcgacccacgcgttcgaggctgtggaggaactgggaacattatgtgctccaagtgtggaggccgggggcatacctgaatgataaaaagcgtggacattgcaatgtcttcgcagcatgacagatcaattctgctagcatatcttcccgagtttaccatggtggggtattagggctaatggcgacatcgtcaattcaaaagagttacccattcttttcggaggaatttttcctt

SEQ ID NO: 25568 - DNA, 457 bp, Zea mays
  Clone ID: cC-zmle189039h04a1
actaggcgtacatccgctgcgggcgccctcataaactgcggttttgctgaaattctcctccactttcccatgcaaagaacatagaaccgtccttgttctctgcgactctgcccggccggtctccgaggcggtcggagggaaccacagagcaaggcgaggagcgcggaagggctgagggaaggggcggtggtgcatggctcgccggccggcgtcgtgggagcagggcggcgaccagtacgactatcttttcaaggtcgtgctcatcggcgactctggcgcggggaagaacaacctgctctcccggttcaccaagaacaccttcgccctcgactccaagtccaccatcggcgttgagttcggcacgcgcacactgcaggtggagaacaagattataaaagctcacatttgggacactgctgggccggataggtaccgagcattaccagtgcttactatc

SEQ ID NO: 25569 - DNA, 436 bp, Zea mays
  Clone ID: cC-zmle189039h04d1
tccggaatttccgggtcgacccacgcgttcgataatccttagctggaacgcgacacgcgagggcgcaacgtacatggcggagacaccggcggaccctaagacccaggccgaccagaaggacctgcatcaggacgaggaccagaacgaagagctggagaacgaccccaaccgggatgagaaggcacagggcagtgaagctgggcaacagggggaggatgatggggatgactacaaggtgaacaaggataccgcgcagaaggtgaagaaagaacaggagggaaacaacgcccagaagagctgcagtactaacattccagaagacaaacgaagcgccaatgccacgtgcttaaggaagaatggaacctacagggaagaaaggaaccatgccagtgaatcctaggtatgaacaggggggaaagttgaaggacatcaaggg

SEQ ID NO: 25570 - DNA, 249 bp, Zea mays
  Clone ID: cC-zmle189039h06d1
acccacgcgttcgcggacgcgtggtcggctatgctatgcaacttcattgtctttaggatcggatagggtgtacgtacgtggattgattgatgctgttagatgcatgtgtgtctttcgcttcacgttgcattgcataagcaagttttttatgatgagtggggcggtgtacactttagtatgaaccatgttttgtgcaatagtggtggtatttgttttctgctggttcaaataaaaaattattatattagg

SEQ ID NO: 25571 - DNA, 107 bp, Zea mays
  Clone ID: cC-zmle189041a01a1
aggacatctgaatgcatataaaaaaaaaactctatgctgctttcattgagcccccaaacctcttgcacacattttaaatatcgaggtctctatttgtcactcccttt

SEQ ID NO: 25572 - DNA, 513 bp, Zea mays
  Clone ID: cC-zmle189041a01d1
cccacgcgtccgcccacacgtacggaggccgctctccctcatgtgatcactgtcgctatctcccggcttaactagtacgcacccatgaatttcggtgggaatggaaaccctacattcccgtgctagcactgctgggcgagcctgaccgtgatcccccgaaagcgcgccatccagagcgcaccatgcttctgagtgacccgaatacagtggtccgaccgcatcactatagttcggtggacaggaacggcaggaaggagaaaggtgtgaccgccctcgaccctagggccaacaactttgatctcatgtatgagcaggtgaaggcgatcaaggaaggccaggcagtcgagaagcccatctacaaccatgtcactggcctcctcgaccctccggagcttatcgcgccaccaaagattttcgtcattgaaggtctgcacccaatgttcgatgagcgagtgagggacctcttagatttcagtatctacttggacatcagtgattaagttaagtttgcat

SEQ ID NO: 25573 - DNA, 307 bp, Zea mays
  Clone ID: cC-zmle189041a02a1
attaaaagggaaagttccctgggaggaacagaaaacaccttttggggggttggacaaaacccaattacccccccccgggggaaaaaagagagtttaggcccccgcccgagggggtttttctttgggatcaggcgcccccccggggtttctttaaaaaagccccccggggcgggggggggttttaaaaaaaaacggagatggggggccactaacacccaagctttgggtattacccccccgggcccgggggaacaccccggaatttaagaccggtacctggggggggggcccccccccctaaagtggg

SEQ ID NO: 25574 - DNA, 373 bp, Zea mays
  Clone ID: cC-zmle189041a02d1
gttggcttatactcaacgtacggtgaagaatgggatgcaagaggttcttctggggtaaactcacacctggctgcggatggctattgtaaagaaagctggtggagtgcctggaggtacaacaaaaggccaatccgggccaaggcctaactctctcttcacacagggtgctggatgtatggggagggccctaccatccttaacatacgcgaactggagactcagaggccccaccgcttaggcttcgtcaccttctccacggaggaggcgatgcggaacgccatcgagggcatgaacggcaaggagctgggcggccgctacatcagcgccaacgttgcccactcccgctgcggacgtggaggctgttgtagtgggt

SEQ ID NO: 25575 - DNA, 556 bp, Zea mays
  Clone ID: cC-zmle189041a04a1
ttttgaagccaaatagttatcattgcaagaacttccagaaccacgggactccatatgattattatatgagcctaggtctttaatttacaggcttccgatgaatctatcaccggaaccaatgcacctctaagcctccacaaggcagaggcagaggcgcagacaggcagaggggggcaaccttcccctgccgactatttgtaacaaatcggaaaagaatgtttatgtgcaccgttccagcatttggagagcactcgtatggccaagagggacccacactaccagtccaatatttacagggcgtatttacagagaacttgctgggctagaccatctgtattttcagaatgtcatatgagaaggtttgttgttaatccatgggccatggtgtagagtccagccagaggattatgttgtctcgtcaaactccatcttctttccacagacagggcatgcttcacttctttccatccactcataaatacagccaagggtggaaattggtgtgagcactgcattactatcctaggtatctcagaatcataatctgcaatttagt

SEQ ID NO: 25576 - DNA, 551 bp, Zea mays
  Clone ID: cC-zmle189041a04d1
ctgttttgttccgagctggagcagtgcattctgtttcccccgctattgaagccactccagctgattcaactgaaagctccttcgatacatatcgttcgcccccaagacctctgccctatgatgatccacgattttcccctcctgctcgtgactggttaaggagtgagaacccaagccattccccagaggaatcggaaccacttagagcaaatgaggatgatgaagaaatggaaacaccaagtataatacagaaggcaagttaaacaaactacaacacaaaaatgataatctgcagctctacttatggtgataaggtgccacccagggaacatggaaattacttcagctatttttccccatctgctgaagatgaagatgtttgtccaacttgtcttgaaggtatcatcgcagtaatcattgttttctctaagtgtattggaaagatgccctgatatttttaaaagctacagtaaaatttccatgacataagaccctggccatgtgaatcgaacaaaggtgttcaaaactatgagcattacattttttttctg

SEQ ID NO: 25577 - DNA, 425 bp, Zea mays
  Clone ID: cC-zmle189041a05a1
ggaagggaacaaccgccaccctttttgttaaagattgtatcctccagtattacatgttacaactttatatatatataaatcacacacccagacattgtacaagagtcccaatgaggcaaaagagttccaagctcgttatgggttgaatgctggaaccgatcggccgaccgatctggcaaatcaatttacctgtcaatcccctcaatcttgtcttcaacctccgaatagagctccctgagcctgtccaggttctcctccgttgtctcccagtagcctctgccactggcttccaggaaggtctgcaccaacttcctgaacgaattggggttggtgtccatgagcctcttcctcatcgcctcgtcctcgatgaacgtggagttggcctcctcgtagacccagttgtcgacctgcccagacgtggcgct

SEQ ID NO: 25578 - DNA, 463 bp, Zea mays
  Clone ID: cC-zmle189041a05d1
agcgccacgtctgggcaggtcgacaactgggtctacgaggaggcctactccacgttcatcgaggacgaggcgatgaggaagaggctcatggacaccaaccccaattcgttcaggaagttggtgcagaccttcctggaagccagtggcagaggctactgggagacaacggaggagaacctggacaggctcagggagctctattcggaggttgaagacaagattgaggggattgacaggtaaattgatttgccagatcggtcggccgatcggttccagcattcaacccataacgagcttggaactcttctgcctcattgggactcttgtacaatgtctgggtgtgtgatttatatatatataaagttgtaacatgtaatactggaggatacaatctttaacaaagagggtggcggttgttccattcaaatcaaatatttattaacacatattcaactcccctttg

SEQ ID NO: 25579 - DNA, 547 bp, Zea mays
  Clone ID: cC-zmle189041a06a1
ttttgagaaatcaagaaccatttagagctgttcagttcgtagtcaacaaaaatgttcagacttcaggtacatatatttatcacttaaggccttgttcggttaatcccgttacccatgaattggatgagattggaaaaaattaagaaagagtttgacttagttgggatttaaacccacccaatcccactcaatccatgtggattggaagctaaccgaacaaggcctaaatgtgaaaggctgttttttcgtactccctgcatatacacaagatataaaaggctatatgaactaaatcttggaataaactaatcatgcagctccctccaaaagatgtgaaaattttgaggacaaatgtttctctcagcaaaaaagctaccgactccaccttttcaaaccaaatatccaagctttcatacacacatcaccaagagagcacaccaaaaatcttcatttcaacctttgcagccatccaagctttcatgcatacatcacgaagaaagcaactgtttctgctgaccaaacaacagcaaaggacttcacgaagaat

SEQ ID NO: 25580 - DNA, 510 bp, Zea mays
  Clone ID: cC-zmle189041a06d1
cccacgcgtccggcaaatggcgcctcagtctcccgcgctcaagctacaacggttcagggtccggtgctgcggcggctgtgccgtctaccgtgggagacaccttggaacgggaggagggcggcggcacagaggcaggcgcttcggctgatgagtcatccaaccggaagcagccgccccctgttgaccccaagattgagaaggagctcaagaaggtagttcagaagactgcggcaacctttgcaccaagggcgtccacgaaaacaaagaaccctgctgtccctggaagtaccctgtacaccgtctttgaagtccagggctatgtttccatgctgttgggcggagcactttccttcaatctcatattcccatcgaatgagccagacatctggaggttaatgggaatgtggtccatttggatgttcactataccttcgcttcgggctcgtgactgctccaataaagagaaagaagctctcaactacttatttctcctgattcctctgatcaacg

SEQ ID NO: 25581 - DNA, 476 bp, Zea mays
  Clone ID: cC-zmle189041a07a1
ccacaccattctatttctcatgtaacaacagcaaagattgttgttggcagtacaaacccatgaccctgcttgcttatcaaaggaactcacaactgtgctaacaacttgccaacgactgaactcattactcatccatataacttactaacaccttgcatagacagacttccgtgcaaaattagggtacagacagacagggatagccggtattcaagtcgccaggctcgattgaacaggaccgacttttcttttgcgaatgcgaaaagactccgacgtactgcgcctgaagccggtgaactcggatcaacgggcgctgacgaggaaagggttctgacatacaccgcactctatcgcgtccgaaccacaagctggaacctcaacctgaagatggaccgcgcatgttgggcatgcgaccttccgcatccgcttgccagaaacatctgaagaccttgatcctgaagacgaccttttattta

SEQ ID NO: 25582 - DNA, 167 bp, Zea mays
  Clone ID: cC-zmle189041a07d1
gggtggacccacgcgggcgcgcacccttccgctggcagagatcgccgttcgtccatgtttctttttttgcttctgtccgcgctgtttggtcctgtgcggactaccagttgggtgacttcactgtctctttggtggctcctttcttgttgatggacgctttttttgtg

SEQ ID NO: 25583 - DNA, 439 bp, Zea mays
  Clone ID: cC-zmle189041a09a1
ttttttttttttttttttttttttttttttttttttttttttttttttttttttttttttttttttttttttttttttttttggggattttttcttaattaaaaggggaaccccccgtttgaaacccacaaaaagggaccccctccaaaattaaaaaaggggggggaggcaaaaaccccaattggaaggggggtggaaaaattcaaaaccccaacaaaaaaaaaagggccccttttaaaaaggttggacaaagggttttaaaaccccacaaataagggggggcccagggggatttccccaaagggggcccaaaagtccccccccaaaatggaaaaggggaacacttccaaaaaaattgggcaaaagggggaaaagccaaaaaaaaaaacccccaaaaacccccgggaaaaaaaccggggtgggaacccccccccgaggg

SEQ ID NO: 25584 - DNA, 382 bp, Zea mays
  Clone ID: cC-zmle189041a10a1
ttttcttctaatgctacgatgacagcaaatttatttgaaatgagtcgtcaccatccttaaaacagttgagccacatgccgcactaccacacttcgtgaacattacacacaatccctcgcctgacaaacagaatcatttatctttggcaatatgcggcggatagccatggactgagaaacgtatcagcacaatatacttgacggcagaacctttcatgcttcagcagccttctctgaagggctgtcttcacccttctgccccatcttcgacttcttggcttcgtagtcttttacagcagctttaatcgcatcctcggaaagcatgctgcaatggagctttactggtggaagggacaagtgcttcgcgatctccgtgttcttga

SEQ ID NO: 25585 - DNA, 418 bp, Zea mays
  Clone ID: cC-zmle189041a11a1
ttttgatgtggctgaaccctctcatatgcatattattgctggctttatatctgtataaatagatacatgtagctatcaaatatgcgccagagaatgcgccaatctgccacagataatatatcaaatacaccccacccaaatataaccaaaggccaccagatcaaatacacgtacatatacatatatatataaatatatacatatacccgattacccgtcatcttattaatttccacccggccgggtcgagatcacattcttctcccaccggttccggactccctctggcagttgaagtagacggcggcgaccggcaagccgaggttgtagagctcggcgaagtcgcgggtgctgaagttctgccgccaccccggggcgtacaccgtctgccggccgagctgctggaagagcagaaaca

SEQ ID NO: 25586 - DNA, 442 bp, Zea mays
  Clone ID: cC-zmle189041a11d1
cggacgcgtgggcacaatggacgccgccgtctccctctccctgcccctgcaccaccacgcccacggcccgctcccgctcccgcacccggcgccccaccacctccactgcgcggtcccgctcaggcaccacgccaccttcgtgtccgtcgtaaccgcgccgccgcccaagcctgacgttcaggctcctccagcggcgcgcctgagccccgccctcgccgagccagcgccaccccgatcgtcctcgttcccggccgtcgtgcgctccttaagccgtgccgccacgggatacccggcttacctgctgacccgtgcgtccggccgggcacgctgagccgtgccgtgcgccacgcgcgcgcgctcctacacctttttcttcggttagagcggcccctggaagagggcgcccgcgcgggcgaggctgccgtgacggtcgtggggcagc

SEQ ID NO: 25587 - DNA, 268 bp, Zea mays
  Clone ID: cC-zmle189041a12a1
attacctgaataaaaactcgggattagggaccggatcctgcaattctcatgtgacatattctaatgcgactcaggattaaatttatgccctacacctaatattactcatttttttattgaaccatctttacaaccctacttcttcgaaatttactcatctgctattgaaccttataacaaccctactacagcccccacacatactgcatttgtctttcctttttgttcctcggcaaaatgctaaccttcgtcccgggagattattttt

SEQ ID NO: 25588 - DNA, 85 bp, Zea mays
  Clone ID: cC-zmle189041a12d1
taggatcccctaactcaacgggtaaccttccgcgtgcaacgttgggggagacgagttatttttcttacgatttagtcttgagacc

SEQ ID NO: 25589 - DNA, 173 bp, Zea mays
  Clone ID: cC-zmle189041b01a1
ccgtggcacaataacatatgctttacattacgagggtttaaacacccgggcgagcaagccaccgttgcatgcttgctgtacaggccgggactcatattccacaggaaaccaggtccaccatccgggctgatctcaaggggagatctgatctcaggatgacgatgtgcctatgt

SEQ ID NO: 25590 - DNA, 485 bp, Zea mays
  Clone ID: cC-zmle189041b01d1
gagccggcgtccgtcctgcatcctcctgcactggagggggaccctcacttgttgattcctctccctgtaccctttgacgcgtgggggtggtggatagcccccatcatggggggggtgcagatgctctcggtgatctacaccgtccggatgatgatgctgagggcgcattgcttgcgcctgcaccggagggggatcgcccatcctggacacggtcgtgaacctctgccacgacctggacgagcccgtgctatggtccatgctgatagactccaaccgagatcaaaccaccattgggtcgacctagaccgtcggctctgaagaacagtgtcaacaacgcgactgcctgcacatacgtccatatttatgcacgtgggatcggtatgtgaaccatagagcagagcagcggacgttctgatccctgataaaaagacaatggactcgaacgttgcatacggacacgagcgtccgagaggatgactattcta

SEQ ID NO: 25591 - DNA, 409 bp, Zea mays
  Clone ID: cC-zmle189041b02a1
accccataaaatgggtctggctttttataaaattttatcgccccaaaggggccagggatgtacaatgtgcttggctagtacactatccagatgggcctttttcctaaagaatcctaccattttagggggggatctcctttacagggtcctttgggagccttgttacataagcgggaggaatgggtgtaaacaataatccaacgcccaggggccataggtggtcgtttcctcccaaaccaatttccgactcattttggattaaagctcgcccgaatgccccggccctgacgtaagcccatgaacctggaagcattcccaaccaactggccaagacatacgggaagaactttactggagtaagggcctattgatagttcccaagggagaaaggttacaggggacccaagcg

SEQ ID NO: 25592 - DNA, 345 bp, Zea mays
  Clone ID: cC-zmle189041b02d1
cccacgcgtccgggcaattgataaggcaataggtgaaaatgggtttaaggttgttactttgctacgcttgagtcccctgttacctttctcccttgggaactatctatatggccttacttcagtgaagttcttgccgtatgtcttgggcagttggttgggaatgcttccaggttcatgggcttacgtcagtgccggtgcattcgggcgagctttaatccaagatgagtcggaaattggtttgggaggaaacgaacagctatggacactgggcgttggattattgtttacagccattgctgccgcttatgttacgaggctcgcaaaggacgcttgtaaggagatcga

SEQ ID NO: 25593 - DNA, 512 bp, Zea mays
  Clone ID: cC-zmle189041b03a1
ttttgaatgggaatatgcagctatatccatggatcagttccaacaagggcaacagctatttcggatgaaattgggctaaagcctttgatcgaaaagaaaaaggaaatagtctgacaaaaacacacatggattcgcatttggaattgggaagcagcacctctgatggagaggagcttacgacgaagccatagacaggcagcaatcaatcacaatcaatcactctcgcgaggacggctcctggtcgtcgtcggactggagcggcggtaggagctgagacttgcggcgagtgtcgcggggcgggagcgggatggcgaggaagtgcttggtcttggagatgggacgggagggttggagctcgacgacgtcgccgaccttgaactggttgtcggggtcgtgcgcctggtacttcttcttgatgcgctcccggcgcttgtacttggggtgtggagccaggcgcaccaccttcaccccgaccgtcttgtccgccttggtcgtcaccacccgccccgtca

SEQ ID NO: 25594 - DNA, 529 bp, Zea mays
  Clone ID: cC-zmle189041b03d1
acacaaacaaactaaccttatcggtctatctatccttctatccccattcccatcccgagacaggagaaggcaaggatgctgctcctgagctcccccttcgtgtccgtgtcgccgccgccgccgccgctcagctcccatggcgctcgcccggcgctgcggatcgaggcggccaggcagctgacggggcgggtggtgacgaccaaggcggacaagacggtcggggtggaggtggtgcgcctggctccacaccccaagtacaagcgccgggagcgcatcaagaagaagtaccaggcgcacgaccccgacaaccagttcaaggtcggcgacgtcgtcgagctccaaccctcccgtcccatctccaagaccaagcactttctcgccatcccgctcccgccccgcgacactcgccgcaagtctcagcttctaccgccgctccagtccgacgacgaccaggagcccgcctcgcgagagtgattgattgtgattgattgctgcctgtctatggcttcgtcgtaagctcctcttcatc

SEQ ID NO: 25595 - DNA, 338 bp, Zea mays
  Clone ID: cC-zmle189041b06a1
gggaaaaaaaaaaaacttggtttaaaccccttttagaaaaaaaattaggggttttaaaaaaataaaggaaattttgcccgggaaaaaaaaaaaaaaatttttaaaggggcccctttttaccccccggcaaaaaaaaaatttttttccaaaaaattaccccttttgggttttttgtttatacccccaaaaaaattttttggggtaaaaaaaaaaaaaattttttttttttttggggaaacccaaaaaaacccccttttttttccccccccaccgggcagaggggtggtccccaaaaatgacaaaattttttttaaaaaaagcccaggggggggtttttt

SEQ ID NO: 25596 - DNA, 492 bp, Zea mays
  Clone ID: cC-zmle189041b06d1
gagattggaagagcatgcttctgctttaagaaaggaaattgaatgcaaaaacaagcaagtaaagctcctcatggatcagctccgtgacctaataactgacgtagccatgtggcagagcccttgctctgtgtgaagtgtgaactgtgaagtgtcaaagagaccctagctggacgtctggtaaaggcatattgtgcatgttgggtaactgactacttggcagttggaagggagaaatagatgggatatgactgggcttcacgaaaaaaaacataaagttttcctctctataccaactaaaattgtgttgggtcatcgatgcaaatgcacataggctgtaatatgttggatatgaatgttattttggacgagtgtagatacgcgtatcctttgaaacttgtctgattttttaccgtgacgaaattcctgtaatgctttgagaatcctgaatttctgtcatataatggcttaaaaacaatgattatatttgctaaa

SEQ ID NO: 25597 - DNA, 312 bp, Zea mays
  Clone ID: cC-zmle189041b07a1
ttttggagaaaagatagtacagtactacacataccaactagtcactcactactatatactaggagtgacggcacatatatcactcactccataacataggtcaaattaaacggcggagacaccagcagaacaagaacaacaatacacaaacacaagtatatatatagtgatgactagctataatagagcatgcgtgcgttttagataaccacaaggaccagcaaacatggcctcttcactgtccatccatctcgcccgatctagcggtggttgctcctggtctcgtcgcccacgcgtccgcccacgcgttcg

SEQ ID NO: 25598 - DNA, 312 bp, Zea mays
  Clone ID: cC-zmle189041b07d1
cggacgcgtgggcggacgcgtgggcgacgagaccaggagcaacctccgctagatcgggcgagatggatggacagtgaagaggccatgtttgctggtccttgtggttatctaaaacgcacgcatgctctattatagctagtcatcactatatatatacttgtgtttgtgtattgttgttcttgttctgctggtgtctccgccgtttaatttgacctatgttatggagtgagtgatatatgtgccgtcactcctagtatatagtagtgagtgactagttggtatgtgtagtactgtactatcttttctccaaaa

SEQ ID NO: 25599 - DNA, 462 bp, Zea mays
  Clone ID: cC-zmle189041b08a1
ttttaccaaaactaaaactcccatatattattaatagcattacctaccattacaatgtatataataacatcgatctttaatttttgtttagaagcaggcatgactacactcagccagcgtagagtagcaaccatgagttcgggcaccaatgcagcagtagcacttgttatctttgcatggaagaaacccttgagcgcattgtgctccttttcctcgcataattccttctttagctagagtagaaacaccgatatcatttgtgacatgacccttcccatgcgcatgagcagcatagtatccgaggagaagtaacgagaaaaacactagtgcatccaccctctttttgttttccatgacgcaagaaaatctaaagaactcctcacgattgatcctagaagagtgcccacgcgtgcgcccacgcgtacgcccacgcgttcgcccacgcgttcgcccacgcgttcg

SEQ ID NO: 25600 - DNA, 482 bp, Zea mays
  Clone ID: cC-zmle189041b08d1
tgggttgacccacgcgtccgctgacgcgtgggcggacgcgtgggcggacgcgtggtcggacgcgtgggcggacacgtgggcactcttctaggatcaatcgtgaggagttctttacattttcttgcctcatggaaaacaaaaagagggtggatgcactagtgtttttctcgttacttctcctcgaatactttgctgctcatgcgcatgggaagggtcatgtcacaaatgatatcggggtttctactctagctaaagaaggaattatgcgaggaaaaggagcacaatgcgctcaagggtttcttccatgcaaagataacaagtgctactgctgcattggtggccgaactcatggttgctactctacgctggctgagtgtagtcatgcctgcttctaaacaaaaattaaagatcgatgttattatatacattgcaatggcagcgaatgctattaataatatatgggagttttagttgtggtaaaa

SEQ ID NO: 25601 - DNA, 337 bp, Zea mays
  Clone ID: cC-zmle189041b09a1
ggatggggtatatatatatagcatcaaaattatgtaatgaagagtagcactgattattgttacatgacgaaggttgagcatccatggaggctagattatagacagacaccctgattttacacgacgaatcgcaagaagcgcatgcattggatatccttagccggagagggcgctggtgttgtagacgaggagggcgccgccgccgaggatcccagcgagggtgacggcccagatcagaagcccagtggttccaccgacgtagacgtcgccggtgggagaccagtcatcctcgttgtagattgggctgtatccgtcgacgttcgcgccgtacttgtcg

SEQ ID NO: 25602 - DNA, 349 bp, Zea mays
  Clone ID: cC-zmle189041b09d1
cccacgcgtccgcgacaagtacggcgcgaacgtcgacggatacagcccaatctacatcgaggatgactggtctcccaccggcgacgtctacgtcggtggaaccactgggcttctgatctgggccgtcaccctcgctgggatcctcggcggcggcgccctcctcgtctacaacaccagcgccctctccggctaaggatatccaatgcatgcgcttcttgcgattcgtcgtgtaaaatcagggtgtctgtctataatctagcctccatggatgctcaaccttcgtcatgtaacaataatcagtgctactcttcattacataattttgatgctatatatatataccccatgc

SEQ ID NO: 25603 - DNA, 274 bp, Zea mays
  Clone ID: cC-zmle189041b10a1
taatatttttttttttttttaaaatataacactctttttttggtttggtttttattttaatactcttttttttaaaattaatccttctaagatcccacaccctaaagattttacaaaaaaaaaaaaaaaatccgttaggaacccatcccaaacgcccggagccaagtcacaccccctcaaaggcaccaacaataaaaacaacaaactcaatacaataaaaactctcaaggtataaaactggcaacatacacccccttttttcctgccaagcccc

SEQ ID NO: 25604 - DNA, 476 bp, Zea mays
  Clone ID: cC-zmle189041b11a1
gcaaaaggtgaaatagcaagatggtaccaaataaatagataaaagtgcacatgctaacagatctcaacagttcacacgataacagcaacgatcacaaacaaaacttgtgatgatgaaaactaggtattgctaaagcaggcgcaggatcgcatcatttcttcttggcagccgccttggtcaccttggcgccggtcgggtccttcttctccacactcttgataactccaacagcaaccgtctgcctcatgtcacggacagcaaacctaccaaggggaggatacgctgagaacgtctccaccaccatgggcttggtcggtatcatctttaccataccagcatcaccgttcttcaggaactttggctccttctcaagctccttgccagaccgcctgtcgatcttggtaatgagctcagcaaacttgacagcattgtgggaggtgtggcagtccagcactgtggcatagccgttgccaatc

SEQ ID NO: 25605 - DNA, 426 bp, Zea mays
  Clone ID: cC-zmle189041b11d1
agggtaaccaagcaaacccggacgggtgttcagacgcgtgggatattccctgggacatgccttttgtgtgcttcggaccatggctggaggtgcttgatgggaggtgttctctttacacagccaaagagctgcctctgctgcaaagtctgaagttgcagagatagtcccacaagagaaatcaccaaaagattccattcaaccaatgtcaccgagtccaagggattctacctcaagatgaagggcgactaccacaggtgcatagaggaaggatgctgcggggagcaccatgaatccctacaaagctgctcgagtttcctctgactgttcaccattattggaagcaggtcatgcagagagccttggaaccgaactcttggagatggtgcctagcagggaagaggagaataaggtgaaagaataaaggga

SEQ ID NO: 25606 - DNA, 360 bp, Zea mays
  Clone ID: cC-zmle189041b12d1
tggtggacggcgagcacggcatctagcgcacgttcgaggtgtttcagaaggtgtgggccgaaaccttctacgccatggcggagaacaacgtcatgttcgagggcatcctgctgaagccgtccatggtgactcccggcgcggaggccaaggacagggccaccccggagcaggtggccgcgtacaccctcaagctcctccaccgccggatccccccctccgtgcccgggatcatgttcctctccggcgggcagtcggaggtggaggcgacgcataacctcaacgccatgaaccaggggcccaacccgtggcacgtgtccttctcctacgcgcgggcgctgcagaacacctgcctcaagacct

SEQ ID NO: 25607 - DNA, 510 bp, Zea mays
  Clone ID: cC-zmle189041c01a1
ggaaggggacgaagaggggccccgcgggcgccggctgctcgtcctcctggacgacctggccgtgcggtcgtcgcactcggccttcttcggctcgctccaggcgcgcgggttcgatctcgacttccgcctcgctgacgatcccaagctctcgctccaccgctacggccagtacctctacgacggcctcgtgctcttcgccccctccacaccacgttttggtggatcagtggaccagaacgcagtcctcgaatttattgatgctgggcatgacatgatcctggcggcagattcctctgcctctgatctcattcgtggcattgcaacagagtgtggggttgattttgatgaggatccagaggcaatggttattgaccatatgaactatgccgtcacagatgttgaaggtgatcacaccttgattgctggtgatgatcttatccattcggacatgatactagggtctgaaaagattgaggctcctgtattgtttcgaggaattggacacatggc

SEQ ID NO: 25608 - DNA, 550 bp, Zea mays
  Clone ID: cC-zmle189041c01d1
gtccgcccacgcgtccgccaggatctgaaatcagaactgagcacgagtgtttaattactgggggtgtagtacttccaaaatcacgtttcagtgctatagactgtaaacgttctgacaagtgctgatcagaaagggtccaagaaaaaaaagaagtgggggcagatcgaacatcctatcacgagtaaatttcccatgagtgcggtcacggtcgtcaaatgttatctaagttggcagtacaaaaacatggttccataaaattggcgccgggtatctcttggcttatagcacaacattcagtgcccacagatcttggtcacgtcagcctccagtgacttgtgcgctcccatgagtcctttatttgtggtacaggttcacaaacgagaatacgaagaaagcacccattgttgaaaatgaggcggtgtagtatgggtacgctgatgttatgaatctctcatactcattatgtctgctaggacgtactggaatctgctttgtaaaagacaaaccaatatatcccagtctttggtactcaactttgaactggaaaact

SEQ ID NO: 25609 - DNA, 287 bp, Zea mays
  Clone ID: cC-zmle189041c02a1
gagccccaaaaaaataaaaattatgttcaaatactacgcgtgaaaatggtatgttcaccttgttacaactgaatggtttgtgggagtgccgtgatgtctgaattcaaataagcatacagaatgcgcgagctgaatgcatgtgtatatacaaactttaatacaattccgaaatgcttgtatcatggattcatatcttccatcatcatgcgctactggctcatccgtagtataaagctgcatgccacaaaaccgaatcagctcacgacgacagctgcggtgccggtacc

SEQ ID NO: 25610 - DNA, 313 bp, Zea mays
  Clone ID: cC-zmle189041c02d1
cggaaaacctgggtcgacccacgcgtgcggttaccggcaccgcagctgtcgtcgtgagctgattcggttttgtgttatgcagctttatactacggatgagccagtagcgcatgatgatggaagatatgaatccatgatacaagcatttcggaattgtattaaagtttgtatatacacatgcattcagctcgcgcattctgtatgcttatttgaattcagacatgacggcactcccacaaaccatttagttgtaacatggtgaacataccattttcacgcgtagtttttgaacataatttttatttttttgggg

SEQ ID NO: 25611 - DNA, 429 bp, Zea mays
  Clone ID: cC-zmle189041c03a1
tttttctttttttcttttctttttagaaaaatgataaagggaacttggttcattagagtgatttcccgtgtttcttacaccagtgaaagtgatatgaaagaaacactcccactttgtggatttttatgggccaaattatctggaggattatatgtggacatatggtttgcctccataaattttcatgaatctttgaggctatttgtgtcatattaatttctttctacaaactatcaacaaaatgcacacagctttccagataagacttctggatttcccagaagattaatccgaataaaatatccggatattctatatccgacgaatattacacatattgttttctaattcgatatccgaacaaaatatccgtattcgtatccggtatccaaataagtccggattttcaaaaattccatctgaaccgga

SEQ ID NO: 25612 - DNA, 517 bp, Zea mays
  Clone ID: cC-zmle189041c04d1
cccacgcgtccgctccttcccggccgccgcgcgagcttggtgggttagtgtctcttcttcgcggagacctgtgagaggagccatcatcatggccgccgttgagactgttgtcctctaggttgctatgtcatgcgagggttgcgcgggggcggtcagaagagtgctctccaagatggaaggtgttgaaaccttcgacatatacctcaaggagcagaaggtgacagtcaaaggcaatgtctagcctgaggacgtcttccagacggtttccatgtcggggaataggacctcctactgggagggcgaagccacggccccggacgctgcggcggcttttggtgccgatgcagctcccggcaccgcggctgaagcgccctcctgctgctgctccggcggcgccagagatcaccccagccaaagctgacgcctgatcgtcacgcttttattcactcacatgtgatgctgcggctgcgactcctaaacctttattctagaaattgctggggattgggtttgattg

SEQ ID NO: 25613 - DNA, 373 bp, Zea mays
  Clone ID: cC-zmle189041c05a1
aaaacggcgggcctggttgatgaaacaaattccccccccaggatttcccttcccgactcccaacaggaaatggaaaggggaagcctgtcccgccagttcggggactgcttccccctcatttttttttttaacatacgtttttttcggggaaaaaacgggattttattctttatggaaagaaccctcgcgcccgtgctgtacgttttgtgggggaaagaaccctggccttatgctttgtacaccttgcacttgtgggtctggggggtgtccttgcaaaaatcctccaaagggtcgccgttgccggccgcccccgcgccgggccatttgggcgccaccaggtgcgccaaatcaaccacgcgttggttgtaccccc

SEQ ID NO: 25614 - DNA, 397 bp, Zea mays
  Clone ID: cC-zmle189041c05d1
tcctgggtcgacccacgcgtgcgcggacgcgtggggaacggcatcgcgctgcgggtgccgtccccgatcgtgtccgtggtggacctggtgatcaacaccgtgaagactggcatcacggccgacgacgtgaacgctgcgttccgcaaggccgccgccggcccgctgctaggcatcctggaggtcttcgacgtgccgctcgtgtccgtcgacttcaggtgctccgacgtgtcctggaccatttacgcgtcgctcagcatggtcatgggcgaccacatgggccatgtcctcccctgggtacgacaacaagggggggtccacccaacgcttggttgtcctgcggcacctggtggcggccaattggcccgccgcgggggtggcccgttccgccacccctttg

SEQ ID NO: 25615 - DNA, 489 bp, Zea mays
  unsure at all n locations
  Clone ID: cC-zmle189041c06a1
ttttgcacggaattgagaagataattcacatcatgctcgaaggtaaagtacatcggatcgaagaaccatgagaaaattgtttgtggaattgtactgaagccacgccccacgcgagcgggaggtcggtcccgcgtgcttacgccggcggcgatgtagcggcctcgagcaggtcctcccgcaggtcgccgtcgacgtcatccccggtgatccggtcgagcacgagcacgatccccatggcgaaggcggcgtcgaagccggcgcgcacccagagcacgaagacgtcccggcccatcatgacgtgcgcgtcctcgtccaccttccgcctgacctccgccaccaccacgttctccttcttcttctcctcctcctncttggcgacgggcgcggcccatgccctggcggaggccacgacgcggcagcagcggcgcgggaaggagccgtcgacgcggaactccccggcggcgccggtggcgaggaggtcgaccagga

SEQ ID NO: 25616 - DNA, 126 bp, Zea mays
  Clone ID: cC-zmle189041c08a1
gactggtaacacagatagaagtgtaaatttaaataagtcaaaatttacagaagagactaacaactgaaattcagattcagatagcaatgcttagcaaaatgtaaacatggaatacataacaacgca

SEQ ID NO: 25617 - DNA, 182 bp, Zea mays
  Clone ID: cC-zmle189041c08d1
tgggtggacccacgcgttcgtgcgttgttatgtattccatgtgtacattttgctaagcattgctatctgaatctgaattggaggtgttagtctctggtggaaattttgactgatgtagaggtacacttctatctgtgttatcagtaaaaaaaaaaagaaaaaataagttcaataaggataaa

SEQ ID NO: 25618 - DNA, 471 bp, Zea mays
  Clone ID: cC-zmle189041c10a1
gcatattgaccagactccagagttctaaaaaaatagtaccagctttttcgaggcttaaagtttgaggtggtctgtgcagcaagggcctcaacagcgacatgcacacctcacacacacaccaagaaaaccaaaaaaacacatgccagaaagaaaagaaaaaagcaaacaaagaaaaaaccttgccacgtatataatcgataattgatgatgtattgaagaacagagttttgaaccatggagcagtttggaagttttacatgactggaaaaaaaagggagatgggattgtagcttttatgagcactgctactagtaatgttcacatagcatggctctgtaataatactgttgatcaccacatccaccagcagcaggcaatccggttgccaacgaggaggcagcctcagacaagcacctgagctgcagctagcctagcaatcggaaccctgaatggggagcaagaaacgtaatc

SEQ ID NO: 25619 - DNA, 65 bp, Zea mays
  Clone ID: cC-zmle189041c11a1
aacttcctccggtccgggtgtttctatccatatccatacgttacctaacgcccgaaccattaact

SEQ ID NO: 25620 - DNA, 491 bp, Zea mays
  Clone ID: cC-zmle189041c11d1
gggtggacccacgcgtgcgcgaacaccagccgaacgggccggtgacgccggtggacatggtggtggacttctacaagttcgactacgagttcggggagccgccgcgcgtgaccagcctgcataacaccgtgcctgttgcgaccttcaacgacttctgcgacgacgtctactttgtcgccgaccagcggggctacgaggccgtcgtctactacctcgccggccagtacctcaagaccgacgataagtctggaaagatcgttgacccgcgcctgcagctcaacaaggtggtgcgagagatcaagtattccccgggtggcgtcaccgtcaagacagaggacaactcggtgtacagcgcacactacgtcatggtttctgcgagcctgtgtgtcctgcaatccgatctcatttagttcaagcccaagctactcttctatggataggtagggggatctatccatttgacatggggcgggttcaccaagatctttctc

SEQ ID NO: 25621 - DNA, 360 bp, Zea mays
  Clone ID: cC-zmle189041c12a1
actattctactcttagcttttttctcaaaacttaattgatatctatacaggagcatacttatgttatgtacacctaaaagatggtataacccgtgcgatattatgtatattggggaaaaaagaggagagcccatgctccctgaacagaatcgctgaaaattgagggctgattacaacctgacttttacaacgagatttttattgtggtcgtggggcacactgatttattaggaacatcaagccctaaacacatcctgcatagttagatcatttacgtcttctttgctcttgaggatgttcaggatattatctattacctggaccttcaacaaataaacctctatgataccatccgccttt

SEQ ID NO: 25622 - DNA, 541 bp, Zea mays
  Clone ID: cC-zmle189041c12d1
ggaagcttcgagttttttttttcttccttttggcttactgcgcaagaagaagggtaacaagaggacggcggcgatggcgaagaggctgctcccatctctgaaccgggtgctggttgagaagctggtgcaacccaagaagaccgccggcggcatcctcctcccggaaacatccaagcagctgaatgctgctaaagtggtggctgttggccctggtgagcgcgacaaggcaggcaatctgatcccagttgctctgaaggaaggtgacactgttctcctgccagagtatggtggaactgaagttaagcttgcagctgataaagagtacctcctcttcagagagcacgacattttgggcacacttgtggactgattcagagcattagcaagcctgtcactagtcggtggttctagacttctagtgtgagatgcgtagtatcagattctgggaacaaaatccctaaaactctgaactggcgggatgccatagattttgtgaagaaaccacataattggccgcttcttggtggcagcgaacttttgc

SEQ ID NO: 25623 - DNA, 493 bp, Zea mays
  Clone ID: cC-zmle189041d01a1
ttttgataaacaggtgttcttgttttatacagtgtgtatatatagagagagacaaagagcaagtgaatttgtaggaacaacgcccacggagaacgaacgcaagcctatttcctcatcacaaggaacggaggcatacataggtctcatgtgtgagcactgagcaccgctggttccggatcatcctcatgccttccaccatgggtcctcgccggtcctgaagtcggtctccacccacgggacgaagaggaccttgccgtcgtcgacgtcggcgtgaaccagggccagcgacagaggcgccggtccacggaccaccttgccctggttgttgtactgggatccgtggcaggggcagatgaacttgttctcagcgccgttccacggcacgacgcagccgaggtgagtgcacacggcgttgatcccgtaggtggccagcgtcttgtcctgctccaccaccaggtacgtggggtcacccttgagcccctgcgcgagcgtg

SEQ ID NO: 25624 - DNA, 420 bp, Zea mays
  Clone ID: cC-zmle189041d01d1
cccatcgcgtccgcccacgcgtccgcccacgcgttcgacgatcgcatgtgcggacgctttagctttagtgagtgaacaccaaccgtttggtgccgactactaacccctaccgatcctcgcctgctgcaaacatggctaccttctgtgtgctctccaacgtcgccaattccacgcagctataccggtcccgcgcttctctgggcaagccgatgaaggggcttggcctgagcatgggccgtgagcgcgcccagttgagcattgagtgccaggcggccagcagcatctccggcgaccgcgtccctgacatggagaaacagaagttgatgaaccttctcctcctaagagccatcttgttgcccaccgtcggcatggtcgatccatacggagccttcttcgtccctgacggattcgggaacgcct

SEQ ID NO: 25625 - DNA, 434 bp, Zea mays
  Clone ID: cC-zmle189041d02a1
acatgtgaatgagtatgtatattatatgtctgcgtgtaataacaaacattaattacgtacgtacgggtcggtgcatctgataccaatttcatgcacattattccatataacaacggttactatatatatattccgcaggacgacgatagatcatatgcatgcgaaagcgctgcagtcttcttctgtgcatgcttcattccttacgagctctccggcctgaaccttctgcccccggatcctgcctccctttggcagttgaaatacgtggcagccacgacgtccaggtggtactgacgggcgaagctcttgcagttgaagttgtgccgcatgtttggtgcaaacaccgtccccctgccgagctgtcggaacagcacgaacaccatgcggtgtatgccggacctcggctctggcctctcgtaaacatgagctcctga

SEQ ID NO: 25626 - DNA, 472 bp, Zea mays
  unsure at all n locations
  Clone ID: cC-zmle189041d02d1
ctaaagtcgccggataatataagaccagcaataacaagctagtttgccctcgttctccaacaaaatgtctgatgtggagccgctggttctggctcatgtcatacgagatgtgttggattcatttgcaccaagtatcgggctcagaataacctacaacagcaggttacttctatcaggtgttgagctgaaaccatccgcggttgtgaataagccaagagttgatgttgggggcaccgacctcagggtgttctacacattggtattagtggatccagatgccccaagcccaagcaatccatcactgagggagtatctgcactggatggtgatagacattcctggaacaactggagccagctttggtcaagagctcatgttttacgagaggccagagccgaggtccggcatacaccgcatggtgttcgtgcttgtccngcagctcggcagggggacggtgtttgcaccagacatg

SEQ ID NO: 25627 - DNA, 415 bp, Zea mays
  Clone ID: cC-zmle189041d04a1
ttttgcatttgtaaagtcttaacatgcaaaaatcccaccacggtttgtactttttccaacaagattggggaaaggtcacacatgaacccctgacttacccattgaatacaaagtaacgcgacctcaatttttttggactgaccctcttcacatctgctcacaatctttagggcacctttgcaaacgggtccattacacttgacaaataacttgcggtctatgtttgatcaccgcaaaccgggcttcgttttaaaatgagaaacgccggtggaacacatataatagtgctccttacttgccgaacctatggtataggagctacgacccccctgctgactgtgaatgtctaccagcttggaccgggggagcgtctgaaatatttccctgaccttatgatccttaggcgctaaaaccc

SEQ ID NO: 25628 - DNA, 395 bp, Zea mays
  Clone ID: cC-zmle189041d04d1
cggcaattgccagacagctcacctgagacaaatgaacctcggattgagtcgattgtacagatggcccacaggtctgatgttgacagctttgctgaactcactggctgccctgtgttgagctctgaagacagcccaagggttatgaactccgtccgggcaagctgtgagccgtcggtcactgattgaagctagatcatagtacacggctcggactcttgaagagcactgtgggtccttggcgcagaatgggatgaaggacatgctgaccttcataatcatccgcaacagtgaggtacgttctggacccatgtcaaaggtcgctgctcaggcttgcgccaacattccttccaacccctggagtcctatccacatgggtttttgcgcctaagactcat

SEQ ID NO: 25629 - DNA, 451 bp, Zea mays
  Clone ID: cC-zmle189041d05a1
gggatgcaattcaaccattccaaaccaacttattgataattaatactagaaaggagagagacatgaaagcatagaaaatacagggtccagaatgtaaccacagataatgataagtcaggtaggtacgacacccagcaaccccttgcacgctatagcaaaagccagctcaagccaggtgaatgtctcggtagcaatcctttggtgatacacttcttttccgatttaagttgagatagagtagggttccgtctccaaagccaaggaagttacttggggccaacatccttcagcgcgcagatctgctcctcccccatcgcagactggacagtcacaacaagatccttcccgctttcgaacccttccttaatctgggccacaagagtctcatcagttgggagtctaagatcatccttagtgttgccatctgaagtaagaaggctcacaaatccat

SEQ ID NO: 25630 - DNA, 380 bp, Zea mays
  Clone ID: cC-zmle189041d05d1
ccgcgcctctacatttcttctctctctgctcctccgccttcgcctgatccatccaagacagggatcgccatgtcggactcggaggagcaccacttctaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaaccgactgagtatcagctgattgatatttctgaggatggatttgtgag

SEQ ID NO: 25631 - DNA, 419 bp, Zea mays
  Clone ID: cC-zmle189041d06a1
ccaaaaccccccccaaaaaaggggggttgtggggcccaaaaaaaaaaaatttttttaaaaaaaaaaccccccccccaaaaagggggggcaaaaaaaaaaaaaaaaaaagggggggggggggggggaaaaaaatttttttaaaaaaacccccccctcaaaggggggttaaaaaaagggaaaaaaaacacgctttttttttttttaaatggggggggagggaaaactttttttttcggggggggggggccccaaaaaaaaaggggggggttttccaaaaagttttccaaaaaacccaaaaggggggcccaaaaggtttttgaaaaaaatatttttttggggggccccctccctgccacaaagggacataaaaaagaaatgttttgggcccacaaaaaaaaaaaatttggggcggggttttt

SEQ ID NO: 25632 - DNA, 229 bp, Zea mays
  unsure at all n locations
  Clone ID: cC-zmle189041d06d1
agaaagaccagggccaagactctaggttttgatgggcgtttgagcatttacgctgagatggaccatgtgggggcagggacctgggtncatgccgaatcaaatctttgctcaaaatccatgggggccagtctttgcggcccctggaaagcctatcgaggaaacagctgctgtcatcttggggatcctccatgacaggaagcacaagtgctccttgccccgcttttcaaaa

SEQ ID NO: 25633 - DNA, 304 bp, Zea mays
  Clone ID: cC-zmle189041d07a1
aacaaacaagggggccaggccaagccaaaaatttaacttttaggttttcccgccccccccaaaaaaccaataaagtttggcaaccccttttacaaaccaggggttacaaaaaacacagggggctcgcccatgggttggggccccaacatacaaaggggggggcctatccccaaaaaaactttagggccgagggaaacaaacaaacgttttatgcaaatttgccccacattttttgagaaagggggggggcataatttgggactagggaacccccaggaacttgggaaaccccggacccgggggg

SEQ ID NO: 25634 - DNA, 187 bp, Zea mays
  Clone ID: cC-zmle189041d07d1
acccacaccgtccggggtgttcacatagttcctcgtcagttaccctaaatctcagaattatagtcctctctccattttctcagagatatagtgttggcaagatgttgcattgatcacgtattgtcttgctttccatgcggagcctgagggtgcgttcttggaggattaggcctactccccctttagt

SEQ ID NO: 25635 - DNA, 255 bp, Zea mays
  Clone ID: cC-zmle189041d08a1
aaacctaataaaaaccaattaattactcacaaaccttaaatacaaataaatatcaaaaccaactaaccactaaccccccacaccgcagattcataccccccatacaaaacacaaaaagacaacccccccacaaaaaacaaatggatcaccacaccccccaaaacaaaaaaccacccacaaaaaaaaaataaaaaaagttaccccccccaaccaaaaaacaactccaacccaactatcaaaaccccccccctcccc

SEQ ID NO: 25636 - DNA, 562 bp, Zea mays
  Clone ID: cC-zmle189041d08d1
ttgatagacgcgtgcgccctcacccccaccgacgccgccggagcccttgaagtagcggaccctggctctcgcgcccatccgcgtcaggagttcgatgtccgtttgcgcctgatggatccgcaccggctgaccggccccgccgcgtccgacgccgacgatgccgatgactgggataatgatgactttgtgatcccaagttttactgttgaagaatctgatatcggtgactgggaagctttacgggctaccgatcctcaaccacctccaaagcccagcaaagatacagagaacatatatcttggaccacacggagcaccggcatctcgagcgaagaaggcataggatacttgggctacggctgggtaccgtgagaagaacaacaaagcgagggaagctgagcagaaggcctttggaactgggcggaacagcaaagggggcaacacaggagaattccatcgccacaatggtggcagccatggcaaggacccctacaagagatctgcttaccttgtgtcgggcgaggctcgttcacattgatacacctatattgtgcctacacctc

SEQ ID NO: 25637 - DNA, 478 bp, Zea mays
  Clone ID: cC-zmle189041d10a1
ttttacgggaatggagctctccttagtctttgttctcatgtacaggcgaaggaacacacaagcgtgctcagccaggcctggcctagccaagctctctacgtagtgcgtgcatcccatcccatcgaagaaataaaattacatcatcatgcgacgctgaaggaggaggcggccttctcgactcccttcctggcgcccttgaaccacctcttgtcgccggcctgcgccttgcagatgtagagcttgccgtcggagacggtggccgcgatgagctggtgcttgccgccctcgtcgccgtccgccgtcctggtgagcacggacacggcgtagtactgcttgccgtcgatcacgggggtggagctctccaggacgttggcggtggccacggcgccggtctcgaacccgccctcggagtcggtcttgccgccgtaagcccgcctgccgagcaggtagtcgacctgggagaggaacttctcgggag

SEQ ID NO: 25638 - DNA, 488 bp, Zea mays
  Clone ID: cC-zmle189041d10d1
acgcgtccccccacgcgtccgcccacgcgtccggtggcacccacgcacactcttttcctttcagtccggaccccggaggagccaagccatggcgtccacctcctgctggctcctccaccagtcaaccggccgcctcggcgcgtcgacgcgcctggccgccgccccgtcgcgcagcgcccagctgctcgtctgcaaggcccggaagcaggacgccgccgcggaccaaagcgacgtctcgcgccgcgccgcgctcgcgctcctcgccggcgtcacggccgccgccggcgccaaggtgggtcccgccgccgcggcatacggagaatcagccaacgtgttcggcaagcccaaggcgagcacggagtacatcgcgtacagcggcgacggcttcaagctgctgatcccgtccaagtggaaccccagcaaggagcgggagttccccgggcaggtgcctcggtactaggacaacttcgacgcctacagcaccgtgt

SEQ ID NO: 25639 - DNA, 462 bp, Zea mays
  Clone ID: cC-zmle189041d11a1
gaaacaaaaaaaaaaagtggaaattattgatgtcataataggtctcggtaggtttcctttcttttgcctggatacaagacgacgacatttacagtaaagggcacaattgtttcaacctgcagttcaaaaccatcacccagtaatggcagtgtttttgtgaactcgatcagatgaaacaaatccaagtttggtacccacaaaaataaatcaataataatacaagagagatgaaaattaaaattatcctctctttttttcaaaaactatacttgatgggtaacgtacaataaccaaggtaaggtgagcctaacaagatgaacaagcccccagggggaaaaccttgtgtggtcggcagaagacgtccaggctaacattcaaatgtcatacggttgctgtctcgagcaaatatgtatcttgcagcttcataaatgtcttccatcagccagaaaagagaaaactcat

SEQ ID NO: 25640 - DNA, 565 bp, Zea mays
  Clone ID: cC-zmle189041d11d1
ccggaatggctgggtggacccacgcgtccgggcttatcactcaggtaaaacctcttatctgggtcgaagcacatattgagaaacattctacaagccgtatagaactcatggcgaaggcaaggagtcagttcatggaaagaagcacagcaacaaatgttgaaattgaagtgcctgtttcttcatatgccacaaacccaaatataagaacttcaatgggttctgctgcatatgctcctgagagagatgcaatggtctggaaagtaaaatcattccctggtggcaaggaatacatgtgcagagcagaatttattcttcctagcataacagcggaagaaggggccccagaaaagattgctccaatacgagtgaaatttgagataccatatttcaccgcatcaggtattcatagtcccgttatctgaagataattgaaaagaagtggttaccaggcactcccctgggttagatatattacgatggcttgcgaatttgagctgagacttatatgaggttcctcttttcgggcgaggaagacatttatgaagctgaagattcatatttgctc

SEQ ID NO: 25641 - DNA, 262 bp, Zea mays
  Clone ID: cC-zmle189041d12a1
cttctatattttttcttggggggaacaccgactaaaccacgattaaaaccattatgaatgttctttcattctttcacaaaaaagccctactcgcctacaaaccaaaagaatctctgcctgtcacggtccgccttaacaaaccaccaggccaaattgtgttccagcccctgcatctagatgttccctgcccctacccccagtgctggggaaggttagtaaatcggcccgggggaaattaattcacggcctgccctctggtaac

SEQ ID NO: 25642 - DNA, 581 bp, Zea mays
  Clone ID: cC-zmle189041e01a1
ttttatttgtttcgaaaaagatatcgtccgattctccttctattgattcttttccgatcgagatgtatggatccatgtgtctacatacctagattctgttcatggattaacgaaaatgtgcaagagctctatttgcctctgccattctatgagtcgcttcctttttgcgtatggcacccccactccctttggcagcatctactaattcggaacttaatttgaaagccatatttcgacccggacgcttttgggatgcttctaataaccaacgaatggcaagtgctcttccttgtttagatcctatttcaatcggaactttccgcgtcgatccttttttattacgtcttgtttttactcctatattgggagttactctacgtattgcttgacgtaaaaccaatagtggatttgtttctgtcttttgttgaatctttttcacggctcgatagagaatttgataagccaatgatttttttccgtctttcataatacggttaaccaccatgttaactaatcgattacgaaaaaatggatcggattttgcggttcttttttctgcagtacctcgacgtgacatgagc

SEQ ID NO: 25643 - DNA, 606 bp, Zea mays
  Clone ID: cC-zmle189041e01d1
aaaagaaaacggattcttgaacctctttcacgctcatgtcacgtctaggttctgcagaaaaaagaaccgcaaaatccgatccaatttttcgtaatcgattagttaacatggtggttaaccgtattatgaaagacggaaaaaaatcattggcttatcaaattctctatcgagccgtgaaaaagattcaacaaaagacagaaacaaatccactattggttttacgtcaagcaatacgtagagtaactcccaatataggagtaaaaacaagacgtaataaaaaaggatcgacgcggaaagttccgattgaaataggatctaaacaaggaagagcacttgccattcgttggttattagaagcatcccaaaagcgtccgggtcgaaatatggctttcaaattaagttccgaattagtagatgctgccaaagggagtgggggtgccatacgcaaaaaggaagcgactcatagaatggcagaggcaaatagagctcttgcacattttcgttaatccatgaacagaatctatgtatgtagacacatggatccatacatctcgatcggaaaagattcaatagaaggagatcgggacgatatcttttcgaacatat

SEQ ID NO: 25644 - DNA, 564 bp, Zea mays
  Clone ID: cC-zmle189041e02a1
ttttgcaaaaaaaacacattagatagtaaaattgttgcgcgtcacattgtaggggcttttgagtagtagtagtagtagtactacattgcataatagtctgcgttcttggtacataaaagagtctctttgcttcagaaccgtcgcagtgaagctgccgagtatcatgaggtttatctatcctctcagccatgtgttcctgtaggacgagttgtcacgccgcgaagcatcatggggtttgtactccatcagatagctgtgcggcagcttgaggtgcctcttgatagaatccctcaatgccatcacagcctgatggtctgatgcgttccggttccagacgctcagaatgtcttcattgaaacggacactaagcacaacaccacagacatcatcgctatactcaagctggtcgcctactaccactagcaccaaatcctcccaaaatcgacctgaaactgcctttttgaatctaattatccacttgccaccattctggtttgcaggatcctcccagaggggacggatgccatccttgaagagatgaaggtcagtggggctcggcaggga

SEQ ID NO: 25645 - DNA, 567 bp, Zea mays
  Clone ID: cC-zmle189041e02d1
cggagaataaggaggccgagcaggaggagcagcagctaccgcacgcgcagaaggataacgcgcccgccgccgccgaggaagacgaagcggattcggaggagaccgagcgccgcaaccgcgacctcaagtccggccttcacccccttaggcacaaactcgtgctctggtacactcgccggacgcctggagcgaggtcgcagtcgtacgaggacaacatcaagaagatcatcgatttcagcacagtcgaatcgttctgggtttgctactgccaccttgcgcgcccttcttccctgccgagccccactgaccttcatctcttcaaggatggcatccgtcccctctgggaggatcctgcaaaccagaatggtggcaagtggataattagattcaaaaaggcagtttcaggtcgatcttgggaggatttggtgctagtggtagtaggcgaccagcttgagtatagcgatgatgtctgtggtgttgtgcttagtgtccgtttcaatgaagacattctgagcgtctggaacccgaacgcatcagaccatcaggctgtgatggcttgagggattc

SEQ ID NO: 25646 - DNA, 378 bp, Zea mays
  Clone ID: cC-zmle189041e03a1
cccaaaaaaaaccagccaaagattttattcatatctaacgggttaaaaagcctcttccaacaaggcaaatccaacaatgggggtgttacacaaaagctacactgggccttacagatcactgaacagtttatggtgataaacgggcttggggctccccagggaaattattgatcccaggcccttattggtcggccccttgatcttttgaacatagagccctgttccatacaactttttccccccccctttttgcaaccctgtgcaaaattccagtggttcaccaccccaaaatttgcactatttttatggggggacccttggttctcactaggaaccgggccttgttcccttaggctctgtttcgttcccttggattgc

SEQ ID NO: 25647 - DNA, 489 bp, Zea mays
  Clone ID: cC-zmle189041e03d1
cccacgcgtccgcccacgcgtccgcccacgcgtccgcgaggagtcttgcgcgcctgctggcgctggggcgggtggacgggagcattgctgtccgcggcggagcccggcgctcgagtctcttctctcctctcctctcctctcctctgcggggggcagccttttatttgacaacggtataaagaaatcaagtacaaatgaagaggcacatctctgcccagtatttgatgactgaagataggtagcagtatggcagctgctacaattgcgggaatgttccttgtgtgttttgagtccctctgcacctgttttggcacaaaaaggaaagatgaaagcgaagaccatgttcttgcagaacattccaattccttgagtttcttatcaaatgaggtcggcttctgatagaatttctgcaagctcgcttcgagcacctgcaagtccatctagaatttcattgtcttcgccccccagccagaatgaacctttaaacat

SEQ ID NO: 25648 - DNA, 463 bp, Zea mays
  Clone ID: cC-zmle189041e04a1
gggagccccaaaaagccccattttttccttaaaattaacttaaaaaaaagcccggcgggggtaacagcatccattgatccccaatccatgctgtttgatgcatgggtctgctggggcccgggattaacacagcactaacaactggcccagagggaccttgcaatcaaaaacacagatgggcaacaaccaacccgagacgaacgaagataaaccctttggactagggtaaacatcacgggagcgaacaggataacttggccgggcgggccccaccgttcaattcctccagttcccgtgggagttgccgtaacccccgccacggttgccaccgccgtagccgccgccaccaccaccgtattcgtcgccgccaccgtatccgccgccaccgccgtaaccgccgccgtcattacggggcccgccaccgccgtagccgccgtcttcacgggcaccaacgtacccaccg

SEQ ID NO: 25649 - DNA, 435 bp, Zea mays
  Clone ID: cC-zmle189041e04d1
cccacgcgtccgggttggcttctcctccccctccggttctggttctggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggatcgccatcgagggcatgaacggcatggagctggacggccgcaacatcaccgtcaacgaggcccatcccgcggcggccgtggaggcggcggcggtgggtacggtggtggccgtggaggcggcggctactgcggtggcgggcgccctgatggc

SEQ ID NO: 25650 - DNA, 411 bp, Zea mays
  Clone ID: cC-zmle189041e07a1
ataaaaaagataaagggaacttggataattagagggatttcccgtgtaattcacacaagtgaaagtgaaatgaaagaaacactacaatattggggattttatggtccaaatattttggaggattatatgtggacatatggtatgcctccataaattttcatgaatttttgaggctatttgggtattattaatttctttctacaaacaatcaacaaaatgcacacagctatccagataagatatctggatatccgagaagatttatccgataaaatatccggatattcgatatccgacgaatatcagacatattgtattcgaattcgatatccgaacaaaatatccgtattcgtatccgttatccgaaaaaagtccggatatccgaaaattccatctgaaccggacgcgttg

SEQ ID NO: 25651 - DNA, 436 bp, Zea mays
  Clone ID: cC-zmle189041e07d1
gttcagatggaattttcggatatccggacttttttcggataacggatacgaatacggatattttgttcggatatcgaattcgaatacaatatgtctgatattcgtcggatatcgaatatccggatattttatcggataaatcttctcggatatccagatatcttatctggatagctgtgtgcattttgttgattgtttgtagaaagaaattaataatacacaaatagcctcaaaaattcatgaaaatttatggaggcataccatatgtccacatataatcctccaaaatatttggaccataaaatccacaatattgtagtgtttctttcatttcactttcacttgtgtgaattacacgggaaatcactctaattatccaagttcactttatcatttttctcaaagaaatacggacgccgctacctaaattaatcgg

SEQ ID NO: 25652 - DNA, 468 bp, Zea mays
  Clone ID: cC-zmle189041e08a1
gcagcaccaagaagcaccattttttccttaagattaacttaaaataaagcctgacgggggtaacagcatccatcgatccgcagtccatgctgtttgatgcatgggtctgctgaaaccgaggatgaacacagcactaacaactgacacagagcgaccttgcaatcaaaaacacagatgggcaacaacaaacacgacacgaacgaagataaaccctctggactagggtaaacatcacggtagcgaacaggataacttggccgcgcgggccccaccgctcagttcctccagttcccgtcggagttgccgtaaccgccgccacggttgccaccgtcgtagccgtcgccaccaccaccgtagccgtcgccgccaccgtagccgtcgtcaccgtcgtagccgccaccgtcattacggtgcccgccaccgtcgtattcggcgtctcacggtcaccaccgtacccaccgccgtcgt

SEQ ID NO: 25653 - DNA, 393 bp, Zea mays
  Clone ID: cC-zmle189041e08d1
gtccgggtgggttgggttgtcctccccctccggttggggttcgggttcgtgaggttctcctgggtgcttcttcctgggtgagcggatcgagatggcttcgtcttatgttgagtaccggtgcttcgtctgcggtctcccctgggccacggacgaccactcccttcacatcttctcttaggacctacggcgaggtcctctagtccaagatcatcctcgatcgggagacgcagaggtcccgcggcttcggcttcgtcaccttctccacagaggaggcgatgcggaacgccatggagggcatgaacggtaaggagctggacggtcgtaacatcaccgtcaacgaggcccattcccgcagtggccgcggaggcgggggcgcggggtacagtggtggcc

SEQ ID NO: 25654 - DNA, 383 bp, Zea mays
  Clone ID: cC-zmle189041e09a1
ggcagacaagatacactggccaccatgttccaaatttgtttgaaattgtttccaccacttattgtttacttatgcgactaagttgagggcgaggatccaatgctggcatatataatatactgaaacaggccacacactattaaattgtatagaacacctaatgggtacattgcgtcgcgtcaaattacttgggggtccagatcccgcagggatgcaagcaaattggccaaatcttctatgatgaaacggatggatctgactgcaggcagggggcaaagtgtttcaatgctcccccatataccggtttcttgaaatgaactgcctctttaataactaccttgggggggataaaagtccattcaccaaacccttgtttttcagat

SEQ ID NO: 25655 - DNA, 506 bp, Zea mays
  Clone ID: cC-zmle189041e09d1
cgcgtccgcctactcgtactggtcccgcagggacaggcttcgcgccatccttgtgctttctgagagagagttcccggacgctcacacgtacgagagggttcacccgcttggttatctacacaccgtggggttctagaatgcacgcacctaccacatgggaacagggtcaggggggtgtatatgccagggtggaaccgagggcagttatctctcaggtaactgcaggcaagacggaactgagatcgacttagattgtggatgcgcgctgcttaatggtaagcctagaagtccacagcctatgtcatagcctaactgaaagagctaaggagaaccagatggagaagcctatcttagctggggcatgaatataagcatacggcatgcgagtgtgtgattaaccttaatggtgatggatctgagaagccagagtttggtgaatggacatggatgacacccaaggaagttattgaaaagggcagttgatttcaagaaacctgtatatgagg

SEQ ID NO: 25656 - DNA, 484 bp, Zea mays
  Clone ID: cC-zmle189041e10a1
ggtattaactcaaagtctcaaacgtgcctcttgttgcattgacacacatgtacaatacaatcgtacatatagtacgttttattcgacaagcagcctctgcatgcaataatagtacaacccccgatttaattaattggactaatgcatgctgaggatggatcagatggagatgctgctggggatgcccctcccggtgactcccggcttggagaagggcttgagcagctcgtacggcacgatcccggcgccgcagcggttcttgaggtccaggttgttgttgcactcgtcgatgaacccctcgatctccttcatcctgccgccgaacttctcgaacgccgccttcaccatgggctccgccagccacgatggctccgcgaactcccccatgtactcctcgtcgggcgagtgcgacgagaggatgtccagcgtcgtcatgaccttgatggcctgcatctgcgtgggcagcatgtccagcagcgtcgtc

SEQ ID NO: 25657 - DNA, 505 bp, Zea mays
  Clone ID: cC-zmle189041e10d1
cgcgtcctgccacgcgttcgactcaccacattcgttctcgctcggtttgcgcgcgtgaggtgagtgagaccaccacgccatacaagaattaatggccctggagacgtgcttcagagcgtgggcgctgcacgccgcccctgctggcagcaaggacaggctcctcgtctgcagcagcggcggtaacctggtgctgccgtcgaagcgggtcgcggccgcagtggaagcgggcgttcacgcacgggcccgacgccaccgacgcctggctgtggaagctggccaaggcgcacgtgctgacccacgacacggggtaccaccagctggtgagccactggctgcgcacgcactgctgcgtggagccctacatcatcgccgccaaccggcagctgagccggctgcacccggtgtaccgtctgctgcacccgcacttccgctacaccatggagatcaacgcgctggccagggaggcgctcatcaacgccgacggcatcattgaggagtccttttg

SEQ ID NO: 25658 - DNA, 339 bp, Zea mays
  Clone ID: cC-zmle189041e11a1
ttttaatcaagctatgaatatgctctttcgaacgtgggcgaactataggaatattttttatggcatccgttgctaagcacggtcaatccattttttgtacattttgcacaacagtgacgtctaacatgacatgtacgagcagaaaaaagaactgacaaatgcatttttctttggcgaggcacatctctcagctcgcgcgctcgtctttcctctgtttgatcagcttgaagaggctgggcatcaccttcttcttcctcttgatggtgaacgagggcgtccgcgggttccggatccccgccgacgaagacacggacgaccgccgcgccccggacgcgtggg

SEQ ID NO: 25659 - DNA, 339 bp, Zea mays
  Clone ID: cC-zmle189041e11d1
cccacgcgtccggggcgcggcggtcgtccgtgtcttcgtcggcggggatccggaacccgcggacgccctggttgaccatcaagaggaagaagaaggtgatgcccatcctcttcaagctgatcaaacagaggaaagacgagcgcgcgagctgagagatgtgcctcgccaaagaaaaatgcatttgtcagttcttttttctgctcgtacatgtcatgttagacgtcactgttgtgcaaaatgtacaaaaaatggattgaccgtgcttagcaacggatgccataaaaaatattcctatagttcgcccacgttcgaaagagcatattcatagcttgattaaaa

SEQ ID NO: 25660 - DNA, 276 bp, Zea mays
  Clone ID: cC-zmle189041f01a1
cgaagggagctcgttttgttggtttctatttttttttcaaccccaaaacagatgcagcattcagagtcacactacagtcagccggcacctggcactagcagtaccactaccagcccaacaggcaaggctgtgctactactgctacaaagcgacagaaacccatcacacgcgcacacacacgggcgacactggacagtccgggacgatccaaaccctgaccaaaaagcactcacggtcgcacagtctcgcggagcagtttcggaagacacgaacgac

SEQ ID NO: 25661 - DNA, 334 bp, Zea mays
  Clone ID: cC-zmle189041f01d1
tgggtctacccacgcgtccggtcgttcgtgtcttccgaaactgctccgcgagactgtgcgaccgtgagtgcttcttggtcagggtctggatcgtcccggactgtccagtgtcgcccgtgtgtgtgcgcgtgtgatgggtttctgtcgctttgtagcagtagtagcacagccttgcctgttgggctggtagtggtactgctagtgccaggtgccggctgactgtagtgtgactctgaatgctgcatctgttctggggttgaaaaaaaaatagaaaccaacaaaacgagctcccttcgaaaaaaaaaaaaaaaaataaaaaaaaaatttaatatgg

SEQ ID NO: 25662 - DNA, 527 bp, Zea mays
  Clone ID: cC-zmle189041f02a1
ttttccaaaatcagggtctaccattaaaatccatttttttaggccatgcctcctgacaatacatatgatttttctgttgctagcttaagcagcagggatttaatcacatttgatattcctgtagattctccttacaaaaagggttgaccctagatagccaatagctccacaaagtatgcctaggccaaggcagaacatcagcgtgtagccgaaatagaaacttgtctggaagaagcctgacatctttgtcttcacatggtagtagtagatggagtacagatacacgtacagagcggttgaggctgcagaagaaaacgacgtccattgccaatggtagttctcggcgttcagcaagaaataagtacccacaatagtgacgcagatggtgactataagaaggatgacaaagaccagcaacatgaagccatagacataatacaccttatagttccagaatgatgtgaacacaaagtacatctcaatgaagatgctaccgaagggaagcaggccacccatcaatgagatga

SEQ ID NO: 25663 - DNA, 547 bp, Zea mays
  Clone ID: cC-zmle189041f02d1
cggacgcgtgggcggacgcgtgggcggacgcgtgggtcctaacattccctgccgagtaaagactattccacggcctattcctgagaagaagtggtaccttacaccttctgtcatctcattgatgggtggcctgcttcccttcggtagcatcttcattgagatgtactttgtgttcacatcattctggaactataaggtgtattatgtctatggcttcatgttgctggtctttgtcatccttcttatagtcaccatctgcgtcactattgtgggtacttatttcttgctgaacgccgagaactaccattggcaatggacgtcgttttcttctgcagcctcaaccgctctgtacgtgtatctgtactccatctactactaccatgtgaagacaaagatgtcaggcttcttccagacaagtttctatttcggctacacgctgatgttctgccttggcctaagcatactttgtggagctatgggctatctagggtcaaccctctttgtcaggagaatctacgggaatatcaaatgtgattaaatccctgct

SEQ ID NO: 25664 - DNA, 479 bp, Zea mays
  Clone ID: cC-zmle189041f04a1
ttttcagttcatggatcatcttcttcttccaccatcaacatgtacaatttgccaaagaaataccctttcctttggttaaattcacaaggagagagaatcctggcttaaagaatatctgttggtgagtagatattacaacaaatcggtcaatgcttcttgtaccttatatgtgtattctttttttttcctaatatatcttccttaaacctcctgtgaagggactgactgacttactgactttatacaaaggctgcaacggcctcggaggaggccatcagccaggatcatcgaatttattaggtgagcaagcgagcctcagccagcagcgggggcgtcttaggctggagcttggcttgctgctgggaccagtaggcctgggccgccaggacccggtcgagcagctcctgaggcaccggctcgccacgccgctgctgcggcgagatgctcgcggtgtgcaccagcgtcttccatttgtcctg

SEQ ID NO: 25665 - DNA, 508 bp, Zea mays
  Clone ID: cC-zmle189041f04d1
ccggaaaacctgggtcgacccatcgcgtccgcaggacaaatggaagacgctggtgcacaccgcgagcatctcgcctgcagcagcggcgtggcgagccggtgcctcaggagctgctcgaccgggtcctggcggcccaggcctactggtcccagcagcaagccaagctccagcctaagacgcccccgctgctggctgaggctcgcttgctcacctaataaattcgatgatcctggctgatggcctcctccgaggccgttgcagcctttgtataaagtcagtaagtcagtcagtcccttcacaggaggtttaaggaagatatattaggaaaaaaaaagaatacacatataaggtacaagaagcattgaccgatttgttgtaatatctactcaccaacagatattctttaagccaggattctctctccttgtgaatttaaccaaaggaaagggtatttctttggcaaattgtacatgttgatggtggaagaagaagatgatccatgaaccgg

SEQ ID NO: 25666 - DNA, 453 bp, Zea mays
  Clone ID: cC-zmle189041f06a1
ggctaggcgccatgtagcagaagttgcttgtagaagagtacagagcatgcatccatggcgaacgaaggccatgcacgagtacaaacgctacgctggtggatgaagtgtttcgtgtcgaaaaggcgtgctgtttgttgggcactgtactggattaattaagcagcatgcctagctagtaggcgtggcgcgcgcgcgggcgcgtcggcagcaggtggtcgcagatggcggcgaactcggccagggcctcggcgagcaccccggccctgcccttggcgacgagcattctgacgagcgcggtcacccgcgcgttcagctgctgtcccgcgaccgtcacggtagccttgaccgcggtggcgccctcttccaggggccgctctagccggaggagaatgtggaggaacgcgcgcgcgtggcgcgcggcgcggtgcatcgtgcccgcgcggacgcacgcgt

SEQ ID NO: 25667 - DNA, 265 bp, Zea mays
  Clone ID: cC-zmle189041f07d1
gcgctacggccacgttcacatcgcaacctgtagcgccatttggatttgcaaccaggaatgcactagcacctctacctagcaacactctgacgaatggcagctgcaacgacagcagcaaccttggcgcgtctggggccgctgcgtcgcctacaaatctgtcctgtccaaagtcatggacttgatgttcggcctttaagttgcgttgctcacccaaatggtgccgggtttttgattttggggttccttctgggaaaactctaggcca

SEQ ID NO: 25668 - DNA, 336 bp, Zea mays
  Clone ID: cC-zmle189041f08a1
tttttttttttttttttattttttttttttttttgggtgggggtttttttttttttttttttttttttgtttattttttctcttgttttattttctctttctctttttctctggggggaaaaagggaaccccctgaaaaaaaggggggaaaaaaccccccccggagggggccccccaaaggggaaaaaaaaaggggacgggggaccccccaaacccccccgggggaaaggggggggaaaaatttttaacccggggggccacccccgggggggaaaaaaaaaaaaggggcccccccccccctttcccatattggtgaaaaggggggtgcgcccgaac

SEQ ID NO: 25669 - DNA, 501 bp, Zea mays
  Clone ID: cC-zmle189041f08d1
ccacaaattgtgggtggatcacgcgtccgctcagccgctattaccagtagtcgtcgcgtttgcagctaggcatatctgagttagccggcggatccgatccgtgcgcgtgcagtgtgtgtgtgtgtgtgtctttttatattgccacaggttacgctcccatggccagccaggtgatgaatagcagccttgttttgcactcgaggccgaggggcctgtcatgctctgctgcgctcacgaggcggtccggccggttcaccgtcaagggcatccagcccgagatggcaacgtaccaggtggtgcatcccatcaacggcgaccccttcatcggtagactggagacgccggtcacctcgagcccgctcgtggcgtggtacttctccaacctcccggtctaccgcaccgacgtgagcccgctgctgcggggcgtccaggtcggccttgcgcacgggtaccttctcgtggggccctttgcgcttactggcccggttcgcagcacgcccg

SEQ ID NO: 25670 - DNA, 552 bp, Zea mays
  Clone ID: cC-zmle189041f09a1
gatcagtggccgcccgcgctgacggcgcggaactggcgcttggagatcttgggcagcaggaacacgcccacgacgccgtcgatgagggcgaaccccgacgccacgccgaacgccgggatgttgcccttgccgaacagcgcgtcccacgggcccgcgcccagcgcgatgatcacctgagggatgacgatggagatgttgagcacgccggtgcacagcccctgcccgccgcccttcgtggccgccagctgcgccgtcaccgcgaacgggacgctgtacaggatggcgagagggacacccaggaacgcgaagaggacgaggcagacggccttgatgctcgtgctggcggtgatggcgtcctgcacgtatccgtggtagtccttgagcgaccagaagctgatcagcgcggtggccgccatggcgacgcagaccatgaagttgctcgtcacccacaccaccctcggtccgaccttccggcacatgggctcgatcaggaacgagctgaatcctagaacgatcgagttgagcagcagcccgtacgagcccactcgttcg

SEQ ID NO: 25671 - DNA, 468 bp, Zea mays
  Clone ID: cC-zmle189041f09d1
cccacgcgtccgcccacgcgtgcgaggacgcgtgggctcgttcggtgctgctgctcaactcgatcgttctaggattgagctcgttcctgatcgagcccatgtgccggaaggtcgggccgagggtggtgtgggtgacgagcaacttcatggtctgcgtcgccatggcggccaccgcgctgatcagcttctggtcgctcaaggactaccacggatacgtgcaggacgccatcaccgccagcacgagcatcaaggccgtctgcctcgtcctcttcgcgttcctgggtgtccctctcgccatcctgtacagcgtcccgttcgcggtgacggcgcatctggcggccacgaagggcggcgggcatgggctgtgcaccggcgtgctcaacatctccatcgtcatccctcaagtgatcatcgcgctgggcgcgggccccggggacgcgctgttcggcaagggcaacattccggcgt

SEQ ID NO: 25672 - DNA, 358 bp, Zea mays
  Clone ID: cC-zmle189041f10a1
ttttggatttcatattggaccttgcgacggctagaagcacgatcttgcccctaagattcacttatgatatagcccgtgggggggaacaaggttcatggttccatattccatgcctgccgatgcatgggtctgccgaaaccgcggatgaacacggcacttgctactgacacacagcgaccttgcctggaaaaacactgttgggctacttccaacacggctcgtacgtatatacaccctctggcctatgggctacatgacgggtgcgaacaggatagctcggtcgcgcgggccccaccggtcttgttctccccatcccatcagtattgacgtttgcggcgcccctgttgccaacgacgca

SEQ ID NO: 25673 - DNA, 370 bp, Zea mays
  Clone ID: cC-zmle189041f10d1
cgtaggcttctactcccccttcgggtcgggatggagatcaggaggttctcccgagctcgaattcggggatgagcggctcgagatggcgacacccaatgttgtgcaccggtggttaagcgacggcctggcctgggccacaaacaaccactctctgcacaacgccttgagcacctacggggaggtgctttagtccaaaatcatactggaccgggaaacgcaaaggaccccaggctttgggttactgaccttgtgcacactggacgcgatgcggaacgccacctaagacatgaacggcctggaactgaacgggctcttcatcaccggcaacaaggcccaacccctggggtggcgtggaagcggcagctgagga

SEQ ID NO: 25674 - DNA, 551 bp, Zea mays
  Clone ID: cC-zmle189041f11a1
ttttggcataaacatttctataatcgactcagggagtacatataggctacaaacacaagaaccacaacatctgcgtgcgtaggcagagactcaaaaggccagccctgtatgaaaattctaatgatacaatccttcaaggtgatcgaagaaggtatattccgtttattggaactcaaattccgtaatgaaatgtggccacgaataatgacaagccaactatgagtatgctcccccgtggatattcttcgcccaccgcagggcagtttaggccttggttttcttgggcacggccaggcgctcccggaaatcatcctccatgagcaccaagccgtccttcaagacgatcttgggctcccaccctagaacttcctttgccttggtgatgtccggcttcctctggcggggatcatcaggagtgttctcggtcatcgtcactgttatatctgggttaatcaactgcaaagttgaagtagtcgcgtcagtaatcagtcaagatttgccaagctttggaagacgaaagcattgcgactttataatccaacttgcctcct

SEQ ID NO: 25675 - DNA, 505 bp, Zea mays
  Clone ID: cC-zmle189041f11d1
cccacgcgtccgatttcttttcaggttgatggtcttattatgctgatgaacggaaacaacactggaccgattaacttggggaacccaggtaaaatccatctgcattttaacttttgttgctatacagtgagctacctacccaagctgtgttttttctgttatatgcattctcctggaccgaggtaaccaagttgggtctcatcttccgcaggtgaattcaccatgctggaacttgctgagaatgtgaaggaggcaagttggattatatagtcgcaatgctttcgtcttccaaagcttggcaaatcttgactgattactgacgcgactactttaactttgcagttgattaacccagatataacagtgacgatgaccgagaacactcctgatgatccccgccagaggaagcccgacatcaccaagggaaaggaagttctagggtgggagcccaagatcgtcctgaaagacggcttggtgctcatggaggatgatttcctggagcgcc

SEQ ID NO: 25676 - DNA, 395 bp, Zea mays
  Clone ID: cC-zmle189041f12a1
gggaagagtcccagatgggttatgcaagtcccgggtcagggcattacttatggggatattgtttcttttttctaaaaaaaaagggtctagacaatcctggttttgaacattattacaacaacgaaaccgtatttttggtccatatatttattggcacttgacaaaaacatgacccacttattcaaaaagaggaacttaccgaagctgtcctgctgctgcacaatacaaaacctcggtgggtttttgaactatgagttccagaacgtaatatccaggaaatgctccctgcatgcttgtttgaaaaggaccccctattattcgtttaaaaaccttctcagaggcctcatacggtctttttaatgtcctgggaggtgtgcgcccagcttgtgaacccc

SEQ ID NO: 25677 - DNA, 420 bp, Zea mays
  Clone ID: cC-zmle189041g01a1
ggaaataaactatattcattattatttgaatgtggaaataaaaacagtgacctcgaaagaagtatattttaggggaaggagagtttttttttatggagggagtacaattgctattgcaataactatttctcacactaaatacaaagaacgtacgtgtatgtgctcaataattattccatccgacctttgcaaggctggaacgacatggaccggtgaacagacaagcaccacccgtctggaagattgcacaaggaatcctatgctgtgcatctcaaggtctcaaccatataccaccactagcttgttctgtactcagcgctcggtggcctgcctcctcgtcgtcgtcgtcacggacgctgcaaatggcagcatcccccagttcaagatcaaccaacacgaaaatgtctgctgacgcgtggg

SEQ ID NO: 25678 - DNA, 420 bp, Zea mays
  Clone ID: cC-zmle189041g01d1
cccacgcgtccgcagacattttcgtgttggttgatcttgaactgggggatgctgccatttgcagcgtccgtgacgacgacgacgaggaggctggccaccgagcgctgagtacagaacaagctagtggtggtatatggttgagaccttgagatgcacagcataggattccttgtgcaatcttccagacgggtggtgcttgtctgttcaccggtccatgtcgttccagccttgcaaaggtcggatggaataattattgagcacatacacgtacgttctttgtatttagtgtgagaaatagttattgcaatagcaattgtactccctccataaaaaaaaactctccttcccctaaaatatacttctttcgaggtcactgtttttatttccacattcaaataataatgaatatagtttatttcc

SEQ ID NO: 25679 - DNA, 496 bp, Zea mays
  Clone ID: cC-zmle189041g02a1
ttcctcgcggtggcggcgcatgtgtccgccgagcgcctggcccatgtcgaagccgaggccgcagacgtggcacaggtggctcgcgggcgcgggttccgccgctgccggcttcgtcgcggtatcctccttcgccggcgcggcggcgggcacgccgagcgcgaggccgtggcgggcccgcaggtggctggtgcggtgcccgcccagcgcctggaacgacccgaaggcgcggctgcacgtcttgcagacgaactcgccgcccgccgcgcgccggggcttcttgctgatgccgtgcttggtggccacgccaccgccgccgcccagggacagcgcgagggagagcggcacggcgccggcgtctctcgggtgcttcatgtacgtatgtcggtggtggggaaggagtgtctgagggggtgagggcttgcgatcgagctcgagatgttaggagagagcccgagagggagagggaggtgaaagcagcatgccgcagtggtttggc

SEQ ID NO: 25680 - DNA, 496 bp, Zea mays
  Clone ID: cC-zmle189041g02d1
gccaaaccactgcggcctgctgctttcacctccctctccctctcgggctctctcctaacatctcgagctcgatcgcaagccctcaccccctcagacactccttccccaccaccgacatacgtacatgaagcacccgagagacgccggcgccgtgccgctctccctcgcgctgtccctgggcggcggcggtggcgtggccaccaagcacggcatcagcaagaagccccggcgcgcggcgggcggcgagttcgtctgcaagacgtgcagccgcgccttcgggtcgttccaggcgctgggcgggcaccgcaccagccacctgcgggcccgccacggcctcgcgctcggcgtgcccgccgccgcgccggcgaaggaggataccgcgacgaagccggcagcggcggaacccgcgcccgcgagccacctgtgccacgtctgcggcctcggcttcgacatgggccaggcgctcggcggacacatgcgccgccaccgcgaggaa

SEQ ID NO: 25681 - DNA, 343 bp, Zea mays
  Clone ID: cC-zmle189041g04a1
acctcaagatacagttttgatttagcgaattacatgtgcaatatccgaccttcacggttacataaagcttataaattttcaggttgaaaagatgtcagttctctttcaagtgtacatgtacaaatgattgaatatcccaggataaatgtgcctggttctaggtgctcacgcgagcaccttctgctattgcaacaattgcattttaagctgtataaagagctgcaggcacatcaaattcatcgaactgtgtcatgatctctacagttgaattggcaagcacaaggggatcatatgttggcaaggtgatgtaccgcgggcagtgcttgctttttgatacacttcc

SEQ ID NO: 25682 - DNA, 378 bp, Zea mays
  Clone ID: cC-zmle189041g04d1
ggaagtgtatcaaaaagcaagcactgcccgcggtacatcaccttgccaacatatgatccccttgtgcttgccaattcaactgtagagatcatgacacagttcgatgaatttgatgtgcctgcagctctttatacagcttaaaatgcaattgttgcaatagcagaaggtgctcgcgtgagcacctagaaccaggcacatttatcctgggatattcaatcatttgtacatgtacacttgaaagagaactgacatcttttcaacctgaaaatttataagctttatgtaaccgtgaaggtcggatattgcacatgtaattcgctaaatcaaaactgtatcttgaggtaaataattctcctccaattcttattatctctaagg

SEQ ID NO: 25683 - DNA, 516 bp, Zea mays
  Clone ID: cC-zmle189041g05a1
ggatgtcaccaaacgaaagggagtgccatttacaactataagtcatcgtcatctcttcaacaacataggcgcacatcatatatatataaatcaatcatttaggcgattacaaggagtcaaagcttatagggacaacgtccgccctgtttcttatcgccagttttctcccatctgaggtgctcagggcaactagttcagactaccccctacaatctgatccccaacatagttggtaaaccggcaaccatttattcacaggccagcttcgtgccaaagctggtcaggcagatggcgaacgcctggaaggcggacagaggctgccggtagtccatcgtaaacgcatcgtcctcgatcttcccgaactgcaggatcaccgtctcctcgtctccgacgccccatggaccgccggagccagctgtggcgacgagctggaagttcttcacggaggcgacggtcacccgaccgtggaaatttatgcaccaacactgaagatggtcgtgccatcttgagccctgt

SEQ ID NO: 25684 - DNA, 613 bp, Zea mays
  Clone ID: cC-zmle189041g05d1
cggacgcgtgggcggacgcgtgggccaagaagcagttcatatgttggaaagttgagatctgacttcttggggacaaagttcatcatctatgatagccaggcgccatatgacggtgccaaaccttcgaggacccgatccactcgccgctttgcaagcaagcagataagcccacaggtttcaggcggcaatttcgaagttggacaagtgacctacaggttcaacttcatgaaatcaagagggccgagacggatgcagtgcaatatccagtgccctgtaggccagggcagcgcttctgatccgtccaaggagaaaacaccctcgccgagttccttggacctgaagaacaaggctccaagatggcacgaccatcttcagtgttggtgcttaaatttccacggtcgggtgaccgttgcctccgtgaagaacttccagctcgtctccacagctggctccggcggtccatggggcgtctgagaccaggagacggtgatcctgcagctcgggaagatcgaggacgatgcgtttacgatggactaccggcagcctttgtccccctttcatgcgtttggcatctgccctgaccagctttggcacaagctggcctgtgaataat

SEQ ID NO: 25685 - DNA, 306 bp, Zea mays
  Clone ID: cC-zmle189041g06a1
caaaaattaaccccatttgaaaaaccccacttaacttaccacagaacaacaaagataggtctcataattcgggcatataaaaccaaaaacccaatcgcaacaatactaataaacactaaaaaagcccaaaaaaatctcaggctacaaaaagggttccaaaaaccattaaaaggcgaaccctaaaacggaaggcccacataaaacatttcccccaaaagtgtacaaagcaacccccctttattcttccaacttaaaccccatctccatggtggggcccctctccaaaaatcctgtaccaaaggctta

SEQ ID NO: 25686 - DNA, 556 bp, Zea mays
  Clone ID: cC-zmle189041g07a1
ttttaattaagggagagccatctcgaaacatgcatatatagaaattatttttcctcagatctcgccgtcaagcatacatgcattatctcagacttcgcagtggcgagctcgatcgatatatatgatgactagcatcagtactaaaatagtattgtatcagggacacacgtacggcatcgaccagagcaccatgcatggtccatggatcatatcatcattatcatggcttcatgggatgggaatggatcggagtacgtgcttaaccatgatcagtacacacgtatctctcggaggggcggcggtatcccgggtgatggccgggcgattaattagtagctgtagttcttgacgaacattccctccttggcctcggcggcctcgccgtcggaggtgtacttgccgagctgcgccagggagttggccttggcgcgcagcagcagcgcgtcctgcgccgccttgaccttgtccggctggccgccccaggtcttgaggcaggtgttctgcagcgcccgcgcgtaggagaaggacacgtgccacgggttgggcccctggttca

SEQ ID NO: 25687 - DNA, 551 bp, Zea mays
  Clone ID: cC-zmle189041g08a1
ttttgaaatgtcaccggaggatgtgttcccccaaatttattttatttcaaaatttgaagggcctgattacatttgagctggcacaaaatgttttgtcggcgtggaggagagaggctttgctttggcagagttgcattacatagttaaacaaattgcaccagagatctgctatggctctggaggctactggcattctgagacgccaaagttgagcctcaattttacaagctgctaagacctgctgcagggattgagtttcattcctggagacgataccattccaacgcttccaaagctgccagcagcataatgcaatgaaagttccaaactgctcctcagggatggaactccgtccggtataactcgctgatcggttgatcagtaggccatgaaaaaacaattgcctccaagaaggccacagcaaaaccacagcggaagatgatttgatcagaagtttcatcttcaatattacacacttcacaaattggagaatagacaatgttcttgacaggttgtgacgacactggatcctgccatttatttcaacttta

SEQ ID NO: 25688 - DNA, 583 bp, Zea mays
  Clone ID: cC-zmle189041g09a1
gggggtggtgtatattttcttttttgttcactttctgtttttccatttaccctgggcggccctaggcgtcttctcagaaaaaaaacaaaaaatatgtgccccccggggaaaaaaaccgcggggggggccaacaccgggggatttttaaccccccgggggccccccccgggctttcgggcccccccccccccggggggggggcgccccccccggaaaaaaaaaaaacaccccggggcccccgggggggcgcccaatatagggggggaaaaaacaagtctcctttaggaaagacccccccccgaaaaaaaggggacccccaaggggggccccgcccccccctcttcccccgggggggggggcccccaaaaaaaagtctcccaccccccccaaggggcaaccaaaaaaaagcccgggggggggggtaaaaccccccggggggggggccccccccttttatgagagggtgggggccccccgaaaacaaacaaaaaaaaggccccccccccccgcggaagggaccccccccccaaaacccctttttttttcgggggggggcgcccccacccccccacacagggggggc

SEQ ID NO: 25689 - DNA, 464 bp, Zea mays
  Clone ID: cC-zmle189041g09d1
acccacgcgtccgcccacgcgtccgcggacgcgtgggcaccggcctgcctcagagagagaaattgcggagattagcggcggcgatggcactcccggcgtcgagctccggcctcttccgcttcgtctccccgcgcagccgcccccagtccaccgacatcgtggctgccgcctcctggggagtcttcgccggcaccgacggcctctacctcgtccagccatttgactggattaagaaaactttcttcgagaaaccccaaccagaggcataaaaggcttgcaagtctgcaactttggtacttcacttttatccgggatggttcctgactgaagagaacttggataactcagcaaataatacgagaccccctcgggtttccctgtttggtttttattattcagatgtaggcaatccccacgagggagacagggaacagagaaacttgctggttcacctgtgtctatat

SEQ ID NO: 25690 - DNA, 386 bp, Zea mays
  Clone ID: cC-zmle189041g10a1
cggataaaaaaagaacgggttcaaccgaattcatttttgcagcgcacttgatattcttacagctccgaggccgtctgaatgcaattaagcggcctcacgttaggcatgcatctaaagctcgaaccaacaatagggacaacaacaccgtggcacgttcattaattatataccaccccccgggcctgtagttgctacgcgggcgtgctcaattgtggcataccttggcggtgggcatggggacccaaatggccgcgtacttcttcttcgccttgggggtcccgttcttggggcccgccatggcggcgccggcgccgtcgatggttgccacggccgccgcaacatccgtaagcatgacggcgcggtgtccgtctgcggcgggcctggcc

SEQ ID NO: 25691 - DNA, 434 bp, Zea mays
  Clone ID: cC-zmle189041g10d1
aaaattaattaaaacacctaccactacacacgacaagaaccacgaggaccaatggggggtcgcattactctttcagcgcaaagcgatggcacgggtcaccatgatggcttccttcgccgccgtggcggaggccgcacccttgggccgaggaaccttccccgtggtcaggtccgacaaggacaaccgttgtcaggagcccaccacgctagcatacaaccgtagccaggcccggcgccaactgacgccgcaccgttatgcttgcggctgctgcgaagatcgtggcagccatcggcggcgcctagcgccgccatggcgggccccaagaacgggacccctaatgcaaacaagaagtaccctgtcatctgtgtcacccatgcccaccggcaaggtctgccacaactgagcacgcccagcgttgcatcttcatggcctgg

SEQ ID NO: 25692 - DNA, 264 bp, Zea mays
  Clone ID: cC-zmle189041g12a1
gggtggggtttttttttctttttctgttctcggaaacaaggcccaaccagaaacaatcgggttttttaaccttggaaaggcccgggggccctttgccccgcccgggtgtatggggatctccaaacaattttcagcacgggcggggggataagaaaccttctttgggctgggacttatgggctaatttatcccgggggggctttggggcctctcatccccccgggggggggggggcaactccggggtcccgggggggggcccggg

SEQ ID NO: 25693 - DNA, 363 bp, Zea mays
  Clone ID: cC-zmle189041h01a1
aaaacccaagcctggcaaatgcttttatttatgtcccaacaaatttaagggtctccctttgggactgctttactcttacaggaaaacaaggggggagactttggacttcctgacctaaataaaactttgggcctgggaaataaaaatcaaacccagttcctccctggaggcagtaattttattgattcccccccccgggggcatactgggattagcaaaccccaggccttgttaaaatcttggggttgcgcgcaatctttaaccacccggtggggaaaaaaccaggcttgtgaacccttttttacgtgggagcgccaaaatatttttttttagccctccccaggttggggggaagcctttccc

SEQ ID NO: 25694 - DNA, 573 bp, Zea mays
  Clone ID: cC-zmle189041h02a1
agaacctagagccatcccaaataccttcatagtaacaccttcatagtcattgtttacataatgaagtttaaaataaacgaggatgtgagataggatatgtaagctgcctctgaacccgataacatagctttgataatgaagtgtgttatatctgattacctgacatctctagtctaaacaactcattagcaaatagtacaagtgtacaaccctagtctaacaacccactatcctagtatagaaacggctgctacctctttagcaagtacagcccatccctcgtttctagcttttcatctgctactagaccagaaagaaaactttgcagctgctgcagcgacttgtcatacgatggctcggcaatacaaaacatctttagagtgttatgtatcctgtccagcgacatactcccaaaatttgttagcattccgacgatgtatttctcgtagactgtcatttctttcttaagctgttcctccactgaagccacagagctttcaccttcctcctcagtcatctgatactctgccatgcgttcattcacaatactgtccttgttgacatcagacatgc

SEQ ID NO: 25695 - DNA, 562 bp, Zea mays
  Clone ID: cC-zmle189041h02d1
ggaagaaaaatcttggaacagtcaagttagaactgcaatttgacttaagaagcgtgcaatttactgtagctcctgtgcatgctgcaatcataatgcggtttcaagagaaatctagttggacttcaaaggcacttgctacagaaattggcatacctatggattctcttaacagaagaataagtttctggacaagcaagggggtcctgactgaatcagcaggaccagatgccgatgatcgcaccttcactgttgtcgatagcatgtctgatgtcaacaaggacagtattgtgaatgaacgcatggcagagtatcagatgactgaggaggaaggtgaaagctctgtggcttcagtggaggaacagcttaagaaagaaatgacagtctacgagaaatacatcgtcggaatgctaacaaattttgggagtatgtcgctggacaggatacataacactctaaagatgttttgtattgccgagccatcgtatgacaagtcgctgcagcagctgcaaagttttctttctggtctagtagcagatgaaaagctagaaacgagggatgggct

SEQ ID NO: 25696 - DNA, 345 bp, Zea mays
  Clone ID: cC-zmle189041h03a1
aatattatataatgtcctactaatacgaataaaaaatatcgatctagtcctctccaccaaaaaaaaaaggggggccccaccaaagggaatgggggggagaccccaaaaaaaaaaaaaaaaaaaatcgaaaagaagaaaacccccaaaaaaaaaaagggggaaaaagtggggggggaaaaaaaaagccaccgtttcattaaaggggggcctcctaaaaaaaaaaagggtgatttattaaaaaaagggggggggaccacaatttttacccacaacccccaagtggggggggaagaaaataatcgggagaacacggcatctctgcgcctatttttggggggggggggg

SEQ ID NO: 25697 - DNA, 525 bp, Zea mays
  Clone ID: cC-zmle189041h03d1
ccggaattcttgggtcgacccacgcgtgcgcccacgcgtccggctctgcggagtgaaagcgattaatttgatttttctttggtattttgattctgctctgcgatcaataagctatagtttggaattcctatatgatagcttcacgtttataatctagccaagagtattgataatgacttcaactttttcgagcatggttagtttaatattgctttggcaatttagcaatagtgcaaaactcctagatgatagcttcgccttataatctagctaagggtgctgatgatgacttcaagtttaatgttgtgccaagtgaacgtgattagtttgagatcgctttggtattttaatgttgattatgcaatcaataaacattcttgttgaactcctatattgtagcttcaccttatgatgcctcagacttcatcgtgccttcttacttttgacagaatgatccattaattaatgccttaatagcgcaggagttacacatttacgatggcatcatctgcttctacatgtatg

SEQ ID NO: 25698 - DNA, 146 bp, Zea mays
  Clone ID: cC-zmle189041h04a1
ggggggggaacccccaggtggggttttgttttttaccccgggcccgggggggggcccccccccgggaagggggggaaccaggggggggggcgggggggggattttttttaaccccccctccataattgtgacacaggggggggggg

SEQ ID NO: 25699 - DNA, 427 bp, Zea mays
  Clone ID: cC-zmle189041h04d1
cccacgcgtccggacgagacaaccacccggcctcccccccacccatcgtactacaactatgtagcggcgtctaaataagatccctccaccggccaccgccattgttccttcctgtcgctgcatggtcgcctgcctcgtgcccgggctaatatacatatacatactatgtgtttcagcataaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaacaacaaaaggggggggccgttttaaggaacccaactttcccgcccggggcgggcaaggaataaccctttctttgggggccctaaatttaaatacccggccggggtttttacaccgggggatggggaaaaccccggggg

SEQ ID NO: 25700 - DNA, 455 bp, Zea mays
  Clone ID: cC-zmle189041h05a1
attccaactgaattacgtatatagtactcaggtagtgacatgtcgcagctgcatgccaatagacataaatagtgtttatcatatggcggcatagacgcctgcggtcatagcagtatttatatcatcatcatcatttgctgtggcagcggccaactgtgcaaagttgatgggatccgcgtactcctgcgggccgtagaagatggcgaccaccccacgttcatttgttgcctgcgtaggatgtagcatgtcccagaacatgtagtcgtcgcgatccgaacagtaagtcgtgtttggctgggcgcacatgaccgccgcgttcagttttcccgatccgcagcatgccctgtcgaccacccggagcccagccactagatggctgttcatcaagtcggtgacaaaattgtaggtgcttgcaatggagtatttcatgccgggcatggaggatgcgacggctt

SEQ ID NO: 25701 - DNA, 543 bp, Zea mays
  Clone ID: cC-zmle189041h05d1
cccacgcgtccgccaaagccaacaaacagagctccaactcagaatgcatccgtcccttggcagcagcaacaagctactagctatgtgtgtttagagcgagcgagggaaaaaaaagaaaacatctaagatatactccatcatcttcgtttgattaacccgcccagtaaagccatgggtactaatgatagagcggtcatttctctggtactcctcgtgtgcatcgctagccgctcgtccttgggtgccgctgaaactgacgttgagcagaagcgcttgtcagtcccgttgatgtttgtgttcggtgattcgctggtcgatgtcggaaacaataacttcctgccgccgcctgcaccccgtgctgcatctccgtacggcatcgacttccatgctggcaccgccggcgccgtctcaggacggttcacgaatggctacaaccttgccgatttagtcgcgcgacgtctggggttcaagatgagtccacctgcttacctctcgttgacaccggtatcatagtttgacctgttcacgtgccgaattggtgcc

SEQ ID NO: 25702 - DNA, 484 bp, Zea mays
  Clone ID: cC-zmle189041h06a1
gctcatcgaaccagccgctagctttattggaataatgaaaaggcatatgccgcgagggaacatggctgtcatctatactttgttgaaaacagggaaaaaatgaactgagaaatgcaacatccacactgctcaatttgctggagctttaaatcaatttgctgtagcttcctagtcatactttccctggacatggtacttgcacatctttttctgggcgcagttgatgagaatttcagcggagtcgatacctgaaagataggctccatggacatagccattgtagtgctcgctggtgtgctcaccggtgaagtataccctcccaaccggtgccctaagctggtcgtattcgtagcggttgacgccaactggccagttggagaaggtgcccttgtagaacctgtcggaccaccatctcgggacaaggatgtcggtggcgtccgggacgtccttgccggggaacatcttccgcagcacctgcatgatc

SEQ ID NO: 25703 - DNA, 510 bp, Zea mays
  Clone ID: cC-zmle189041h07a1
ttttgcaaccagggacagagtggcgaacacaatattagggaaccattttaaacgcaaaagttcgcttgcaacaagaagcaggcaattatgatgtttcatcacaaaatctatgacatcacgacagttcagagttcttagggattttgatcccagaatctgatactacgcatctcacactagaagtctagaaccaacgactagtgacaggcttgctgatgctctgaatcagtccacaagtgtgcccaaaatgtcgtgctctctgaagaggaggtactctttatcagctgcaagcttaacttcagttccaccatactctggcaggagaacagtgtcaccttccttcagagcaactgggatcagattgcctgccttgtcgcgctcaccagggccaacagccaccactttagcagcattcagctgcttggatgtttccgggaggaggatgccgccggcggtcttcttgggctgcaccagcttctcaaccagcacccggttcagagatgggagcag

SEQ ID NO: 25704 - DNA, 405 bp, Zea mays
  Clone ID: cC-zmle189041h07d1
gtcgagaggtatcaccattgttattgctctgtggaagtttgagaccaccaagttctactgcacggtcattgatgcccctggacaccgtgacttcatcaagaacatgatcactggtacctcccaggctgactgtgctgtccttatcattgactccaccactggtggttttgaggctggtatctccaaggatggccagacccgtgaacatgctctccttgcgttcacccttggagtgaagcagatgatttgctgctgcaacaagatggatgcaaccactcccaaatactccaaggcacgttatgaagagatagtgaaggaagtctcatcctacctcaagaaagttgggtacaaccctgataagaatgcctttgttcccatttctggttttggagggtgacaacatga

SEQ ID NO: 25705 - DNA, 413 bp, Zea mays
  Clone ID: cC-zmle189041h08a1
ggacaaaggggggaaccccccttttttttttggaaataggaaagttttaaaaaaaccacttccattgggataaaacgatcccacaaaaaaacaatttggggaaatttttttttaaacccctttcccttttaacctaaataatttgggggcccaagaaaaaaaaaaaaattcgacccgggactagggggattaaaatttttttttttccacccaatccccacagacgggggaaaacaaaagggccaaattcaaggctttaaccaaaaaaaagggtttttccaactgggaaatccacatttcagttttgatcccccaaaaatttgtaccccccaaacgcccgggcaaaagcttaaattggtattttttggattaacttggtttcttggacccccaatttttggtccctttttttt

SEQ ID NO: 25706 - DNA, 389 bp, Zea mays
  Clone ID: cC-zmle189041h08d1
tgggttgacccacgcgtccgcccacgcgttcgctgacgcgtgtgcatacacattggccttatgtttaactcttggagaatttcatttatgcccatgtgaagcggggtagagcaaagctcactaatattactactgggggtgctgccttctgtgctggtggtatggctcttgtttgccaccgctgctgtgctacctttctgcttcacctgcaccttcctctgatattgagggagagtttacagaaagagggagcatataatgttggtccaaggaagcaagctaatccgaaagatatcaagtgaagcgtttgtccggtcgcttgggtggtgcgaatttctgggtgatcaaaactggaatgcggattccgcagttgaagatatcctttcttt

SEQ ID NO: 25707 - DNA, 486 bp, Zea mays
  unsure at all n locations
  Clone ID: cC-zmle189041h09a1
cttacgcattctcaaactttgacaaaaactaacaggatttgatcttacattgatgaacaatgtttattgtggcagatggcattgcttatatgctgatttgtctcaacaaaattactatgtgctgcagatagttgggggctcatctgaaatcacgatccatgnggcacaagtngttggaaagcatcacaatcaggatagtgcgtccaaagtcgcatcacaggagagaaggaatccaccaagggaatgacgcgtcataatctatccgtcctgcaaaactcctggataaagtttggaccttatttaggaagagaagcaccctggacgagccgcgtggtatcaattcttgccgctctcctccactttcatcttcttctcccacctacgttttttgtagtctagcagcatctggggcattttcttcatcagcttaacagtatttgctcgcttcttggcggaaatgcggtcgcacttgtggcccttgcgctt

SEQ ID NO: 25708 - DNA, 275 bp, Zea mays
  Clone ID: cC-zmle189041h10a1
gcaacgcataatacaaccgtttgaatttcgcgatgcttgctcgcagcatcatataacggtcgcattgacacccagtggttcaaccacggtgatcacgtaacgtttttaccgtaacatcgataagtgaacctcattctggcctagagttttcccagaaggaaccccaaaaacaaaaacccggcaccatttgggtgagcaacgcaacttaaaggccgaacatcaagtccatgactttggacaggacagattttgtaggcgacgcaacggccccagac

SEQ ID NO: 25709 - DNA, 383 bp, Zea mays
  Clone ID: cC-zmle189041h11a1
ttttatcttagcacattgctatttctacgacaggatagggtgtcgatgatgctattgaactgccccttgatgcacagatccacctttactacgcctccacaataaatgatgctcgtccggcgctgcgtatcctggcgggcagcccattttctgggcggttggtgacgaccaatggggacataaacgcatcaaagtggtgggcaggcatcatgcctagactgctcaacggaatgtgcagacaggacagtccaaaatcattgcaagcgcatcaccagcgtattttccaataacgtttacccccaaattaggcttgaactgttacgcaatataagctacgttgagttactaactcatggtcccatgtccagactatactactaatt

SEQ ID NO: 25710 - DNA, 458 bp, Zea mays
  Clone ID: cC-zmle189041h12a1
gcaccaagaagcaccattttttccttaagattaacttagaataaagcctgacgggggtaacagcatccatcgatccgcagtccatgctgtttgatgcatgggtctgctgaaaccgaggatgaacacagcactaacaactgacacagagcgaccttgcaatcaaaaacacagatgggcaacaacaaacacgacacgaacgaagataaaccctctggactagggtaaacatcacggtagcgaacaggataacttggccgcgcgggccccaccgctcagttcctccagttcccgtcggagttgccgtatccgccgccacggttgccaccgtcgttgccgccgccaccaccaccgtagccgccgccgccaccgtagccgccgccaccgccgtagccgccaccgccatcacggtgcccgccaccgccgtagccgccgtctccacgggcaccaccgtacccacc

SEQ ID NO: 25711 - DNA, 331 bp, Zea mays
  Clone ID: cC-zmle189041h12d1
ggaatttcttaatagacccactcgttcgcgggtgggtgaggtactcccgagtgggggtccatgggtttgcggatcgagatggcgacctttgatgctgagtaccgatgcttggtctgcaacctctcctgggccacggaggaccactccctccacaacaccttcaacacctacagcaaggttctcaagctcaagagcattctggatctgtatactcataggtcccgcgggttcagcttcgtcaccttcttcacagatgaggcgatgcggaacgccttccaaggcatcaacggcaaggagctggacggtctgaacattaccgtctacgaggccc

SEQ ID NO: 25712 - DNA, 326 bp, Zea mays
  Clone ID: cC-zmle189042a01a1
catataaaaaaaaaactttatggtacttttcttgatccaccaaaccgtgtgcccacattttaaatatcgaggtctctttttttctttccctttaataaaaagaggacaccggacccgctttttttttccgttgagggggaatgcttccttctttgctgagataccatatcatataacgggggataaaggattttttattgtgtttccacggaaattaattacaatcggccggccgattggggcaacccctgctgaggaggtgcctacatgacgaactgattgtgcgaaacataaaacattttcaaacaagacaaggaacgtttctg

SEQ ID NO: 25713 - DNA, 591 bp, Zea mays
  Clone ID: cC-zmle189042a01d1
cggaattctcgggtcgacccacccgtccggccgcgcgtacggaggcccctcaccctcatgtgatcatgtctttatctcccggcttaactagtacgcacccagtggtttcggtgggaatggaaaccctacaatcccctgctaatactgcagggcgagcctgagcgtgatcccccgaaagcgcgccatccagagcgcacaatgcaactgagtgaccccaatacagcggtccgaccgcatcactatcgtgcggtggacaggaacggcaggaaggataaaggtgtgaccgccctcgaccctagggccaacaactttgatctcatgtatgagcaggtgaaggcgatcaaggaaggccaggcagtcgagaagcccatctacaaccatgtcactggcctcctcgaccctccggagcttatcgcgccaccaaagattttcgtcattgaaggtctgcacccaatgttcgatgagcgagtgagggacctcttacatttcagtatctacttggacatcagtgatgaagttaaagttgcatggaaaatccagcgggacatggcagagcgtgggcacagccttgaagcatcaaggccagtatcg

SEQ ID NO: 25714 - DNA, 247 bp, Zea mays
  Clone ID: cC-zmle189042a02a1
attaaaagggaaaggtccctcgggggaacggaacacaacttttggggggtaggacaaaacccaatcacccccccccgggggaaaaaagggagtttaggcccccgcccgagggggtttttttttgggatcaagcggccccccgggtttttttagaaaagccccaacaggcgggggggacttttaaacaaaaacggaaatgggttgccactttacaccaagctttgggtttgctccctccgggcccggg

SEQ ID NO: 25715 - DNA, 411 bp, Zea mays
  Clone ID: cC-zmle189042a02d1
gttggattataatcacaactacggttaaaaatggcattcaagatgttattctggggaaaactcacacctgcctggggaggctattgtaaagaaagcatggttgagtaccggaggtacaacagaaggctaatctgggccaagcactaacactctcttcacacaacctttatcacctacggggagggccctaccatccttaacatacttgaactggagactcagaggctccaccttttaatcttcatcaccttctccacggaggaggcgatgcggaacgccatcgagggcatgaacggcaaggagctggacggccgctacataaccgccaacgatgcccactcccgcatcggacgtggaagctgttgtattgggtaccgagatggacttcgatgccgcggctacaacaacggc

SEQ ID NO: 25716 - DNA, 485 bp, Zea mays
  Clone ID: cC-zmle189042a03a1
ttttgctcttcggagtatcatttcagtaaaaatatacgtcctggcgcacaaaaacagaagtacagacgcagcaaagaagattacaattattctctagcgggctcacatgaccctcacagcggaatcggaatgcacatgaaaattacaaaatatagagctcagtaggagtgactaggcttggcagttcctgtgacatgtccttgggaaaaactggtgatgacaaacattgcttaaagatcctcagggccattgacatccttgttctcaagtacgtctccatctggaatctccaacttcactccaggcttggcgataattgtcaccttgcccttgagtgtaatttcagagccaaaccagacattaccagaaaccttcaagctgtcaagctcaactatgctggggatggacttgaaccgagcaaggaaattggcaaccttcttgaactaggccaagctaattgaaaggctagctggattcgctctgat

SEQ ID NO: 25717 - DNA, 437 bp, Zea mays
  Clone ID: cC-zmle189042a03d1
ccggaattctcgggtcgacccacgcgttcgtgcagacgtgacttccactctttccctctgatctttacaccttgtttgatggctttgacatcctcaactcattcagagcgaatccacctataccctggtattgagcttggacctgagttcaagaaggttgacaagtaccttgctcggatcaagtacatccccagcataggtgagcttgacaccttgaatggttcttgtgatggctgagctggctctggaatgacactcaagggctaggttacaattagcgccaagccttcaactaaattgttgatttcaagaaggcaacgtacttgagaacaaggatgtcaatgggcctgaggatctttaagctatgcttgtgatcaccagtttttcccaaagacatgtaagaggaactgtcgagcctagggactgctactgagctc

SEQ ID NO: 25718 - DNA, 582 bp, Zea mays
  Clone ID: cC-zmle189042a04a1
ttttgaagccaaatagttatcattgcaagaacttccagaaccacgggactccatatgattattatatgagcctaggtctttaatttacaggcttccgatgaatctatcaccggaaccaatgcacctctaagcctccacaaggcagaggcagaggcgcagacaggcagaggggggcaaccttcccctgccgactatttgtaacaaatcggaaaagaatgtttatgtgcaccgttccagcatttggagagcactcgtatggccaagagggacccacactaccagtccaatatttacagggcgtatttacagagaacttgctgggctagaccatctgtattttcagaatgtcatatgagaaggtttgttgttaatccatgggccatggtgtagagtccagccagaggattatgttgtctcgtcaaactccatcttctttccacagacagggcatgcttcacttctttccatccactcataaatacagccaaggtggaaatggtgtgagcactgcattactatcctaggattctcagaatcataatctgcaatttagttacattaatatataacaatagtgagaat

SEQ ID NO: 25719 - DNA, 645 bp, Zea mays
  unsure at all n locations
  Clone ID: cC-zmle189042a04d1
gaattctcggtgcgacccacccgtccgctgttttgttccgagctggagcagtgcattctgtttcccccgttattgaagccactccagttgattcaactgagggctccttcgatacatatcgttcgcccccaagacctctgccctatgatgatccacgattttcccctcctgctcgtgactggttaaggagtgagaacccaagccattccccagaggaatcggaaccacttagagcaaatgaggatgatgaagaaatggaaacaccaagtataatacagaaggcaagtaaaacaaactacaacacaaaaatgaaaatctgcagctctacttatggtgataaggtgccaccaagggaacatggaaattacttcagctatttttccccatctgctgaagatgaagatgtttgtccaacttgtcttgaaggtattatcgcagtaatcatttttttctctaagtgtataggaaagatgccctgatatttttcaaaagctacagtaaaatttccatgacataagactttggtacatgtgaattgaacanaaggtgttcaagactatgagcattacattttttttctggtgatactgtataatcacattctcactatggttatatattaatgtaactaaaatgcagaatatg

SEQ ID NO: 25720 - DNA, 425 bp, Zea mays
  Clone ID: cC-zmle189042a05a1
ggaagggaacaaccgccaccctttttgttaaagattggatcctccagtattacatgttacaactttatatatatataaatcacacacccagacattgtacaagagtcccaatgaggcagaagagttccaagctcgttatgggttgaatgctggaaccgatcggccgaccgatctggcaaatcaatttacctgtcaatcccctcaatcttgtcttcaacctccgaatagagctccctgagcctgtccaggttctcctccgttgtctcccagtagcctctgccactggcttccaggaagggctgcaccaacttcctgaacgaattggggttggtgtccatgagccttttcctcatcgcctcgtcctcgatgaacgtggagttggcctcctcgtagacccagttgtcgacctgcccagacgtggcgct

SEQ ID NO: 25721 - DNA, 360 bp, Zea mays
  unsure at all n locations
  Clone ID: cC-zmle189042a05d1
caccttcattgaggacgaggggatgaggtttaggctcatggtcaccaaccccaattttatcaggaagttggtgcataccttactggaagccagtggcagaggctactgggagacaacggatgagaacctggacaggctcacggagctctattcggaggttggagacaagattgaggggagtgacaggtaaattgatttgccaagatcggacgggcgatcgggtccaggattcaacccataacgagcttggaactcttctgccttattgggactcttgtacaatggctgggtgtgtgattnatatatatataaagctgttacatgtgatactggaggatacaatctttaacaaagagggtg

SEQ ID NO: 25722 - DNA, 596 bp, Zea mays
  unsure at all n locations
  Clone ID: cC-zmle189042a06a1
ttttgagaaatcaagaaccatttagagctgttcagttcgtagtcaacaaaaatgttcagacttcaggtacatatatttatcacttaaggccttgttcggttaatcccgttacccatgaattggatgagattggaaaaaattaagaaagagtttgacttagttgggatttaaacccacccaatcccactcaatccatgtggattggaagctaaccgaacaaggcctaaatgtgaaaggctgttttttcgtactccctgcatatacacaagatataaaaggctatatgaactaaatcttggaataaactaatcatgcagctccctccaaaagatgtgaaaattttgaggacaaatgtttctctcagcaaaaaagctaccgactccaccttttcaaaccaaatatccaagctttcatacacacatcaccaagagagcacaccaaaaatcttcatttcaacctttgcagccatccaagcttccatgcatacatcacgaagaagcaactgtatctgctgaccaaacaacagcaaaggacttcacgaagaatggaatcataacgttgatcagaggaatcaggagaanatagtagtgagagct

SEQ ID NO: 25723 - DNA, 621 bp, Zea mays
  Clone ID: cC-zmle189042a06d1
cggaattctcgggacgacccacgcgtgcgcccacgcgtccggcaaatggcgcctcagtctcccgcgcgctttctacaacggttcagggtccggtgctggggcggctgatctcgtctaccgtgggagacaccttggaacgggaggagggcggcggctcagaggcaggcgcttcggctgatgagtcatccaaccggaagcagccgccccctgttgaccccaagattgagaaggagctcaagaaggtagttcacaagactgcggcaacctttgcaccaagggcgttcacgaaaacaaagaaccctgctgtccctggaagtaccctgtacaccgtctttgaagtccagggctatgtttccatgctgttgggcggagcactttccttcaatctcatattcccatcgaatgagccagacatctggaggttaatgggaatgtggtccatttggatgttcagtataccttcgcttctggctcgtgactgctccaataaagagaaagaagctctcaactacttatttctactgattactctgatcaacgttatgattccattcttcgtgaagtcctttgctggtgtttggtcagcagatacatgtgctttcttcgtgatgtatgcatgga

SEQ ID NO: 25724 - DNA, 480 bp, Zea mays
  Clone ID: cC-zmle189042a07a1
atgaagacgagcgttttgtgatgtaacatcagctaaggtagttgttggccggacaaacacattaccctgcttgcttctgaaatgaacttacaactgtacttacaactagaacacgaatcatctcattacttatacatataacttactaacaactgggctgtgacagacttacgtgcataatacgggacaaacagacagggatagccggtattcaagcgccaggctagattgaacaggaccgactcttcttttgcgaatccgagaagactccgacgcacgtgcgcctgaagccggtgaactcggatcaacgggcgctgacgaggaaagggttgtgacatacaccgcactctatcgtgtccgaaccagaagctggaacctcaacctgaaaatggaccgcgccatgagggcatgcgacctcccgcattcgcttgccagaaacatctgaagaccttgctcgtgaagacgacctttgatgtatat

SEQ ID NO: 25725 - DNA, 455 bp, Zea mays
  Clone ID: cC-zmle189042a07d1
agaattctggggacgacccacccgtgcggggacgcgttttggaatttaatgaagcctattaatgagttttttgatcactgggtaccagatgaagctgtgggggtgttcacagaacgctcagcacatatcaacgctttcaaccgcacgcatgaatgtcgcaactgtggtgatattttctgctatcagagcacccatcgaagaactactctgactacacatgcacatgctcaacccgttctattttgtgacagatgcatggcttacgtaacgcaaagacttaacaatgcaagagcagtggcttctacgacctattcgttcacagccaccaagatcttgccaaaaaacttcaggaagccatggatatacataaaaggtcgtttttcacgaacactgccaacaaatgttactgccaagcggctgcggtaggtcccatgcccaacctgcactgcccattc

SEQ ID NO: 25726 - DNA, 491 bp, Zea mays
  Clone ID: cC-zmle189042a09a1
ggttgtgtatatttggggagatataatggggggtagtatataatttttaagtacttggggggttggatttaattttaaaaaaggtccactcccctttaaacccataaatttagattcgccccatttaaacaaatagtgggggggttcggacacacccatttctaagaaggtctttaaaaaaccttccaattgacaaaaaaaattcccccttctacaaaaccttggcacccagcgttttaaaacccccctgaatttttctgcccaatggtcattccccaaagggtgcctaaagatccccccccaaaatggtatagtgtactattttcaaaaattttggtgaagaattgtaatatccaaaaaataaaacccccaaaaaccccccgattaaaacccctgattggacccccctccctaaaaaaaaaaaatccccgaaaaccaccctttttaaaaaaaaaaatggccgaaaaaaaaaacaaaccccaaactttttt

SEQ ID NO: 25727 - DNA, 473 bp, Zea mays
  Clone ID: cC-zmle189042a10a1
gcggccttagtgttctgtgtgcttctaagtctacaattacagccatgttatagggagattagtctttcccatccttaaaacaggtagccacatgccgcactaccacactggttgaacattacacacaatccttcgactgacaaacagaatcatttatcttaggcaatctgcggcggatatctatggactgagaaacgtatcatcacactatacttgacggcagaacctttcatgcttcagcagccttctctgaagggctgtcttaacccttctgccccatcttctacttcttggcttcgtcggccttttacaggagctttaatcgcatcctcggaaagcatgctgcaatggagctttactgggggaagggacaagtggctcgcgatctccgtgttcttgattgtcaaaacttcatacattggttttcccttcacccattcaggatcgacggacgaggacgctatggcggagcc

SEQ ID NO: 25728 - DNA, 390 bp, Zea mays
  Clone ID: cC-zmle189042a10d1
cgtccgccgacacgggggcagacgcacgggttcggtgacatcatgaagctgttgatttttgtcgaccagaactccggtgagagcgggggggcctgcttcaagacttttggctgccgcatccgtcatagcgtctcttggtcgcgctaccgatagggttatggggaccaccatgggtgatgttttgacaatcaacatcgcggtgttctctatgactcgtcccttccaccagtaaagctccattgcaacatgttcgccgaggatgcgattaaagctgcttgttaaagactacgaagcccagaagttcaagatgggtcataagggtgaagacagcccttcagtataaagctgcttaagcatgaaaggatctgccgtgaagtctattgtgctgat

SEQ ID NO: 25729 - DNA, 560 bp, Zea mays
  Clone ID: cC-zmle189042a11a1
attaaataatttgaggtggctggaccctctcatatgcatattattggtcgcttgatatctgtataaatagatacatgtagctatcaaatatgcgccagagaatgcgccaaagtggcacagataatatatcaaatacaccccacccaaatataaccaaaggccaccagatcaaatacacgtacatatacatatatatataaatatatacatatacccgattacccgtcatcttattaatttccacccggccgggtcgagatcacattcttctcccaccggttccggactccctctggcagttgaagtagacggcggcgaccggcaagccgaggttgtagagctcggcgaagtcgcgggtgctgaagttctgccgccaccccggggcgtacaccgtctgccggccgagctgctggaagagcagaaacacgcccggtggatccccagcaccggccgtgggctctcgtagcacacgacctcggtcccaaaagatactccagtcgtcgccggaatatcagtgaccagccagtgcaggtacctcctgaggttgggatcgctggggc

SEQ ID NO: 25730 - DNA, 319 bp, Zea mays
  Clone ID: cC-zmle189042a11d1
aacggcatttctggggcgacccacgcgtcgcgggacgagctacacatatcactccccaccgccccgtctcaattcatgcagcggtattaggtgtacgaccacgtgtccctccgtctagccgcagcgcgcgcccgcatctgacagtgtgctgcctactactgctaaacattcgcccaccagttcgcgtgaggaaatagcacacctgctgagcatcgctacgttcgctactctcgcctagccttcttgccctgggcaaggcttgctatgctaggatcagcaggaggagtctctgcctcggcacatgtcatcgatgtgggat

SEQ ID NO: 25731 - DNA, 448 bp, Zea mays
  Clone ID: cC-zmle189042a12a1
agaacctgaataagaactcgagaggggaaacctaaacgtgcaattttcatgtgacatagcttaatgagactcaggataaaattgaggcccgccaccgaaatctactcatttttttattgaaccatattacaaccctactacatcgaaatttactcatttgtgattgaattatattacaaccctactacaggccttacacatcccttatttgcctttcctttctgctctccggtaaaatgctaacctttgccccgggagattattatttcgatccaatatttgttggcgcacatcttcagattacagggttttcgacgagcccaactgttttgccttgtgcactctttgtcacttgcattttgaacgatagctggaatggaggaagaaaataaattacggtaagtatcaaaagcgttaccccagaaaagtcttggttttatcttcatct

SEQ ID NO: 25732 - DNA, 377 bp, Zea mays
  Clone ID: cC-zmle189042a12d1
acctttagagtggccgccctcttctaacatttttttttttttttcaacaagaaaacctgaaattgggtcggggaactttttaacacacactttatatataaggtatcgcgatattatatgtatccgctgcatcgtacgcactttttatcaccatctatgcctatatcaattctctgcttaaggcatgcactgggaaattaaatacggctgttaatgcgcctctcagctggtggagccctgcatcctggacgcaaacctgtccgcggcccaccggggtggtgcctccgaacacccaaacaagctcggcgaaggtctgcatcgccacctgccacgcctgctcttcggggacgaggtacacgacggcggggcccgcggcc

SEQ ID NO: 25733 - DNA, 417 bp, Zea mays
  Clone ID: cC-zmle189042b01a1
tacccttggtacatttacattttctttacattactaggtgttaaacactcgggcgaggaagccaccgttccatgctcttcgaacaacccgggccgtaaattccccaagaaaccaaatccaccagctgggctaatctaaaggggagatctatctcgaaatgacgatggcgtctatgtacagagaggcacaacctcacactggttttttgcaacgctctacaacgggccgaaaccaaggtacgccaactgatggacccaacgcccacaaaggcataaaattaaaggccgcccagcttgatctcctcgagcttaaactcctagaacatttcttttttcttgaagaataacgacaggcccgaggcgcggtctcttgaactcatttttatcccagcgcttttaaatcgtgcgctcgtgctcg

SEQ ID NO: 25734 - DNA, 522 bp, Zea mays
  Clone ID: cC-zmle189042b01d1
cggaattttcgggtcgacccacccgtccggaggtggcgtccgtcctgcatcctcctgcactggaggggcaccttcacttgatgattcctctccctctaccctgggacgtgttgcggtggtggatatcacctatgatggggtggctgcacatgcactccgtgatctacactctccggctgatgatgctgagggcgcattcctagcgcctgcaccggagggggatgcccatcctcgtcacggacgtgaacctctgctaggacctggacgtgcgcgtgctctcatccatcctcatcgtcttcaaccgagaccaacactcaccattgagctcatcctagatctcgagctctgaagaacaatctcaacaacgcgatggcgtgcacatacagacatatttatgactcgccgatcgatatgtgatccatagagcacagcactggccttacatgattccttgataaacagacaatgtactcaaacgttgcatacggacacgagagactgagaggtgaacaattctatgct

SEQ ID NO: 25735 - DNA, 252 bp, Zea mays
  Clone ID: cC-zmle189042b02a1
accccaaaaaaatgctctggctttctataaaattttatcccaccaaaggggcccgggatgtacaatgggcttggctagtacactttccagatgggcctttttcctaaagaatcctaccattttagggggggatctcctttacagggtcctttgggagccttgttacataagcgggagcaatgggtgtaaacaataatccaacgcccaggggccataggtggtcgtttcctcccaaaccaaatttccgactta

SEQ ID NO: 25736 - DNA, 499 bp, Zea mays
  Clone ID: cC-zmle189042b02d1
cggaattctcgggtcgacccacccgtgcggccacgcgtccgggcaattgataaggcaataggtgaaaatggttttaaggttgttactttgctacgcttgagggggctgttacctttctcccttgggaactatctatatggccttacttcagagaagttcttgccgtatgtcttgggcagatggttgggaatgcttccaggttcatgggcttacgtcagtgccggtgcattcgggcgagctttaatccaagatgagtcggaaattggtttgggaggaaacgaacagctatggacactgcgcgttggattattgtttacagccattgctgccgcttatgtaacgaggctcgcaaaggacgctgtaaaggagatcgacgactagaatggtaggattctctaggagacagggccatctggatagtgtactagcctagcacattgtacatcactggcacctttggtgcgataaaatcttatagaaagccagaggcattttatga

SEQ ID NO: 25737 - DNA, 425 bp, Zea mays
  Clone ID: cC-zmle189042b03a1
ttttgaatgggaatatgcagctatatccatggatcagttccaacaagggcaacagctatttcggatgaaattgggctaaagcctttgatcgaaaagaaaaaggaaatagtctgacaaaaacacacatggattcgcatttggaattgggaagcagcacctctgatggagaggagcttacgacgaagccatagacaggcagcaatcaatcacaatcaatcactctcgcgaggacggctcctggtcgtcgtcggactggagcggcggtaggagctgagacttgcggcgagtgtcgcggggcgggagcgggatggcgaggaagtgcttggtcttggagatgggacgggagggttggagctcgacgacgtcgccgaccttgaactggttgtcggggtcgtgcgcctggtactttttcttgatgcgctccc

SEQ ID NO: 25738 - DNA, 504 bp, Zea mays
  unsure at all n locations
  Clone ID: cC-zmle189042b03d1
ggaattnttgggtcgacccacgcgtgcgacacaaacaaactaaccttatcggtctatctatccttctatccctcattcccatcccgagacaggagaaggcaaggatgctgctcctgagctcccccttcgtgtccgtgtcgccgccgccgccgccgctcagctcccatggcgctcgcccggcgctgcggatcgaggcggccaggcagctgacggggcgggtggtgacgaccaaggcggacaagacggtcggggtggaggtggtgcgcctggctccacaccccaagtacaagcgccgggagcgcatcaagaagaagtaccaggcgcacgaccccgacaaccagttcagggtcggcgacgtctgcgagctccaaccctcccgtcccatctccaagaccaagcactttctcgccatcccgctcccgccccgcgacactcgccgcaagtctcagctcctaccgccgctccagggcgacgacggaccaggagccgtcctcgcgagagtga

SEQ ID NO: 25739 - DNA, 256 bp, Zea mays
  Clone ID: cC-zmle189042b05d1
gaaaaactcaccggggtagtactaaatagtaaaaagctgtaataccctttttttttttctaccaatgataagtaagggggggttcataaaaatatgaacaggtcgtatcgtgaagataaagtattggtagatttatcaagtaacttctgccacataagcggtgtttgaggtcactataaatgaaatccccctttccggtttttaaacacatcgtgaattgcttaaaccaaattaacttagttaaattgaggaggat

SEQ ID NO: 25740 - DNA, 491 bp, Zea mays
  Clone ID: cC-zmle189042b06a1
gccttcagaactgaaagacatttccgtttaaggccccgtagacgcttgcgatggctaggagtcctgactcattgggtggatctggctagattccgaatggttataaatgacttagaatactgtaggtagcgcaaaataagatactcaataggacccaagataagccaaaaagtcacacctgcacaacaacccaaagaaatctgccgagcaaaaaaaacaaacaattgaaaaaggagagagggcatgacccgggcacaaaaaaaaaatcctgacccacaaaaaaaaacccatgggataagtggctgactaacccccaaaaaatttgtgtgggacaaagaaaaaaaaattcttttttgttttcagaaccacaacaaaaaccgcgattaaattcccccccaaccatgaaaagtttattagccccaacaagacaatattggcactacaaaagcacacaaaagtgtcttttgaatcttacacagtgagacctcacc

SEQ ID NO: 25741 - DNA, 312 bp, Zea mays
  Clone ID: cC-zmle189042b07a1
ttttggagaaaagatagtacagtactacacataccaactagtcactcactactatatactaggagtgacggcacatatatcactcactccataacataggtcaaattaaacggcggagacaccagcagaacaagaacaacaatacacaaacacaagtatatatatagtgatgactagctataatagagcatgcgtgcgttttagataaccacaaggaccagcaaacatggcctcttcactgtccatccatctcgcccgatctagcggtggttgctcctggtctcgtcgcccacgcgtccgcccacgcgtccg

SEQ ID NO: 25742 - DNA, 347 bp, Zea mays
  Clone ID: cC-zmle189042b07d1
ccggaattctcgggtcgacccacccgtgtcggggacgtcgtggtcggactctgtggtcgactagtaccagtatcttttcaccggtagatcgggcgagatggatgggcagtgaagaggccatgtttgctggtccttgtggttatctaaaacgcacgcatgctctattatagctaggcatcactatatatatacttgtgtttgtgtattgttggtcttgttctgctggtgtctccgacgtgtaatttgacctatgttatggagtgagtgatatatgtgccgtcactcctagaatatatgagggagtgactagttggtatgggtaggactgtactatcttttctccaaaa

SEQ ID NO: 25743 - DNA, 479 bp, Zea mays
  Clone ID: cC-zmle189042b08a1
gcgggctttttttttttttttaccaatactaaaactcccatatattattaatagcattacctaccattacaatgtatataataacatcgatctttaatttttgtttagaagcaggcatgactacactcagccagcgtagagtagcaaccatgagttcggccaccaatgcagcagtagcacttgttatctttgcatggaagaaacccttgagcgcattgtgctccttttcctcgcataattccttctttagctagagtagaaacaccgatatcatttgggacatgacccttcccatgcgcatgagcagcaaagtatccgaggagaagtaacgagaaaaacactagtgcatccaccctgtttttgttttccatgacgcaagaaaatctaaagaactcctcacgattgatcctagaagagtgcccacgcgttcgaccacgcgtacgaccacgcgttcgcccacgcgttcgcccacgcgtccg

SEQ ID NO: 25744 - DNA, 490 bp, Zea mays
  Clone ID: cC-zmle189042b08d1
ccggaattttcgggacgacccacccgtccgcggacgcgtgggcggacgcgtgggcggacgcgtgggcgtttttttgctcggactcgtgggcactcttctgggagcaatctttaggagttctttatcattttcttgcgtcatggaaaacaaaatgagggtggatgcactagtgtgtttctcgttacttctcctcggatactttgctgctcatgctcatgggaagggtcatgtcacaaatgatatcggggtttctactctagctaacgaaggaattatgctaggaaaaggagcacaatgcgctcaagggggtcttccatgcagagataacaagtgctactgctgcattggaggccgaactcatggttgctactctacggtggctgagtgtactcatgcctgcttctacacaaataatgcagagcgatgttattatatacattgtcacggcaggtaatgctattaataatatatggcaggattagttatggat

SEQ ID NO: 25745 - DNA, 337 bp, Zea mays; identical to SEQ ID NO: 25601
  Clone ID: cC-zmle189042b09a1

SEQ ID NO: 25746 - DNA, 338 bp, Zea mays
  Clone ID: cC-zmle189042b09d1
cgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgcccttcctcgtctacaacaccagcgccctctccggctaaggatatccaatgcatgcgcttcttgcgattcgtcgtgtaaaatcagggtgtctgtctataatctagcctccatggatgctcaaccttcgtcatgtaacaataatcagtgctactcttcattacataattttgatgctatatatatataccccatcc

SEQ ID NO: 25747 - DNA, 504 bp, Zea mays
  Clone ID: cC-zmle189042b11a1
gcaaagggtgaaatagcaagatgggaccaaataaatagataaaagtgcacatgctaacagatctcaacagttcacacgataacagcaacgatcacaaacaaaacttgtgatgatgaaaactaggtattgctaaagcaggcgcaggatcgcatcatttcttcttggcagccgccttggtcaccttggcgccggtcgggtccttcttctccacactcttgataactccaacagcaaccgtctgcctcatgtcacggacagcaaacctaccaaggggaggatacgctgagaacgtctccaccaccatgggcttggtcggtatcatcttcaccataccagcatcaccgttcttcaggaactttggctccttctcaagctccttgccagaccgcctgtcgatcttggtaatgagctcagcaaacttgacagcaatgtgggaggtgtggcagtccagcactggggcataagccgtgccaatctgcccagggtggttcatgatgatgacct

SEQ ID NO: 25748 - DNA, 534 bp, Zea mays
  Clone ID: cC-zmle189042b11d1
gtcgagaggtatcaccattgatattgctctgtggaagtttgagaccaccaagtactactgcacggtcattgatgcccctggacaccgtgacttcatcaagaacatgatcactggtacctcccaggctgactgtgctgtccttatcattgactccaccactggtggttttgaggctggtatctccaaggatggccagacccgtgaacatgctctccttgcgttcacccttggagtgaagcagatgatttgctgctgcaacaagatggatgcaaccactcccaaatactccaaggcacgttatgaagagattgtgaaggaagtctcatcctacctcaagaaagttgggtacaaccctgataagattgcctctgttcccatttctggttttgagggtgacaacatgattgagaggtccaccaaccttgactggtacaaaggcccaaccctgcttgaggctctcgaccagatcaccgagcccaagaggccttcagacaagcccctgcgtctgccccttcaggatgtgtacaagattgg

SEQ ID NO: 25749 - DNA, 285 bp, Zea mays
  Clone ID: cC-zmle189042b12d1
aagaaaagcagctgaacgtgccaagtgtggctgtctcttctccaagaaaagtagctgaacgtgccaagtgtggcgttgtttatggattgtcgaactcaaagctggatttggcttttgagggggaaatggttgcatatatatatttgtggacctgtggtggtgtgaccagcgatctttgatgtcataatgcgatatatatactctactttcagctgcagaaaaactactaaacaacaacatacatcaaaccaaacaaataaaccttttgttacattcgatcaaatg

SEQ ID NO: 25750 - DNA, 591 bp, Zea mays
  Clone ID: cC-zmle189042c01a1
ggaaggggacgaagaggggccccgcgggcgccggctgctcgtcctcctggacgacctggccgtgcggtcgtcgcactcggccttcttcggctcgctccaggcgcgcgggttcgatctcgacttccgcctcgctgacgatcccaagctctcgctccaccgctacggccagtacctctacgacggcctcgtgctcttcgccccctccacaccacgttttggtggatcagtggaccagaacgcagtcctcgaatttattgatgctgggcatgacatgatcctggcggcagattcctctgcctctgatctcattcgtggcattgcaacagagtgtggggttgattttgatgaggatccagaggcaatggttattgaccatatgaactatgccgtcacagatgttgaaggtgatcacaccttgattgctggtgatgatcttatccattcggacatgatactagggtctgaaaagattgaggctcctgtattgtttcgaggaattggacacatggctaatccatcaaacagtttgggtctgaaggttctatcagcctctccatcagcatattcagctaattcaaagactaagttagc

SEQ ID NO: 25751 - DNA, 606 bp, Zea mays
  unsure at all n locations
  Clone ID: cC-zmle189042c01d1
cccacgcgtccgccaggatcagaaatcagaactgagcacgagttcttaattactgggggtgtagtacttccagggtcacgtttcagtgctatagactgtaaacgttctgacaagtgctgatcagaaagggtccaagaaaaaaaagaagtgggggcagatcgaacatcctagcacgagtaaatttcccatgagtgcggtcacggtcgtcaaatgttatctaagttggcagtacaaaaacatggttccataaaattggcgccgggtaactcttggcttatagcacaacattcagtgcccacagatcttggtcacgtcagcctccagagacttgtgcgctcccatgagtcctttatttgtggtacaggtacacaaacgagaatacgaagaaagcacccattgttgaaaatgaggcggtgtagtatgggtacgctgatgttatgaatctctcatactcattatgtctgtaaggacgtactggaatctgctttgtaaaagacagaccagtatatcccagtctttggtactcaactttgaacttggaaactccatatacatctggaactnttgaaggttgttgaatacagacccttgttgcagtcgacatag

SEQ ID NO: 25752 - DNA, 287 bp, Zea mays
  Clone ID: cC-zmle189042c02a1
gagccccaaaaaaataaaaatggtgttcaaatactacgcgtgaaaatggtatgttcaccttgttacaactgaatggtttgtgggagtgccgtgatgtctgaattcaaataagcatacagaatgcgcgagctgaatgcatgtgtatatacaaactttaatacaattccgaaatgcttgtatcatggattcatatcttccatcatcatgcgctactggctcatccgtagtataaagctgcatgccacaaaaccgaatcagctcacgacgacagctgcggtgccggtacc

SEQ ID NO: 25753 - DNA, 337 bp, Zea mays
  Clone ID: cC-zmle189042c02d1
ggggccggcaccgcagctgtcgtcgtgagctgattccgttttttggttgcagctatatactacggatgagcgggggtcgcatgatgatggaagatatgaatccatgatacaagcatttcggaattgtattaaagtttgtatatacacatgcattcatctcgcgcattctgtatgcttatttgaattcagacatcacggcactcccacagaccattcatttgtaacaaggtgaacataccattttcacgcgtagtatttgaacataatttttatgttgttggggctcagagaaattcttattctagaaataagtttggggcgtgccgtttataggagg

SEQ ID NO: 25754 - DNA, 430 bp, Zea mays
  Clone ID: cC-zmle189042c04a1
attattttattgggattttaggtcgttttatacctgtcaccgtgacatcgttaaactaaactgccttacccactaaatagcaagaagctgaaaaaaccttttttaattacatcataattaactaataaaaaaaatcatcttccagaaaatgacaccacactaccacaaccctaagaacaaacaaccagcccggaagaacggggtaactacagccacaaaaacggagctccaggccactatacgctaaaacccttatatccggaaattaaccacatccgaaacagccccaaccccatcaaccaaccccaatccaaagggggaaaaccaaatagcaagtgcgacacctacccgaatacctaaaaagccaggaaccggatggctatcgctaagctacacccctaacccggcccaccaacccccccctaccctc

SEQ ID NO: 25755 - DNA, 585 bp, Zea mays
  Clone ID: cC-zmle189042c04d1
gccacgcgtccgctccttcccggccgccgcgcgagcttggtgggtttgtgtctcttcttcgcggagacctgtgggaggagccatcatcatggccgccgttgagactgttgtcctcaaggttgctatgtcatgcgagggttgcgcgggggcggtcagaagagtgctctccaagatggaaggagttgaaaccttcgacatagacctcaaggagcagaaggtgacagtcaaaggcaatgtcaagcctgaggacgtcttccagacggtttccaagtcggggaagaggacctcctactgggagggcgaagccacggccccggacgctgcggcggcttctggagccgaagcagctcccggcaccgcggcagaagcgcctcctgctgctgctccggcggcgccagagatcaccccagccaaagctgacgcctgatcgtcacgctattattcactcacatgtgatgctgcggctgcgactcctaaaccttaaatctagaaatagctgcggattgggtttgcattgcatcgtgttcttgccgtctagcaagtgactataagaataatggaattaaccatgacccagtgtgtgtt

SEQ ID NO: 25756 - DNA, 376 bp, Zea mays
  Clone ID: cC-zmle189042c05a1
aaaggggggggggggggtgatgaaacaaatcccccccccaggattaccctacacgactcccaacaggaaatggaaaggggaatcctttacccccagttcggggactgcctacacctcatatttttttataacatccctctttttcggcaaaaaatctggatattattctctagggaaaaaacccccccccccgtgctgtacgtttttccggggaaagaaccctggccttttgctttgcccaccttgcactcgagggtctggggggtgtccttgcaaaaaccctccaaagggtccccgttgccggcccccgcctccccgggccacttggccccccccaggggcgccaaatcaaccacgcgttgggtggccccccact

SEQ ID NO: 25757 - DNA, 368 bp, Zea mays
  Clone ID: cC-zmle189042c06a1
gcggccttttttcttttttttgcacgtaatttttaagatgattcacatcatgctcgaaggtaaagtacatcgggtctaagaaccatgaaaatattgcttgtggaattgaactgaatccactccccacgctagcgggaggttggtcccgcgtgcttacgccggcggggatgtaacggcctcaagcaggtcctcccgcatgtcgtcgtgttcgtcatccccggtgatccggtcgagcacgagcacgatccccatggacaatgcggcgtttatgccggctcgcacccatagcacgaatacgttccggcccatcatgacgtgcgcgtgctcgtgcacctttcgtctgagctctgtcaccaccacgttctcct

SEQ ID NO: 25758 - DNA, 371 bp, Zea mays
  Clone ID: cC-zmle189042c07a1
acccttcaagcgaaggcagtcacttcgacggttgtgagtcatggactgctcctcagatacacaggggcacatgaggaacataaatacaccagatgtacggacacgcacggagccagggcagacaggaacaacaggggtgctgactgatgcatggtgaacgcacccacctgatgcccgctggtcacctatgttaaagtatcccgtgcagagtgatccagagcttctgggctgaaggcgacggctcattgctagggcatgacgccgtgtcgagcataaggaagactggctatagctgtacgccgggagagattgctatgggttcccagtttcacatatcataccatccggtttgatcatgcgtaaaggctgga

SEQ ID NO: 25759 - DNA, 419 bp, Zea mays
  Clone ID: cC-zmle189042c07d1
gaacacccacccgtgcgagtactcagaatcataaactcaacctgccactctctggtttttaaacagatgccaaacaaacaatctgggtggggattaaaaaccaaaaacccccccccaacaccactacccaatccaaagagaaccaaccacataacaatctacccagaccacacaataaagaacctcacacattacaccctacacctgatatccacacattatcccaaaatgacaccacctaacacacgcagaaccccacaaacctgcacacatacccatacaattacagcatcaaaatccagcaggccctacactccaaccataccaaaaaataataacaaaaaaccaaataactgaaatcccatcttgacataacaaacttgacaaaaaaacgttacacacaccaataaccccaaaaa

SEQ ID NO: 25760 - DNA, 131 bp, Zea mays
  Clone ID: cC-zmle189042c08a1
ggggtgacggggaacacaaatagaaggggaaatttaaataaggcaaaatttacataagagactaacaactggaattcagattcaaataccaatgcttaaccaaatgtaaacatggaatacataacaacgca

SEQ ID NO: 25761 - DNA, 155 bp, Zea mays
  Clone ID: cC-zmle189042c08d1
ccggaattctcgggtcgacccacgcgtgcgtgcgttgttatgtattccatgtttacattttgctaagcatttttatctgaatctgaatttcagttgttagggtgttctgtaaattttgacttatttaaatttacacttctatctgtgttatcagt

SEQ ID NO: 25762 - DNA, 487 bp, Zea mays
  Clone ID: cC-zmle189042c10a1
gcatattgaccagactccagagttctaaaaaaatagtaccagctttttcgaggcttaaagtttgaggtggtctgtgcagcaagggcctcaacagcgacatgcacacctcacacacacaccaagaaaaccaaaaaaacacatgccagaaagaaaagaaaaaagcaaacaaagaaaaaaccttgccacgtatataatcgataattgatgatgtattgaagaacagagttttgaaccatggagcagtttggaagttttacatgactggaaaaaaaagggagatgggattgtagcttttatgagcactgctactagtaatgttcacatagcatggctctgtaataatactgttgatcaccacatccaccagcagcaggcaatccggttgccaacgaggaggcagcctcagacaagcacctgagctgcagctagcctagcaatcggaaccctgaaaggggagcaagaaacgtaatccagcccagccttcgcg

SEQ ID NO: 25763 - DNA, 222 bp, Zea mays
  Clone ID: cC-zmle189042c11d1
gcccacgcgttgcgtaaatatctagagcacgccatcaagtgatgactgtgactttttagaggaataccgctctgctcgcatgagggggtttatctgtcaagccagcctgcggcagcgaaaaacctccagtagagtacagcccccccgagtaatgttaggtagcatacttccatcattactatctggggggggctattcttcgcattatcaataaaagtctga

SEQ ID NO: 25764 - DNA, 132 bp, Zea mays
  unsure at all n locations
  Clone ID: cC-zmle189042c12a1
tcctctanagctggctcgctcctttttttttgttttttactttcttttagatactccaaaacgttcatttcattgtcgatggcattataccatacatagtgttcctgtacaccccacaggttagagttttcc

SEQ ID NO: 25765 - DNA, 481 bp, Zea mays
  Clone ID: cC-zmle189042d01a1
ttttgataaacaggtgttcttgttttatacagtgtgtatatatagagagagacaaagagcaagtgaatttgtaggaacaacgcccacggagaacgaacgcaagcctatttcctcatcacaaggaacggaggcatacataggtctcatgtgtgagcactgagcaccgctggttccggatcatcctcatgccttccaccatgggtcctcgccggtcctgaagtcggtctccacccacgggacgaagaggaccttgccgtcgtcgacgtcggcgtgaaccagggccagcgacagaggcgccggtccacggaccaccttgccctggttgttgtactgggatccgtggcaggggcagatgaacttgttctcagcgccgttccacggcacgacgcagccgaggtgagtgccacggcgttgatcccgtaggtggccagcgtcttgtcctgctccacaccaggtacgtggggtcacccttgagcccctg

SEQ ID NO: 25766 - DNA, 72 bp, Zea mays
  Clone ID: cC-zmle189042d01d1
aattatggtgtcgacccacccccccgcccacgcgtacgacttctgtttagatacacttaaccataatttttt

SEQ ID NO: 25767 - DNA, 477 bp, Zea mays
  Clone ID: cC-zmle189042d02a1
acatgtgaatgagtatgtatattatatgtctgcgtgtaataacaaacattaattacgtacgtacgggtcggtgcatctgataccaatttcatgcacattattccatataacaacggttactatatatatattccgcaggacgacgatagatcatatgcatgcgaaagcgctgcagtcttcttctgtgcatgcttcattccttacgagctctccggcctgaaccttctgcccccggatcctgcctccctttggcagttgaaatacgtggcagccacgacgtccaggtggtactgacgggcgaagctcttgcagttgaagttgtgccgcatgtctggtgcaaacaccgtccccctgccgagctgccggaacagcacgaacaccatgcggtgtatgccggacctcggctctggcctctcgtaaaacatgagctcctgaccaaagctggctccagttgttccaggaatgtctatcaccatc

SEQ ID NO: 25768 - DNA, 572 bp, Zea mays
  Clone ID: cC-zmle189042d02d1
cggaattctcgggtcgacccacccgtccgctaaagtcgccggataatataagaccagcaataacaagctagtttgccctcgttctccaacaaaatgtctgatggggagccgctggttctggctcatgtcatacgagatgtgttggattcatttgcaccaagtatcgggctcagaataacctacaacagcaggttacttctatcaggtgttgagctgaaaccatccgcggttgtgaataagccaagagttgatgttgggggcaccgacctcagggtgttctacacattggtattagtggatccagatgccccaagcccaagcaatccatcactgagggagtatctgcactggatggtgatagacattcctggaacaactggagccagctttggtcaggagctcatgttttacgagaggccagagccgaggtccggcatacaccgcatggtgttcgtgctgttccggcagctcggcagggggacggtgtttgcaccagacatgcggcacaacttcaactgcaagagcttcgcccgtcagtaccacctggacgtcgtggctgccacgtatttcaa

SEQ ID NO: 25769 - DNA, 126 bp, Zea mays
  Clone ID: cC-zmle189042d04a1
aagccgggggttaaaggtgagcgcgggaatgagactttattatgggtttgcgcaaggtgtctggcaccttttaactatggttgtagcgacattgaacctgccatccaatttaagggaggttatggt

SEQ ID NO: 25770 - DNA, 412 bp, Zea mays
  Clone ID: cC-zmle189042d06a1
cggggaaagacacacccaaatctgggaacctaaagagcggccgccctggcgccgtttaaaccaatttgagaaatagcgcgccgcgccgacaacggcgacgctgacgatgagctctcgagctaaacgataactaactgacggtatgataacgagtctcggtacaaaccgccgaaccgcgctcccaaatgaatacgtatatggaattaaacaatctaataactgctcagctggtgattttaaaaaggctgagatagttgccgttttggtcagagaatcggaggaggtatcttttacggtaggaaaaacagtatttcttttatacggcggatggtggtgacttatatagaaagcggaatttgtacttcccttaaaaattattacatactcctgcccgacccgagtgcgtcgactc

SEQ ID NO: 25771 - DNA, 98 bp, Zea mays
  Clone ID: cC-zmle189042d06d1
tcaaaaatatcaaccaactccaaaaccatatacaacacctatttataataaacatactgtataatccttactgaaactctttcaacctaccatatttc

SEQ ID NO: 25772 - DNA, 157 bp, Zea mays
  Clone ID: cC-zmle189042d07a1
tttttattttacgtttgagaatttctctcaacatttccgcggcccgggtcaattataaaggccctatcctgttaactcacactcgtgagaatgcaataaacaagtcctcaccaatcacgggtcactaacagcccataaaaacattcataatgggggg

SEQ ID NO: 25773 - DNA, 357 bp, Zea mays
  Clone ID: cC-zmle189042d08a1
atcatcccaggccgccctgttttataatttaccagacttccaataaatctactatccccacccacactcacccataaccccccacccggcaagagtccaccaccccacacacacacacgagggcaacccacccccaccaactggaggggggccacccccccgcacgacaaaaacccccgatccaaaaaaaagaaaacactcgtcccccccacaagcaacaacattccccaccccacctatacaagcccccctcccccttcactgggagggcgggcccccctaaattctcaaaaagggacaccagaaggccccctccaaatccaaagcccattcttgtttagggccccccccccccgt

SEQ ID NO: 25774 - DNA, 283 bp, Zea mays
  Clone ID: cC-zmle189042d08d1
ctatctgcccatccgactgaggaggttgatgttagatggctcctgatggatccgcactttctgacctgcccatgcgcatacgactccgactatgccgatgactgtgataatgatgactttgtgatcccaattttatatgttgaataatatcatctctgagactgttaagactaagtggctaccgatctctaaccacctacagatccgatcatagatacagataacatatttgtttttccacactgagcaccgccatctcgagcgaagattgcagaggatgctt

SEQ ID NO: 25775 - DNA, 498 bp, Zea mays
  Clone ID: cC-zmle189042d10a1
ttttacggtaatggagctctccttagtctttgttctcatgtacagtcgaaggaacacacaggggtgctcagccaggcctggcctatccaagctctctacgtagtgcgtgcatcccatcccatcgaagaaataaaattacatcatcatgcgacgctgaaggaggaggcggccttctcgactcccttcctggcgcccttgaaccacctcttgtcgccggcctgcgccttgcagatgtagagcttgccgtcggagacggtggccgctatgagctggtgcttgccgccctcttctcctgccgccgtccttgtgagcactgacactgcgtattactgcttgccgtctatcacgggggtggagctctccatgactttggctgtggccacggctccggtctttaacccgccctcggagtctgtcttgccgccgtaggccttccttgccagcaggtagtctacctgtgagaggaactcctcgggagagccgtattccgcgatggtc

SEQ ID NO: 25776 - DNA, 471 bp, Zea mays
  Clone ID: cC-zmle189042d10d1
ccacgcgtacgcccacgcgtccgcccacgcgtccggtggcacccacgcacactcttcttcctttcagtccggaccccggaggagccaagccatggcgtccacctcctgctgcctccctcaccagtcaaccgcccgcctcggcgcgtcgccgcgcctggccgccgccccgccgcgcaacgcccagctgcttgtctgcaaggcccggtagcaggacgccgccgcggaccaaagcgacgtctcgcgccgcgccgcgctcgcgctcctcgccggcgttacggtcgccctcggcgccaaggtgggtcccgccgccgcggcatacggagaagcagccaacgtgttcggcaagcccaaggcgagcacggagtacatcgcgtacagcggcgactgcttcaagctgctgatcccgtcctagtggaaccccctcaaggagcgggagttcccctgggaggtgcttcgctacgaggacaactt

SEQ ID NO: 25777 - DNA, 472 bp, Zea mays
  Clone ID: cC-zmle189042d11a1
ggaaacaaaaaaaaaaagttgaaattattgatgtcataataggcctcggtaggtttcctttcttttgcctggatacaagacgacgacatttacagtaaagggcacaattgtttcaacctgcagttcaaaaccatcacccagtaatggcagtgtttttgtgaactcgatcagatgaaacaaatccaagtttggtccccacaaaaataaatcaataataatacaagagagatgaaaattaaaattatcctctctttttttcaaaaactatacttgatgggtaacgtacaataaccaaggtaaggtgagcctaacaagatgaacaagcccccagggggaaaaccttgtgtggtcggcagaagacgtccaggctaacattcaaatgtcatacggttgctgtctcgagcaaatatgtatcttgcagcttcataaatgtcttccatcagccagaaaagagaaaactcatataagtctc

SEQ ID NO: 25778 - DNA, 561 bp, Zea mays
  Clone ID: cC-zmle189042d11d1
cacgcgtacggtcttatcactcaggtaaaacctcttatctgggtcgaagcacacattgagattcattctagaagccgtatagaactcatggtgaaggcattgagtcagctcaaggaaagaagcacagcaacaaatgttgaaattgaagtgcctgttccttcatatgccacaaacccaaatataataactttaatggggtctgctgcatatgctcctgagagagatgcaatggtctggtaagtaaaatcattccctggtggcaaggaatacatgtgcaaagcataatttagtcttcctagcataacagcggaagaaggggccccagaaaagaaggcaccactacgagtgaaaattgagataccatatttcaccgtatcaggtattcaggtccgttatctgaagataattgataagatgtggttaccatggctacttccccctggagtttagatattatctaccgacttggctggctgaataatgaagctgagcacttattatgagctttcttcttttctggctgatggaagacatttatgaagctgcatgatacatatttgc

SEQ ID NO: 25779 - DNA, 171 bp, Zea mays
  Clone ID: cC-zmle189042d12a1
aaaaaacttaaccccccataaaaccaataataattaccttttatttttttacaaaaaaaattaatttcttaacaaaaataaataattaatcctatacattgaagcttaatttaaccacccccccaaatacttttacataccaccttatataaatttttctttaaccattcc

SEQ ID NO: 25780 - DNA, 492 bp, Zea mays
  Clone ID: cC-zmle189042e01a1
ttttatttgtttcgaaaaagatatcgtccgattctccttctattgattcttttccgatcgagatgtatggatccatgtgtctacatacctagattctgttcatggattaacgaaaatgtgcaagagctctatttgcctctgccattctatgagtcgcttcctttttgcgtatggcacccccactccctttggcagcatctactaattcggaacttaatttgaaagccatatttcgacccggacgcttttgggatgcttctaataaccaacgaatggcaagtgctcttccttgtttagatcctatttcaatcggaactttccgcgtcgatccttttttattacgtcttgtttttactcctatattgggagttactctacgtattgcttgacgtaaaaccaatagtggatttgtttctgtcttttggtgaatctttttcacggctcgatagagaatttgataagccaatgattttgttccgtctttctaatacg

SEQ ID NO: 25781 - DNA, 526 bp, Zea mays
  Clone ID: cC-zmle189042e02a1
ttttgcaaaaaaaacacattagatagtaaaattgttgcgcgtcacattgtaggggcttttgagtagtagtagtagtagtactacattgcataatagtctgcgttcttggtacataaaagagtctctttgcttcagaaccgtcgcagtgaagctgccgagtatcatgaggtttatctatcctctcagccatgtgttcctgtaggacgagttgtcacgccgcgaagcatcatggggtttgtactccatcagatagctgtgcggcagcttgaggtgcctcttgatagaatccctcaatgccatcacagcctgatggtctgatgcgttccggttccagacgctcagaatgtcttcattgaaacggacactaagcacaacaccacagacatcatcgctatactcaagctggtcgcctactaccactagcaccaaatcctcccaaaatcgacctgaaactgcctttttgaatctaattatccacttgccaccattcttgtttgcaggatcctcccagaggggacggatgcca

SEQ ID NO: 25782 - DNA, 473 bp, Zea mays
  Clone ID: cC-zmle189042e02d1
cggaattttcgggtcgacccacccgtgcgcggagaataaggaggccgagcaggaggagcagcagctaccgctcgcgcagaaggataacgcgcccgccgccggggaggaagacgaagcggattcggaggagaccgagcgccgcaaccgcgacctcaagtccggccttcacccccttaggcacaaactcgtgctctggtacactcgccggacgcctggagcgaggtcgcagtcgtacgaggacaacatcaagaagatcatcgatttcagcacagtcgaatcgttctgggtttgctactgccaccttgcgcgcccttcttccctgccgagccccactgaccttcatctcttcaaggatggcatccgtcccctctgggaggatcctgcaaaccagaatggtggcaagtggataattagattcaaaaaggcagtttcaggtcgattttgggaggatttggtgctagtggtagtaagcg

SEQ ID NO: 25783 - DNA, 582 bp, Zea mays
  Clone ID: cC-zmle189042e03d1
gggtcgacccacccgtccggccacgcgtccgcccacgcgtccgcccacgcgtccgcgaggattcttgcgcgcctgctggcgctggggcggcgggacgggagcattgctgtccgcggcggagcccggcgctcgagtctcttctctcctctcctctcctctcctctgcggggggcagccttttatttgacaacggtataaagaaatcaagtacaaatgaagaggcacatctctgcccagtatttgatgactgaagataggtagcagtatggtagctgctacaattgcgggaatgtttcttgtgtgttttgagtccctctgcacctgttttggcacaaaaaggaaagatgaaagcgaagaccatgttcttgcagaacattccaattccttgagttcttatcaaatgacgtcgggttctgatagaatttctgcaagctcgcttcgagcacctgcaagtccatctagattttcattgtcttcgccaccaagcataaatgaacctttaaacatcagtcttgaacatgtggttaaactgacacataacttcgctccgaccgtgatgattggggaatggtactttggaaa

SEQ ID NO: 25784 - DNA, 52 bp, Zea mays
  Clone ID: cC-zmle189042e04a1
gggagacgccatcatcccggcatcggcggacctcgggattgatgccggcccg

SEQ ID NO: 25785 - DNA, 400 bp, Zea mays
  Clone ID: cC-zmle189042e07a1
ataaaaaggataaagtgaacttggataattagagggatttcccgtgtaattcacacaagtgaaagtgaaatgaaagaaacactacaatattgtggattttatggtccaaatattttggaggattatatgtggacatatggtatgcctccataaattttcatgaatttttgaggctatttgggtattattaatttctttctacaaacaatcaacaaaatgcacacagctatccagataagatatctggatatccgagaagatttatccgataaaatatccggatattcgatatccgacgaatatcagacatattgtattcgaattcgatatccgaacaaaatatccgtattcgtatccgttatccgaaaaaagtccggatatccgaaaattccatctgaac

SEQ ID NO: 25786 - DNA, 480 bp, Zea mays
  Clone ID: cC-zmle189042e07d1
cccacccgtgccgttcatattgaattttcggatatccccactcttttcgcattatttataccaatacagatattatgttcggggggcgaattctaatacaatatctcttatattcgtcggatatccaatatccggatattttatctgataaatcttctcggatatccatatattttatctggatacctgcgtgcattttgttgactgcttgtacaaacaaatataattatacacaaatagcctcaaaaattcatgaaaatttatggatgcataccatatgtccacatataatcctccaaaatatttggaccataaaatccacaatattgcagtgtctctttcatttcactttcacttcgtttaattacacggtaaatcactctaattatccaagctcactttatcatttttatgaccccgaaagtaaaggtctaacaactattatgtcggctaccgctctataagatcctagcttacgta

SEQ ID NO: 25787 - DNA, 384 bp, Zea mays
  Clone ID: cC-zmle189042e08a1
tcctttttttttttttttgggttttttatgcggtgtttttttggggggggggggaagcaccatttttttctggggaggtagggagaataaatcctgacgggggtaacattattcatcgaacccctatccatgctttttagatgcctgggtctgctgaaaccgagtatgaacacattactaacaactgaaacaaagcgaccttgcaattaaaaacacagatgggcaacaacaaacacgacacgaacgaagataaaccctctggactagggttaacattactgtagcgaacaagataatttggccgcgcgggccccaccgctcaattgctccaggttccgtctgagatgacctaaacccccccacggttgacaccgtcttatcctc

SEQ ID NO: 25788 - DNA, 391 bp, Zea mays
  Clone ID: cC-zmle189042e09a1
ggcagacaagatacactggccaccatgttccatatatggttgaaactgtttccaccacttattgtttacttatgcgaccaagttgagggcggggatccaatgctggcatatataaattactgaaacaggccacacactattaaattgtatagcacacctaatgggtacattgggtcgcgtccaattattgggggtccagatgcgggagggatgcaagcaaattggccaaatcttctatgaagaagcggctggatcttactgcaggaagggggcaaaatgtttcaatgcttccccatatacaggtttcttgaaatgaactggcttttcaataacatccttgggggggatacatgaccattcaccaaactcttgtttttcagatccatcacca

SEQ ID NO: 25789 - DNA, 293 bp, Zea mays
  Clone ID: cC-zmle189042e09d1
tgccattagccttcctgtatgagctagaggggaaccagtatggagaaggcctatctttagatggggcactgtatttaagctttctgcatgcgtcggtgtgattaaccctaatggtgatggatctgagaagccagagtttggtgaatggacatggatgacacccaaggtagctttctgaaaggccagtgattacaagaaacctgtatatgaggggggcttggatcactttgccccttcctgcagccagatctcagcgctttatattgattatttggccacttgcttgcatccct

SEQ ID NO: 25790 - DNA, 509 bp, Zea mays
  Clone ID: cC-zmle189042e10a1
cttaatatttttttttttggtattaactcaaagtctcaaacgtgcctcttggtgcattgacacacatgtacaatacaatcgtacatatagtacgttttattcgacaagcagcctctgcatgcaataatagtacaacccccgatttaattaattggactaatgcatgctgaggatggatcagatggagatgctgctggggatgcccctcccggtgactcccggcttggagaagggcttgagcagctcgtacggcacgatcccggcgccgcagcggttcttgaggtccaggttgttgttgcactcgtcgatgaacccctcgatctccttcatcctgccgccgaacttctcgaacgccgccttcaccatgggctccgccagccacgatggctccgcgaactcccccatgtactcctcgtcgggcgagtgcgacgagaggatgtccagcgtcgtcatgaccttgatggcctgcatctgcgtgggcagcatgtccagcagcgtcgtctccggct

SEQ ID NO: 25791 - DNA, 467 bp, Zea mays
  Clone ID: cC-zmle189042e10d1
ccacgcgtccgcccacgcgtccgcccacgcgtccgactcaccacattcgttctcgccgtggtctcgcgcgtgaggtgagtgagaccaccacgccagacaagaattaatggccctggagacgtgctttagagcgtgggcgctgcacgccgcccctgctggcagtaaggacaggctccttttctgcagcagcggcggtaacctggtgctgccgttgaagcgggtcgcggccgcagtggaagcgggcgttcacgcacgggcccgacgccaccgacgcctggctgtggaagctggccaaggcgcacgtgctgacccacgacacggggtaccaccagctggtgagccactggctgcgcacgcactgctgcgtggagccctacatcatcgtcggcaaccggtagttgagccggctgcacccggtgtaccgtctgctgcacccgcactttcgctacaccatggagatcatcgcg

SEQ ID NO: 25792 - DNA, 339 bp, Zea mays; identical to SEQ ID NO: 25658
  Clone ID: cC-zmle189042e11a1

SEQ ID NO: 25793 - DNA, 339 bp, Zea mays
  Clone ID: cC-zmle189042e11d1
cccacgcgtccggggcgcggcggtcgtccgtgtcttcgtcggcggggatccggaacccgcggacgccctcgttcaccatcaagaggaagaagaaggtgatgcccagcctcttcaagctgatcaaacagaggaaagacgagcgcgcgagctgagagatgtgcctcgccaaagaaaaatgcatttgtcagttcttttttctgctcgtacatgtcatgttagacgtcactgttgtgcaaaatgtacaaaaaatggattgaccgtgcttagcaacggatgccataaaaaatattcctatagttcgcccacgttcgaaagagcatattcatagcttgattaaaa

SEQ ID NO: 25794 - DNA, 276 bp, Zea mays
  Clone ID: cC-zmle189042f01a1
cgaagggagctcgttttgttggtttctatttttttttcaaccccaaaacagatgcagcattcagagtcacactacaggcagccggcacctggcactagcagtaccactaccagcccaacaggcaagggtgtgctactactgctacaaagcgacagaaacccatcacacgcgcacacacacgggcgacactggacagtccgggacgatccaaaccctgaccaaaaagcactcacggtcgcacagtctcgcggagcagtttcggaagacacgaacgac

SEQ ID NO: 25795 - DNA, 342 bp, Zea mays
  Clone ID: cC-zmle189042f01d1
ggaattatctgggcgacccacccgtccggtcgttcgtgtcttccgaaactgctccgcgagactgtgcgattttttttgcttcttggtcagggtctggatcgggccggactgtccagtgtcgcccgtgtgtgtgcgcgtgtgatgggtttctgtcgctttgtatcagtagtagcacagccttgcctgttgggctggtagtggtactgctagtgccaggtgccggctgactgtagtgtgactctgaatgctgcatctgttctggggttgaaaaaaaaatataaaccaacaaaacgagctcccttcggaaaaaatatatagcttagatagtatattattgagggg

SEQ ID NO: 25796 - DNA, 303 bp, Zea mays
  Clone ID: cC-zmle189042f02a1
ttttccaaaatcagggtctaccattaaaatccatttttttaggccatgcctcctgacaatacatatgatttttctgttgctagcttaagcagcagggatttaatcacatttgatattcctgtagattctccttacaaaaagggttgaccctagatagccaatagctccacaaagtatgcctaggccaaggcagaacatcagcgtgtagccgaaatagaaacttgtctggaagaagcctgacatctttgtcttcacatggtagtagtagatggagtacagatacacgtacagagcggttgaggc

SEQ ID NO: 25797 - DNA, 600 bp, Zea mays
  unsure at all n locations
  Clone ID: cC-zmle189042f02d1
cggaattctcgggtcgacccacccgtccgcggacgcgtgggcggacgcgtgggcggacgcgtgggtcctaactatccctgccgagtaaagactattccacgggctattcctgagaagaagtggtaccttacaccttctgtcatctcattgatgggtggcctgcttcccttcggtagcatcttcattgagatgtactttgtgttcacatcattctggaactataaggtgtattatgtctatggcttcatgttgctggtctttgtcatccttcttatagtcaccatctgcgtcactattgtgggtacttatttcttgctgaacgccgagaactaccattggcaatggacgtcgttttcttctgcagcctcaaccgctctgtacgtgtatctgtactccatctactactaccatgtgaagacaaagatgtcaggcttcttccagacaagtttctatttcggctacacgctgatgttctgccttggcctaggcatactntgtggagctattggctatctagggtcaaccctttttgtaaggagaatctacaggaatatcaaatgtgattaaatcctgctgcttaagctagcaacagaaaaatca

SEQ ID NO: 25798 - DNA, 444 bp, Zea mays
  Clone ID: cC-zmle189042f04a1
acgaccttgtttatttgttttcacttaatggatcatctagtagagccaccatgaacgtgtgcaatttggcaaataaataccctttcctttgggtaaagtcacagggagagagaatctgctaaaaaatatctgatggtgagtagatattacaacaaatcggtcaatgctacttggaccttatatgtgtagtctttgtttttactaaggatatcttccttaaacctcctgtgaagggactgactgacttactgactttatacaaaggctgcaacgggctcggaggaggccatcagccaggatcatctaatttattaggggagcaagcgagcctcagccagcagcgggggcgttttaagctggagcttggcttgctgctgggaccaaaatgcctggtgccccaggacccggtcgagcagcttctgaggcaccggctcgccacgccgc

SEQ ID NO: 25799 - DNA, 496 bp, Zea mays
  Clone ID: cC-zmle189042f04d1
ggacgacccacgcgggcggaggacaaatggaagacgctggtgcacaccgcgagcatttttcttcagcagcggcgtggcgagccggtgggggggagctgctcgaccgggtcctggcggcccaggcctactggtcccagcagcaagccaagctccagcctaagacgcccccgctgctggctgaggctcgcttgctcacctaataaattcgatgatcctggctgatggcctcctccgaggccgttgcagcctttgtataaagtcagtaagtcagtcagtcccttcacaggaggtttaaggaagatatattaggaaaaaaaaagaatacacatataaggtacaagaagcattgaccgatttgttgtaatatctactcaccaacagatattctttaagccaggattctctctccttgtgaatttaaccaaaggaaagggtatttctttggcaaattgtacatgttgatggtggaagaagaagatgatccatgaactgaaaa

SEQ ID NO: 25800 - DNA, 54 bp, Zea mays
  Clone ID: cC-zmle189042f08a1
gcggccgcccttttatagggggtttggttttatggggagccttctcttaggggg

SEQ ID NO: 25801 - DNA, 293 bp, Zea mays
  Clone ID: cC-zmle189042f08d1
gagacgacccacgcgtgcggtcagccgctagtaccacgtcgtcgtcgcgtttgcagctttttttatctgagttagccggcggatccgatcgttgcgctttcagtgtgtgtgcctgtgtgtccgtagagatggccacagcttacgctcccatggcaagccaggtgatgaagaccactctcggaatgcactccaggccgatgggcctgtcaagcgctgcttctctcacgaggcggcccggccggttcaccgtcaaggccatccagcccgagagaggcaactgtacctaggttggt

SEQ ID NO: 25802 - DNA, 422 bp, Zea mays
  Clone ID: cC-zmle189042f10a1
gatttttggttttctaaatggaccttgcagacacctagaagcagcattattttcttaaaattcactcacattttaggctggcgggggtaacgagtttcatggatcctcatttcatgccgaccgatgcatgggatatctgaaaacgcggattaacacatggtctgctactgacacactacgacccttgcctcaaaaacccatatggggtacatccaacacgacgcttactaatatcaaccctctggactaggggaaacatgacgggagcgaacatgataactcggccatgcggtccccaccgttcatgttctcccctttccgtcagaattgactcagcctgcccccctggatccaacgaagcatctcgcgggttgcacacccgtatccgtcgtagccaccggttccctccgtcaccctgtaga

SEQ ID NO: 25803 - DNA, 598 bp, Zea mays
  unsure at all n locations
  Clone ID: cC-zmle189042f11a1
catgacggggggggggtcgaacttcagctgggagcctctagagcggccgacctttggttttgattttgggataaacattagtataagcgactgatggggtacatagtcggctacaagcacaagaaccacaacatctgtgtgcgtaggcaaagactaaaaaggccaaccctgaatgaaaatgctaatgatacaatacttcagggtgagcgaagaagggctattccgtgtattggaactcaaaatccgaaatgaaatggggccacgaataatgacaagccaactatgagtatgctcccccggggatattcttcgcccaccgcagggcaggtgaggccttgggtgtcttgggcacggacaggcgctcccggaaatcatcctccatgagcaccaagccgttcttaaggacgatcttgggctgccaccctagaacttcctttgccttggagatgtccggattcctatggcggtgatcatcatgagtgttctcggtcatcgtcactgatatatctgggttaatcaactgcaaaggtgaagtaggcgcggcagtactcagtcaagagttgccaagctatggaagacgaaagcatngcgactatat

SEQ ID NO: 25804 - DNA, 513 bp, Zea mays
  Clone ID: cC-zmle189042f11d1
cccacgcgtccgatttcttttcaggttgatggtcttattaggctgatgaactgatacaacactggaccgattaacttggggaacccaggtaaaatccatctgcattttaacttttgatgctatacagtgagctacctacccaagctgtgttttttctgctatatgcattctcctggaccgaggtaaccaagttgggtctcatcttccgcaggtgaattcaccatgctggaacttgctgagaatgtgaaggaggcaagttggattatatagctgcaatgctttcgtcttccaaagcttggcatatcttgactgattactgacgcgactacttcaactttgcagttgattaacccagatataacagtgacgatgaccgagaacactcctgatgatccccgtcagaggaagcccgacatcaccaaggcaaaggaagttctagggggggagcccaagatcgtcctgaaggacggcttggtgctcatggaggatgatttccgggagcgcctggccgtg

SEQ ID NO: 25805 - DNA, 382 bp, Zea mays
  Clone ID: cC-zmle189042f12a1
agggaaccagtccgaggggggtttttcaagtccccggccaatacatcactaatggggataatggttttttttcataaaaaaaaacgttctactcaatcctgtttctcaacatcaatccaacaacctaaacccccttcgagggccatagatttattgacactggcaaaaacaagagccgctaactttgaaacaagaacttacacaagctcacctaatgctgcacaatacaaaacctccctgtgctctaacactaaaagccccagatctgtaatctgctaaaggctctctacatgctctgcttgaaccggaccccatatatatcatccagaaccttcttagtaatctcacggtcttccttatgtcctgtgagtatccctccaat

SEQ ID NO: 25806 - DNA, 406 bp, Zea mays
  Clone ID: cC-zmle189042g01a1
gggtaataaactatattcattattatttgaatggggaaataaaaacagtgacctcgaaagaagtatattttaggggaaggagagtttttttttatggagggagtacaattgctattgcaataactatttctcacactaaatacaaagaacgtacgtgtatgtgctcaataattattccatccgacctttgcaaggctggaacgacatggaccggtgaacagacaagcaccacccgtctggaagattgcacaaggaatcctatgctgtgcatcttaaggtctcaaccatataccaccactagcttgttctgtactcagcgctcggtggcctgccttcttgtcgtcgtcgtcacggacgctgcaaatggcagcattccccaatttaagatcaaccaacacgaaaatgt

SEQ ID NO: 25807 - DNA, 476 bp, Zea mays
  unsure at all n locations
  Clone ID: cC-zmle189042g02a1
ttcctcgcggtggcggcgcatgtgtccgccgagcgcctggcccatgtcgaagccgaggccgcagacgtggcacaggtggctcgcgggcgcgggttccgccgctgccggcttcgtcgcggtatcctccttcgccggcgcggcggcgggcacgccgagcgcgaggccgtggcgggcccgcaggtggctggtgcggtgcccgcccagcgcctggaacgacccgaaggcgcggctgcacgtcttgcagacgaactcgccgcccgccgcgcgccggggcttcttgctgatgccgtgcttggtggccacgccaccgccgccgcccagggacagcgcgagggagagcggcacggcgccggcgtctctcgggtgcttcatgtacgtatgtcngtggtggggaaggagtgtctgaggnggtgagggcttgcgatcgagctcgagatgttaggagagagcccnaaagggagagggagggtgaaagc

SEQ ID NO: 25808 - DNA, 496 bp, Zea mays
  Clone ID: cC-zmle189042g02d1
gccaaccactgcggcctgctgctttcacctccctctccctctctgggctctctcctaacatctcgagctcgagggcaagccctcaccccctcagacactccttccccaccaccgacatacgtacatgaagcacccgagagacgccggcgccgtgccgctctccctcgcgctgtccctgggcggcggcggtggcgtggccaccaagcacggcatcagcaagaagccccggcgcgcggcgggcggcgagttcgtctgcaagacgtgcagccgcgccttcgggtcgttccaggcgctgggcgggcaccgcaccagccacctgcgggcccgccacggcctcgcgctcggcgtgcccgccgccgcgccggcgaaggaggataccgcgacgaagccggcagcggcggaacccgcgcccgcgagccacctgtgccacgtctgcggcctcggcttcgacatgggccaggcgctcggcggacacatgcgccgccaccgcgaggaa

SEQ ID NO: 25809 - DNA, 125 bp, Zea mays
  Clone ID: cC-zmle189042g03a1
gcgggagcggtaatcactggggggcggacccgcggggggggaacttaaacttttacattttaggtatagcctgcgtagggttaggacgttactgactataggattagaactaattttgtacaaaa

SEQ ID NO: 25810 - DNA, 165 bp, Zea mays
  Clone ID: cC-zmle189042g03d1
acccccccggtctaccagcgactcaccgacctagatcagcacacactgcacttatttagctaggaacagcaacagcttcggggggggagttctcaatgatctcctcgacatctctggcagtagcacctcacgtactgccttccctcgaacggcgtgctttctact

SEQ ID NO: 25811 - DNA, 375 bp, Zea mays
  Clone ID: cC-zmle189042g04d1
gaaacacccgcttaagtatcaaacgaatgactgcacgtaagaggccgctaactgtttttttgcctaaacgaaaccggaacctacggggggatatataatgatcaaaccgaagcatccgctaatttatcgaacgaatcataaaagtcaacaaccacagatagcattaactagagaagtagcgtaccggacggttaataattgtaattgagtagcgatagaagattgtgaaatacataaagcgatacaaattataacacctgataatcaatataaaacatcatttaaagaatattagaaacttcatgaaactgttaactctaacaagctttaaaaatgcgaaacctgattcttgatggttaaaatgattgtgtctat

SEQ ID NO: 25812 - DNA, 408 bp, Zea mays
  Clone ID: cC-zmle189042g07a1
ctttttaatgaagggagagccatctcgaaacatgcatatatggaaattatttttcctcagatctcgccgtcaagcatacatgcattatcttaaacttcgcaatggcgagctctatcgatatatatgatgactagcatcagcactaaaatagtattgtatcagggacacacgtacggcatcgaccagagcaccatgcatggtccatggatcatatcatcattatcatggcttcatgggatgggaatggatcggagtacgtgcttaaccatgatcagtacacacttatctctcggaggggcggtggtatcccgggtgatggtcgggcgataaattagtagctgtagtttttgacgaacattcccttcttggccttggcggcccttgccgtcggaggcgtacctggccgag

SEQ ID NO: 25813 - DNA, 461 bp, Zea mays
  Clone ID: cC-zmle189042g07d1
gaacacccacgcgggcgggagatcctgctggacggcaagcactgcatcgagcgcattttcttatgtggcgcacaacgtgtgggccggagccggctactccatggcggacaccaacttcatgttcgagggcatcctgctgaagccgtccatggtgactcccgttgctgaggccaaggacagggccaccccggagcaggtggccgcgtacaccctcaagctccttcaccgacggatccccccctccgtgcccggcatcatgttcctctcccgatggcaatcggaggtgcaggcgacccaaaacctcaacgccattaaccaggggcccaacccgtggcacgtgttcttctcctacgcgcggacgctgcagaacacctgtctcaagacctgatgctgtcagcccgacaaggtcaaggcggctcaagacacgctgctgctgcaccccaatgtcaacctcctggcgc

SEQ ID NO: 25814 - DNA, 143 bp, Zea mays
  Clone ID: cC-zmle189042g09a1
atgacgggtaggcctcgtcctaagctgggatcctctacagcgaccaccctttagatcgtttttgagcgacacccgacaccgacatactaaaccgccttagccataagaaagtaggggggttgtaaatactcttggaataactc

SEQ ID NO: 25815 - DNA, 439 bp, Zea mays
  Clone ID: cC-zmle189042g09d1
acgcgagggcaccgccctgcctcagagagataaatttcgctatctgcggcggtgatggcactcccggtgtttagctccggcctatttcgattcgactccccgcgcaaccgcccccagtccaccgacatagcgcctgccgtcttatggggagacctccccgggaccgccggtctctaagtggggcagccattggactggattaagaaaactttcttaccgaaaccgcaaccagaggcataaattgtttgcaaggctgcgacgtcggtacttcacttttatccgggatggttcctgactgaggagaactcggttaactcagcaaaccatacgagaccccctggtgtacccctgtgtgatttttatgaaacagatgtaagcaatccccagccgggagacagggaacaaccacactggttggataaaacgtgtccatataata

SEQ ID NO: 25816 - DNA, 280 bp, Zea mays
  Clone ID: cC-zmle189042h01a1
aaaacccaaccctggaaaatgcttttattaatgttccaacaaaaataagggcctccatttgggactggttagcttttacaggaaaacaaggggggaaactttggacttcctgacctaaattaaactttgggcctggaaaaaaaaaatcaaacccagttcctccctgggggggggaatatgattgattcctccacacggggggtttctggcttattccaacccgaggccctgttcaaaatttggaggtgcgcccaatcttgaaccactggggggggaaaaa

SEQ ID NO: 25817 - DNA, 496 bp, Zea mays
  Clone ID: cC-zmle189042h02a1
gaacctagagccatcccaaataccttcatagtaacaccttcatagtcattgtttacataatgaagtttaaaataaacgaggatgtgagataggatatgtaagctgcctctgaacccgataacatagctttgataatgaagtgtgttatatctgattacctgacatctctagtctaaacaactcattagcaaatagtacaagtgtacaaccctagtctaacaacccactatcctagtatagaaacggctgctacctctttagcaagtacagcccatccctcgtttctagcttttcatctgctactagaccagaaagaaaactttgcagctgctgcagcgacttgtcatacgatggctcggcaatacaaaacatctttagagtgttatgtatcctgtccagcgacatactcccaatatttgttagcattccgacgatgtatttttcgtagactgtcatttctttcttaagctgttcctccactgaagccacagagctt

SEQ ID NO: 25818 - DNA, 513 bp, Zea mays
  unsure at all n locations
  Clone ID: cC-zmle189042h02d1
cgaaccacccgtccgggaagaaaaatcttggaacagtcaagttagaactgcaatttgttgttagaagcgtgcaatttactgtagctcgggtgcatgctgcaatcataatgcggtttcaagagaaatctagttggacttcaaaggcacttgctacagaaattggcatacctatggattctcttaacagaagaataagtttctggacaagcaagggggtcctgactgaatcagcacgaccagatgccgatgatcgcaccttcactgttgtcgatagcatgtctgatgtcaacaaggacagttttgggaatgaccgctggccacagtatcaattaactggggaagagggaaaacgctttgtttcttttgnggaacaacatcttaagaaaaatatgacagtctacgagaaatacatcgtcggaatgctaacaaattttgggagtatgtcgctggacaggatacataacactctaaagatgttttgtattgccgagccatcgtatgacaagtcgctgc

SEQ ID NO: 25819 - DNA, 126 bp, Zea mays
  Clone ID: cC-zmle189042h03a1
ctttagtcgggactaacctttttatttttttttcatgagaggttttttggtgggctgggtgaccccgaaactaggtgggggggggatgagcatccttttatctttaaaaactaaccaccgaaatct

SEQ ID NO: 25820 - DNA, 464 bp, Zea mays
  Clone ID: cC-zmle189042h04d1
gaggaacccacctggacgcaccaccgtcccaaaagaatctacactccaacaccttttttttctcctaccccacgtgcgacagaggggagttatattaaatcaacgcccacctacagaccctcttccttacaatgcatccaattctttctacgccacgaacaaatataccgatacattctactgtgctactcaggtcaaaaaggctcaactttagaacccttctggatgaaggatcaactcaacattatgatacagctcacaacgatcatcactgttttatcttattcttaaaacacgtttgattttgctacatgaaaactgggggagtatatcggattttgcttcatgaggacttacctttgatgaatagtgtagggaaaactctagaaatgatatcatcatcgaaccatgtacgccattccaccacattgaagaaccatttgaggatactttaaaatatacct

SEQ ID NO: 25821 - DNA, 320 bp, Zea mays
  Clone ID: cC-zmle189042h05d1
ctcaccatacatagcttcaacttttttgcatacgtcccttggcacccgcaacgggcgactaactatgtgtgttcagagcgagccacggaaaaaaaaaaaaacattgtacatatactccatcatcttcgtgtgattaacccgcccattaaaggccctgggtactaatgataaatccctcatacctctcgtacacctcgagagcatcagatgccgggcctacttgtctgccagttaaactgacgatcatcacaaactcttgggaatccctttctagttgggtactagaataccgagggcgataactgaaacaataactccct

SEQ ID NO: 25822 - DNA, 435 bp, Zea mays
  Clone ID: cC-zmle189042h06a1
acaggctgaatcttagttctttatatcggccgaccttgtgataagagtgaattttttatttgtaatagaacccgtctgtggctttatgggaataatgaaaaggcctatgccgctagggaactattagtagtcatttatactttggttaaaacagctaaaaaagcaactgtcaaagtcatcatgtacactgctgtatgtgctagatagtgaaataacggtgtttgtgcttgtgatgtatacttttaatgtacattgtacttgcacatttttttctgtgtgcgattgatgagaattgcatcttagtcgatacctgaaagatagtctccatggacatagccattgtatagctcgctggtgtgctcaccggttaaaaatacccttccaaccggtgccctaagctggtcgtattgtaagcggttgactccaacttggcca

SEQ ID NO: 25823 - DNA, 387 bp, Zea mays
  Clone ID: cC-zmle189042h07a1
acttaatgtagaatcaatagagctaccaacgttatttatatttttacagtttgcgacagaggggggatctcatgggtagggaaccttgatacctcagaagagggcttgccccaataatcattgcgatttgatgtgtcatcaacaaaattagggacatttactacaagacatatttgttagggattttgatcccataatttgattctacgcatcttacactagatgggtataaccaacgactagtgaccggcttgctgattctctgaatcaatccacaagttgtgcccaaaatgtcgtgctctttaaaaaggaggaactctttatcatctgcaagcttaacttcagttccaccatactttggcaggataacagtgtcaccttccttat

SEQ ID NO: 25824 - DNA, 394 bp, Zea mays
  Clone ID: cC-zmle189042h10a1
cctttttatcttttttttcaatatctgcaacgcataatgcaaccgcttgaatttcgggacgcttgcgtgcaggataatttaacggtcgcattgacacccagcggatcaaccacggggatcacataacgattttaccgcaacatcaaaaagggaacctcactctggcctaaagttttcccagaagggaccccaaaaacaaaaacccggcaccattttggtgagcaacgcaacgtaaaggccgaacatgaaaaacatgacttgggacaggacatatttagttggcgacccaacgggcccagacgccccaaggatggtgctgtctttggatcttgccattcactaaattgttgctctggaaaggtgctatggcattaccggtttcaaatcactttgg

SEQ ID NO: 25825 - DNA, 445 bp, Zea mays
  Clone ID: cC-zmle189042h12d1
ggttgacccacgcgtccgcgggttcgtgaggttctccggggttcgggttcatgggtgagcggattgagatggcggcgtcggacgtcgactaccggtgctgggtccgcggcctcacctgggccacggacgaccactctctccacaacggccttcagcacctacggcgaggccctcgagttcaagatcattctccatcgggagacgcataggttcctccggtttctaggtattgtcaccttctctacggtggaggcgatgcggaacgccatcgagggcatgacctgcaaggagctggacggccgctacatcccgtaacgaggcccagtcccgcggcggctcgtggaggcgtcggcggcgggtacggtggtggccgtggaggcggcggccaccggcggtggcgggctcccgagatggccgcggccgctaccgctgtggcggctggcta

SEQ ID NO: 25826 - DNA, 481 bp, Zea mays
  Clone ID: cC-zmle189043a01a1
gaacacaattattccttgtcgattgaacaatagtttacatcatggtacaaaccgaaaaccagcgtgcgctcacatgcatccggacacctaaaggtcaccggcggcgcctccctcacttgccggggacgaagttggtggcgtaggcccaagcgttgttgttgacggggtcggcaatgtggtcagcgaggttctcgagcgggcccttcccggtgacgatggcctggacgaagaatccgaacatggagaacatggcgaggcggccgttcttgagctccttgaccttgagctcggcgaaggcctcggggtcgtcggcgaggccgagcgggtcgaagctgccgccggggtagagcgggtcgacgacctcgccgagcgggccgccggcgatgcggtagccctcgacggcgcccatgagcacgacctggcaggcccagatggcaaggatgctctgcgcgtggatgaggctcgggttcccgaggtagtc

SEQ ID NO: 25827 - DNA, 538 bp, Zea mays
  Clone ID: cC-zmle189043a01d1
ccccagccgtgcgcatcgatctgcaagtctcgctacgtagcagtgcaataaaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagcttctcgcccgcaacggcgtcaagttcggcgaggccgtgtggttcaaggcccgcttccagatctttagcgagggcggagctgactaccttgggaacccgagcctcatacacgcgcagagca

SEQ ID NO: 25828 - DNA, 420 bp, Zea mays
  Clone ID: cC-zmle189043a02a1
ggaagcagcagtcatatcagagatcaaaatgagaaggtttcttccccctctcgataatgtacacccatgggcatggcacgttctttacttcaaaccctcacacacagttttttccccggtaaaatcaaggacggcagcagcgcatgacttggcatcgctgccggcttggggcgcgtcctcacaggctgggcgtcctctcggcggcgccggaaatgacggtgagcaggttgttgcccaaggggtcgctgaggtgcttggcgaggttctcgacggggccttcgccggtgacctaggcctggatgaaaaaggcgaacatggagaacatggcgagccggccgttcttgatctccttcaccttgaggatggcggcctggtcggggtcgctggccaagcccagggggtcgaaggggccaccggggt

SEQ ID NO: 25829 - DNA, 486 bp, Zea mays
  Clone ID: cC-zmle189043a02d1
gcccaagccctctgcggtgtcgtcctcttctccggacatcagcgacgagctcgccaagtggtacggtcctgacaggaggatctacctgccggatgggctcttggaccgctcggaggtaccggagtacctcaccggagaggtccctggagactatggctacgacccttttggcctgggcaagaagccagaggacttcgccaagtaccaggcctacgagctgatccatgccagatgggccatgctcggtgccgctggcgctgtcatcccagaggcgtgcaacaagttcggcgctaactgcggccccgaggccgtctggttcaagaccggcgccctgctcctggacggcaacaccctcagctatttcggcaacagcatccccatcaacctggtggtcgccgcgacgcgtggggtcgacactcgtcggcggcgccgagtactaccggatcatcaacaggctggacctcgaggacaagcctgaccccggtg

SEQ ID NO: 25830 - DNA, 333 bp, Zea mays
  Clone ID: cC-zmle189043a03a1
ggggaagaaaaccggggccccctggggccactttttttttggggggcgagggctggtttttaatgtcccccaaccaggggatgctgggcccccgagcttggcccaggggatttcccttgaacaagcttttttacggggcaacaaaatttggtgttttttttagcccttcccccgggcctgggggttgcccacaaaaaaattgcccccccccgcttggcctgttcccggaaacaggtacgaacccccaactggaacccccccggcttaaaaaattttggtttcccgcccttttggcccaaaaaaaaacccgttcagctccggcccattttattg

SEQ ID NO: 25831 - DNA, 465 bp, Zea mays
  Clone ID: cC-zmle189043a03d1
aaccgcagtagcttgcgcaactgcgactgcgtagcacttggtacaagactgaaacctgaaggaccttcagtaatttaggcgcggcagacggtagccaataaaatgtgccggagctgaactggtttttattatgtacataatggcagtataacaaaattactgaaggcaggtgggttgcagttgtgtgttcgttactgtttactgtaacatgtcaagctgtcggctgcaatttctttgctggcaagccgcaggcactggtgaagtgctgataaatacatcatattctgttgacctgtgaagaagcttgttcaaggtagattccattgtactagctctgttgctcagcatctccttgtttgggaacattaacaaccagccctcgcccctcaataaaatagtcgcatcatgtagctacagttttcatctcaaaaaaaaaaaaaagaatactaaattttagataaaatt

SEQ ID NO: 25832 - DNA, 487 bp, Zea mays
  Clone ID: cC-zmle189043a04a1
ttttgctgttaggagctgcattgcggtcgacgcgcaaggcagtcccgggtgagggtgatggccaagaaagtgtacatgtgatgccgagctagagaacgagaagtgggatggaccgcgcacacgggagagcgtgcatgcgttttacttctgcgcggcaatgcgggcctgcaggcgcaggttcttctcgagcgggccgtggttgttgatgtactgcaggtagcagccgtccttgaggatgcggttgtcggccttggcctgctggtactcggagcgcatcatgttggtgaagccgtggcgcttcgagatgatgatcttctggcggccagcgaacttgtagcgcgagcggcgcagcgcctcgatgacgacagcgcggttcgagtcacgcgtgcgcaccgacaggaggacctggccgatgtcgacacgggcgaccgtgtcgtacggcttgccgtatgcgccacgcataccggtctgaagtctatcagcaccg

SEQ ID NO: 25833 - DNA, 555 bp, Zea mays
  Clone ID: cC-zmle189043a04d1
gtagtgcccgcttcgggtgcgtgctgtttcagtcattcgatgtattcttatgaacaagattctggtctgcgccggggctgatagactttagaccggtgtgcgtggcgcctacggcaagccgtacgacacggacgcccgtgttgacatcggccaggtcctcctgtcggtgcgcacgcgtgactcgaaccgcgctgtcgtcatcgaggcgctgcgccgctcgcgctacaagttcgctggccgccagaagatcatcatctcgaagcgccacgggttcaccaacatgatgcgctccgagtaccagcaggccaaggccgacaaccgcatcctcaaggacggctgctacctgcagtacatcaacaaccacggcccgctcgagaagaacctgcgcctgcaggcccgcattgtcgcgcagaagtaaaacgcatgcacgctcttccgtgtgcgcggtccatcccacttctcgttctctagctcggcatcacatgtacactttcttggccatcaccctcacccgggactgccttgcgcgtcgaccgcaatgcagctgctaacagc

SEQ ID NO: 25834 - DNA, 221 bp, Zea mays
  Clone ID: cC-zmle189043a06a1
attatttttgtttttttccaatactcaacacaccttagtgcataggtgaggaaagtatccattgatcgttaattaacaaacaatcaaaatagtatatttttgaatttgggatgcaggatattatgtaatataaaaaaaatcaccaccctatttttttggcacataactgctagcttaacctatttttatacaaaacaagtatattagtaaactatacctct

SEQ ID NO: 25835 - DNA, 503 bp, Zea mays
  Clone ID: cC-zmle189043a07a1
aaaattgccaacttcaatccttgaagcaaaactgttttggccccaatacacgcaaaatttgatccatccgggggtggttgtctaaataacgtcacgccacggggatacgttaataccaccttcattctaagttttcctacaacaccctacacgaatgctcacacacagccagcaaaaaactaaacggaaaaatgggaaggaaaaaaagttacacgctatgacaaccagcgcaaaagagatacgggggggctgattactcttcttcgttaccctcttccttggaaagctggatcatgtcgtcaatcctcagtatagtaatggcagcctccggggcaaactgaataatcttcactttgctcatagagggctctatcacgccatactcaaggttgttgcgaatgatacctttagagaggtcaagacccatacttgaataatgttgcttatcggcctttgtttgagcagtatgatgatttgccctaagctttgctacaagctcagtt

SEQ ID NO: 25836 - DNA, 122 bp, Zea mays
  Clone ID: cC-zmle189043a07d1
acccttcgcacaccagttagggaaaatcagccaccgaatgacctccccgtaaccgttttggccgagcgaaatgcgtctaatagcatacatttcactggaacctatgtttcattagggggttg

SEQ ID NO: 25837 - DNA, 148 bp, Zea mays
  Clone ID: cC-zmle189043a08d1
cgcatactcgtcaatgagatattgtgtgttttcgagccatcaagagtataatttttcttttaccggcgaagcgatgcttttcggggcctgagactactccctgtatgctttaacgggccgcacgaataataccggttatggatgtatt

SEQ ID NO: 25838 - DNA, 593 bp, Zea mays
  unsure at all n locations
  Clone ID: cC-zmle189043a09a1
ttttgtcataaggaggactgatgaggctctttggacgcttccgctcgctccacatacatacatacatgggccactccgtggcacagctcacaagtctttcgagtcaacccaaagactttttggcaatgcacgatgagagtaattaaggacaatgacgatatgcgttcctttcagcagttcatatctgaacccaccacgatttctgggacaatcgaagcatcgattcgactccggtggttggatgttggaacaaattggatggtgtattattgctccaaataaactgaaaacaagaagttaccccttctcgtgtatcaaactattctaagttcttcatatactcttttgaaagcttggagctcattattagttcctgctccttcaccagcgagtaccctgactcaatcaatgcttccagtgttggctttgggggtataaacgttggaagctcctcgcctttctttcgcttaagaagcttctcatttagctgttcatgcccaccgatttcttcgacccactccaagatagcctgatcatatgtcctggatctcaagctncatagaagtccagagcttggtttggaaatgcgtcta

SEQ ID NO: 25839 - DNA, 648 bp, Zea mays
  Clone ID: cC-zmle189043a09d1
tatgggtgtgagggccagtcggtctgtaaggcagtacacgactgaactgatatttagagcaatgtttgtggtgccagaaattatgggtgcatgcgaactagaggtctgaaaaagcaggggaacccgggaggctaatacgtgatagatacagaactgcctcccaagtaatccaaaaccaggaaacacgcatatgacggtcaataatcaaatagctgttggaactttgatgaatttggcagataatcctactagggtgagcatcggccagaaatggagagaatctgatgttacacacagggtgccaataatagttactggaaatgaggtttcaactctatatgcacccttaattcgtgatgggagaatggaaaaattctactggcagcccaaccgtgaagatataattagtattgttcatggcatgtatataaaggatggattatctgttgaagaagtatcaagaattgtagacgcattttcagaccaagctctggacttctatggagctttgagatccaggacatatgatcaggctatcttggagtgggtcaaagaaatcggtgggcatgaacagctaaatgagaagcttcttagccgaagaaggcgaggagcttccacggttattacccaaagccaacactggagcat

SEQ ID NO: 25840 - DNA, 466 bp, Zea mays
  Clone ID: cC-zmle189043a10a1
ttttatgattttcaaaatttcttttattcatgcacgcttattcccttgtatggatcacaggcaagagacaggaaaaaaaacaatctgtagttctgtacattatatgtatagctctctgtgaacctgtaaattaatgcgagtgtatgatctactaccatcttctaggcaaggtcaatctgacagctaccaactactgtacttccctgcgctgcctcgctccgtccaacggtcagccggtggtcgtcgccgggttcgggtaagggtcggtccagcatccgtcctccgccacggccttcttccacctcctgttgaacagctgcagctcggtgtaggaccgctgcctgaccgctaaccggtctgccgacgcggcagccgtcgccgtcgccttgccgccgtcgccgagcgtagggatgccccgggggagcacgtactggctgtcgacgaccccgacgttgcggctccggtc

SEQ ID NO: 25841 - DNA, 554 bp, Zea mays
  Clone ID: cC-zmle189043a10d1
cgacccatgcgaccgataacggatagttcgttgcatcagcaaaatagcgattgcgtttcattttctgagggcttgctccagggcgcatatgggcatcatcagcggcctgtacttcccagcggattcgagatccttccgagatgggtcccgtcgccaacgatgcgtggcataagcggttcttgagcgtctcgccgacggacacgctgggcttcttcttcgtgctgatattcgtcgccggggcaattgttacgcttgatcataaggagagcctgggcatatcgcaactgcagccaagaggagggatcgccgtagagcagatgatgcctccagcgaccagcgagctgcgcgctgagccatcagcagaggaagcccacattctgtgagaataaatgtaggcctgcaggcatcgaggcgttgccgaggggcatcgtgcatgacaagttcaacttcgagatggagtccctgggtggcaaccctgaacggaaggagaagaatggcaacggccggcactcgaaaagcctcctggcattcccgtcggcatcaacaaaaggcga

SEQ ID NO: 25842 - DNA, 213 bp, Zea mays
  Clone ID: cC-zmle189043a12a1
gggccactggggtccaccaacgaaggtgcgaccgggaaatggcggaccaccagctggccccaaaatgagtaatcctaaaacgggcggaaagaaggggcaaggctatcgcgggcgaaaaagtgttctggggtaaagagtcaccgcacaaaaacgcccggaagcaaaaagcggaaaacccggagggataaaagggggggcgcccaaacaaaaatg

SEQ ID NO: 25843 - DNA, 486 bp, Zea mays
  Clone ID: cC-zmle189043b01d1
ccccacgcgtgcgacgacctagtgcacaagccagcaggacgacaaggaagctgtttattgaataacaggtcaagtaagttgctgcccccgattatatatctttacgctccctccctcgagaccaagctagcgacagagcacgcacggagcggctgtggcagtttgacagtgcaacgcgcagaggcagctgctacattattacatccatgggtcatccaaacaagatcccccacggcgacgaccagaagaagaaggagcacgagaagcatgtggtgcgaagcaagaccgacaggacgcgcgagaagaacccaatcacggagccggagcccaagccgtggaacgaattcgcagtcgcgaaacccatcccgagaatgagccgccgaggcatgagggagtgatcttcgtaaccctcattcgtctgggtctacgggatcaatgcgtgcattgttcgatcgatctatatagatcatatatacgccacggtcg

SEQ ID NO: 25844 - DNA, 386 bp, Zea mays
  Clone ID: cC-zmle189043b02a1
cggtacttggatgaaaatcaaagttgagttggtattactactttacataggcacgagcacaagtgcatgatatgtacaaccgtcgatgggtccacagtccccaaatgatacgagctcgctcacagggacatggggcagcaaacctcggggggctttgctatttgatctttaccatcaagcactgggtccccgagccatcgggctccacctcgccgagttgtagctgctgcaagcgctgatgctcgactccctcattttcatctcagatataccactgttgcagatgtttgcaaacgctctcatgtacttcatgccgtactgagtaagtgaaccacactgggactcgaaaatccgcaccatcctcttcaaacagtcccagtcatcga

SEQ ID NO: 25845 - DNA, 569 bp, Zea mays
  unsure at all n locations
  Clone ID: cC-zmle189043b02d1
gccaacattgcaaacatgctgctttggccaggcccaaagggtgcattcaatcaaagagatgctgatcttctcttcatgtggaagaggtacgagcagttaaatggggggaccgaagagaagctgagggctctcatagagattaaagaaactgttcagcacaggaagcatcttgacagcagtatcgatttcgttgggaggctcgtcttcggatttgagaaagggccttcgatgcttgaggctgttagaacctctggtcaaccattagtcgatgactgggactgtttgaagaggatggtgcggattttcgagtcccagtgtggttcacttactcagtacggcatgaagtacatgagagcgtttgcaaacatctgcaacagtggtatatctgagatgaaaatgagggagtcgagcatcagcgcttgcagcagctacaactcggcgaggtggagcccgatggctcggngacacagtgcttgatggtaaagatcaaatagcanagccccccgaggtctgctgccccatgtccctgtgagcgagctcgtatcatctggggactgtggacccatcga

SEQ ID NO: 25846 - DNA, 495 bp, Zea mays
  Clone ID: cC-zmle189043b04a1
tttttttttttttttttttttttttttttttttttttttttgtttttttttttttttttttttttttttttttttttttttgggaaaaaaaacaacccgggtcccaaaaggggcttgacttaaggggaaccgttccaatcaaaacaccgaatttaacctttcccaacaacaagttttttaagggggggttcaaactttaaaccggccggggggggggttttaaagggggagggggcctttaaagggcccttaggaactcctcacccccggaaaaagggaaccgccccccttcctttttgtttgcaacggggaccgggggggctctggccaaaaaaagaaacctttttgggggcccccccccccctttgtccgggaaaacgaactcgggggcaccccccttggggttcccggaccccggggtacaccccggaaatccgggccggtacctcggggggaccccactttccctaaaggggggtcgtttaaagcgtgggg

SEQ ID NO: 25847 - DNA, 434 bp, Zea mays
  Clone ID: cC-zmle189043b04d1
acgcgtacgcgtcaccaaggcgctcgacctcgagctcgatctcacggacaaagggctgggcgtgcgctcgaagaggttcgctctcctggccgacgacctcacggtcaccgtcgcaaacatcgaggaaggcgggcagttcacgatctccggcgctgaggagatcctgaaggcgctttagaagctccgtctcctctagaagccgcagcaacgatcggtctatagtgtgaactcgcctttgaataacttgtcgttgggcaaggtctagttcggtgttgtgtatggaacggtcgtcactgagtcatgcacgatttggtatccgtgtcgtttatgttcacaacaaatattttataaggcaatgccactgtatatcaatgtccaatatcaatattttatctgctgtagctaattttcttcatatccaaaaatgcaggggg

SEQ ID NO: 25848 - DNA, 511 bp, Zea mays
  Clone ID: cC-zmle189043b06a1
accggcctgatttgggaaaggaatcctcttcttccctcgtatttttccatctcctattgtaccataaaagtgttacactgttgcttatgtctccgctttctgcgggacagcagtccactcgaactgccatttgaacgcattctccagttctgtgataaaactgaatattttgctagcatctacacatgctgatattattagcgtgtctggctgcaaccctcgcctggggagcgacgctaggcagccgcatccgaccccagatcgaactgtctggcgttgatgcctggcctaggcgtgcttaccagggtgggatgggaaccgaacacagacaaggcagggaattcttgctctaagccttacttaacttgccattactttctttccatcacaaacatcacacaaaatggaaccaattccttcacagtatgggcacttcgtatcttcaccgacccactccaagaactgcggttcaatgttcggctcacctgttccatcacattctaagcacatg

SEQ ID NO: 25849 - DNA, 623 bp, Zea mays
  unsure at all n locations
  Clone ID: cC-zmle189043b06d1
ggtcgtcccacgcgtccgcaagacgtgaaaaccaaagatggcacaaacggagcagcggttcctgctgtttcagggatcgcggaggtacgcaaaactacggttgcagaaaacggtgtctcgggagttggggtctccnancacanattgtttcttctgggngaaaacannnnnnaaaacccaaccagagggggncgtaggggagggagggggggcaccggcgcaggtgcatctactaatacttgcatgtcgggtcgaggcnaaagccgcctcatgtgcttanaatttgatggaacaagttancctaacattgaaccgcagttcttggaattnntctntnaaaataccaagtgcccatactgtgaaggaattggttccattttgtgtgatgtttgtgatggaaagaaagtaatggcaagttaagtaaggcttagagcaagaattccctgccttgtctgtgttcggttcccatcccaccctggtaagcacgcctaggccaggcatcaacgccagacagttcgatctggggtcggatgcggcttgctagcgtcgctcccaggcgagggttgcagccagacacgcttataatatcagcatgtgtagatgctatcaaaaattcagtttta

SEQ ID NO: 25850 - DNA, 382 bp, Zea mays
  Clone ID: cC-zmle189043b07a1
aaaacaaaaccccggacaaaaatatgataaagggggatccggcccccccaactgggctgttcttgaggacttacctgaaataaaaactccctcccggaaaggggcgtgccctcccaacaaatgtaatttaacctctggaagacatattgatgggggggcctatatatgcgtatatattaacgaacttgaggttatgcataccttgaatatcttgccttcaccgaaattaactacagcctttccaacaaaactgggcaaaaaaacaccttcccttcctttacaaaaaggggggtctcccgaacttaaaaaaaaaacattgccacccgggtgatcatccccatcttttttggggtgcggctttttccaaagtaactgaacaaca

SEQ ID NO: 25851 - DNA, 635 bp, Zea mays
  Clone ID: cC-zmle189043b07d1
cccacgcgtccgggatgattaggtatccgtatccgtggattatatacttctcgcgggcgatttgcgatgcgacccatacaagaaagaaatcagttaaactgcgatatgatgcgctctagctagttaatcatatatacatatatacacgtccgatccattcgtgtggatgacatccatgttgcatatgtacaagtacatgtctcttcttcaagagtcaagactagctgtaattgagctgagcatacttggtgttgctgttgttcagttaatttgcaaaaacgcacaacacaagaaagaaggagaaaaaaaacagagtggaaatgttttttttttaagatctggagaacaacatgattgagaagggagggaaggtgattctgagcacagttttgttggaaaggctgtagttaattctggtggatgtaatatattatatgtatgtatatgcttagattcgttaatatatatgcatatatatgcacccacatgaatatgatttacagagaatattttaatttgttgtgagtgcatgcccttttcctggatgctatttttatttcttgttagttcttcagatctgctcagttggtgtggccggatcgcccttaataaaattgttgcccgcgttctggact

SEQ ID NO: 25852 - DNA, 362 bp, Zea mays
  Clone ID: cC-zmle189043b08a1
gggggttggggatctgcttggttcctttctcgcttcgggacactgtcgcctctcggtcctcatggagggcgaaaagggggccccgccggggaaaaagcgcccccgaacagggcccgcccgccgggccaaaggggggccgggcgggcccaggcgggcgggccagccacccccgagccgggggcaaagacccccgccgggtggttcacgggccccgagcacgaaagcgtccacaccgcccgcacagggggcgaccagcccgccgcccgagcgaccaggggtggccccgcccgggaacgcccccatgggggggggcaaaggggacccggggggggacaaagacgccgggggggccatggagcccc

SEQ ID NO: 25853 - DNA, 428 bp, Zea mays
  Clone ID: cC-zmle189043b08d1
caattccaggtgttactcatctgcttcattatctgcacttttagctatggcctgacaggtgtcattggatacttgatgtttgggaaatcattaagctcccaggtgactctgaaccttccagctaaccattttgcctccaacattgcgatctacacgacgttgatcaatccgtttaccaagttcgcgctgctgatcactccaatagcagaggctatcgaagataaacttcatgtggacaagaataagaccgtcagtatcttaatccggactgcgctggttgtcagcacaaccattgtggcccttgccgtgcccttctttgcctatgttgtcgctcttactggttcgtttctcagcagcacggtcacaattttgctttttaataataaaaaagggggatttttatattggcattattaatttttactttt

SEQ ID NO: 25854 - DNA, 139 bp, Zea mays
  Clone ID: cC-zmle189043b09d1
gcgcaaaatatacggggtccgaggtgtcgatggataatataactttgtctcgacttgactttgctagacttattgtggttttggtccctttcttgtttacatcgtcgcctgtgagtaaacaggtatattcggggacttt

SEQ ID NO: 25855 - DNA, 445 bp, Zea mays
  Clone ID: cC-zmle189043b10a1
ttttattctattacaacgtatatccccgcacatgtaaatttagctactacaaggtaagcatttttgcttcacttagaccgactgtagaggcttaattgggagggcaaaacggcactgttaacacctcaaacagtgattgcctgcccagagaaatgtatactgtctactacaactccgattatatacaacccactgactggctggctgactgactgactgatagagaaacccagagtgctgctctacatgctaatagaaggagctaagcttgatcagcaacccgaaaggactcggcgcctccgcaggcatcaggcatcagccgatcttctccgtgctgctgtcgtcggttggccagatgaccgtctccatcagccgctcccgcatcagcgccaggttctcgtcggagatcttctcgtacgtcttggcatggtcgcatttctttatc

SEQ ID NO: 25856 - DNA, 583 bp, Zea mays
  Clone ID: cC-zmle189043b10d1
cacgcgtccacgccactgctaagctgctccccgttcgccaggtcggcgaccaggcgaaacgtgctgctgcaagaagaagaataggtacacagacagcatgtccggagttcaggcgatgccggcggccgtgggcgtggcggggctgagagggtcagggttggttagcagcagcagtaccggcttgttcgccggcgactgcaagaggaaggctcgtcgcccggcgtgctcggcctgggccctcaggcagagccggatcggcagcaggagcaggagcaagaggggcctcggcatcgtctgcaacctcgcgggacagtacgaggattccttcgacgacgtccagcggcaactgatgaactacttcacctacaaggccgtgaggaccgtgctgacccagctctacgagctgaacccgccgagctaccgctggttctacaacttcgtcgctgtcaacaagcctaccgacggcaagcatttcctccgtgctcttcggcaggagaggcaggagctcgcagagcgagtgatggtcaccaggcttcacctgtacgggaaatggataaagaatgcgaccattgccagacgtacg

SEQ ID NO: 25857 - DNA, 500 bp, Zea mays
  unsure at all n locations
  Clone ID: cC-zmle189043b11a1
aagcatcataaaattctttttataaaagggaatcaaggaatggtgatcaattttccaaggaagggaatgcatcaattgtttagcacacaatcctatcacctaatacatcatataaggggataaagattttaaaacaacaaggaaaagggataatgcaccggggcttgcctaggataacactaggttagggtttgttagatgacgtccacttggtgatcagccttttgtcttggcacttgttcagcctgtccatctttaggttgatccaccagcatcaccttgtgaagaagcccacccgttacatcatcttggggtcgactcggttcttgtcctccacactacgtgattaattaacgtaccacatcacatatcgatttggtattaacaagaacgacgacgaccaccgattcacccaaatcacacaacacctgatggatgatgcgctggaactttcctttccccataatcctaggattcttctnctcatcacgcacaaatct

SEQ ID NO: 25858 - DNA, 443 bp, Zea mays
  Clone ID: cC-zmle189043b12a1
aaacaataatgggctttcatccaagagccagggtgctacacgagcttcagtacatttatacatagacacacaactgctacatttactagtgatgatgatgatgatcaacagccagcagtgaaccactgatgctggctggggtgtgtgcttgcaaaacacagggcgagatcaactgaaaaggaaggaattagttatacgctggggctctgctctcatttgggccatatatatatacacacacaacatgcgagccgtccattccaatccaaggattacgtacaagaaagtaagagcagcgcaaaacgatcctcaccctttcttgggcctggagaaaaacccgccgaggctgagcccgccgttgccgccctcttcagcggctttcttgggcgccggggcggcggcggccttgcccttgctccccaccttgttcaggacggggtccg

SEQ ID NO: 25859 - DNA, 362 bp, Zea mays
  Clone ID: cC-zmle189043b12d1
aaacaacggtgaccattgaattttggcacccgctgattcacataagacttttgggcaccaggtacaaaagagtgacagggctaccacacgacccccagagatgaaaagatcaaggagcggccctttaacaacacaaggcctaaagaaattgctttgcggaagtgagagctaagaaacggagctgcctccaagggagagacgccattgttcactcctgcggccacttccctgaggtgaacggatcagccggagccgtcgaagatgttgttgatagggatgaagaggagcttgactaagtagccggcgaatcccatgacgtcgaagccgatcgcaggccgcgcgaggagctaggggaactccct

SEQ ID NO: 25860 - DNA, 340 bp, Zea mays
  Clone ID: cC-zmle189043c01a1
cccccccccaatttttttggggggaaatacccaaaaccttcccccttggggggggggaaaaaaaacccccgggttaacaatttaatttaaaggggggccctttttttgggggaaaaaaaaaggggattttttaggggagggggggggggggccttttaaaaaaggggccccgggggcccccttttttttttttttttttttaaaaaacctggggggaaagcccaaaaaaggggggaaaaaacaaaaggggccaaaaaaaaagaaaaaaacccttgttaaaaacacccccttggggggcggtggaaaaaaataaaaccctttttttccccccctaaaaggg

SEQ ID NO: 25861 - DNA, 624 bp, Zea mays
  Clone ID: cC-zmle189043c01d1
cccggaattcttggggcgacccacccgtccgctttcttgctcgccacagcttcgtcaaagacacgcggaaaagaataggaagggggaggcgactcgaccgaggcccggtttcgatctctggtcctccgattgcgtccagatctaccagcaatggcatcatcttcggacccatggatgaaggaatacaatgaagcatccagacttgctgatgacatcagttccatgattgccgacagagggtctcttccacaatcaggcccagaaattatgcggcatacttcagccattcggagaaaaataactattcttggtactagactggatagcttggagtcattgtttggcagaattcctccaaagtcaatcactgacaaggagatgcataaacgccaagacatgctttccagtttgaagtctaaagccaagcagatggcgacaagtttcaacatgtcaaacttcgctaacagggaggatctgcttggtcaaagtaaaatgccagatgacatgagcagagttgctgggttagataaccaaggaattgttggccttcagaggcaaattatgaaagagcaagatgagggtctcgagaagctggaagagacagtgctgagcacgaagcatatt

SEQ ID NO: 25862 - DNA, 488 bp, Zea mays
  Clone ID: cC-zmle189043c03a1
aggcgctagagatgcatgtatgtatgtacgtacgtaacttttacggagtcccttagttgctatacatattgcactgaatgtcacacttacgacgacaccaagggaaacgaaaacggaatgtctggatcaggtaacagcaacaaattaagccaggaaaagtcgatttacaccctcacttaggatgaagccgagctcgacttcgcctgctcggcgtacaacgctttgatctcctccacgtcgtcgtagcttccgaggaatatcggggacctgtcgtggatcttggttgggaccagatcaagagcccgttctttgcctgtgaaggactggcctcctgcctgctccattaggaacgacatggggaaaacttcgtacaggatacggagctttccgtttgggttcttctcgtcagcagggtacaaaaacacaccgccgtatagcaaggtacggtgcacgtcagcaaccatactttcaatgtatctcaaagatct

SEQ ID NO: 25863 - DNA, 646 bp, Zea mays
  Clone ID: cC-zmle189043c03d1
aacctggcaatgaacatgctcgccgtcggatactgcatgtacggcagttcctgcacgctcggtctgagcactggaactggtgtcaatggcttcacgctcgacccttcacttggggagttcatactaacccatccagacatcaagatacctaagaaggggaagatctattcagtcaacgaagggaacgccaagaactgggacgcgcctgttgccaagtttgtggagaagtgcaagtaccccaaagatggctcgccaccaagatctttgagatacattggaagtatggttgctgacgtgcaccgtaccttgctatacggcggtgtgtttttgtaccctgctgacgagaagaacccaaacggaaagctccgtatcctgtacgaagttgtccccatgtcgttcctaatggagcaggcaggaggccagtccttcacaggcaaagaacgggctcttgatctggtcccaaccaagatccacgacaggtccccgatattcctcggaagctacgacgacgtggaggagatcatagcgatgtacgccgagcaggcgaagtcgagctcggcttcttcctaagtgagggtgtaaatcgacttttcctggcttaatttgttgctgttacctgatacagacattccgtttcgtttccctt

SEQ ID NO: 25864 - DNA, 158 bp, Zea mays
  Clone ID: cC-zmle189043c04a1
ggatatcaacaattaaccagcaggaaacaaaaaccaccactattgcacaaacatggttcattttagtgtacaacgccaactcatcatctcgacttgcctatgcaatgcaacgtgaaacaaaagacacacatgcatttcgcagcatcaatcaatccacg

SEQ ID NO: 25865 - DNA, 200 bp, Zea mays
  Clone ID: cC-zmle189043c04d1
cgtgcgcgtggattgattgatgctgttagatgcatgtgtgtgtgtggtttttgttgcattgcatacgcatggagagatgatgagttggcgttgtcactaatattaaccatgttggtgcaatagtgggggtttttgtttcctgctggttaattgttggtatccatactagcgtgcgggtaaaattaatgtatttacttgag

SEQ ID NO: 25866 - DNA, 325 bp, Zea mays
  Clone ID: cC-zmle189043c05a1
attagtctaggataatttattattattttcttttttactttatacatatattttaataatttatattttaggggcaaaccgggcaggggtaaaaaacccccgaaaaacactatagacggggggacagaaaaaaaccccccccgaaacttgggaaaaaaaaaaaagacccggggggccccccaggaaaatcagaccgggccccggagggagaccaaatttccccaaagagagacccaaaaaaacgcggggaaaccaagggcaaaacgcgccccgggggaaaaaaagaaatccgtccaaaattccacaaaaaaaaaaacccggaaaa

SEQ ID NO: 25867 - DNA, 291 bp, Zea mays
  Clone ID: cC-zmle189043c05d1
tgtagtgtcgcagagctgaattggcagtgatgaatcattctacctgtatatattatacttgcagggtatataagactggctcaaagctgctgaaaaaaaaaaataagtaaataataaataaaataaaaaaggggtctaaataaatctcgaaaccggtggggggggggggggaggctcatctataaaaggaaaaaaaaaaaaaaaaaccccccccattaaaaaattcaaaaattatttcccaaccgttcctaacaaatatatattattattttcaacctaaaaaaaattcac

SEQ ID NO: 25868 - DNA, 505 bp, Zea mays
  Clone ID: cC-zmle189043c06a1
gtccttttttttttgttttttttttttttttatctgttttttaacacggaaactttggagttgatagtccaaaacctaatatagtttcatgttgcatctataatcacgtgtagattatgagcggactattttacgaaaatgattgcgctacgggggaaaaaatgtttgacctatgtacagatactgacattctcaattgaaagacttggaaagacttatgccgcgagcagtttctggatgtccttctaaatctggacgggctaagtcgttggaggatatgtctaatgactatgacattcttattcgctaacaacttctcaaaagtccattttacgagatcacccaaaaatcctcctggaatggacttaacaaattcttagaggggaccatgtttaggtacattgacatcaaccttagctagaaggggaaatggcaatttgagtcttgtgcatgcaaactgcttaatctgactatttgatccaagttcttgcgcaccaaattgatt

SEQ ID NO: 25869 - DNA, 607 bp, Zea mays
  unsure at all n locations
  Clone ID: cC-zmle189043c06d1
cacgcgtaacggtcgaactctcgctcgccgctcgcgaaccgtcctcgacggcttcccacttcggctcgtccgctcttgtacgggtcatctcacttatttgggtgcgcttcaccgcagtcactccgatcggtgctgggcttgggtgcctccgtctacggcacccacataccgcnccccaancnnngcacccttacttggggtgagcgccaccggagctaccgatgagggncgtcggacnactacaccnnttaangacattnatnnaaaaaatcttcctcttaaaaagttcaagaataangtgttgctgattgttaacgttgcttctcaatgtgggttgacaacagcaaattacactgaactatctcatatctatgagaagtacaagactcaagggtttgagatccttgcatttccttgcaatcaatttggtgcacaagaacctggatcaaatactcagattaagcagtttgcatgtacaagattcaaagctgagatttcgatttttgacaaggttgatgtcaatggacctaatacagctcccatctataaatttcttgaagtccaatgcaggaagatttttgggtgatctcgtgaaatgggattttga

SEQ ID NO: 25870 - DNA, 514 bp, Zea mays
  Clone ID: cC-zmle189043c07a1
tttttggtttactttatcttttccttttattaccggaaagaattgaatttacacggtccatgcaactttacaatgactcttggagataacgtcactatgagctttggtacaggacatatgttgccttcaggtagtctatgatttctgcgctttcgaacatctggactcccgtgttaggatcttcgatgtaaggcgcctggaaaactcccttttttttgaaaacttcttgtcgtttgaggctgccacgtgcgcagctgtgtagcagatgtggcaattacaactcaacaagcgtttattgtactaatctacagaagggagatccctcgaatgcccatatctctataggctgcggtgggattcttgaagcagcataggaatttgcctttccaatacgaccaagagtagcaagccctgctgtaattgctgtcaacagaccaagcgatagcataattggaacacttccatcaccatatgtgtcagctaggtatttaatgatgttatctgactcatacat

SEQ ID NO: 25871 - DNA, 437 bp, Zea mays
  Clone ID: cC-zmle189043c07d1
cgcgtacgcccacgcgtccgaattctttccggtaataaaaggaaaattttaagttaaccaatatgcgcttgaattcggagcttggaaggtgaaggaggaatcaaaaataggacagtgcaaacgaccggaaaagacgatcgagatatatgaatttgaaggttgtccattttgtcgaaaggttatagagatggtatcagtcttggacctagatgtactattttacccctgtcctcaaaaaggcccaacattccgacctaaattccttgaaatgggtggtaagaaacagattccttacatggtggatccaaacactggggtcgccatgtatgaatgacatgacatcataaaatacctagctgacacatatggtgatggaagcgttccaattatgctatccgttggtcagatgacagcactttcagcagggcgttgctact

SEQ ID NO: 25872 - DNA, 486 bp, Zea mays
  Clone ID: cC-zmle189043c08a1
tttttaaaaccaagagtttatagtcgattgatgatgaatgttgttccctgggagtggggaggagtacatgcacggacgaagtattctattcacacaaacggaaagaagatcagatcagaaagagtcgttgttggcgtcatcattgcaggaagtagccggagatgaagaagaggaagccgatgaggaggctaccgtagatgagcaggcccttctggccggaggtgagggagttgccgcccagcccgaactgctggttctgcgcgaacccggcgatctccacgctcttgctctcgaagaaggactgcgcggcgccgcaggtggggcaccgccagtcatcgggcagctgcgcgaaggggaggcccggcggcactgggtacgacgggtcccccgccgcctggtcgtagcggtacccgcaggactggcactcgtggactccccgtgttcagcaccgcgaacttctcttgaaccgcctcgggttcagctttg

SEQ ID NO: 25873 - DNA, 570 bp, Zea mays
  unsure at all n locations
  Clone ID: cC-zmle189043c09a1
cggaccaatgtcatattccattcattcctggaactggaccaatgtcatattgtatttgcttacgccttaccataccatctgcagtgctagttttgtcttgtccatacatacaaacaaccagatacagtcaactacacccggtggtctacacaacacagtaggacaaggatcctaaaaccaccatctcccttgtgcatgctggtggcatgatcaggcgatatattatacagcaaggaggcgatggttatcattggcagcagcgccgcagccagactgttgccctctaccgtttgtagttacaaaatggtgcatcccttctgcaccttcttcttcctcttcttttgctttggtggctggagaaccaccttaattgctgcgtcaaacactgcttttatgttcacagaagcgcctttctcctagcaccgctttgagcgcaaatcccggcacgggcaaccaagagggccgcccaacgattcgccccagacgttcgcatagctcagacaaacgcacaggattaggtgcagtntcattgattacacctttgtatgtaggggttcgttagagattcat

SEQ ID NO: 25874 - DNA, 488 bp, Zea mays
  unsure at all n locations
  Clone ID: cC-zmle189043c09d1
tcggcggtgccacctacactgccaaagcgagtgtttcaacgggtggctaggcttttcgtttacacttagctctttcagacgcagatgctcggttagaacagtgcccgtcctacacacgactaaccaatccagacggggccacatcctcagcgtgtatcttagctattccaacatctagatcgaattntttctcagccctcttttatacccatgccctcatttgccctcaaagctacgctaggataatgcgcttctgcgaacataaaggcagagattcacgcagcaggaaaagtggctctccatccaccaaaccaaaataacactaatacacaatttctcactggatccaccattttcacactaccaacggtatacggcaacagtctggctgcggtgctgctgccaatgataaccatcgcctccttgctgaataagaaatagcctgatcatgccaccaccatgcacaatggagatggagggtttaggat

SEQ ID NO: 25875 - DNA, 434 bp, Zea mays
  Clone ID: cC-zmle189043c10a1
ttttggacaaaataaccagtgtttatttggttggattctcgttttggttttcataataaagttcgattacaagcattgacaagagagggacaatgcatactagcatgcatatacagcaagtctctcttctgagttattggcgcccacgccagttctgaatcatgatcgcacggacaacagcagcagggaggaacagaggtttgttatttgccaacagattacacacatgattggcattccacacgcaaccgatcgatatgacgattatactcctatttattagcaccagctatatatatatagccatgtctggagtctggactagcaagcaaccgagatcgatgatacagagatagattcatcggtttgcatgagcatgacttgttggcagccactatgttacaccaccatccaccaacgcatgtacaaagttc

SEQ ID NO: 25876 - DNA, 494 bp, Zea mays
  Clone ID: cC-zmle189043c11a1
ttttgcgatatatgcgttcattacaacataacactgttcattacaacataacactctgaacatatgcaagccatcagttttcaccgtttcaccatcctaatgtggtcttttattgacccgagtgtactggactaaggtgcatcaaggtggggcagaaccgcagaactacattcactgcctcaactgaagctagggcagataggtcccttggacaaaccaaggcgaacctccattccgtggtgcatgtcaggttgacggaaaccttcagaaccttgaggcatgttaagataatcttcaaaaccaaaatcatctagggaacctgtcagtgcctcatatccaagcagagatgatggcaaagcaccagggggcctttggaaccttgagaggatttgggcatcgagatccttgcggatgttcaaggcggatccgtagatggcctctgtcccaacttctttttgtccgccagaacttggcctccgattggatgctggact

SEQ ID NO: 25877 - DNA, 248 bp, Zea mays
  unsure at all n locations
  Clone ID: cC-zmle189043c11d1
atataacacagcagnagcagacggctggctgcttgaattgatcatatcccgtatgcaaaggctactagagatacacatatgtgtttaggcgccgatgcatgtatgcatggcatggcatgggatgctcatgaactaccgatgtacttgtcnatgaaggaggggagcgtggacttcgggacggggccgatgacgctctccttcttctcgccgcccttgaagatgagcacgggggggatgctgcggatgcc

SEQ ID NO: 25878 - DNA, 275 bp, Zea mays
  Clone ID: cC-zmle189043c12a1
gtatttgcaagataaaattttctatatgccatatcaaggaagggcattacatataaacgacttatgcatgacacaaaacaccacagcccgggatttttaaatccaagtccacaaattcgaaatggtaaagaaagatgttcaatagatgaacacaatcatagtctgcggcttactcatgaagcatgccgactggaaacccaaacatgggccaccttacgctggaaatatctgtcttgggcacgaacccaaataatgggccctggtcaggcttgccc

SEQ ID NO: 25879 - DNA, 339 bp, Zea mays
  unsure at all n locations
  Clone ID: cC-zmle189043c12d1
ttttgcgttcggaaatagaggctattttaggagagacatgcctttacatgatacttagcccatccaaaaaaaaacgctttgcctcgcagcgttagcccgggcttacttgtgggaacgataacaatacttggttggcttgttgacagccgacggcatcacatggaattattagagcggctcagtgaccttggatgttcaaatcccaagaatcacatagccagatattcaattacctaaacaagctcaatgtacgccataagggcatcatctccccgcctcgcgaacggngggatgatccttgagcagccgccttctgggggtccatacctgtctgcaacc

SEQ ID NO: 25880 - DNA, 114 bp, Zea mays
  Clone ID: cC-zmle189043d01a1
gtcattatcaaccaagatatttgaaataatgaactttaggacttggtatgacgttttatgttaagcgttgtcaggttttgctattcgtgttatgctgaattgttggaactccta

SEQ ID NO: 25881 - DNA, 614 bp, Zea mays
  unsure at all n locations
  Clone ID: cC-zmle189043d01d1
cgaagctttcatttttgtgcttatcctagttgttggtttagtttatgcatggcgaaaaggagccttggaatggtcttaactgaatattcagaaaaaaaaaaaaaagaaggaaaagattccattgagacaattatgagtttgattgagtttccgttactcgaccaaacaagttccaattccgttatttcaactacactaaacgatctttcaaattggtcaagactctcaagtttatggccccttctatatggtaccagttgttgtttcattgaatttgcttcattaataggctcacgattcgactttgatcgttatggattggtaccaagatcaagtcctagacaagcggacctaattttaacagctggtacggtaacaatgaaaatggctccatctttagtgcgattatatgagcaaatgcctgaaccgaaatacgtcattgctatgggagcctgtactattacagggggcatgttcagtacagattcttatagtactgttcgaggagttgataagttaattcctgtggacgtctacctgccgggttgcccgcctaaaccagaggctgttatagatgccctaacanaacttcgtaagaagatagcgcgagaaat

SEQ ID NO: 25882 - DNA, 534 bp, Zea mays
  Clone ID: cC-zmle189043d03a1
cataaagctaagttctattatgcaaaacattattacaacacagaaacatgcagattcttttgcgctgcattgggagcagtgcaaccagtgagttacgaataaattcagctagtactagcagcaagcatgtgctactgattccaatacacatgaatcaattagcacccaactgaaataaagtacatccaaagttattgagttcaatgttattagatgcatgtgcataaggctcagactcgtcgttcttcacagcctgctagtagtgtcagtactggaggttctcaagggagctctattgatccagtcagtcagtcaggagatgttgatgctcctttgtcgcaacgctacctattcactgctaggtgctgctagttatgtgactccatctttgactctgccatgttctgatgttgttctcagtcttctactaagggaccaccttacacatccacttcaactcttcaaatattcatgcatagattcttgattctgatacttcctttcatatccctcactgcactgattttcttccat

SEQ ID NO: 25883 - DNA, 530 bp, Zea mays
  unsure at all n locations
  Clone ID: cC-zmle189043d03d1
ttcgaatcgagccaacctgactcatctcatcacccgtccaaggacggggtcgtncttcccgggcctcccgagacccatgcaacccatccgggcttgaattgctttcgaatcgaatctcctgtgctgcacagttaggtttggaacataggaaacattaagaatatgaaaagagttggacgaaagagcgccctgcctatcaacagagaggatccatcatgtgtacgaccagtaagggaacaagaatgacacatggaagaaaatcagtgcagtgagggatatgaaaggaagtatcagaatcaagaatctatgcatgaatatttgaagagttgaagtggatgtgtaaggtggtcccttagtagaagactgagaacaacatcagaacatggcagagtcaaagatggagtcacataactagcagcacctagcagtgaataggtagcgttgcgacaaaggagcatcaacatctgctgactgactgactggatcaatagagctcccttgagaacctccagtactgacactactagcag

SEQ ID NO: 25884 - DNA, 423 bp, Zea mays
  Clone ID: cC-zmle189043d04a1
aggatcataaataaattatgaaatcttttctaataacagtataacacacattttatatataagttatcgtgatattatatgttcccgttgcaacgcacgcactatttattacgttataagcatagagcaattctctgcttagccatgcacgggaaattagatacggctgcaaatgcgctcgtcagctggaggagccctgcagcctggacacaaacgtggacgcggccaccgcggcggcgcctccgaccacgcagacgagcgcggcgacggcctgcagcgccacctgccacgcctgctcttcggggacgaggtacacgacggcggggcccgcggccagcagcgggagcgcgagcgcaagcagcgcgccgggcgtgccggggtccgtggccgtcgacagcgcgcccagctcctccagcttggaca

SEQ ID NO: 25885 - DNA, 570 bp, Zea mays
  Clone ID: cC-zmle189043d04d1
agaggcagagcgagcgagcgagagagcgctggtcatggcgtcactgtctgtcgccgccgtggcggccaccatagcgatgccaagcagcagcggtgggagagggcgccgtctcagggtcgcgtccatggccacccagaagggccagaagccgacgcccaagaccgtctccggcacgagaagatcgggcacgacgacggtgttcccggtgggcgagccgggcccgcggccggcgacgacgagcggcaaagcgccggttaagctgctgacgaacgtggagaagctgcggctgctgaccaaggcggagcgcgcgggcctgctgtcggcggcggagcgcgcggggctgtcgctgtcggcgatggagcggctgggcctactgtccaagctggaggagctgggcgcgctgtcggcggccacggaccccggcacgcccggcgcgctgcttgcgctcgcgctcccgctgctggccgcgggccccgccgtcgtgtacctcgtccccgaagagcaagcgtggcaggtggcgctgcatgccgtcgccgcgctcgtctgcgtggtccgaggcgccgccgcggt

SEQ ID NO: 25886 - DNA, 383 bp, Zea mays
  Clone ID: cC-zmle189043d05a1
aaaaagaatcgatttttttttaacgtcaccatgggggaaaagaaaaaagaaatacacgtgtttttttttctagtttccacacccccttttatacagcaggaagcatccaatcctcaactttggaacaagacgatccaaatctaccatccagaaaccttcatattcgagggatttttagggggtatgtttctggactcgaatggcttcaaggactggatatcaaaatgaattcccgcttgggggaaccccgccaagcagataccaaatccttagacttcccagattgggccacatcaagcgggcgtcttatcagagaatggggcacccgcatctgttctgcttgacggaattcgcaagctgcttcttgtttttgtcagcttgtg

SEQ ID NO: 25887 - DNA, 290 bp, Zea mays
  unsure at all n locations
  Clone ID: cC-zmle189043d05d1
cccacgcatccgggatcttgttaaggggaggtctggtggacctccgccggcgatctttcttgtatgatatggccggcggtaacgagctgatcgaggtcatgttccggctcttcgactgcactgacatcattcccaccaattacgatccgggcagcacggtctcctcgctcaaggatttcatcctcactcggcgnccccaaaataacnatataactccaaaaactgttaatgactctaaccttatcaatgctttaatgatattgtaaaataatctgacactttcaaagtcc

SEQ ID NO: 25888 - DNA, 442 bp, Zea mays
  Clone ID: cC-zmle189043d06a1
tttttaaaataacatgaaagactgatatgttcatataagtattttaagcaggcgcaggggcaggaatccctccccttactttacaacagaacaaagatttggccaaacaaatccatacaacaattcaatccgtaggtctggtgctatagtaaacagcggtggcggtggccgtagcgcctgaacgaacaaggcgaaagaaattattgtcggcgaaagggccgggacctggaccagaccttttctcggcagtctggcggatccggcgccgcctaagccgcggcagcgggtgatgcgggagcagccgcgggggcaggggttggcctggccgtccgggcggcagttgtagtagctggcgccgtggcgggagcagggcacgttgtcccgacggagcgcgccgtagctgaagaacccgccgacagagagcgcgcggaggtgggatcca

SEQ ID NO: 25889 - DNA, 277 bp, Zea mays
  unsure at all n locations
  Clone ID: cC-zmle189043d06d1
aacgctctttcccccacttaccctatctcggcgccatggctaaacacgcgctgacagctcctactcctgcaaaccaacacggcttacaattcatacaacaacattttccgggggggagataaactggggctagggggggggggggggaacgccccannaaccacccaccaacantatacccaattcctccccaaaaacacaaaataacaaaacacttacctgactaaaacccaccaaacctctctctactaacaaatttacatcatctactgctcac

SEQ ID NO: 25890 - DNA, 521 bp, Zea mays
  unsure at all n locations
  Clone ID: cC-zmle189043d07a1
aaaaaagcgacagcccgaatttgcattaacaagtacattacatacacgattcctcctctgctctccaaagttttccatggtatacatacaccttcccaagatccatgacggcggtcggacacctagcagttagacactcgaatcactcgagctgagcgtaccagaccccctggatcttgacatccttgggcgccttggccccgaggtcggtgtcggacggctgcacgctctcgaagacgccgatgacctcgccggtctccgggttgctcttggtgacgctcaacgtgatgttgccggtggaggaggcggcgttcttgatgttctccttctggagctcctccttgtcacctctgcccccggcggggagcgcgacggcgttgtcgtagccggtggagccgccgcggcccttggggtcgaggaaggaggagccacggtagctgggcacgaggaagggcccgtcgaagctttcaggcttgccggtggcgacgagctgcttgacggtgaagaggaacggnacgcgc

SEQ ID NO: 25891 - DNA, 468 bp, Zea mays
  Clone ID: cC-zmle189043d07d1
gccaaaggcatgaccgccgcgacgacgatggcagcctcgctccttgccggggccaccctgatgcagccggccaagatcggcggccgggcgccctttgcctcgctgccgtgccgcccgtcgtcgcaactcgcctgcagggcgttcggcgtcgacgccggcgccgccaggatcacgtgctccctgcaggacgtcgccagcaggtgcgtcgacgccgcgaagcttgccggcttcgcgctcgccacctcggcgctcctcgtctcgggcgcgagcgcggagggcacgcccaagaggctgacctacgacgagatccatagcaaaacgtacatggaggtgaagggcactggcacggtgaaccagtgcccgaccatcgacggcggcgtggaggcgttcccgttcaaggccggcgtggaccagatgaagaagctgtgcctggagccgacgtacttaaccgtcaaggcggagggcatt

SEQ ID NO: 25892 - DNA, 520 bp, Zea mays
  unsure at all n locations
  Clone ID: cC-zmle189043d08a1
ttttactattaatgtttctccttccattatatatcaaaagttcgatgcacgaatggacaaattaatttagacatctggtttcagttacagaaggcagtacgtgctttaggtctacgagagaccaatagcttgtcagcccattgcatatttctgagtccagctcctagcagtcgattcgtacttcacgcgatcagtcttgtacaagtgagcaatctctgggaccaacggatcgtcagggtttgggtccgtcagaagggaacaaattgagaggaggaccttagaaactgtcagtgcagggctccattgctccttcaagatatcaagacagatgctcccgttgctgttgatattcgggtggtaaaccttcgtcttgaatgcaaccttcggtggtttgaatgggtagtccggtggaaagtgaatagtgaccaanaatacgccaccagcgtatgggctatctgatggccccataatccgncgcctgccagtagaacatattttcggcacaggggacgagcatact

SEQ ID NO: 25893 - DNA, 553 bp, Zea mays
  Clone ID: cC-zmle189043d08d1
ccacgcgtccgaggacctgcagaaggatcctcccacctcttgcagcgcattatcatttaaggagataaggatagtgctcatgcaccatggtagactagttatgtacttgagcatacaagcctgctgagtgctttcagagccatcaggccttacattgggacactagcaaatctagtatgctcgtgccctgttgccgaagatatgttctactggctggcgacgattatggggccatcagatagcccatacgctggtggcgtatttttggtcactattcactttccaccggactacccatttgaaccaccgaagggtgcattcaagacgaaggtttaccacccgattatcaacagctaccggagcatgtggattgatatcctgcaggagcaatgtagccctgcactgacagttttaaggctctcctctcaatgtgctgccttctgacggactccaaccctgacgatcctgtggtgcccaagattgctcacttgtacaagactgataccggatgtacgatccactgttgggagctggacttacaaatatgcaatgg

SEQ ID NO: 25894 - DNA, 470 bp, Zea mays
  Clone ID: cC-zmle189043d10a1
tttttgccaaaaaccaatatacaactcaacttaatacatattcaggaaagtatccattgatcgttaatttacaaacaaacaaaaaagaataattaggaatttgggatgcaggatataaggaaaaataaataaaaacaccagcctattctctggcacatatctgctgctttaagctacttcatacataacaagcacatttgctaactctaccctcatcattgctccaaacatgcttcgtgctgtcatctagcttttgcttttctcgctttcaaagtatttgaggacaccatacccaaccgtaccagccaaaaacagaacaactgttggagtgaacgatggataaaggtacttaacaaagaagctgtcatattcctctggcagaaaaccggaggcggcgagtgcgatgccctcgacaaggatgatgatgcctagcccaagccaggcgaggaggaaggcgttctcgttggcct

SEQ ID NO: 25895 - DNA, 420 bp, Zea mays
  Clone ID: cC-zmle189043d11a1
aaaaaaaaaggcaaagaaaacaaaacaaaaaaaaaaaaataagaccccggcgagggaagaaggataagtactgtcctgacacaggaatacaataaaaccaccggaaagcaaaagaaaaaaaaaagcccctcaaaggaaaaaaaaagacaaccaaaccaaaaaaaaaaaggccaaagacgggggggaaaagggcaaggaatgggggggggggggaaaggaaaccgggggggggaatgccggcccggggggggccccgcccgagtccgcccgggcccgggagggaatcccactatacctaggggaggccccggggaaaactgggcaaaaaaaggtttggtcatggatgggcttgaaaagccaatccccgggccgcaagcaaaaaaaccctagggggggagagaaaacggcggggccaggggg

SEQ ID NO: 25896 - DNA, 293 bp, Zea mays
  unsure at all n locations
  Clone ID: cC-zmle189043d11d1
tttttgggtgcatatatatgcatatatattaacgaatctaagcatatacatacatataatatattacatccaccagaattaactacagcctttccaacaaaactgagctcagaatcaccttccctcccttctcaatcatgttggtctccagatcttaaaaaaaaaacatttccactctgttttttttctccttctttcttgagttgagcgtttttgcaaattaactgaacaacagcaacaccaagtatgctcagctcaattacagctagnctagactctagaagaagagacat

SEQ ID NO: 25897 - DNA, 385 bp, Zea mays
  unsure at all n locations
  Clone ID: cC-zmle189043d12d1
aggtattagtattacgaagaagttttattcaggtcacgagcttattgtcgtaattcgtacaggagctgagtgcgtgcacgtacgatagccaagtacgatgaccctgcacaaccagncaaccacagacatacataaggcacgcaggcaagcacgaacgggcgtggatgccggccgccgggcggctcagttagccctggcgaggaagctctccctgcgctcgaggacctcgccggagcaggtgttgatgtcctcttcgaccctggtctcgcgcaccacgaagccgaggccgccgaggagaccatggaggtgagggaggntggcgccggcgcgtgagaccgtgtcgacctcctcgaacttctccttgacgacgagctgctggacgccg

SEQ ID NO: 25898 - DNA, 354 bp, Zea mays
  Clone ID: cC-zmle189043e01a1
aaaaaagggctttttatcatgccgcttatcaagttcccaacaaaaaatttcatgtctgaataaaaaaaaatagcttatgggccaaccgcaggggcttgcccaaagcccaacccccctaatttaaattccctttaaatccctggcccccccgcagtcccaaataagttgctaaagccgcctggcctaaaaaaaaaaacataacatccttttttccctttgggggccaaccattgctaataagccaaccctgggtggaaaaccaccaaaagtcggcagcatgacccctggtgggaaaaatgggtttatttcctcatcggccccaatttttggcgcccggtaaaatctaatgtaacc

SEQ ID NO: 25899 - DNA, 539 bp, Zea mays
  Clone ID: cC-zmle189043e01d1
attgatagcgagcacctcggaatcccggattccgagtaccaggccatcgtccgcatgccttcttctgagtttatgaggatctgcaaggatcttagcagcatcggagacactgtcgttatctcggtaaccaaggagggcgtgaagttctccacatctggagaaattgggagtgcgaacattgtttgcaggcagaaccaaactattgacaagccagaagaggctaccattatagagatgcaagagccggtttccctgacttttgccctaaggtacatgaactcgttcacgaaggcgtcttcactgtccgaacaagtcacgatcagcctgtcgtccgagctaccagtggtggtcgagtataagatcgctgagatgggttacattagattttacctggcgccaaagattgaggacgatgaggagatgaagccatgattgccatcagtgctcatgctgccgacttttcgtcgtcttccatccatggtttgcttattagctattgtttgcactcaaagggaaaaaaggatgttatgttttatctc

SEQ ID NO: 25900 - DNA, 426 bp, Zea mays
  Clone ID: cC-zmle189043e02a1
gcaccacaatgcacactttactaataatttctcactgtttgggttgtaagaaagatactggatacatgatattgcatctctactgtgactcgcccagagccgcgcgcgcgcgccatgggcatacacatacatacacacgcactccattaccatgcattttttttcccacgggggatgatggagacctgccaaagatgtatagttgccctacatggccgatcgaacgcctacaagctgcccgcgccccgggcgccctattgttaacagggcacgcaccaccgtcggagctagcacccgatgtagttttcaccgtcgttgccgccgccgccggtgaagccgaggggggagcgctgggctacatggcagcagcatcaggccaatgttgggggccggggtaaaaactaaagaggaccggccgggacacac

SEQ ID NO: 25901 - DNA, 478 bp, Zea mays
  unsure at all n locations
  Clone ID: cC-zmle189043e02d1
cccacgcgtccggcagggtgtgtcccggccggtcctctctagtttttaccccggcccccaacattggcctgatgctgctgccatgtagcccagcgctcccccctcggcttcaccggcggcggcggcaacgacggtgaaaactacatcgggtgctagctccgacggtggtgcgtgccctgttgacgatagggcgcgcggggcgcgggcagcttgtaggcgttcgatcggccatgtagggcaactatacatctttggcaggtctccatcatcctccgtgggagagaagatgcatggtaatggagtgcgtgtgtatgtatgtgtatgcccatggcgcgcgcgcgcggctctgggcgagtcacagtagagatgcaatatcatgtatccagtatctttcttacaacacaaacagtgagaaattattagtaaagtgtgcattgtggtgcnnnnnaaaaattaagaaaattttttttagaataaa

SEQ ID NO: 25902 - DNA, 124 bp, Zea mays
  Clone ID: cC-zmle189043e03a1
ctatctaacttttttttactttttttaacatgacccatacagacattgtcgtcggtggttagtctgatgatagacttcaattgtatacatgtaacctaatgtacatagcaggtcgcctcatgat

SEQ ID NO: 25903 - DNA, 508 bp, Zea mays
  Clone ID: cC-zmle189043e04a1
gggccaatacgtttatactcgtccattcagtcagtcaatggagagtagcagttgttttacaatgtacaaatgaggcgagacggcaggctacactaccagctagctgcacatcaccggcccttgtaatcttagcaaacaaacgaacaaatcaaccagcatatatatcggattaccactactaatcaaactctagctaacctgctagatttgcctcttgatgcatgcgacagcttccatgccaaatgcttccacgttaaaacatcggaaacgcggctgcccgtgtcgctagagcaaacagcccttctcttcttctcagttggcctggcagaacgtacggaagaacaccctcgaaggaaagggaaaaaaaagaacaagcagtaacggtagaagagaaatcccaaacaagcacgcgacgcgtcgcagctctgcgctgctagatgggaatggcgccattgccggttgcttgatagtgtgcgttcaccaggccattcagtggcttcatgacgtg

SEQ ID NO: 25904 - DNA, 593 bp, Zea mays
  unsure at all n locations
  Clone ID: cC-zmle189043e04d1
acccacgcgttcggttccgaaggggtcaaaaacccatatgggggcaacaatgcgccttggatcaaggaggacctttttccaggtcactaactgcaaatctgctaaactgtatgggaatgctagctacgttgatgaacggcaccgccacagatacgaggtgaatcctgatatggtcccagaatttgagaaggcagggctttctttcgttggcagggatgaaagtggtaaacgcatggagattatcgaactgccaactcataggtttttcgtcggtgcacaatttcatcctgaattcaagtcaaggcccggcaagccatctccgcttttcttaggattggtagcagcgtcatcaggtcagcttgatcacctgctccaacctggtcttatcagttcgactggcagacacacctgcagcaaaggaggagcgcaaaaattaaaggctgggcacgtcatgaagccactgaatggcctggtgaacgcacactattcagcaaccggcaatggcgccattcccatctagcagcgcagagctgcgacgcgtcgcgtgcttgtttgggatttctcttctaccgntactgcttgttctttttttt

SEQ ID NO: 25905 - DNA, 333 bp, Zea mays
  Clone ID: cC-zmle189043e05a1
ttttgttttttttactagcaatatcaatagatattatgctgcaatgaaatttgacgcactatggcagtctaagtgatatacagctattaccaaaagaaaaaaaaagtgcaagaaaataaacctatattgtagataagagaaaatagtgaatcccataataatttcagcaaacaaaaacattgctgaaacatttccgagtgccatttgtcatacaattgtctggaagcaattaatgaagttcagatataagactaatatagacctctaggttcttatttcagaagattaacatagggatcatgatggcataaagtgatgcacattaacctcttg

SEQ ID NO: 25906 - DNA, 329 bp, Zea mays
  unsure at all n locations
  Clone ID: cC-zmle189043e05d1
cgcgtccgcaagaggttaatgtgcatcactttatgccatcatgatccctatgttaatcttctgaaataagaacctagaggtctatattagtcttatatctgaacttcattaattgcttccacacaattncatcacaaatggcacttccaaatgtggcagcggggcgttgggttgctgaaattattatctcattcactattttctcttatctacaatatanntttattttcttgcactttttttttcttttggctatagctggatatcacttagactgccatagtgcgtcaaatttcattgcagcataatatctattgatattggtcgtc

SEQ ID NO: 25907 - DNA, 534 bp, Zea mays
  unsure at all n locations
  Clone ID: cC-zmle189043e06a1
ccttaagattaacttagaataaagcctgacgggggtaacagcatccatcgatccgcagtccatgctgtttgatgcatgggtctgctgaaaccgaggatgaacacagcactaacaactgacacagagcgaccttgcaatcaaaaacacagatgggcaacaacaaacacgacacgaacgaagataaaccctctggactagggtaaacatcacggtagcgaacaggataacttggccgcgcgggccccaccgctcagttcctccagttcccgtcggagttgccgtagccgccgccacggttgccaccgccgtagccgccgccaccaccaccgtagccgccgccgccaccgtagccgccgccaccgccgtagccgccaccgccatcacggcgcccgccaccgccgtagccgccgcctccacggccaccaccgtacccaccgtcgtcgtcttcacggncgncgcgggactgggcctcgttgacggtgatgttgcggccgtccagctccttgccgttcatgccctcgatggcgttccgca

SEQ ID NO: 25908 - DNA, 393 bp, Zea mays
  unsure at all n locations
  Clone ID: cC-zmle189043e06d1
ggtgggttggcttctcctccccctccggttcgggttcgggttcgtgaggttctccggggttcgggttcgagggtgagcggatcgagatggcggcgtcggatgttgagtaccgcttcttcatcnacnncctcacctaaaccacggaccaccactccctccacagcgccttcaggcaccgaccgcaaagncctcnantccaaaatcatcctccatctttaaacccataagtcccacggcttctgcttcttcaccttcttcacggaggaggcgatgcggaacgccatcgatggcatgaacggcaaggagctggacggcccgaacatcaccgtcaacgaggcccagtcccgcggcggccgttgaggcggcggcagtgggaactgtgggtggccgtgg

SEQ ID NO: 25909 - DNA, 505 bp, Zea mays
  Clone ID: cC-zmle189043e07a1
ttttaatcgataattgatgatgtattgaagaacagagttttgaaccatggagcagtttggaagttttacatgactggaaaaaaaagggagatgggattgtagcttttatgagcactgctactagtaatgttcacatagcatggctctgtaataatactgttgatcaccacatccaccagcagcaggcaatccggttgccaacgaggaggcagtctcagacaagcacctgagctgcagctagcctagcaatcggaaccctgaaaggggagcaagaaacgtaatccagcccagccttcgcgaagaaggccacagacgaaggctctccaccgtgttctccacaaatgcccaccttcaagttaggcctagctttgcggcccctctctgtagcaaacttcaccagctcgcccactcccctctggtccaggacctcgaaggggtcatgttggaggatgccctgagcaagatagacgggaatgaactttcccacatcatccctgctgtaccc

SEQ ID NO: 25910 - DNA, 435 bp, Zea mays
  Clone ID: cC-zmle189043e07d1
tgaggatgtggttgccggaataagaaccccagaggaccttgactctatgaagaacctcatgccacaggcctacgacgagcttgttgagaactgcaacatcctggagagccactataaggaaatgcatgatatcgagttcactgtccaggaaaacaggctgtggatgttgcagtgcaggacagggaaacgtacgggcaaaagtgccgagaagatcgccgtggacatggttaacgagggccttgttgagccccgctcatcgatcaagatggtagagccaggccacctggaccagcttctccatcctcagtttgagaacccgtcggcgtacaaggatcaagtcattgccactggtctgccagcctcacctggggctgctgtgggccacgttgtgttcactgctgaggatgctgaaccatggcattcccaagggaaagc

SEQ ID NO: 25911 - DNA, 395 bp, Zea mays
  Clone ID: cC-zmle189043e08a1
aggcccctaatccggagctttattacacggtctgttaactctggagtggagcattataggttcagagtacaagagcacagcaagtctacatcgagcgccgcagggctagtccgcggcggcggctactcgaagttgtagtgcttgtcgacggcctcggcgacgtcccaagtgcagctcatgcccttggggaagacgacaaggttttccgcgccgatctccacgaactcctccccgtggccttcggggtacaccttcaccttcccctgcagcaggtagcacgtctccttggcggagtaggtccacgggaacttgcttttctcgcacccccacttgggccactggcggacgcctagctcggagagacgggacttgggcgggttgcgctccaccttgat

SEQ ID NO: 25912 - DNA, 457 bp, Zea mays
  Clone ID: cC-zmle189043e08d1
cagggaggcggcgattcgcggcggtgagggcgtccgcggagacgatggcgacggagaagctgggcatcaaggtggagcgcaacccgcccgagtcccgtctctccgagctcggcgtccgccagtggcccaagtgggggtgcgagaagagcaagttcccgtggacctactccgccaaggagacgtgctacctgctgcaggggaaggtgaaggtgtaccccgaaggccacggggaggagttcgtggagatcggcgcgggagaccttgtcgtcttccccaagggcatgagctgcacctgggacgtcgccgaggccgtcgacaagcactacaacttcgagtagccgccgccgccgactagccctgcggcgctcgatgtagacttgctgtgctcttgtactctgaacctatgatgctccactccagagttaacagaccgtgtaataaagctccggattagggg

SEQ ID NO: 25913 - DNA, 293 bp, Zea mays
  Clone ID: cC-zmle189043e10a1
cacggacgcgggggtcaacccggaaattcggaaccggttcccggagggggaccatttttcccaaaagggaggccttttaaaaatcgggaaaataagggaaaaagtacacacccggggaaaattagtatccctggaaaaatccccaaaaaaaagagccccgaaagaaaaagggaaacgcccggggggccaaatggggggcgtaaatcccagaacttggggtgcccaccagggcgggattggaaccgaaaaaactcaagggccggaatttttaatgtaagccccaccgaacgggg

SEQ ID NO: 25914 - DNA, 436 bp, Zea mays
  unsure at all n locations
  Clone ID: cC-zmle189043e10d1
ttgttatatcttattaataaaaagaataagcatctttaatccttttatccaccaaaaatacggaaaagtactgaaaaaaacctttatgggtccttgggtgatatactatcccttattaaaacccctttcaggccacnaaccttcccttcaaaccacccccgaaggggggggggggggggggggggggcacctacggcccttaaaaaacctagactttcccgagggggtatccatcaacacattccccctccctatttttctaaaaaataaaaattccccaccacagccccccttccaaacattattgcaccctaaatgaaaatttaaccccccccttaatattctccttaatcacctaggaatggtttttaacccccttctatccctattcactttcccccgcctaaacacccccacctttacttttttcccctac

SEQ ID NO: 25915 - DNA, 577 bp, Zea mays
  unsure at all n locations
  Clone ID: cC-zmle189043e11a1
ttttgacaagacactagtaccagcagataaatgcaccgtcatgtcaacattacagcaacttggaggacaaagggaatttgccaacgcaattctgcaagtcagacaaggctatacatcaggacctcactttattagacgcacaaaaacgaggcttgccgcaaataatctactattgccataaaataacaacaggcctcaagtacaatgtcctgaacaatgcgtacatgtcaccaacactactctactgtataatggaagcatcatcccttgtgtcatccaagtcgctagggaaaacacggtgcgaaacaatcaagctacttcccttaccatacattatgttgtctttaatggaggtcatgaagagcagtggttcctgactgaccaggctgatcttctctctgatccaactaagccttaggttcttgatgttgacgccatctatcagaacctcaccccatgtggatcgtagaaccgctcaacaaggctgatgacggtcgacttgccactcccactctctccgaccatggncattgttgtcccactgcctactcgcaacgtcaacccgtctagtatcagc

SEQ ID NO: 25916 - DNA, 310 bp, Zea mays
  unsure at all n locations
  Clone ID: cC-zmle189043e11d1
ttttaacaaacatatgcaatatcgctaagctcaaggagcgctgcctcaagtagcccagtgcagaggcattagaaatctacagagggtcccatgaaaatccttggttatttgaatagcctcaaaagataaaaaacagagtccgcgtatcagctcgccccaactcacaaagcttcacggactacatactaatcagcttttgcggcagtacttttgatggccatgagagcacatgcctcaaatctcttgactgcttcagcacacttgagcgggtcctttgtattggncttgtaacactcaaagcagcctgccc

SEQ ID NO: 25917 - DNA, 361 bp, Zea mays
  Clone ID: cC-zmle189043e12a1
aaaaagcaaaagggccaagacccgatggtgaaaagattgaaacaaaaagggccccactcccccggaaaaattaatccccccgggggggggaaaaatccgggggcgacaaaacaggggaaaaacccccccattcccaaaaaacccggggggtagctgttcacccccttacaaaaaaccggggacccccccatgaacctttccctcccccgccaccaaaactaaaggggctctataaaaaaggggactttttttgggtgggggaggccccggcccccaaaaaaatttgaggggaacggggatttcccaaaccccccggggtaggcccccccaaaatcggcccccccgggggcccccccttttt

SEQ ID NO: 25918 - DNA, 274 bp, Zea mays
  Clone ID: cC-zmle189043e12d1
atctgaaagggccaatcacctcatccttgacccaacgggggggtattggaagaaagtcctggggaaccacccaagcagacttgccctcctccaaaagagattacgagcaacccaggttataatgctcgagggtcctgaggagtcggcgagataatcgaagcataatgtgctccttcgctcttgatgattgaaagagcctagatttcggacatctagatgggcgacaagacaggggaaaccgttgccccttaccctcagacgctgctggtaattg

SEQ ID NO: 25919 - DNA, 152 bp, Zea mays
  Clone ID: cC-zmle189043f02a1
aaaataggaagttctagatataatttgggtactatagtgtggggccattaccatatataacataaaacttctcccccaattctgtttagtcgagcttctcgatctgtcattatacctcgagaagtagaaagaatagcaattcccattccgcc

SEQ ID NO: 25920 - DNA, 267 bp, Zea mays
  Clone ID: cC-zmle189043f02d1
tcaggacacatcgcgtaactcgccaatgagtaatgagcaagtttttggacttcttagaggtataatgatgtatcagacaggctagactaaacagaagtgggggagaagttttatgttgtatatggtaatggccccacctatagtacccaaattctatctcgaacttcctattttagaaaggaacagtaaaatggcacgatatgaagtaaaaaaacaaggggtggggagtgtgaggaacaatgcttcctgacgcctgctggcaaagta

SEQ ID NO: 25921 - DNA, 156 bp, Zea mays
  Clone ID: cC-zmle189043f03a1
acggggaaaacctcccaaaccaaaattttttttggcccacgttaaaaaaaacgggcgttgttttagggctcggaaaggctcactaaacatgggggagcatatatacccccattggggggggaaaaaaaacaaaaaatacccttttgggacccgggg

SEQ ID NO: 25922 - DNA, 145 bp, Zea mays
  Clone ID: cC-zmle189043f03d1
aaacgcgtaatttgtgtgtttatgcgaccggcgatgtgtgtatatatgctactacatgtttagtgatgctttccgagacctgagacaacgcccgtctgttttaacgtggcgcaagaataattctggttctggatgtattctccgt

SEQ ID NO: 25923 - DNA, 347 bp, Zea mays
  Clone ID: cC-zmle189043f04a1
gtgaaatacgatgtccataccaaaatgggtgcggaaaaccaaaagggaccaaaaacggtggcccctacaaaaaggggaaacaattctataaggggaagcatttcggacgcgggggtcaaagggggaaaagcggacccaaaccggcatgtggggcaacaaggcccataggggggggcattaaagggagaaaaaaccaagggcaaagacgattcccgagaaaaaaaaaaaaccccaaacgttttcacacatcttaaaaaacggaagcatgtttcgtcaggccgggggggccgaaaaagccaacaaaccaacagtaactgcggtgaagtcacaaaacaacccgggggcgg

SEQ ID NO: 25924 - DNA, 91 bp, Zea mays
  Clone ID: cC-zmle189043f05a1
ttttgtttttttgtttacccaaattttgtttacttcttttgggttgattttttgttaggaccatccatgcacgagaaagcaaagcaaacaa

SEQ ID NO: 25925 - DNA, 85 bp, Zea mays
  Clone ID: cC-zmle189043f05d1
cccacgcgtccgagttgagcaattgtctttgctaaagagcggatatgcccggatctctctcctattaaacaaaaaaaacaaaaac

SEQ ID NO: 25926 - DNA, 312 bp, Zea mays
  Clone ID: cC-zmle189043f06d1
aatgtagcaacggtgttataggtcgtaaattgtaatagtatatttttggaatgatttaggagctttgcaagtagaccacacaggatcggaattgcggactcgtggcttaaactgtaacaactgtaaactatagtgtcggatatttttaagatgaaaaacgggagaggtgccgatacctctctagggggaaaaaaaagatctgtgttaacacaatagtcgggcgaattttcacaatatctgggcgctcacaatgtatggggcacttttggggaaagtgtgcgcaaaacccatatttgtttatgttgtctaaac

SEQ ID NO: 25927 - DNA, 186 bp, Zea mays
  unsure at all n locations
  Clone ID: cC-zmle189043f07d1
gttacgggggattatcgcgtagttagccctcgtaggagttttcctaaactgtctgtaggagtttggtagtaggctgagccgtatggtttctggtagttagccgtctgtagggagttagtctttaaacgtctgtataaaaactgcactgtttctggtagtgtaactgtcngtcaggagttagtagtt

SEQ ID NO: 25928 - DNA, 448 bp, Zea mays
  Clone ID: cC-zmle189043f08a1
ttttatgaaaactgactaacacagtaaggttcaaatcaaataataataatgggtaaacgccgagacatgataatctggaacaattccatatcagacaataacttggaagacagccccttccactgggcacaggcgcaaagctgataatttgttattatctccttgcaagttcaacatcaggcctgcacatttcgcagccaacacaacagtttatctgactgctagttcatcaggtttagactagtaaccacccctcagagcaaggacaagatggaggacagatccaccctcgaagttgtagtcctttgcggtcttgtcatcagcaagctgcttaccagcatagatgagcctttgctgcacgggaggaatgccttctttctcttcaacacgctccttgatcctgtcaatcgagtcagtgggttcaatgtcgatctcgatctctttccca

SEQ ID NO: 25929 - DNA, 585 bp, Zea mays
  Clone ID: cC-zmle189043f08d1
gacccacgcgtccgaattttattgggcgtgcttcggcttcattgacacaaggttcgagttcttcaccgtctagtacgactgggcgagggaggaagaggcgaggagaagatgcatatcttcgtgaagaccctgacggggaagaccatcaccctcgaggtggagagcagcgacaccgtcgacaacgtcaaggccaaaatccaggacatggaagggattcccccagatcaacagcgactgatattcgctggcaagcagctggaggatggacgcacgctggctgactacaatatccaaaaggagtcaactcttcatttggtcctcaggcttaggggtggaaccatgatcaaggtcaaaactctcactgggaaagagatcgagatcgacattgaacccactgactctattgacaggatcaaggagcgtggtgaagagaaagaaggcgttcctgccgtgcagcaaaggctcatctatgctgggaagcagcttgctgctgacaagaccggaaaggactacaacatcgagggtggatcctgcctccatcttgttcttgttctgggggggggtacttgtcttaacctgatgaac

SEQ ID NO: 25930 - DNA, 453 bp, Zea mays
  Clone ID: cC-zmle189043f09a1
ccgctaggttaacagagaacacacggtttgaagatacagttaccaaacccgaaggaccaaccataatactccgtaaatgataatatagactgatatcaagccaataccaataacaagatagcacaggcatgctatgctaggtaggaagcaagcactctgacacgccagcaccccacttccagttccacgacaacagttactgtttctcagttcagcaccgattaagacacatcttatgacattgtccttaataggcaatagccatgggcattaggtaccatgattccacgaatttcttttatttcagctgcagacctcaagtctagaaggtggagccgttccaaccgaagtccgagcgcttcgagtcatagaacttgaggtagaagcgtgacttgggaacagacagctttgactccaggatagaagcgatgccagcactaagcttcttgttca

SEQ ID NO: 25931 - DNA, 495 bp, Zea mays
  unsure at all n locations
  Clone ID: cC-zmle189043f09d1
gtagtatattggggatagacaatctgatcgcgtggctagtacatgaactttgtgaagctagagcatatgttatatccagttggtcatatctggtttgtcccacttacagctattaccttaatttttatgactagaaacgctcttacttcgtgtggaactattccagggggagacttgatgtcattatcggaagtgaggggggaggggggcagacatctacctaatncccattcctattacctattaacgacaatctcataaaatgtgtcttaatctattctgaactgagaaacatatactgtttttcgtgaactggaagaggggtgctggcgtgtcatagtgcttgcttcctacctatcatagcatgcctgagctatcttgatattggtattggcttgatatcagactatattatcatttacggagtattatggttggtccttctggtttgtgaactggatcttcaaaccgtgtgttctctgataacctagccgg

SEQ ID NO: 25932 - DNA, 437 bp, Zea mays
  Clone ID: cC-zmle189043f10a1
ggtgaaacgagattcaaatcggctggcatgattgatgaaacaaatacacaccccaggattacactacacgactcccaacaggaaatggaaagcggaagcctgtaccagttcggtgactgcatacaactcatatatataacatacgtctctttgggcgaataatctgtatattattctctatggaaagaaccctcgcgcccgtgctgtacgtttcgtcgtggaaagaaccctggcctcatgcttcgtacaccttgcactcgtcggtctcggggttgtccttgcagaagtcctccagagggtcgtcgctgccggccgccgcggagccgggccacttggccgccaccaggtgcgccagatcaaccacgcgttggctgtacccccactcgttgtcgtaccaggcgacgaccttgaccatgtcgtcgcccatgaccatgctg

SEQ ID NO: 25933 - DNA, 392 bp, Zea mays
  unsure at all n locations
  Clone ID: cC-zmle189043f10d1
ccggaattcctgggtggacctacacgtacgtgtgttctgtaccatcgacgctcccctcaccatggccatgggcgactacatggttagtgacgtggtctagcactacaactattggaggaacagacaacgcgtggattatctgtctcacctttcggcgcccaattaccccacctcaccggggggcggtcgcggggaccctctttaggagcgggacaaaacaacccccacacctactaatgcaanttttactaaccataacgccattgttctttccacgactaaacgtacatcacgggctccagggttctttccatagagaataatatacagattattcgcccaaagagacgtgtgttatatatatgagttgtatgcattcaccgaactggtac

SEQ ID NO: 25934 - DNA, 334 bp, Zea mays
  Clone ID: cC-zmle189043f11a1
aacaaaaaaaaactgtagtttattacaaacaagtttttatttctagtgtggacgcataaactaattgtcacaggaattacaaatggttttcattattcaaactgccataattaataataataaatcgcgagggaaaaagtatggttccccttaagcaaagtaacaaaccttattattattaatattatttttagtgcatagcactagcagcttgctagagctttgcataaagcagccgtcctagctcctttatattttcagcctccaagcacacgagcacgcggacgttgccggtaccaccgtcgtcgttcatcaagtgcatagagccgccgcg

SEQ ID NO: 25935 - DNA, 451 bp, Zea mays
  unsure at all n locations
  Clone ID: cC-zmle189043f11d1
ttttagttaaatctgggcagggctatacatgtagattaatttgaagtttaatcaaacccgtaattcataaaactatactactatgtagcaacagctgggtgagaaatttaactttacattctgagagagtactatgtagcaacgctttgttcgttcgtctgcccactcgttgtcgctggccttgtttgcgatatcctccccttacattgttctcagatcctagatgggatgagcggcgtggagtttgacaggtacgccgccgaggctgccacgccgctacctagtttcactgggtaccccacatccttgagcaccatctccacaccggtcagacatcccagaagttgcagctcgttgaagttgccgagatggccgatcctgaagaccttcccggcgatcttgntgaagccgaggccgaggctgaagttgtaccgcttccacgcgtgcctga

SEQ ID NO: 25936 - DNA, 401 bp, Zea mays
  Clone ID: cC-zmle189043f12a1
cagacaaaaaactttattattgaactataactcataagaaatttaaaagagggccccaccaatgatgggttgttggtaaaatgctgttgggtttgtcaaagcaagttggttgaatggccccaattgttgcagttgaaaaagggtgccagcgttaggcgcaccgtgttggtaaaacggaaacaattggggttgtgtaaaaaaggtagcagggctcacaccaactagctggttgaatggtagttgttgtggctgctgtaaaaaagccggaaagttcaaagctgtcatttggttgaagggaaaaaattgctgggggtaggcaacaaatagctgtctaaagggtaattgttgttgttgcaaataagaaccagagtttattgcacttagtgggttgaatggaaaaa

SEQ ID NO: 25937 - DNA, 238 bp, Zea mays
  Clone ID: cC-zmle189043f12d1
ggtctgctgttttttgcttagctctatctggctgttatggctctgctctaaaagcaacgggggccgccccagggattgcggcccgggaccaggggaaccacccgctttcccccgcgagagaccactacaaaccagggggggtcgaggactgaaccccatccggggggacagtgacaaccggtaaaaacggcccccctaaaaccaaccactagcctgtaatgaacaaccgggggggccc

SEQ ID NO: 25938 - DNA, 259 bp, Zea mays
  Clone ID: cC-zmle189043g01d1
gacattattactatttttgtttctccttccattatatatgaaaaggtgcgggtactattggacaaactaatttacacatattcgttttagctacagagggcattatcgccttttatgtctacgagaggaccaattatcttgtcagcccattgcatatttctgagtccagctacttatggttggattcgtactttcacgccatcagttcttgtacaagttgagcaatttaatgggaccaacgcgatcgatcagggttgtg

SEQ ID NO: 25939 - DNA, 350 bp, Zea mays
  Clone ID: cC-zmle189043g02a1
gggggaggagaaatttaaaactatttatataaggtggaaaaaaggggggaaaaaaggggtggaataggacatttactcgagaggggcttaaaagctacccgcaaccaaaaactttttcgggccctttataaaaaaaggccagctccaagcggggggggggggggggccctgggggtgggggccatcccaacaacaacaagggactgggggtaaaaaaccgccgccgccgttaaaccggagccggacgggccattcttggagcaacaggaaatatgacattattacccttgaaacccggggcgacaggggtaaaacgggaagagtaggcttttgcataacgaagggggggg

SEQ ID NO: 25940 - DNA, 255 bp, Zea mays
  Clone ID: cC-zmle189043g02d1
gtgttcaagaagcgggatgcactgatggccccttgccgtgagctgctgagcaccgggatatctggcaagacactcatcactgtatccactccactgggtcctgcggaggcaaacagctcgagattgaatatctgctgctagctgccgcccttcgttatgcataagcctactcttgccgttatactcctgtcgctccgggattctagaggaataatggcatatttactgttgcttcaagtatggcccgtacggctg

SEQ ID NO: 25941 - DNA, 512 bp, Zea mays
  Clone ID: cC-zmle189043g04a1
gaacgagcaggcatttttattcgaagcaaaaggtgcagccaattcccaccatactaggaaccaggccagcgctgcccaaaaacgctcaaacaaggaaaaaaaacgagaaggaaccaaagttgttggaaaccaagtacacataactccaatacacgactaacaatgcgaattgcggtgaaacagatcgaaatgcaggcgatggttctccggcctgggcttcttcttcttcttctttccccgtactaatcgaaggacagcggaacctggcttgccaggctacggtacttcagggcgtagaacatctcgatgtagcggcgggtctcgcgcctctccaggttgctcacgtacttccagaacccgtacacgccggtcagggtcatcagcctctcggagtagagcttccaggtgtacttctcatagattctctgcaggccgccctgtgagatcttgtcccagtagctcggatctgccttgcatttgtcaaagaagttgaccaggatatccgcggcctt

SEQ ID NO: 25942 - DNA, 451 bp, Zea mays
  Clone ID: cC-zmle189043g04d1
ggggagttagtacatcctatcgcgggaggggaggtttaaaattaaattgatgtacaaaggcatggatttacttatctatctgggactagatctgacttgtcggtcaccatagataatataataagtactcttttaagctttactcagagaggctgatgacccttaccggactgtactgggtatggaagtacttgatcatcctcgacaggctcgagaccctacactacatcgagatggtgtacgctctgaagtaccagatcctggccagccaagattcgctgttcttctattagtacggggcacgaagaagaataataagcccaggccggctaaccaacgcctgcaagtggatctgtttaccgcacttcgcattgttagtcgtgtattggagctatgtgtacttagggtaccatgaacattggagtcttctcggttatttatccttgtctga

SEQ ID NO: 25943 - DNA, 447 bp, Zea mays
  Clone ID: cC-zmle189043g05a1
aaacatgggatatatactaataatattgggctatattccgttaagagaataagctctcaatccttcaagtcattacaaatcatagtttgagatacatagcattcagcatatagagggggggcattgacattcaatatagggcacattattgatgataattatataggggacccatgcagtggcctatgggctctacttttccctaaaccttcttccacccgatccaccttccctttgacagttgaaatgggtaccactggcaatgctgaggtgatattgccgtgcaaagcttctgcagttgaagttttggcgcatttttggtgcaaaaaccgtacccctgccaagttggcggaacaacacaaataccagcctgtggataccagatcttggatctggtctcttataaaatactagctcttggccgaagttgaactaattgtttcagga

SEQ ID NO: 25944 - DNA, 570 bp, Zea mays
  Clone ID: cC-zmle189043g05d1
gactcgtgggatatggagtcaccgatcctttggtgatggctcgtgtcctacaggatgtgttggatacctttacaccaaccattccactaagaataacatacaacaatagtcaagttctggcaggtgctgagctaaagccatctgcggttataagtaaaccacgagtcgatatcggtggcaatgacatgaggactttctacaccctggtactgattgacccggacgccccaagtccaagccatccatcactaagggagtacttgcactggatggtgacagatattcctgaaacaactagtgtcaacttcggccaagagctagtattttatgagagaccagatccaagatctggtatccacaggctggtatttgtgttgttccgccaacttggcaggggtacggtttttgcaccagaaatgcgccaaaacttcaactgcagaagctttgcacggcaatatcacctcagcattgccagtgctacacatttcaactgtcaaagggaaggtggatcgggtggaagaaggtttagggaagagtagagaccatagaccactgcatggctacactata

SEQ ID NO: 25945 - DNA, 382 bp, Zea mays
  Clone ID: cC-zmle189043g06a1
ggaacaagcctagttatttcattgggagggtcactggtaatacaaataaaccaaatcccctagggataaatcccttttttttggaaaaaaaaaatcaaaacagggccgaaagaaaattgatttttctgattccaccacgggaatttattacaaggggccgggggggaaaacaccggggggggggggggtttacaggacaaactggttgcggaaaaagtaaaacgtttccaaaaaagacaggttaggcttctgcaccccccttaaattggcaaccgggcggatgggggcccccatggccccctgcaaatcacaaccccccgccgggtttttcatgaaggccctcaaggaactaaacagggggcccaaggtgaccccccccggg

SEQ ID NO: 25946 - DNA, 444 bp, Zea mays
  Clone ID: cC-zmle189043g06d1
tcgaggcggacggggacgactaggccatctgcccgcgggacgcgttccagagcgggcccatcctggacgactagatcaacgaggtcatcgtgcgcccgctggtgcacggcgccaggctgcacgccgtggtggacgcctgctacagcgccacggtcctggacctcccctacctgtgccgcatgtccaggaacgggttctggcagtgggaggacgagtgcccgccgtcgggcgcctggaagggcaccagcggaggccacgccgtgctcatcatcggatacagcgagggcaaaggcaacttcgccatgatgcccgacgcccacgcgtaggtcgtcggggccatgacgcacagtttcgtccggacgctggagtgccagccgcgcggggtcacctacggacacctggttagctccatgatggccatcatgaagaaccccggcgggggct

SEQ ID NO: 25947 - DNA, 373 bp, Zea mays
  Clone ID: cC-zmle189043g07a1
aatataaacaaagggggggtttaatccaaaagccagggggctacacgagcttcagtacattaatacatagacacacaactgttacatttactagggatgatgatgatgatcaacagccagcagtgaaccactgatgctggctggggtgtgtgcttgcaaaacacagggcgagatcaactgaaaaggaaggaataagttatacgctggggctttgctctcatttgggccatatatatatacacacacaacatgcgagccgtccattccaatcaaaggattacgtacaaaaaagtaagagcagtgcaaaacgatccttaccctttcttgggcctgaaaaaaaacccgccgaggttgaccccgccgttgcctcacc

SEQ ID NO: 25948 - DNA, 132 bp, Zea mays
  unsure at all n locations
  Clone ID: cC-zmle189043g07d1
ttatgggggatcgcccgataactgaatnatgcgtgcctggattttgtcagggactacttttgaacgggctttatgatattcttggaaaaggaactgaatatggcaggaatgggtgaaactgaggaaagtaaa

SEQ ID NO: 25949 - DNA, 452 bp, Zea mays
  Clone ID: cC-zmle189043g08a1
ttttggaaatataacttcttatttctaggaggccacatacatcagccaaaaaacttcattattgaatgacaactaataagcaatctaaaagagggcaccgccaatgatgtgttgttggtagaaggctgctgggtttgtcaaagcaagttggacaaagggcagcaactgttgcagttgtaaaagggttgcggggttagccacaaactgctggtagaacggaagcaattgttgttgtgtcaagaaggaagcggggcttgttgtagctagctggccaaatggtagtagtatttgctgctggaaataagcagaggggttcagtgcggcgaattggttaaatggaagaaattgttgctgctgagagtaggcagtagctagctggctgaatggtagtagttgttgttgctgcaaataagcagcagggttcagtgtatacagttggttgaatggaagaa

SEQ ID NO: 25950 - DNA, 675 bp, Zea mays
  Clone ID: cC-zmle189043g08d1
ccggaattgctgggtcgacccacgcgtgcgaagcaacatagaaagtggaatacagtagcaacaatagagcaacaatggcggccaagatattttccatccttatgctccttgctctttctgcatgtgttgctaacgcgaccatttttcctcaatactcacaagctcctatagctgcccttcttaccccataccttccatcaatgaccgcttcagtatgtgaaaacccagcccttcaaccctacaggctccaacaagcaatcgcaacaagcaacttacctttatcacccctgttctttcaacaatcgccagccctatctttggtgcaggcattggtacaaaccatcagggcacaacagctgcaccaactcgtgctaccagtgatcagccaagtagctctggcaaacctttctccctactctcagcaacaacaatttcttccattcaaccaactgtctacactgaaccctgctgcttatttgcagcaacaacaactactaccattcagccagctagctactgcctactctcagcagcaacaatttcttccatttaaccaattcgccgcactgaacccctgtgcttatgttccgcagcaaatactactaccatttggccagctagctacaacaagccccgcttcttcttgacacaacaacattgttccgtctacagcag

SEQ ID NO: 25951 - DNA, 409 bp, Zea mays
  Clone ID: cC-zmle189043g10a1
aatcacgaaaacaacccttattcatcgaatgctttcacagaagatttatccatacatgtatgctcattggggtagacgcagctgaccacctagagctagctgtatacagattgactcaacatgtggcaacgtaggaacacatgtttatagacgacattcttcgtactaatagcctggcttgggtgctaaccaaacgacaaccacgagatcgcaacgatttaaaaagaaaaaaactcagaagcaaatcgacaccagaaacccgtcttactcatcaagcactccatccttcttctcgatagcatccaacttcctccaagcagacaagattagccagcttgcagtccttcgcaaaaggtgctgcattctcgccatcaaagcagcgaagaacggatttgggcgagctagcaac

SEQ ID NO: 25952 - DNA, 538 bp, Zea mays
  unsure at all n locations
  Clone ID: cC-zmle189043g10d1
gtatgaagctccccttggctacagcattgaggacgttcgacctgccggaggcgcgaagaagttccagtctgctgcttactccaactgcgcaaagaagccatcctgatatcccttttggcttcctcnttctannagtttaggatttcttttctgacacttcgattgttaccaatccccctggcctgctgctttcctgacaatcnaccanttccccagtcttgctccctgcagtcctccctcctccatctccagcgttgtgttctgactcacctgcaccaatggctgttctttctgctgctggtgctcccccggcctcagctatcgggtttgagggctatgagaagcgccttgagatcacattctctgaggcacctgtctttgtggacccccatggcagcggtttgcgtgccctctccaggtcccagattgactctgttctggatcttgcacggtgcacgatcgtgtccgagctctccaacaggattttgactcctatgttctctccgagtcaagcttgttcatctatcctctgaagatt

SEQ ID NO: 25953 - DNA, 448 bp, Zea mays
  unsure at all n locations
  Clone ID: cC-zmle189043g11a1
tttttattttttatatttttttttttttttaattgagtcaggtttgtctcctattccttatttgctctccaaagttttccatggaacacatacaccttcccaagaaccatgacggcggtcggacacctagccatgagacactggaaaaactcgagctgagcggaccaaaccccctggatcttgacatccttgggcgccttggccccgaggtgggcgtcggacggatgcacgctctcgaagacgccgatgacctcgccggtctccgggttgctcttggtgacgctcaacgtgatgttgccggtggaggaggcggcgatcttgatgttctccttctggagctcctcctcgtcacctctgcccccggcggggagcgcgactgcgttgtcgtagccggnggagccgccgcggcccttggggtcgcggaaggaagagccacagtagctgggca

SEQ ID NO: 25954 - DNA, 438 bp, Zea mays
  Clone ID: cC-zmle189043g12a1
cgcagcagtttattgccccttctttattcaccattcacaaatgtacatacagccagttgtgttcgagcatcctggtccagaatgctcttgctaacagttctggaaggtgaaagaaaacaaataactgaaatttaaccatagtccacagatgacacaatatcacaaatattgccgtgaccgcgagtcatctacgaaaaacttgcgctcatcaacagaaaagaattggacctgactacacataaatacagggaaaaggccatgaagccaatctgttcaatttattcaacacttgccaaactattggaacactgatcaacgatcagtgattcagtgggaggcatctctgctatagtactggtccaaggtcttcgccgggatacggtggagaagttcgcgagggaagatccgaagcaatgtccatgcaagatctagtgactg

SEQ ID NO: 25955 - DNA, 447 bp, Zea mays
  unsure at all n locations
  Clone ID: cC-zmle189043g12d1
gcaaacgtaaagcagattttttattaaagaatatatatttggcatgccgcgacgacaaggcagtgcagagcagcgcagcgcaggccgaggcgccagatgatgacagcttacaagatcacagacacacaccccaacagttgatttattcatgcaaataagcaagagaacatgggaaagcagaatgggtggtattcatgcacgcttcactggcgacaaaacacaacaacaaaaaacggaacttccacatcgncgacgactgtccatggacgcttctctctggcaaggaatctgagccatagggatccaatgtaaccaaatagagaagcaaatttgtcggcaagaataaacatcatgcagnaagggggccctctgcattgctacgcccattgagctgctctgggaggatcttcttccccacatcttcctcattgacccgacttaattttc

SEQ ID NO: 25956 - DNA, 426 bp, Zea mays
  Clone ID: cC-zmle189043h02a1
tttttttttttttttttttttttttttttttttttttttttttttttttttttttttttttttttttttttttttttttttttttttttttttttttttttttttttttttttttttttttgggggaaaaaaattatatcccggggggaaaatttttttttggggccctaggggggggaaaaaaaaaaaaaaaatttggaaaaaaggggggcaaaaaaaaaagggggccgcccggggaaaaaaaaaatctattcttgggggcccccaaaaaaaaaaatgtttttttaggggggggggggcccccaaaaaaccccttccctgggggtgaaagggtataaaacccctcttaaaaaaaaaaaaaaacccccgttgttttgtttggtccccaatctctcccgggggggggcccccccccctggggggtgg

SEQ ID NO: 25957 - DNA, 437 bp, Zea mays
  unsure at all n locations
  Clone ID: cC-zmle189043h02d1
ctccacctacaacttttacaacccgcagcagaacaactgggacctcaacgccgtgagcgcgtactgcgcgacgagggacgccagcaagccgcttgcgtggcgcatgaagaacggatggacggccttctgcgggcccgacggacccaccggacatgccgggtgcgggcagtgtctcctggtgaccaacacggcgactgtggcgttcatcacggtgaggatcgtggaccaatgcaacaacggcggcctggacctggactactacaccgtgttcaagcccatcgacaccaacggacagggcttccatgccggccacctcaccggtaactaccagttcgtcaactgcggcgacaactgaactgatagattattcacctgtgcatgcacttatatgtactagcaccattattccacgagntatatggatgtgatcccacacg

SEQ ID NO: 25958 - DNA, 478 bp, Zea mays
  unsure at all n locations
  Clone ID: cC-zmle189043h03a1
aagccacgaagtcttaatcttaagttgaccagaaatgttaactttgatgacaaccactgaattcaggcagccatcgttcacgaactacctctcacagacaacatcgagacgtttttgacaagaaaaaggaaggaaagtccgattgaaaacaacatattgtaagcacagaaatccatggcttcgcagaaatttgaccttcacaagctcgttcttttctacccttaatgacaccgtcaccagcttttaatcagaggaatggagtatcttcaggtaaggcagttatttacagctagcaatcggagttggtgactttttgcactgacatcaggtggggaaaaaatctccatgtcaatgaagccaatcaccggctgaaattgaactttggctactgataatcagggttgaatgcaagagcctcttggtagataagaccttcatttgntcttcagacaatgcatgctgcttcgagtcaaagctg

SEQ ID NO: 25959 - DNA, 610 bp, Zea mays
  Clone ID: cC-zmle189043h03d1
ggtgagtataaaggcaccgtcgtaaacacgttctgaattggataccgattggagcagacgactgggtttttgatgggcctcatgaatatgaattggtggatccgggatctggcataaatgatacgtggaaataaatctttgtcagaggagcactggcggtattttctttatcacacttcttcgcggcttgaagtatatacattccgcaaatgttcttcaccgtgacttgaagcctagcaatcttcttttgaatgcaaactgtgacctcaagatatgggattttgggcttgctcgcaccacctcagaaactgattttatgactgaatatgttgacacaagatggtatagagcaccagagcttttgttgaactcctcacaatatactgctgccatcgatgtgtggactgtgggctgtatatttatggaactgatggaccgcaaacccttgattcctggaagagaccatgtccatcagctacgtcttctaatggagctcattggcacgccaaatgagggtgatcttgatttcgtaaatgaaaatgcaagaagatatatgcgccaacttcctcgtgacgctagacagaacttacctgaaaaatttccacatgta

SEQ ID NO: 25960 - DNA, 296 bp, Zea mays
  Clone ID: cC-zmle189043h04d1
gggtgtcttgagttcatgggttgtctcatggagacccagtggtaagatccaaccagttgtaaattgtgccttttcagattcttgccacgcagtatgcttctggaagtcaggggccctctgctcaaacctactcttactgaaagtaatttcaagcaaaattttcctacgatcatatgacatttccatcaaacaataaccgaaacactacttccattcgcaactctaaaattttacacgatcccaaaaatcttacagccttggtcagactatctgacccacgctcacctgggggtagg

SEQ ID NO: 25961 - DNA, 376 bp, Zea mays
  Clone ID: cC-zmle189043h05a1
agtacaacataacattttgaacatatgcaagccatcatttttcaccggttcaccatcctaatgtggtctcctattgacccgagtgcactgcactaaggagcatcaaggtgaggcagaaccatataactacattcactgactcaactgaagctagagcagataggtcccttggacaaaccaaggcgaacctacattcctgggggcatgaaaggttgacggaaacccttataaccttgaggcatgttaagatcattttcaaaaccaaaaacatctaaggaacctgccaatgcctcatatccaagcagagatgatggcaaagcaccagggggcctttggaaccatgagaggatttgggcattgggaaccctgcggatgt

SEQ ID NO: 25962 - DNA, 446 bp, Zea mays
  Clone ID: cC-zmle189043h06a1
gagtaaaaaagcgacagcccgaatttgcattagcaagtgcattacatacacgattcctcctctgctctccaaagttttccatggtatacatacaccttcccaagatccatgacggcggtcggacacctaccagttctacactcgaatgactcgagctgagcgtaccagaccccctggatcttgacatccttgggcgcctgggccccgaggtcggagtcggacggctgcacgctctcgaagacgccgatgacctggccggtcttcgggttgatcttggcgacgctcaacgtgatgttgccggtggaggaggcggcgttcttgatgttcttcttctggagctcctactggtcacctctgccctcggcggggagcgcgacggcgttgacgtagccggtggagccgacgcggccctaggggtcgatgaatgaggagccactgtagctggg

SEQ ID NO: 25963 - DNA, 388 bp, Zea mays
  Clone ID: cC-zmle189043h06d1
cacgcgttcggagattcgtctcgccggtggaggaggtgtatattcatattgtattattgccgctacgacgagggcagcctcgctccatgccgtggtcaccctgatgcatgcggccaagatcgggtgggcgggcgctactttgtcttgctggcgttccgaccgtcttctgaactcgcctgcacggcgttcggcgtagacgccggcgccggcaggatcacgtgctccgtgcaggacgtcatcagcaggtgcgtcaactccgcgaagctggccggcttcgcgctcgccaccttagggctcctcgtattgggcgcgagcgccgagggtgcgcccaagatgctgacctacgaccagatgcagagcagaacgtacatggaggtgaagggcacgg

SEQ ID NO: 25964 - DNA, 475 bp, Zea mays
  Clone ID: cC-zmle189043h07a1
ttttgaaaacagaggttatagtttacaatacagtttgaaacggacaaaaaaattacatgcacagccagtgttgagacatcttctactctcctgtgcttgcaagtcgacgtgataattggcggtgctttattaatttgcttaggagataaggtcatcctccttgtgcgtctcgatgacgacgtttgagggggggtacgccacgcaggtgagcacccagccggcggcgatctggccgttgtcgaggaagctctggtcggactggtccacggagccggagacgaccttgccggcgcaggaggagcaggaccccgctcggcaggagtagggcaggtcgatgccttcctccttggcgtagcccaggatgtagacgtcgtcgggcacctgcagatccacctccccctccggcgtgatgagctttacgttgtaggtggtctgcgcgcgcatcctgctgctggcgccaccgccacgggttatg

SEQ ID NO: 25965 - DNA, 436 bp, Zea mays
  Clone ID: cC-zmle189043h07d1
atctgtggcaaggaagctatctgaccaccagaccagttttatcatccgttcactccagccattacccgcaggtagcatgcaaatggacactgacctgagcagcccccgcgcgccggccttctgcttctacctccgcgccgagccagcgtccactaccgtggtcatgacccgtggcggtggagccagcatacggatgcgcgcgcaggccacctacaacgagaagctcatcacgccgtatggggaggtggagctgcaagagcccaacgacgtgtacatcctggactccgccgaggaggaaggcattgacctgccctactcctgccgcgcggggtcctgctcctcctgcgcacggaaagtacgcttacggctccgtggaccagaccgaccagagctacctcgacgacggccagatcgccgtcggctgggggctcacctg

SEQ ID NO: 25966 - DNA, 488 bp, Zea mays
  Clone ID: cC-zmle189043h08a1
caatcattgaatttcttttattaaaaggcgtcattggtattgccaccatgtaagtgcatagttcaatttcacccagaaaaccaagaatattccaacaaaaaaaaaaggggaaggtgcagggaacaaaacacaacctggtggtttcacgctatacaagggcgatagatttgaagcccccttcattaatttgtgtggcaatagaactgtcacccgtcttgattatcttgccattttccatgatgggaacgtaactgggcttaatgagatccaaaagacgttggtaatgtgtaatcatcagaacagagttttggggtgtcaacagcccattcactgcattaacaacatcttgaagtgcatcaacatttaaccctgaatctatcttgtcaagaagggctaaatctgctccaatgactgaaagctgcaatatcttattacgcttcctttcaccaccgctaaaaccttcattcacattgcgatcaaggaacttt

SEQ ID NO: 25967 - DNA, 578 bp, Zea mays
  Clone ID: cC-zmle189043h08d1
tggcgcggactcatggggaacggtgacgcgcctcctgtcttgttttcctttcatggcgccgaccctcgccgacgggtgatcgacgtcgcccctattcatctgcttgatggtcccgccccatacgccgatgctcacgcacctcctccttctatctccttacagacgcggggacgctcgcccacggcggcggcgggagctgagtcttctgtcagcacgctcctcgaggtgcgcggactcaccgaatacgtgaaggagactgggcagctgaatcctagccggcgatcaccttaccatccgcgagggcgagattcatgctattatggggaagaacggctgcggcaagagcaaccctcacaaaaggtctcactgggcagtctcattatgaggtgacgggtggcaccattctcgtggaggggggggacctggttgacatggagccatatgacagacctctagcaggccttttcatgaactcccaagcacctatgtgagattcctgaatcaacaatttcgattttgtgctatggctgcgaatgctcgctaagaaaggaatggtctaccagcattgggggcccttg

SEQ ID NO: 25968 - DNA, 408 bp, Zea mays
  Clone ID: cC-zmle189043h09a1
gcaaagaagctatttgccgtgtgctaaaaacacacctggcaacaaagcttttatcgagtgttttctcctatcatattttgtttgatactcggcaaaaagccggattacagtagtgaattcaatgtatttaatacatctttcttaagtatatataacagagtgacgtgtacacaagaataaaaacaagtactgtgtgggatggcaatacagctatccatgccatgaaagtagcagtgaaaaattacattgggaacctagggctctatatattcgttcatgatattcatgctcccctaacagcacagacgggtgtaattttcgcgaacgtttttgagctgttccttagtgttgtgatacattcattgattaacaattggggtagagcccgagcgggcactggtgatcatt

SEQ ID NO: 25969 - DNA, 315 bp, Zea mays
  Clone ID: cC-zmle189043h10a1
ttttgtttttattaacgcagaataacatcccgtcgggggataggttttacatcgagccgtaatccatgctgccagctgcatggggcttctgtaacctagggtgaacacagcactaataattcacccaaagaaaacggggaaggggcaggacaaatgggcgatactgctcattatacgtaataaaatggacactctgggcaaggcgaatcatttaagttgtgtggaataaaacatgggcgctcgggcgattatgttcagattctccatgtaccgtacgaaatgccgtttccgcagacccagatgacaccgccgggg

SEQ ID NO: 25970 - DNA, 389 bp, Zea mays
  Clone ID: cC-zmle189043h11a1
attacgaagaagttttattcaggtcacgagcttattgttcgaattcgtccaggagctgagtgcgtgcacgtacgatagccaagtaccatgaccctgcacaaccagtcaaccacagacatacataaggcgcgcaggcatgcacgaacgggcgtggatgccggccgccgggcggaatcatttagccctggcgaggaagctatctctgcgctcgtggacactatcggtgcaggtgtcgatgtccacctcgaacctggtctagcgcaccacgaagccgtggccgtcgtggtgaccatggtggtggtggtggtcggttgcagcccgaccgtgagagccggtcgaactgttagaacttttacttgaggacgtgctgctggactcacgctccgggc

SEQ ID NO: 25971 - DNA, 340 bp, Zea mays
  Clone ID: cC-zmle189043h11d1
cgtcgccctttttttttttttttttttttttagtcgttcgttctttttttttattaattatttgtttactaattttttgtacgaatacaagtgtttccacattgaaccttacgctggctagccagaagttatcgcacttaacgaaaccccatgcatggggatatacagatgattctgatcaaacgatctctacccttaatatccccttcagcttatgtacataccagtcactccttagcccttgctcccttcagaccatgcatgcattgcaacacgggccgaatctgtaccctccagatagattaacaacacacacaaactgatccagaaagagaactta

SEQ ID NO: 25972 - DNA, 468 bp, Zea mays
  Clone ID: cC-zmle189043h12a1
ataccaatgtcccctgcgccatagataactacaatttcaagataacatcctttttttccccaagcttattcatctgccggcgtaacactgagaagccatgtatctgcatatagctgttggtgtgaacaaacaatggaaaacaaacagtagcacgagcttcaacgcagaagtctacaattcagaaaccacggataaaccacgaacatatcagagggttatgttgtgctactgataattcgactatagcttgcaatacatcttttagcaaaggcaaactctgacccacatctgctggccccccagttacacgtaactgtctatcagagacttcctcatgtcctccacaatcgcagtgggctgcccttctctcagcttgaagacgctttcgatgactgagagctccgtggctgtcgtgtccgagccacaaaaggcagtccagtcgttcactgtcatgcctgcagcaatgac

SEQ ID NO: 25973 - DNA, 297 bp, Zea mays
  Clone ID: cC-zmle189043h12d1
gggccccaaaaacttattttctcagggggtccacgggccgtggacccaaaaaaatgtgtttcccggggagccctttttctgggggagggtgcccccagggccaaaacaggaccccccccttattgggtccggacccccaagggctttttttggtcgccaggggccggtgtgccaaataccccaaaaaatgggggttttctccaatgggctctctttttttgagggcctgcaactgcaggaaagcgggggtgaccaccaccagggcattgggggagactagagggccctgccccccct

SEQ ID NO: 25974 - DNA, 336 bp, Zea mays
  Clone ID: cC-zmle189044a01a1
gcttgaagtcgttcgtgcttgttttacaccaaaaataagtatactagtgctactgctaattcatgtgtggggacttcgctgccttccctggctggccgggccgagagaaacaaaacgaagccgcatgcatgggaatttaccacggacgctgacctaaggatcacataccatgacgacccggtcgaggtattgaacaccccagaccctccgcagccgtcaaccccttaagaccatgcacgcattgctacacgggcctgaaccgtgccgtcgaggttgattctcctcccacacaacctgatgcagaccggaacttcagggtccaataggggccttcca

SEQ ID NO: 25975 - DNA, 196 bp, Zea mays
  Clone ID: cC-zmle189044a01d1
gacccacgccgtccgcatctgctcataggcgtcgtcgagcccttccttaggccatctctatgccgcctctgcccgcaccagcagtctcccatcgagagcgcatgcctcaagagcggagagccaagaggcagagtagagctccccagagccttcctctctcccctctctatcctcagacgagcaagcctaggcaggg

SEQ ID NO: 25976 - DNA, 388 bp, Zea mays
  unsure at all n locations
  Clone ID: cC-zmle189044a02a1
ttttgacgttttcttttagagtgcaattatatattttttttaatggatgaaatttagagaacgtagctagagaccgtctaaggaatgaaactttcacagncttagagtgacaacaataaaattgaacccgataagagaatgaatacatgttggggtgctcacaagtagcctacatcctcgtcgaggagagtccaaactataatacacaccgctagaacagcaacatattctagcaggtctgcgcggatagatgctgggcattacgccactgagcaggttgctaccggagacctccatggacgaatagtagagatcatccatccgagaccccgatgctgtgggtgtgctggagctgntggagcccatccccatgacgccagactctgac

SEQ ID NO: 25977 - DNA, 258 bp, Zea mays
  unsure at all n locations
  Clone ID: cC-zmle189044a02d1
acccacgcttgcgcggacgcgtgggcggacgcgtgggcgggagctggacatgatatggcgcttgacgccggggacggagtacattgcatcgtctgagtctggcgtcatggggatgggctccatcagcaccagcacacccacagcatcggggtctcggatggatgatcactacattncgtccatggaggtctccggtagcaacctgctcagaggcgttatgcccagcatcactccgcgctgacctgctagtatatgttg

SEQ ID NO: 25978 - DNA, 475 bp, Zea mays
  Clone ID: cC-zmle189044a03a1
agagccagcccttttttttttttttttttttttttttttttttaaattgtatttttttttttgggataaggtaaaaaacagaaaaactaacaaaaaaacaaagaaggaaaaagaaaggaggcgggccaaaaaagaccacaaaaaagggaaggaaagcagagtcttcagggggggaggcccggaaagagccaggaacccaggccccaaagaaaacaaaaggggggaagagaagaaaaaaacaacacacaaaaaaacaaagaggaagagagggggggggaaagaggaacagccaaaaaacgggccgctgaacaagagcaaaaaacaggaggggaggggggggaagccccggaccgggaccggcaggcgggcaacaaaaaacgagtggcgggggagaggaaaccgccggggaaggaggacgggtaagggcaggaaaaaaaggacgggcaccaaggggagaaggggggggggggaacac

SEQ ID NO: 25979 - DNA, 205 bp, Zea mays
  unsure at all n locations
  Clone ID: cC-zmle189044a03d1
gaattcccgggtcagacccatcgctgtccgtatgattcgcgatgcggagcctcttttttttttcctgtcagtagtgattatcttactgtcctctagagtagctaggtttcagatggatccagtntgatatgttgctatgctgagtagtagagttttcattaggagatcagtattccattacattacataggctttggcttctgta

SEQ ID NO: 25980 - DNA, 269 bp, Zea mays
  Clone ID: cC-zmle189044a04a1
gcagtcggggagcattcttcttatttaagaatatttttttaggcatgcctcgacgactatgtctagtctagtatctcatcgcaggcgggggtgccagatgatgtctgcttacaagatcacagtcactcaccccaacagtggatttattcatgccaataagcaatagatcatgggaaagcagaatggtgggctttcatgcacgcttgactggtgacaaaacataacaacaaaaaatggtacttccacatcgccgaagactgcccatgaga

SEQ ID NO: 25981 - DNA, 436 bp, Zea mays
  Clone ID: cC-zmle189044a04d1
ggcgctggatagccagcaagacggccaggtccgagcgcgtcttcttcgactggaaggactacctcaggttctacgacatgggcacgtactggccctacacgccctccatccagctcctctacggcctccgcaccgagctcgacctcatcttcgaggaagggctggacaacagtcgagaggaggcacaaccgcctagggacagccaccaggctcgccgtcgaggcgagggggctcagcaactgctgccagaaggaggagtggttcagcgacaccgtcaccgccgtcgtcgtgccgcccaacatcgacagcgccgatgtcgtcaggcacgcgtggaagcggtacaacctcagcctcggcctcggcctcaacatgatcgccgggaaggtcttcaagatcggccatctaggcaacctcaacgagctgcaacttccgggat

SEQ ID NO: 25982 - DNA, 338 bp, Zea mays
  unsure at all n locations
  Clone ID: cC-zmle189044a05a1
ccggcgcggaaggtctatgccttgatgaacgacgactagaggaaccggcaactttcgcgtgctcgtttgcttggaggctgaaaatataaaagagcttggacggctgctttatgcaaagctctagcaagctgctagtgctatgcactaaaaataataggaataataataaagttcggnacttagcttaaagggaaccatactttttccctcgcgatttattattattaattatggcaggttgaataatgaaaaccatttgtaattcctgtgacaattagtttatgcgtccacactagaaataaaaacttggtcgaaataaactacagttgtttttcgtt

SEQ ID NO: 25983 - DNA, 180 bp, Zea mays
  Clone ID: cC-zmle189044a06a1
ctgaacacaagcatgtatcaggctcctatcatttgacagtttgcatttagcttccatgcgggagatgagtcttcggaatttccgacaatttcccttgttatggatgcctgtcaggcatgcataacccaaaccaaagacctcctaagaggtgcgtgtgctcacaactggtagaaagccccc

SEQ ID NO: 25984 - DNA, 720 bp, Zea mays
  unsure at all n locations
  Clone ID: cC-zmle189044a08d1
aaagaaaacaaaaaaaaaaaaaaaaacaaaaaaaaaaaaaaaaatcaacaaaataaaaaaaaaaaaaaactaaaataaaaaacaacaaaaaanaagaaacgacccatcgaanccaaaaanaaaaaaaagaaaaanccaaaanggaaaaaaaaaaaaaaaaagaaaaanaagaaaaaaaaaagaaatttaaaaaagaaaaaaaaaagaaaaacagaaaaagaaaagaaaaaaaaagagaaagataaagaaaaaacacaaaaaagagaaataaaaaaaaaaaaaaaaagaaaaaaaataataaagaagaaaaaaaaaaaaaaagaaaaataaagaaaaacaaaggaaaaaaaacaaacaaaaaaaaaaaagtcaaaaaaaaaaagaaaacaaaaaaaaacaaaagaaagaaaaaatagaaaaagaaaaaaaaaaataaaacacaaacaaaaaaagagaaagaacaaaaaaaagaaacaaaagaaaaaaaaaaaaagagagaaaaagaaaacgacaaaaagaagaagaaataaggagcagaaaaaaatcaataaagaaataggacagaacacaaaaatggaaaaagacgatttcataaaatacaatgaacaataaaaaaagaaatatagaaaaaaaaataaaaagaggagaaaaaatagaacaaacggaaaaatagaaacaaaaaacaccatgaaaacaacaaaaagaaaaaggaaagaaaaa

SEQ ID NO: 25985 - DNA, 309 bp, Zea mays
  unsure at all n locations
  Clone ID: cC-zmle189044a09a1
tttttaggttttttttttttttttttttttttttgaagaggagaaaaagtctggcttcgaacgagggttctgttcaagtaaagattttctttaaagaatggngagggatcggggaagcactttgcttcttgttgtacgtgggggaaagtgaagaacggnttcagctacgctggcaatggcctccctcccagaatctgggtggcgacccagatgtgagctatttcttttttggtacgaagctagtcagggcaagcttgcaagccaagagagttttcttttgacgcactcaagctttgctttcctggcccg

SEQ ID NO: 25986 - DNA, 162 bp, Zea mays
  Clone ID: cC-zmle189044a09d1
gtcgactcacgcgtccgctcttcccctactcggtgttcgcccgctctcttccgccctacgtcttggcggctttgccatccgactcaccgtccccggggactgccgcatccacctggagcatggcttccattagggcgttgctgccagcactctgacattccc

SEQ ID NO: 25987 - DNA, 243 bp, Zea mays
  Clone ID: cC-zmle189044a10a1
cagaaatatatcgagataaatctcattctatttattgatttttgctaggaaacacacgtggggaagagggccccattatcgtgtacatcccatatgtaatctaaaagaaggcacctccaacgatgggttgctgcctcgacaagtctggattcatcaaagagaactggtggtatggcagcaattgtagctgctgtaggaaggcggcgaccaaagggttagccactaccaatggattaagcatct

SEQ ID NO: 25988 - DNA, 220 bp, Zea mays
  unsure at all n locations
  Clone ID: cC-zmle189044a10d1
cgcgtccgattcacgaaatattgttttttttttgctgtaaatccctgctgttatgcttggatttttggaggggttgtgtcggaacaccggtgtatttttagatatttgacacaactgtgacacgagggaaggatgtgctgatgtgtattggctctcttgttctctaagtgatatgttttatcataaatatatnatattttaaatatctcatttttttctg

SEQ ID NO: 25989 - DNA, 260 bp, Zea mays
  Clone ID: cC-zmle189044a11a1
tttttattgattttcagatttttgaaccagggatcaggacggtggtgctacttgactggggaatataaaggacttgggattggagcttttatgagcactgctacttgtaatggccacatagcatggctctgtcataattctggtgatcaccacatccaccatcagcaagctatccggttgcctatgaagaggcagcctcagacaagctcctgagctgcaacatgcctagcaatcgggaccctgaaaggggagcaagaaac

SEQ ID NO: 25990 - DNA, 503 bp, Zea mays
  Clone ID: cC-zmle189044a11d1
cgactccacgcgtccggccgatcatacacctacgctttctcattacggggctgaacacgaagctattgcaggagcacagccactatcgggccccgttcaatatactgggggacaccttgcgcggcatgattccgcacaagaccaagaggggggaggcggatcttggggggcttcaagacgaactaatgctgtgccatcgtcgtgccacaagacccagcgcctgatcattcctgacgctcttaaggtcctgaggctgcaacctggacacaagcactgcctccttggtgagctatctaaggaggtttgatggaactaccatgacaccatcacggagcttgaagagaagaggactgataaggcccaggtggcctatgagaggaggaagcatctggccaagctgcgcctaaaggcttaggctacagccgaggagaagttagggtcccagctggacattcttacttcgatcaagtactgaatttgtggaacatttgatccatcgggtt

SEQ ID NO: 25991 - DNA, 403 bp, Zea mays
  Clone ID: cC-zmle189044a12a1
ttttgttttttttttttttttttttttttttttattttatatgggatccatcggtttgaaaccatcaaattggatccccttccatattccacaagctggggctaggtcagctcttcatttgcaagctgctttgataatttcattaccttcacgagcaagatcgcgccctttgttacgagcttgtacacaggcttctaaagccacacgattagctgctggaccaggggcttttccccaaagatgacctaaagttcccccaccaaatgggtatacggaatcatcccctatgatttcgggcagagctggcatttgcctaacatgaatacccccaaaagccaccgagataacacctgggttggatacccagccctgagagaataagattccgcgagaacgatctttt

SEQ ID NO: 25992 - DNA, 470 bp, Zea mays
  Clone ID: cC-zmle189044a12d1
cggacgcgtggggttgatgggaatgagtacattgattacgttggttcctggggtcctgcaatcatcggccatgcagatgataaggttaatgctgcattgattgaaactctgaagaaaggaactagctttggtgctccatgtttgctggagaacggattggctgaaatggccatctttgccgtgccaattatccaaatggtccgctttgtcaactcagggacagaagcctgcatgggagcgctccgcctcgtgcgcgcattcaccgggcgggagaagatcatcaagttcgaaggctgctaccatgggcatgccgattccttcctttgtcaaagccggcagtggtgtggccacccttggccttcctgactcccctggcgtccccaagggggccacctacgagactctaacggcaccctacaatgatgttcaggcagtgaagaaactgttccaggacaacgccggggagattg

SEQ ID NO: 25993 - DNA, 447 bp, Zea mays
  unsure at all n locations
  Clone ID: cC-zmle189044b01a1
aagcgaatgaaatcatcgtcagtaaagatcaaactctaccaccagtacaaatcccgtccctgcgctagtcggagggagcatccaacatggccatgaaagcaacaataaagcagaaaaataaatctaaacagtgcagcatcacttcgcctaataaatctaaacagttgatgcaacaagccatgagcacctgattcttgaagtgtttgcaaacatacgaaactgacgggacgccccagtacaattaacctcatcccttcgcctaatagttagccagaaatcatatgggaagcttattcagtctcggcagcaacaggtctccgaagagccacaacagggctcctatagactatatgaactcgngataccaaaggtgacatacataactcatcacaactttcctgtttgaatcaaaatcaagagtcaagaccctctacaacctaataaaaa

SEQ ID NO: 25994 - DNA, 463 bp, Zea mays
  Clone ID: cC-zmle189044b01d1
cggacgcgtgggcggacgcgtggggctagactggtaagatctttgagtaggtctgagaggcatgccacatatgtatcaacaagacaccaatttatggggataatggctcaatatcccctggtggtgagcggatcggaacacctgcaatgactactagaggtagcctagaagaggacttcgagtcgattgcagacttcctcataaggtctactcagattgctagcaatgttctgaaagaacatggcaaagcgcaaaaggagtttctaagaggcctaatgaacaataaggatgttatggaactccgaaatctagttgtggcatttgcgtcacagtttgctatgccaggttttgatgtatgaatgtgcatatatactggagtcagcaattatccagattcacagcaacattgtcatccgctcagttcctcgaatactagcaagtgttgctctcgactgcacaacga

SEQ ID NO: 25995 - DNA, 403 bp, Zea mays
  unsure at all n locations
  Clone ID: cC-zmle189044b02a1
aaaaaaagcaccccaagaggccctgggggtttttttcccggttttttttccaaaacccgggggggggggacggggggtttttccgcctgtacaaaacaaccccccccattttttcggggggggggggggggcaggggggggggaacagggggcccccttagggggggcccacccggncggggggggggaaaagcggggggtntaatttgggcccccccccccttgggagggcccccccccgcttgttcggcccgggcggggggggccccccaaaccccctgggggggggggggggtcctgggggnccctccccaagggctttttttgttttgggacaggacccggggnnnnncccccccccgcccccgggggggggggcccgggggcccgggggggccccggg

SEQ ID NO: 25996 - DNA, 374 bp, Zea mays
  unsure at all n locations
  Clone ID: cC-zmle189044b03a1
acatgtcaggacttgagtgtattggttagactaaaaccaaactttacatgaatcttggttggaactatcaaacttagcggcaaaacataagaagttattacacacgcacgcaaacacacttngacaaacattatcttcatggggttataagaaattattcgattgccatggtttgccaaagatataatagggtaacacttatactcaatatgggacttggccaactccatcatgatggaaaaataggctaaggtggggttaacaataagcattaaatgtctcttgacccacaaagcccaacctgtagcgcaattccttgagaagaaagaggacacgtgcctgccatgtctgctgctgaatgtaaaagcaatgcc

SEQ ID NO: 25997 - DNA, 475 bp, Zea mays
  unsure at all n locations
  Clone ID: cC-zmle189044b04a1
ggcgtccgccctagtccccggcggcgacctagcgggctccgctgagctctgactggtgcttttctagacgaggagctgcggcggccaagaccaatcgaccatggctacccgtctccagttcgagaacaactgtgaaacaggggtttgctccaagctgacaaatgcttactgtctggttacgattggagggtcagtgaacttattcagtgcctgagaggctagagctcgcagatgccatccctgaggccaagacctctattggaggcacttgaataataggccgactttgggtcggaaacaagaatggacttctatagccacatactactaccgaccaagagcttcagcatctgaagaattgcttgcctgatcaagtggnggttctacgcatagatgagatgtgatctgcccttggcaattgcataggctgcattgaccatgttgcacttacgcaccctgaccttgacaaggagac

SEQ ID NO: 25998 - DNA, 214 bp, Zea mays
  unsure at all n locations
  Clone ID: cC-zmle189044b05a1
gctaacgagcagcagatgttctattaaagattttatttttggcatgcctcgacgacaaggcaatgcatcgcatgggacctgaggccgcggcgcctgatgattactgcttatcagagcacagccacacaccccaacaggnggtctttacctgcgaataagcacgcgcacattggaaagcagattggctggttttcattgcacgcttcactggcga

SEQ ID NO: 25999 - DNA, 188 bp, Zea mays
  Clone ID: cC-zmle189044b05d1
ttttataaaaaataaagggtgttgattcgaggcaaagaatggtatataaaaagagaggggaggttgatgaatatgtgagacgtgaggtggaagatggtagatgtgttaatatttgggaacgaacagttctgatgagagaaaaggtgttagaaagtaataaatacaatgggtgatttatttggagtaga

SEQ ID NO: 26000 - DNA, 323 bp, Zea mays
  Clone ID: cC-zmle189044b06a1
aaaccgaaccagaataccggattacttaaaacgcgtgccacgataatattgttcaccaacaaaaggttctaacgcggatacaccgcgacgacgacgataaatcgagcagcgactgggccagccagccactgcagcagacacacgagactgacacaaaccgcttagtccacctcctcgatcttggggccagggccaccgcttccagccggagcgtcctcgtccatgccgccggagcctcccatgtcggcacccgcgccctggtacatcttggcgatgatggggttgcaaaggctctccagctccttcatcttgtcatcgaactc

SEQ ID NO: 26001 - DNA, 315 bp, Zea mays
  Clone ID: cC-zmle189044b06d1
cggaattggttgatcgacccacgcgttcgctagcactatgccgctgggatcgcctctaacatcgaagctaaccgtatggacgaggcggaggcagtggtgggcaagtgacgtactgtccctcgtgcgggccctgcgcttgattttgtgggtgtttgctactacgtactagtactacttaccttcgggccggtgtgccttcgaacgtgtacggtaactagaagcggtcagcaccagctacacaaaacactgcggatgctacttgtgaacggaatataacctgtcaatcatttttagaatcaaaataataattaattg

SEQ ID NO: 26002 - DNA, 358 bp, Zea mays
  Clone ID: cC-zmle189044b07a1
gacagcctccttcgaaggacaagaccaatctcatatctgagcatttcgtttttgtaataacaataacctttgggggcagaaaccaactccggcataaaaaggactgggataccgagattatctcaataggggcccctacaaactgaagatgcaatgacttagagaagcttcactcgctgaggtttggatagatctttcagcacgcctgaatcagccaaggacagggaatttgcgtgttacgggtccaaacggaaggatatcggctgggttcttcttgagctctgggggattgaactcattacgcggaagaacaatcacttgagactggccacccttttcaatcacccaacctgaggtc

SEQ ID NO: 26003 - DNA, 400 bp, Zea mays
  unsure at all n locations
  Clone ID: cC-zmle189044b08a1
ttttagagagcggagaaccgatacaggcatttgatacaggcagtaagtacgaggatcgcgatattcccacagtaaccctcctacattttgccctggctggcgttgtacacaaccttactgaccttgtactccaccacaacgcccggcttgccttcacccgttacgaaaaggcccgcggcaacataagttccattctgaagttccttgtatttctcatttcccgtctcgaatgagaagttgacaaatgaatcgccatagtcagttgtcttagcatcgggagcaccagacagcactttgccgactccctgcgtgagcttcacaggacctttgtaatacatcgccagaactgagccgncgaggttcttgacttgactcctcacgtccaagcgcatgtttccgc

SEQ ID NO: 26004 - DNA, 178 bp, Zea mays
  Clone ID: cC-zmle189044b08d1
aattggttggtcgacccacgccttcgctcaaatgcctgcgggctcacacttcttataagactactttacctttttatactccttatcgaggatggtttgttgagggtagcatatatcttaaacttacacttttgtaatcactccgatgataataacgctcaatttttgttactggaaa

SEQ ID NO: 26005 - DNA, 392 bp, Zea mays
  unsure at all n locations
  Clone ID: cC-zmle189044b09a1
aaccaaacaagtaaaaaaccatatggattacttgcattacataatctaaaatacacctgctaagtacttagtccctccagtgtccgcagtacaaccataagagttgaaacactaacaagncacagaagttcgaagtcataagtgctgaaacactagaagacaaccataatccggtaacactgaccaagctatattgctcctcttctcgaagagagctgtttacaatgaccaatttcttaatgccaagagcacctgtaacccgatccatcgncacctatccatgaagagcttgtgatatcgccactacacaaccacactggatcttgggcagcaccggagggtcgacgaccaccctgagctcaccgacctggatcttgggcgccacccagacc

SEQ ID NO: 26006 - DNA, 528 bp, Zea mays
  Clone ID: cC-zmle189044b09d1
cacgcctccgagcacttctacgtcacacgggcgctgcgcacagacacaccaagcgtttgcacctatggcttactaccaagaggtggactactgctcggaggaggtgaggtcggtggccccggccggcttcggccgccacggcggcggtgtccagcagcacgtcgtcaatgagaagctcgcggaggtcgacacggtctcacgcgccggcgcctaccaccaccaccaccatggtcaccacggcggccacggcttcatggtgcgcgagaccagggtcgaataggacatcaacacctgcaccggcgaggtccacgagcgctgggagagcttcctctccagggctaactgagccccccgggggccggaatccacgcccgatcgcgcttgcctgcccgccttatgtatgtctgcggttgactggttgtgcaggttcataatacttggttttggtgcgtgcacgcacttaatttcttgacaattacaacaataagtctttgacctgaataaaattttgttcgaatactattccct

SEQ ID NO: 26007 - DNA, 432 bp, Zea mays
  unsure at all n locations
  Clone ID: cC-zmle189044b10a1
ttttgacaatcataggattcaaaacaatctgcatcattcagatgagctttcagtaattctaattctaatatgaaaaccatacaaatgcatatgcatatgatgcctaagaggatcttacctaactgtctagcagncagaacgacaactatgtggtctgtattctctcccaaaattcatcccctaatttttagtttcatgtagccttcatctcgtacaaatttcacaaaacaaaaggccaaacacaatcacattctcctatatctcacacacctgttatgggtcctcttcgctactgagttccgacctaatcccaagcctccgatgcttccatggcgacgccacgctacctcctgcttctcttcgacacccttgccgccctcaccctcgccttcgttctcttgcaagtagttaagtagctagaggatgcacttc

SEQ ID NO: 26008 - DNA, 395 bp, Zea mays
  Clone ID: cC-zmle189044b10d1
caaccacgcattcggcttctgaagagcgaaagactttttgctatacactagagacggtaagccttagcgcaccaacagaggatacttgaaatctgtctgcctcacgaagcttctgtgccaactccatgtggacaagtaaccaaaaagagaacaagatgtttagaagaggcactcggctactatggctagggcacacccaaccggggggacaaggtgttcaggcgccatgggaggcatcaagtctgcctaggaggtgcgctgccactatgaaaaacttgattacgacgtcaagatgattgagtcatgcaatgtgccgtaccccaatggcaagacacagggagtctggagcccaggataaaaaatggtggaggctcaaagaggcagaaacaaagctt

SEQ ID NO: 26009 - DNA, 409 bp, Zea mays
  Clone ID: cC-zmle189044b11a1
ttttaggccaaaaaggattagaagatctatgtatgtaacatgccgatcaggttgttggttctgcactttcctacttttgagctgctcacaaacacctacactacgtacgcgggtcatcatcggcatatctacaaaacttttgcttcctacacagtctcatccatcatgcactgcatcgtagtcaggcttcctcggctcagagctccaggtgctgctcgtagcacagctcgctcatgcagaggggacaggatctcttcctccagcatcttgaggacagcgctcatggacggccgctgcgccgggtctgcgtcggtgcacatcgctgcgatgtccaggatggcttccacggcttccacctcgacgtcgccgcatcgctcgtcaacgatatcctccagccggagctcccccg

SEQ ID NO: 26010 - DNA, 564 bp, Zea mays
  Clone ID: cC-zmle189044b11d1
cagccctccaggctcgaaacctaacccacccgcccggggatcccattcggcggcggcggcggccatggagccctcccccgtcggcgacggtggctcggcggagcggtggcgcgcggaggcgtcgcgggcgttccagcactacctggaccgcgcggtgccgcacacggcggggcggtgggcgggcacgctcgtggccgcggcggtgtacgcgcttcgggtctactacgtgcgcggcttctacgtcgtcacctacgggctgggcatctacctgctcaacctcctcatcggcttcctctcccccatggtcgacccggagctcgaggcgctcgaggccgggcccgggctccccacccgcggctccgaagagttcaagcccttcgtccgccgcctccccgagttcaagttctggtatgccataacaaaagccttttgcattgctttcggcatgaccttcttctctgtattcgatgttcctgtcttctggccaatacttttctgttactggatggtgctctttgtcctgacaatgaagcgacaaattatgcatatggtcaagtacaagta

SEQ ID NO: 26011 - DNA, 347 bp, Zea mays
  unsure at all n locations
  Clone ID: cC-zmle189044b12a1
gggaggggcaaatcacatgcctgttagcccaaaactccagatgggacaccttcccaaggggccttaactggtcagcttttaatatgctgggccaccactttnctggtaaaaaaggttctttacctggagggtagcccccaacttcctcttattaccaaaaaacaggggggtaccggggggggaaaaaaagaacccttgggaatgacaaaaggaatccccccctcaccttttcaggttggaattaagcctggacagcccttcggctggcactgcttcgaacggaggcaaaaggccaaaatctacctggggaataggaacatccacaatgggcccgctaaaaccatttt

SEQ ID NO: 26012 - DNA, 563 bp, Zea mays
  Clone ID: cC-zmle189044b12d1
actagttctatgatccccagggcagctctggtggctgatgagatagcggagcaggctgaattcttctccttcggaacgaacgacctgacgcagatgacctttgggtacagcagggatgatgtgggaaagttcattcccgtctatcttgctcagggcattcttcaacatgaccccttcgaggtcctggaccataggggagtgggcgagctggtgaagtttgctacagagaggggccgcaaagctaggcctaacttgaaggtgggcatttgtggagaacacggtggagagccttcgtctgtggccttcttcgcgaaggctgggctggattacgtttcttgctcccttttcagggttccgatggctaggctagctgcagctcaggtgcttgtctgaggctgcctcctcgttggcacccggattgcctgctgttggtggatgtggtgatcaaccagatttatttcagagccatgctttgggaaacattcctagaggcagtgctcataaaagctacaatcccatcttccctttttttccagtcatgtaaaacttccaaactgctccat

SEQ ID NO: 26013 - DNA, 393 bp, Zea mays
  Clone ID: cC-zmle189044c01a1
ttttcacctgaacactgcattttattcctcatcataaacatgacatccaaactagacatatcgagcatgctgtacatccgcctctccgatcaaagagagacgcatacagcatatagtactgcactgcactgcatgcccccagacacaagcatgcacacacaaagcacaacacataaacgactagctagagctatcgcggcgaccgagactctacggcagcgtacgtagcagcagccaccgcctttaagaggccatatgccgccgcgccggcagaggttcaaggaggtcgcgcgcgcggtccgctcgagagaggttcttctctcaagacccctgcgcctggtcgaagcggagctgagctgcatccttgatgtcgcgggcctaggacgccagcct

SEQ ID NO: 26014 - DNA, 328 bp, Zea mays
  Clone ID: cC-zmle189044c01d1
gaccacgcgtccggtagtcgaagctcaagcatcagcggcaggagctctgggcatcttgcgctcgagggagtacctagctcgctctgctagcctaccaaggctgatcaccaccggggtgcgacgggtggaggcggtggctacggcgacctccagcgcgggggcggcatcacggcgaggcgcagcagcaacataaatcaaggcgccaagatgacagggctcaaagccgcgacggccgcgaccttcggcgggtcgatgctggtgccagccgggctgatcctggccggcaccgggatcgcgctcacggaggccacccccgtgctggagatct

SEQ ID NO: 26015 - DNA, 354 bp, Zea mays
  Clone ID: cC-zmle189044c02a1
ttttgcaaattgggacactatgattgaagaaccagtcattcaaaggatgcaccttttatagcaacaaatacagaacttaatccttagcaagcacaagagtaacttagtttagcagtgttacagcaacccacatacccagctacaacgaacacctaacgtactacacagacacaagttgatacggcagcatcctgggacgtgccaccaggcgtagtcaaggacttagtcctcgtcaccagccgcagccttggcgctgccgccgccggccttcttcgggagaagcaagttatggatgttgggcatgacaccaccgctagcgatggtcaccgtgcccagcaagcgggagagctcttc

SEQ ID NO: 26016 - DNA, 465 bp, Zea mays
  Clone ID: cC-zmle189044c02d1
agacccaagcctgcgcccacgcgtccgcccacgcgtccgcgcggtttggctttctcctctctttcgcacccgcttctcgctccggattccctctgctctttccctaacgaaagtagccacggcggggagaggcaaggcgatcggctcaagcgccgccaagaagagcccgtccaggagctccaaagctggcctccagttccccgtgggaaggatcgccaggttcctcaaggccggcaagtatgccgagatagtcggcgccggcgcccctgtctacctcgctgccgagctcgagtatctagctgctgagagttctagagctggccggctaagcggcacgcgacaacaagatgacccgcatcgtaccgtgccacatccagctcgtcgtccgctacgacgaagagctctaccagttgctgggcacggtgaccatcgctagcggtggaggcatgcccaatatgcataacc

SEQ ID NO: 26017 - DNA, 394 bp, Zea mays
  Clone ID: cC-zmle189044c04a1
agctagaagtcgtacgtgcttgatttatattaattataagtctactagttctcgtactaatacatgtgtttccacattgaaccatacgctggcaagccagaagtaagcgcacaaaacgaaaccccatgcatggggatatacagatgatactgatcaaacgatctctacccttaatatccccttcagctaatgtacataccagtcactcctcagccctcgctcccttcagaccatgcatgcattgcaacacggcccgaatctgtaccctccagatagattaacaacacacacaaactgatccagaaaggaacttaagggttcaaaggtagccttccagtccatatcagctcaccagcgaaggattcgtatccctcctcgacctcgactcaaccgg

SEQ ID NO: 26018 - DNA, 66 bp, Zea mays
  Clone ID: cC-zmle189044c06a1
gccttttatcttattgtgggctttggttgggggttggaactccactgctgctaacaaactaaacct

SEQ ID NO: 26019 - DNA, 459 bp, Zea mays
  unsure at all n locations
  Clone ID: cC-zmle189044c07a1
cacgcagaccgaagctaggatcctgtatgagcgtgcagccctcgtcctttttttttagccctttaacttattttgggcttttgttgggggttataactccactgtagcttcagaactaagctgccttaatcgtcgatgataaaggacacgtctgccacactataccgcggtgatccaggtctgggacctgggcacccctggtactatgctagaatgcaaactgcttcccctagatagaaggagaagcgcccgaacttcaccattatgccacaaggggagtatgtcacacgagtcctgattttaagtcaggcacctcatgagaactacaaaattcacaatggacagaaagggttgattagacctacagcccactttagtttgtntgtactgatagctcatcctccaagaagttgtactcgaatgagaagtcattcttgattctttggcaccatcctgagc

SEQ ID NO: 26020 - DNA, 560 bp, Zea mays
  Clone ID: cC-zmle189044c07d1
ttaaatagtacgaagttgtaaagatctctggaattactcttcgactaacgaattagtatttctctttttatgctgtaatagtactgactactaggtctggtatctgctgagggataaatgtacctggtaggatttactgtgttattcttgcacattagtggtgttgaggtactataactgaattctcctcttctggtttttatatcatctcgtgaaatgctaaagttaaattaacttagttaattctgaggaggattagttttattggttgttgctaatccttagcgaagggttttaaagttaggattcggatagatattaattacttagatagctatatgtgtttgtttacctgatttttttcttctgacttggtttgtcaacctttttatgtatcttcgttttcaacctggctaagtaagtataggcgatggctgtaagtatgcagtctttattgacgggctgagttggttgccgccatatttagtacttggtctctatgaactaccttcttattgaataagattcgctctatctggtctaactctgttttggtgagt

SEQ ID NO: 26021 - DNA, 386 bp, Zea mays
  Clone ID: cC-zmle189044c08a1
gatctgcgcttcagaggcgggtactacggcggaggaggcatcgcgacgccggggtacgctccggcggtcccgtacgggatgtcgcaagagaacatcgtgggcaacgggtgcgggcgggcgctgccgccgctgccgaccgtgaaggtgtactgccgcgccaaccccaactacgccatgatcgtccgcgacgggaaggtggagctggcgccggcgaaccccatggacgagtaccagcactggatcaaggacatgcggaggagcacgagcatcatggacgaggtaggttacccggcgttcgcgctggagaacaaggcgaccggggaggccatcaagcactcgctggggcagtcccacccggagcgcctggagccctacaacccggactt

SEQ ID NO: 26022 - DNA, 79 bp, Zea mays
  Clone ID: cC-zmle189044c08d1
ccgaagtgcatattatggggttgggtgtgccgcggccgtctttttaatcgacttatgagaaagatgttgtgtcttctag

SEQ ID NO: 26023 - DNA, 344 bp, Zea mays
  Clone ID: cC-zmle189044c09a1
ttattggtttctcttctcccgcccacctttctctctattgttttgttttcttttaattcccccaagaaactttatcccggcgcacgagccttttggccgatttcgtaccggtgcctggggcctgcccccccctaatcccagtttcaattccctgcccatcctgtctaccctcttcctacttaagggccgcctggccatccccaacgggctgtgattcccgcccccgggcggtcctatttgccctggcgaggaaaccctccctgccgcccggggacctcccccggtcaagggtcgatggccccttcgaccccgggctcgccccccacgtaaccggggccccccgt

SEQ ID NO: 26024 - DNA, 299 bp, Zea mays
  Clone ID: cC-zmle189044c09d1
cgcgtccggcgcagcggatacacattactcgacaccactctcaggaacggatatttacgatttctgatcgatgaaaaacgcagcataatgcgactcctgctgtgaatggcagaatcccgcgaaccatccagtttttgaacgcaagttgcgccccaagtcttctggcggcagggccgtctgcccgggctgctcgccctaagacactcctaacacccccccgccaggcgagggacgtgccgtgtcgccctttgttaagagtaccttttgatgagcaaggccaacaaggatcttatgggccg

SEQ ID NO: 26025 - DNA, 526 bp, Zea mays
  Clone ID: cC-zmle189044c10d1
cctcctgggtcgactcacgcgtacggcgagatggcaagcggggaagaaggcaagggcgagacggtgctggtcaccggtgccagcggcttcatcggttcgaccctcgtccgcggcctcctcggccgcggctacaacgtccgcgccggcgtcctcgaccccgacgacagggcggagacggaccaccctctcgcgctcgccgccggcgccggccgcctcagcttcttccgctgcgacctcctggacggcgccgcgctgctcgacgcggcaagggggtgctcgggcgtcttccacctcgcgtcaccctgcaccgtcgaccccgtcaaggacccccagaatcagctgatggtgcctgcggtggaagggacgctgaacgtggtgcgcgcggccaaggacgccggcggagtgcggcgggtggtcgtgacctcgtccatctcggccgtcgtgcccaaccccgggtggcccgccggcgaggtcgtcgacgagcgttgctggaccgacatcgactactgcgagaagaatggggttt

SEQ ID NO: 26026 - DNA, 59 bp, Zea mays
  Clone ID: cC-zmle189044c11a1
ttttatattttttttttttttttttttttttttttattttctgtggtttttgctttttt

SEQ ID NO: 26027 - DNA, 597 bp, Zea mays
  Clone ID: cC-zmle189044c12d1
gaacttcaagacaatagttgatggcctaggtgctgttctctatcagtacccattcaatgtaccagcatactatgcattgatactgcgatcgctcaccgtactagaaggtttagcactctatgctgaccctgattttaaggtgcttgctgcatcatacccttactttgcgaaaaggctactgactgatcccaacccatatctcagagatgctttaattgagcttgtattcaaggatggaaaattcagatggaataggcttgaaaatcttcttgttcaagggcgccaagatagggagtttgcagccaaagatgcactgcagcctgttctaaagcttctccttggtcctggtggggaggaattgcgtgcgttagttgtgaaagaggcagttcgtgtgacagaagccatcgccattggaacactggtcgattcatacaatgcagctccatcatttttgaagccattaatttccagcggcaatctagctgaaccctttagtttagtgagactgaacaagaacagatgatggagctcctagaccaggttttcagagtatgggggtctttgagatcctcaataaccttgatccgagccttttgc

SEQ ID NO: 26028 - DNA, 425 bp, Zea mays
  unsure at all n locations
  Clone ID: cC-zmle189044d01a1
aattgccataagattacatgtacataaatttgtcatcatttcacatgttagagatacaaattgaaccagacagtttgagattgatatttctggttattgttctctttaagggaataaaactcaaaaagaaacatctcaagagctaccaaaaaataccaattgtacactcagatctaaagcgtatgtttcgctacagaactccgggtattgatctcttcaaggtaacattgaagctatttcaccatgaaagaactcttgcaactgcagcctccaacagcactgggatttgntgaaaccacaaatgttgaacgtataagttcctcctcgtaatccacagaggcaccttttacgaaattatatgagatgtcatncacgaccaatctaacaccatcagnctcaaaaaacctggcatctgcatttttctt

SEQ ID NO: 26029 - DNA, 384 bp, Zea mays
  unsure at all n locations
  Clone ID: cC-zmle189044d01d1
acccatcgcgtccgcggacgcgtgggcgcgaccgattaccccgccgccgccgagtctgcagctgcgatggcgtcgtcggtgtcgcgggcgctgctccgccgcgtcgcagaactggctagaggacgcctccgcgccaaccaccggatgctctcatccgcgtcgtccaccgccgccatcgagatggcttcgcagntgccggcggaggcccaggccgtgcgcatgacggaaggttgcgtgcggagattaaaagaattacatgctaaaaaaccatctgctgaaggtaagaagctgcgcttaagcgaagaagctggaggatgttctgggttccaagattctttcgctcttgatgacaagaaaaaagctgatgacagggtttttgagact

SEQ ID NO: 26030 - DNA, 455 bp, Zea mays
  Clone ID: cC-zmle189044d02a1
ccaagaagtcgaggatcccggccatcaagagcgacgccgagatcgtcaacccgccctggctcgacggctcgctccccggcgacttcgggttcgacccgctggggctgggcaaggacccggcgttcctcaagaggtaccgggaggcggagctgatccacgggcggagggcgaaggcggccgagctgggcatcttcgagggagcaggcgtggagcggcatcccgaggttcgaggccggcgcggacccgagcgccatcgcgcccttctccttcgggtcgctgctgggcacgcagctgctgctgaaggggtgggtgagagtcgaagcggtgggaggacttcttcaacccggactccctagccgagagagtgggccacgccctaggcccgcactgccgagaacttcgctaacttcaccggcgagcaaggctacccgggcggcaagttcttcgacccgctc

SEQ ID NO: 26031 - DNA, 501 bp, Zea mays
  Clone ID: cC-zmle189044d02d1
acccacgcgtccgcggggatgtagacgccgtccttgacggagccggcgaggccttgcgggtcgaagaacttgccgcccgggtagccctgctcgccggagaagttagcgaagttctcggcagtgcgggaccagggcgaggcccactccacggcctgggagtccgggttgatgtagtccacccaccggttcgactccacccaccccatcagcagcagctgcgtgcccagcagcgacccgaaggagaaaggcgcgaaggcgctcgggtccgcgccggcctcgaaccacgggatgccgctccacgcctgccccacgaagatgcccagcacggccgccatcgcccaccgcccgtggatcagcttcgcctcccggtaccacttgaggaacgccgggtccttgcccagccccagcgggtcgaacccgaagtcgccggggagcgagccgtcgagccagggcgggtagacgatctcggcgtcgctctcgatggccgggatccacgacttc

SEQ ID NO: 26032 - DNA, 305 bp, Zea mays
  unsure at all n locations
  Clone ID: cC-zmle189044d03a1
acccacgcgtccgaagacgcgagggcggcggaggagatgcgggaggaggagaagaggcctgttcgacaccatcttcggcgcgctgtacaaagaggagcagctgctggagacggaccccgtcctgaacaaggaggggagcaagggcaaagccgccgccgccccggcgcccaagaaagccgctgaagaggagcggaacggcgggctcagcctcggagaggtcttctccaagcccaagaaagggagaggatcgnttagcgctgctcttactttctagcacgtaatccttggattggaatggacggctc

SEQ ID NO: 26033 - DNA, 450 bp, Zea mays
  unsure at all n locations
  Clone ID: cC-zmle189044d04a1
aagcgaatgaaatcatcgtcagtaaagatcaaactctaccaccagtacaaatcccgtccctgcgctagtcggcggggcatccaacatggccatgaaagcaacaataaagcagaaaaataaatctaaacagtgcagcatcacttcgcctaataaatctaaacagttgatgcaacaagccatgagcacctgattcttgaagagtttgcaaacatacgaaactgacggtacgccccaggacaattaacctcatcccttcgcctaatagttagccagaaatcatatgagaagcttattcagtctcggcagcaacaggtctccgaagagccacaacagagtctcctatagactatagtaactcgngataccaaaggtgacatacataactcatcacaactttcctgtttgaatcaaaatcaagagtcaagaccctctacaacctaataaaaactc

SEQ ID NO: 26034 - DNA, 317 bp, Zea mays
  Clone ID: cC-zmle189044d05a1
aaggttgttctatttttacgccccaagagttcattatcttgctttaaagatatcatgacgggggttgactccgcctttttcgactggccgggccgcaagaaaaaacaaccggtttggcaaccccgtgattttcccctacgtttacttttggataaaaacacagacgccatgggcgatgtttaaaaagccatggatccaccggaataggccaccccaaatcggaaattccacaaagctaacactgaccgaaccctgcgggtgccgctgctacctctactaaaaaacaatttggagcccacgggtccccggactcggag

SEQ ID NO: 26035 - DNA, 115 bp, Zea mays
  Clone ID: cC-zmle189044d06a1
tttagacgttttctttttgagagcctttatttatattttttgaaggatgaaatttagagatcgttgctagagaccgtctaatgattgtaactttcactggctaagtgtgtcatct

SEQ ID NO: 26036 - DNA, 535 bp, Zea mays
  Clone ID: cC-zmle189044d06d1
gaattcccgggtggacccacgcgtccggcgagagtgttgaattggagaggaaggtgcaggaccttgtagcagaatctgcagctagcttattccaagtttgacgaacaggcagtggatactgtggagtcgagatcccgcgaattcagcctggattcatcaaccagttcaggcaagcagttagaccaaacttaggctggcttaccaaacccaaccctgcatggagtgcaagaaccttccggcatcatgggcttcaagttcatcctgggagttgccctgctgtctgtcctaatcggcgtgtttcttgggaagcgggactagcgctcaagtcgtgctgaaagggctcagccagcggtaagcctgaaaggattggcggccttgatggtaatggttcgacgacttcctgggagaagggctcatccgcgtgattctttttgccgtaatcttcaccttttcgggtaaggggaggggggccaaggaatatgatttttgatcattcctaccctttcatgccaatggcccactgcatgccactggt

SEQ ID NO: 26037 - DNA, 94 bp, Zea mays
  unsure at all n locations
  Clone ID: cC-zmle189044d07a1
gacatcatcacacagagctcaaaatagttttaaaagggaaataatagtcgattacatcatacgtctgagacgtccacatagnccttacaataaa

SEQ ID NO: 26038 - DNA, 427 bp, Zea mays
  Clone ID: cC-zmle189044d07d1
gcgacggatacgaacggtgcacctgctgttgtggccctatttgccatgtgatcgagacttcttgagccccagatacgggctcactccctaacatcgtatcctgcaacttgcaagactgctcatggatgacctgctccacgatagaacccgcacctgtgtgcccttacttggctcgtctagcccgcggcagctcacaggagcactggcttgagagcttggctatacgcatggtggctctggttattatccgatgacaatgtatggtgcttagtatttatcatcatgtggatacccaagagagaatggtgaactgactgctgtaatatatcctaacacaaaccttatttttgttcaccatgtttttcctagtgcatgtgcgctttggccgttctttcagtgaacatgaatcggcctgataacgactatt

SEQ ID NO: 26039 - DNA, 476 bp, Zea mays
  Clone ID: cC-zmle189044d08a1
gaaccaaagttaatgtctagaacatcattcattcactggtcaaccggtacagtatagcaaaaatgcctgttcagattaagctaaactttgacggatttctctagacagcgatgtctccccagatggccagagacacgagctaccaattcatttactcttgcgctcactgttgtagtcatcaatcagcttctcgacatccttccagaacaggccctccacaagaactccttcctttgtaaaccactttgttacgctcttagggaaatgaactggcttgtttgcagagatagactgaggatccgcacttgctattgagagagtgtacatgtccgagaatcttggtaatttagaagaaatagagaggccagtgctgctgaaagaacccatatgagggagcgtgaataggatggcatccttctccttggtgtagctaaggatcagcagcaccacattcagcaccacatacagggcgatgc

SEQ ID NO: 26040 - DNA, 561 bp, Zea mays
  Clone ID: cC-zmle189044d08d1
cgacccacgcgtgcgctttgcttctacgtcggtgcgcagtttgtgcgccaggggaaaactacctttccagatgttttcaaggttttcttctcgttagttctggcagctattggagtctcgcaagcgagtgcgctggcttctgatgcgaccaaagcaagggactctgctatttccatctttagcgttctggacagggagtccaaaattgactcgagcatcggcgacgggatgacgctggaggttgtcagtgggaacatcgatttcagcaacgtcagcttcaagtacccactgcgtcctgacgtccagatattcagcgacttcaccttgcgcattccatctggaaagacagtggcgcttgtcggagagagtggcagcggcaagtcgacgataatcgctttgctggagcgtttctacgacccagattccggttgaatatccctggacggcgttgagatcaagagcctaagagtgagctggctaatggaccacatggggcttggtaggcaggagccgttgctgttcaacgacacgaaccgcgccaacataacgtacgggaagcac

SEQ ID NO: 26041 - DNA, 263 bp, Zea mays
  Clone ID: cC-zmle189044d09a1
aaaaatgattgacaggttttattccgttcacaagtagcatcagcagtgatttgtgtagctggtgctgaccgcttctagttaccgtacacgtgcggcggcacatcggccgcgaggtaagtatgactagtacgtagtagcaaacacccagaaaatcaagcgcagggcccgcacgagggacacgtcgtcacttggccgcctccgcctccgcctaggccttgcggtaggcttcgatcttagcggcgatcccagcggcctcgtgctcg

SEQ ID NO: 26042 - DNA, 386 bp, Zea mays
  unsure at all n locations
  Clone ID: cC-zmle189044d10a1
gaacatcgccgaacaaaaattattcgatatttcacatacctaagattacaagggaaacttttatctttacaatggctgggggggggcaaagacacaaaactttcacacaggcggcatgtcgcatttcctcgttatcgggtcttctttaggattgctgatgttcgcatttcagcatcctccttggcaaagctccaccaaaggtacgacagggggatagccccagcgaggcagatagcacggccatttgcgtatccccatcgggggggaatggcngaggcttccacaagtactggaaccgcacctccgacgggaacagatatgatcttgagccgggaacgatgcccactcatgacagcccacagagcccacaggagacactgagcaat

SEQ ID NO: 26043 - DNA, 280 bp, Zea mays
  Clone ID: cC-zmle189044d10d1
cgcgtccgaagcaggatttcaaggaggcactatgatgcatactggcaataaggtctttcatctgaccacccctaggatccttacagggaccgtgatagaacctatatagccagctcgattgccttatctatagctgcggatgatcctattccagcaactgtggggctttagagctgactataaggctgcagaagataaacatcactggactggggatgttgtaaggaagagtcctgattcacagagatctccccactgacagaaggttgctccatgagga

SEQ ID NO: 26044 - DNA, 264 bp, Zea mays
  unsure at all n locations
  Clone ID: cC-zmle189044d11a1
gaagccgcgaccaagctcaggatcctctagagcgagncgccttttttttttgctgtcgtctttctcttttctttttgtctttacttgctcgtctgctagatcgctgttatctaggaagtccgaagaagcacggaaccccagggcgcttgctaggactcgcagggggcaagaacctgagaacgagtactgaacccactagaactattcagcaatcggcctctagctcgatatgtgtaccaatcgatagggtcggtgggtcggcca

SEQ ID NO: 26045 - DNA, 70 bp, Zea mays
  Clone ID: cC-zmle189044d12a1
ttttcttattttttttgaagctggctatcaattttccaggggggttatttgctttcttttatccaaaatt

SEQ ID NO: 26046 - DNA, 320 bp, Zea mays
  unsure at all n locations
  Clone ID: cC-zmle189044e01a1
gcagctggaagtagagtttatcacattatgacatcaaagatcactggtcacaccaccacacgtccacaaatatatatgcgcaaccatttccccctcaaaagccaaatccagctttgagttcgacaatccataaaccacgccacacttggcacgttcagctgcttttcttgagaaaaagcccgccgaggccgccgaggttgaaccccccgccgctgccgctgtcgtcgccgccggcagccttcttgccggcggncgtcttggcgcgggaagcggaagcctgcgcggcgcccaccttgttgaagagcgggtccgcctccacc

SEQ ID NO: 26047 - DNA, 435 bp, Zea mays
  unsure at all n locations
  Clone ID: cC-zmle189044e01d1
gaatgncagggtcgacccatcgcgtccgcggacgcgtgggcggacgcgtgggcggacgcgtgggcggacgcgtgggcggacgcgtgggcggacgcgtgggcggacaaggctttgcgccatcgttcggtttccttgctgaattcccgatcgctcgctcgctcgaaatgaaagaagcttgctttgagcatggcgtctctggcgttcggcagcaccgtagcggcggccgtggcggcgtcctcgagggaggacgcggccggcgcgccggtccgtgctggtcgtgccgcccgctgccagcaagggcggcccggcgccggccaatgaggagaagggcctcggcgagaccatcttcggcttcatcttcaagaaggaccaactggaggagacagacccgctcctcaacaaggtcggcgccgcgccggccgccgnctcccgcgc

SEQ ID NO: 26048 - DNA, 253 bp, Zea mays
  Clone ID: cC-zmle189044e02a1
caaaacattgtcaccttttctaaaaaccacagggttcacccaggaagagtccccttttctacatggccggactggctaaatgtgtattcctgaccccccacaccaggagggtgcaaggcccccaaaggttaaacctttatctcacttttcggcccttaagacttgaagtgtgtttatgccaccgggaccccaaaaaccccccggaatatctgtatccccatgggctagacaacgctgaaatcaacgggtgcta

SEQ ID NO: 26049 - DNA, 367 bp, Zea mays
  Clone ID: cC-zmle189044e02d1
gacccacgcgtccggagcagacttacgagacatacatgtcgtgtggatagagattctcagttgagtaaatcctctctaatcggtgtgatatgcccggatctctgacccggtacctaaggcaggaggtaaacattaggtataaaaatgatgttgaattgatgcaacggtgcaatcggactaaatgctaccaaaccattgaaagtgaggacgcaattgattaacggatcgctgcataagtatgtaagctgatgcttgataaagcctgttactagattgctattaaaccagcactatacctggagagtcatcttaccttacatgggcatgactcgtgaaggcacactttgcactctgggttttgaaaccc

SEQ ID NO: 26050 - DNA, 384 bp, Zea mays
  Clone ID: cC-zmle189044e05a1
tttttgcttttgattttattttttatttttatcatgactttcaaactagacatatcccgcccgtgggccatccggctgtgcattcaacgtgagcctgatagcgactatagtgctgaactgtactgcttgccagcggaccctcacttggcctcacaaagctaaacagatgatgcaccaagccatgagctcctgattctcgatgtgttagcaaacataccaaactgacgggccgccccagtacaattaacctgatgccttcgcctaataaggagccagaaatcatagcgggcagcttattcagagtggagagctcatgaatacccaagccactgcaggacgccgatcgactatagtaactcgagaaccaaggctgacatacataac

SEQ ID NO: 26051 - DNA, 435 bp, Zea mays
  unsure at all n locations
  Clone ID: cC-zmle189044e06a1
ttttagaatttgcacacataactagaggccatctacattaaatcatgcattacatagggacatataggaatcaacttgggagacaatatgacagaaccatgaatgatgcaatgatgaagcatgaatccacacatcaaagtaatcagcaattgcttgcacaatccagtacacatacatattgtcactagaagaaaggaagtcctcaatgaaacaatacctctgcatatggcatttgatacaaaaagaacattaattcattattttctagattaaaccattctttcagaaatctcctctgaagcttctgcaattaattccccattctaagntataaatattaggaaatagcataaatcaagacactaattctatattggtaccaagggtttagaagntgcatttggcatacaacatattacatatacccaaacactc

SEQ ID NO: 26052 - DNA, 338 bp, Zea mays
  Clone ID: cC-zmle189044e06d1
attgtggatggacccacgcgtacgcactcagctattgagcatatgagatcgtgacgcacgagccatggacaccgtcagcgcctacgaggtgaccaccatatttgaccgcgccgataacgccaggcccaaatctctagggctgcctacatttgagggcgaggagcaagaaggagcggagcaactacccccgaggatcccaatgcctgggtgagcagtcaggaccaagggttcaagcgcgacggtgatacggcacagtaggggcggtgaccgcgatggtcgtgccggcgctggcgcacgaggacgagcgcatgttcacagagggcaccgggctgagccta

SEQ ID NO: 26053 - DNA, 327 bp, Zea mays
  Clone ID: cC-zmle189044e07a1
gcatagcaaaccatggcgactttttttttaatattttgggcaaacaggccacacccacaatgacgcttttggataccccttagcaatttcaagccatgaacagagggtacacaaagacggtctggcaagcctgggatacaaatccgcctctcaaaattaagagcaaagggacagcgttaaaacttagaggagaggcggcccgctagcattgtatttacccaaatcggggagtcgcaaggacccaatcttataaagtttacacactccccattttaaggccccctcccggacgcgagggtcgacccggagaattccagaccaacccct

SEQ ID NO: 26054 - DNA, 455 bp, Zea mays
  Clone ID: cC-zmle189044e08a1
tttttcttcaacaaggattctttactgaataaatgttgcaccacgttcaccggggaatttacaatccatactagtcctgaagtacaagggaatgagaatgccccatgccatagatcacgggttttgttttctaggagtacgagctggcctcttattaacttacaagcacataattacggagtattgcctaaccactatacatgatacattggattttgatggtacatcctactatatacatacaccctactataaccaatataaatggctgcatcttatcgaccaaaagtagaagctgaaagcagcatcaccagattgttttactgctcatggaagtcctcgtaagaagaccaggaggagtcactttgatatggagttgtttcccgcggactagatgggagtgaatcttgcatcgacagacctgggttcttttgcaccctaggacggaacttcct

SEQ ID NO: 26055 - DNA, 462 bp, Zea mays
  Clone ID: cC-zmle189044e09d1
agtccacgcgtgcgaggactcgtggggaaatcctgatacgtgaggtggaagatgggggatgtgctaatatccaggaacgaccacttctgatgttagaaatggtggagaatgttagaacatacactagctgatttatttgcagcagaattattctcatcaagttcttcatgggagtattcttgcctggatatcattgacgttgctgtggcattcacttcaaagcatgcatcatgcatggaaaagatgctttaaaagaaaccatggaagccaacaccataaccactgaaagcgacaagaaaattaactcgggtcatgaggaagatgttggggaagaagatccacccatagtcatttattgggcgtatcaatgcagagggcccccttactgcatgaaggttattcttgccgcaaatttgcttctctatttgggtaacattgaatccctatggctaagattccttg

SEQ ID NO: 26056 - DNA, 410 bp, Zea mays
  Clone ID: cC-zmle189044e10d1
ggggtagttggagtatagcgaaggagagtgttgttgatcgaggcgaccttgagcgtcttagtagttactctcttgtgagatgtccaatagaacggtttatgtcagtgaccagaccaccagtgggaatgactcgcatgtacgagggcattgatttttactcggacatcacccggtccagggatggaggagcttaacatggacctggtcaggaagtgcatggagcctgttgagaaatgcctgagggatgccaaaatggacaagagcagcgtgcatgatgttgtgcttgttggtggatccactaagatcctcatggtgcagcaactgctgcaggacttgttcaacggtacggagctgagcgagaacatcaatcctgatgaggccgtgggctatggagatgctgtccaggctgc

SEQ ID NO: 26057 - DNA, 370 bp, Zea mays
  unsure at all n locations
  Clone ID: cC-zmle189044e11a1
atgtgtcgaatcgaaatagtgactgcattcacttgacttctgcgtggacaaaaggggatatcatcacatgaacctttaactgtattgagacaggacgacgtgagacagcgactttatgctttgatgatgtagttgataatgtaagccatctttcggattagaaacttcggtcaacggaatccaagttgaaccgcttaacaagcacgatttgtacagtacaactgtctgtagacatcagaatcccaaagggccgaccaccaccacctgttcacagagaacggagggagaatcacccaccggcgagggtacttgggcctcccatccttgccgncaaacagtttattgagacggatgtgcttgccgagcgccc

SEQ ID NO: 26058 - DNA, 559 bp, Zea mays
  Clone ID: cC-zmle189044e11d1
cacgcctacgaacacccctacgtacgcctttcctctggaaacccttctgtcgcctgcctctcccccgccgggccggcactttccctctgccgtcaactccggcttccgcgcgaggtcgagctagcgtttggagttctcgagacctgctgtgatggcgacagagcaagcggcggagaactacacggtggaggacctcgtggccctgaacccctacaaccccgacatcctcaacgacctcgagaagttcgtcaatgagcaggtctcatctcagacatataacttggatgcaaatctcagccttcttcgcttgtaccaggttgagccagataggatgagcatacagattgtggcccacatactgattaaggctctcatggcaatgccagcccctgacttcagtttgtgcttattcttaatccctgaacatgtgcaaatggaggagccattcacggtattgatagttctttctcactacctagagactgctaggttcagtcaattttgggatggagcagcaaagaaccgccacatatccgaagcagtgccaggttttaacaag

SEQ ID NO: 26059 - DNA, 243 bp, Zea mays
  Clone ID: cC-zmle189044e12a1
cggggttccgtgagaataggtatcctaaatcactcccaaaaacccggaccggcccccggaggatccccaccctgcccccaagggagcgagctcagaacggggaagaaccaagcctaaagcaaatgcgtgaatgaaatcaaaacccatttccaaaaccccactgcatacgaaccaaaaactcaaaaagcaaagcccggggagcctaaaggaagagccaactaacttcaatcgggtggcccccac

SEQ ID NO: 26060 - DNA, 602 bp, Zea mays
  Clone ID: cC-zmle189044e12d1
cccacgcgttcgactaaatcaacatgtcaggtttcccattctctccattcccgctttcacagtccgcgtcgacatcgatgcgccgatgcaagttggaggccagcatggcgcgcagctggtcatcgttccaatggtttccggtacggtgaagagtgaagaaggctttgagccgaagttggatggagaactacatggtgttggctacgactacattcacaatgatgccgacggcggaaacatgcgcttggacgtgaggagtcaagtcaagaaccacgacggcacagttctggcgatgtattacaaaggtactgtgaagctcacgcagggagtcggcaaagtgctgtctggtgctcccgatgctaagacaactgactatggcgattcatttgtcaacttctctttcgagacgggaaatgagaaatacaaggaacttcagaatggaacctatgttgccgcgggccatttcgtaacgggtgaaggcaagccggtcgttgtggtggagtacaaggtcagtaatgttgtgtacaacgccagccagggcaaaatgtaggagggttactgtgggaatatcgcgatcctcgtacttactgactgtatcaaat

SEQ ID NO: 26061 - DNA, 417 bp, Zea mays
  unsure at all n locations
  Clone ID: cC-zmle189044f01a1
agcggctaattgagtcgattcagatactggattcactttcagaaatctctccacatacaaacagagagcatacaacttgagacatgtacgggaaggttcgcttattatccttagaacaacatcctacagccaagcatggccaacatcaaagctttatttctctcaagttttgctcattatgcattggactgtatatatcctctaaccggaagacatgactacagctccaactctatcgagagggatgagacgcagctccgaaccatgtttcagaaacacgttgcctgcactttgctgggggttgatgccaattccatcgntggtgatgatggcactggtctggggcgggaccttgaactcctccgcggcgtacttgagcaccgaggagaaaggcgccgcctcgggcacgctgaacac

SEQ ID NO: 26062 - DNA, 503 bp, Zea mays
  unsure at all n locations
  Clone ID: cC-zmle189044f01d1
gagccgcgcacctatctggcggcggcgcaagatggaaggtatccttcttgatcatcctcacctccgaccccaagctccccttcaaagagttcagcgagcccgtgagcggcgcccttcaccgcggagctctagtacgccgcggaggagttcaaggtcccgccccagaccagagccatcatcaccaacgatggaattggcatcaacccccatcaaagagcaagcaacgagtttctgaaacatggttcggagctgcgtctcatccctcgcgatagtgtaggagctgtagtcatgtcttccggttagaggatatatactgtccaatgcataatgagcaaaacttgagagaaataaagctttgatgtaggccttgctaggctggaggatgtagntacaaggataataagcgaaccttaccgnacatgtctcaagttggatgctctctgtttgtatgaggtgagatttctgaaagagaatccatgatctgaatcgactcaattagccgc

SEQ ID NO: 26063 - DNA, 292 bp, Zea mays
  unsure at all n locations
  Clone ID: cC-zmle189044f02a1
caatcaagataatcttggggattaatttttctggtcaatccatcgccccaatcatttaataaaaatagcgaactagagaacgattactgaatagncctagttaattcagtaatcgttctctagttcctgcctccgggcgagcccctagcaagcgccccgggggttccactacttcactcaaacttccaagattacaggggggatcgaaggcgagcccgtagagacagagtcggagcgagcccgacgactgcaagatcgccttccagcaatagggcggaggccggacccgtgg

SEQ ID NO: 26064 - DNA, 332 bp, Zea mays
  Clone ID: cC-zmle189044f02d1
gcgtccggcctccgactatagctggttgagcgatcttgctgtcgtcgtgctcgttccgactctgtctctacgagctcgccttcgatcaccgctgtaatcttggaagtttgagagaagtagaggaacccacggggcgcttagctagggactcgacatggaggcaggaactagagaacgattactgaattaactagaactattcagtaatcgttctctagttcgctatttttattaattgattgggtcgatggattgaacagatatattaatcacaaagattatcttgattgaataattttttttatttaattttatattaattttttatattg

SEQ ID NO: 26065 - DNA, 467 bp, Zea mays
  unsure at all n locations
  Clone ID: cC-zmle189044f03d1
acccacgcgtgcgagctagtcatcactagtcacgttcgtccaccagagacaactttggccatggagacgagcttcagagcgagggcgctgcacgcccccgctggcagcaaggacaggctcctcgtcggcaacctggtgctgccgtcgaagcgggcgctcgcgccgctgtccgagggccgcgtcgccacgcgccggccgaggcacgtctgccagtccaagaacgcagtggacgaagttgaggaggcggacgagaagaactgggacgggttggagatggcgtgcgagacgccggtgctggaggagttctgggcgccgaggagcgggccgagccggatgatcgcgccggagatcgacgagctggccaaagactacgccggcaagatcacgtgctgcaaggagaacacggacgacagccccaacgaggcgtctacctacggcatncgcagcatccccaccgagctcatctt

SEQ ID NO: 26066 - DNA, 116 bp, Zea mays
  Clone ID: cC-zmle189044f04a1
cttgaggattggttttgagctttgacattggagagcggccgcaagaggagggagagccgcgagacccacgacaccctaagataaacgctttgtgtcgcagagaaagcccagcccta

SEQ ID NO: 26067 - DNA, 218 bp, Zea mays
  Clone ID: cC-zmle189044f05a1
ccttttctctgtttttttttccttatgataaacctgacttcctaacgagccatagaacccatgctcatcatcccattcttccctcaaggaagaacagagtcaaatatttaaaactgcactggagtgccagcccaccccctcaagaatgccaagcctaagcgcagggattgaccgtctaaatagagctatcgtggggaactagacccctcgggtcggcc

SEQ ID NO: 26068 - DNA, 490 bp, Zea mays
  Clone ID: cC-zmle189094b12d1
ggtgatggtagtgattagcggccacagatttgccttcagttctgttctctcctggccagtaagtagagatgggggagcgcgacttgctatatggttccggtgtataacatccaaatttgttgtgttcaaaaaaaaaaaaaaaaaaaaaaaaataaaaaaaaaaaaaaaaaaaaaaaaaaaaaaaaaaaaaaaaaaaaaaaaaaaaaaaaaaaaaaaaaaaaaaaaaaaaaaaaaaagggggggccttttaaaagaaacaaaattaacgatcccgggcttgaaaaaaaaaaattttctaaaagggacacaaaaataaaattattgggccgctttttaaaaaagggggagggggaaaaaacctggcttaaccaaaataaaatgtcttgaaaaaaatcccctcttttaaagttggggaaaaataaaaaaggccccaaacaaacgcctttcataaaatttgcacacctaaaaggaaaaggaaccccccccttat

SEQ ID NO: 26069 - DNA, 404 bp, Zea mays
  unsure at all n locations
  Clone ID: cC-zmle189094c01d1
aaaaaaaaaaaaaaaaaaaaaaaaaaaaaaaaaaatattatttaaaaaaaaaaaaaaaaaaaaaaaaaaaaaaagaaaattaaaaaaaaaaaaaccaccggccccanacccaaaaagaccaaaccccacaaacccgtccacccaaataaaaacccccaaaaaacccccaccaaaacccattccccgccacccccacaaaaaacccaaacaaagcaaaaacccccaacaaccccaacaaaaccaccaacaaaaacaaccaccctaccccaaaagccaaaaaaccaaaaagcccccaaccaaccccccaaacaaaataaccaaaacccaaaccctaaaaggaaccccccccaaaccaacccaaaaaccccaaccaaataccaccacacccccaaacaaaccccccc

SEQ ID NO: 26070 - DNA, 495 bp, Zea mays
  unsure at all n locations
  Clone ID: cC-zmle189094c04d1
gccacgcgtccgaagcacttcgacgtcacacgggcgcttcgcacagacacaccaagcgtcggcaccaatggctggctacctggaggtggactactgctccgacgaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcagggagagcttcctcgccagggctaactgagccgcccggcggccggcatccacgcccgttcgtgcttgcctgcgtgccttatgtatgtctgtggttgactggttgtgcanggtcatcgtacttggctatcgtacgtgcacgcactcagctcctgtacgaattacgacaataagctc

SEQ ID NO: 26071 - DNA, 565 bp, Zea mays
  Clone ID: cC-zmle189094c07d1
cgcccgagcatgcgaatctgggagcatctttgagggcctcctgtctgtatgttataaatgtgtatgcgaccaccgcgtcgggtgcggaggagagtagctgggggacgtactgccctggcgagttcccgagccctccaccggagtatgacacttgcttgggagacctgtatagtgttgcttggatggaagacagtgatttccacaatctgcgaactgaatctctcaagcagcaatacaacttggtcaaggataggacagcggttcaggatacattcagctatggctcccatgtgatgcaatatggttcattggagttgaatgttaagcatctgttttcgtacattggcacaaaccctgctaacgatgacaacacgtttatagaagacaactcgttgccatcgttctcaaaggctgttaatcagcgcgacgctgaccttgtctacttctggcagaagtaccggaaattggcagacagctcacctgagaaaaatgaagctcggaaggagttgcttgaagtgatggcccacaggtcttatgttgacagcagtggtgagctcattggaag

SEQ ID NO: 26072 - DNA, 377 bp, Zea mays
  Clone ID: cC-zmle189094c08d1
cgcccgcggacgcgtgggcggacgcgtgggcgcgcccttagcctttattctcttctcacatccacccagaagcacttgggtgcgggttcatacgaacctcacaccgccccagaccctgaatcaatgttcacgtcgattgaggaggtgagcaagccgatctgactaggtgctgcatgcgagaccgtgccatgatcgaggtgggcactcttgggttgcgagcgctctttactatcacgtcttcttctggtgacgcactgttcaagagaactagatctagtgagaaaccgttcagaattgggatcgtgctcatgaagcgcttcttcttacattcgatagcggaccgggcgagggggaggaatcagtgtatcgatggaaac

SEQ ID NO: 26073 - DNA, 404 bp, Zea mays
  Clone ID: cC-zmle189094c11d1
aaaaataaaaaaacacacaaaacaaaaaaacaaacctcaattttaaaaaaaaaaaaaaaaaaacaaagaagagaagtttaaaaaaaaaaacccaaaaccacaacccccaaaaaacaaaaaaaaaaacaaaaccaaaaaaacacactaaacaaaaaaaaaaacaaaaacacaaaaacaaaaaaaaaaacaccaaaaaaaaaaaaaacaaaaaacacaaacaaacacaaacaaacaccaaaacaaaaccaccacacaaaacaaaaaaacacaaaccaaaaaaaaaaaaacaaaaacaccaaaccaacaaacaacacacaaaacaaaaaaaaacaaacaaacaaaaaaaaaaaacaaaaaaaccaaccaaaaaaacaaacatatcaaaaaaaaaaaacaaaaaacac

SEQ ID NO: 26074 - DNA, 671 bp, Zea mays
  unsure at all n locations
  Clone ID: cC-zmle189094d01d1
aacaaaaaaaaaaantnnatcaaaaaaaaaaaaaaaaaaaacaaaaaaagnnggggctataaataaaaaaaaccaccaaacccacccacgnaaaaaaaaaaaaaaaaataaacaaaacaaaaaaacaaaaaaaaaaaaaaaaaaaataaaaaaaaaaaaaaaaaaaacaacaaaaaaaacaacaaaaaaaaatacaaaaaaaacaaaaaaataaaataaaaaaaaaaaaaaaataaaaaaaaaaaaaaaaaaaaaaataaaaaaaaaaacaaaaaaaaatcacaaaaaacacaaaaacaaaaaaaaaaacaaaaaacaaaacacaaaaaaaaaacaaaagaaaaaaacaaaaaaaaaaaaaaaaaaaaaacaaaaacataaacaaacaacaaaaataaaaacaaacccactaaacaacaataccaaaaaaaacacaacaaaaatacaaaacaaaaaaaaaaatacataaacacaacaaaaaaaaaaacaacacaaaaaacaaaaaaacaaaaataataaaaacaaaaacaacacaaaaaaaacaacaaataaaaaaacaaaaaacaacaaaaaaaacaacaaaaaaaaacaaaaaaaaaacaaaaaaaaaacaaataaaaaactaaaaaaaaaacaaaacacaaaaccaaaaaaaaaatcaaaccatacat

SEQ ID NO: 26075 - DNA, 522 bp, Zea mays
  unsure at all n locations
  Clone ID: cC-zmle189094d02d1
tccgattgataccaactagcaacatacatagtgaagtacacnatcatcatcttagcaccaatgggagccaagagttggccctccttgccctccttgctctttcaccacgcgctgctacctcgacttttattccacaatgctcacaacaatacctctctccggtgacagccgcgggatttcaatacccaactatacaatcctacatggtacaagaggccatccaagcaagcatcttacggtcattagcattaaccctccaacaaccatatgctctattgcaacagccatccttagtgcatctgtatctccaaagaatcgcggcacaacaactacaacaacagttgctaccaacaatcaatcaagtagttgcagcgaaccttgttgcttacctcgagcaacaacagtttctttcattcaatcaactagcttggggtgaaccctgctttctacttgcaggcacaacagctactaccatttaaccaacttgtccggagcccttatgccttctactgcaacaacagc

SEQ ID NO: 26076 - DNA, 115 bp, Zea mays
  unsure at all n locations
  Clone ID: cC-zmle189094d03d1
tggcagaagctgaagctgctttgaatgaggcagaggctgcagaagcagaagcccgancgttttatgcannngccgaagcgagagcanagacanggaagaacagaaangcnggaaa

SEQ ID NO: 26077 - DNA, 310 bp, Zea mays
  unsure at all n locations
  Clone ID: cC-zmle189094d06d1
ggaaggatccggngcatgcagttgnggccggcctacggcaacaagaagttcgaaaggctgtcttacctgccgccgctgtcgaccgaccacctgctgaagcaggtggactacctgctgcgcaacggctggataccctgccttgagttcagcaaggtcggcttcgtgtaccgcgagaactgcacctccccgtgctactacgacggccgctactggaccatgtggaagctgcccatgttcggctgcaacgacgccacccaggtgtacaaggagctgcaggaggccatcaaatcctacccggacgccttccacc

SEQ ID NO: 26078 - DNA, 294 bp, Zea mays
  unsure at all n locations
  Clone ID: cC-zmle189094d08d1
tggcgaaacaattttacaatttcaccaaacccgagcacacgcaagggaggcnggggttggattattgaaacccaatccaccaaacccattgatccatggacggtatcgatgtggtaaaggtcgttatgcctgaggaatattaccaaaaggcatatagggggaggttataagcgcctataccagaaaaccgattgtagatagaatcaaaaatacatatattggcgcaaacacaaccaaagaattctacctttcacgatacgcaaacattcgtttcatacaatatggagaatggcg

SEQ ID NO: 26079 - DNA, 634 bp, Zea mays
  unsure at all n locations
  Clone ID: cC-zmle189094d09d1
aaaaaaacaaaaacaactcaaattcaaaaaaaaaaaaaaaaaaaaaaaaaagaaggattaaaataaaaaaacaaaaaaccccacccccaaaaaaanaaaaaaaanaanaaaacaaaaaaaaaaaaaaaaaacaaaaaaaaaacaaaaaaaaaaaaaacaaaaaaaaaaaaaaaacaaaacaaaaaaaaaaaaaaaaaaaaaaaaaaacacacaaaaaaaaaaaaaaaaaaaaaaacaaacaaaaacaaaaaaaaaacaaaaaaaaaaaaaaaacaacaaaaaaaaaaaaaaaaacaaaaaaaaaaaaaaaaaaaaaaacacaaaaaaaaaaaaaaaaaacacaaaaaaaaaaaaacaaaaacacaaaaaaaaaaacaaaaaaaaaaaaacaaaacacacaaaaaacaaaacaaaaaaaaaaaaaaaaaaaaaaaaacacaaaaaaccaaaaaacaaaaacaaaaaaaacanacacaagacaaaaaaaacaaaaacaaaaaaaaaaaacaagaacaaaaaaaacacaaaaacaaaaaaaaaagaaaacaaaaaaacaaacaacaaaacaacaaaaaaaacaaaaaaaacaaacaaaaaaaacaaaacaaaaaacaaaaaacaaagaaccaacaac

SEQ ID NO: 26080 - DNA, 248 bp, Zea mays
  Clone ID: cC-zmle189094d12a1
taaaatacattacacaacaattctattaaacatatcaaaaaaatatatataaatactaaactaattaaaattaaaaaacaacattgaataaacttaaatacaatatattaaaatctaacaataaccatatataatccaatcaacataattcttaaaaaaaaaaaaaaattctctatttacaaaccttaatttatatccaaaaacctaatttactttccattcacataaaatttttagaatactaaaaa

SEQ ID NO: 26081 - DNA, 466 bp, Zea mays
  unsure at all n locations
  Clone ID: cC-zmle189094e01d1
cttcctcgacggcacgtcggttaggcacccgcgcctccgcttcggaaaggcnagctgtttttaactacacgcgcgagtgcgccatatacgccgtctgcgcaggcagagaggcccagatcgtgttccagtgcaacatcttacgaggcaggtggtgggcccccaaagaagacaactgtattcaagtacatgccggagaaggacggcgaccgagaggacgtgatggccgggtccatcagctcggaaggggacgccttactcaatggcgcgctgccctgcctgatcgataaaccctggatctgtctttaggcctgaggactgggaggcagcaatggaccatggagccagcgtcgccggcgctaaaggacataatacagctctgcgcaggaaggcaacccggagcaccgtcccccgggagatcgttgactttaagccatactgatatgctgcagctcactttatcgcttct

SEQ ID NO: 26082 - DNA, 597 bp, Zea mays
  unsure at all n locations
  Clone ID: cC-zmle189094e02d1
gcgtgcggcgagcgcgccatgctcgccagccccggcgacgtccgttgcgctgtcgctctacgcgggcctcgtttgggagacgcatttcgcgacgctggccgcgccgccgactactacagccgcgccgtccaggccgcgcccgacgactgctacgtcctgtgctcttacgccgggttcctgtgggacgccgaggaagacgaggaagagaactccgagcccttgccaccgccttcgctgttccagggggcagctcagcgtccttccatcacagcggcctcttagatgatcgtgaactcgatctagatctcaccaccgcctgtgaacgaagctgaatctggaaccctggagagtggagagtgactgggtgataaccgtgcagaaacccccgacgagtgactcacatcgccggcaggctcctcgccgcttgtgaactgaatcacggcacatgtaaaactgaatctggcagagcacacacgcgcctaagcctattagcgtctatagaccttgcanggctatgtatagtagatatgtagattgagaccctgctgaacttgacgtgcagtatgttcctagtcacttgtgatcattactagtaat

SEQ ID NO: 26083 - DNA, 422 bp, Zea mays
  Clone ID: cC-zmle189094e03d1
cactcgtccgcccacgcgtccgtgattgctgggatgatgacaatggcccgcagttgtatcagggtagccctttttatcatacttctcctggaagcgcctcagccatgggaaaaaatgtgtccaatgcaaagacgtttcttgaaaagagatacacagaagatatggagcttgatgatgccatccacactgcaattttgactttgaaagaaggatatgaggggcaaatttcctccaacaacattgaaatcggaattattcgagctgatcgtgagttcaaagttttaagcccagcagagatcaaggatttcttggaagaggtggagtaagctgtctgttgatgatactagttcagacaacaatagcagcgtcacttatgagcagccagcctgaagattgtcttggttttattactcttgtaactg

SEQ ID NO: 26084 - DNA, 368 bp, Zea mays
  unsure at all n locations
  Clone ID: cC-zmle189094e04d1
gcgtgcggggagacgaatagagccaaaacgaagaacagccgggtagaggaaagggagacatgctcgcctcaccggggggggtctttgcccaatccttcgctgctgcccacccatggaaacatacttgatgcgtcgcctcccgtgcncacgccggcacgctgcgcggcgctgtgcgtcgtagcaaggtcaaggtggccactccccagaacgaccgcatgggccgccaacgccggctacgcaggaaggtcagagggaccactgagaggccgaggctgagtagccgtccgatcaaacaaacatatgtacgcataactcatcgaccacacaaagcagagaactatggctcagctcaaaccatgcacaaatct

SEQ ID NO: 26085 - DNA, 406 bp, Zea mays
  Clone ID: cC-zmle189094e05d1
cgtgcgtccacgcgtccgatgctctcttccctggccctggagtgcttggcttctttcttccttccttccttacatgtttctctatagtatatatgcatatatgccaccgctttagctggctggctggctcgccgccggcggccttctgctcggacccttggatctcccctgcctgcgcggcgggggcacggtggacctaaatagagctagctagcctgcgcaggccggaggaccggagtcggaggcgccggaggtacggtgtgtgatgccctggcgtggtatggtatttatgggtgcctggccgcagaggagatggtgaaggaaattattaataaaactatgataatgataacgggtgggtgggggttgctgcacctgcctggggaattgagcatgtatatactat

SEQ ID NO: 26086 - DNA, 447 bp, Zea mays
  Clone ID: cC-zmle189094e07d1
gcccacgcgtacgggcgccaaagtcaaggcttttcatggcgagccccgggctgtgggacgcgcgggcggggatcggtccggctcccgagcgcatcaacggccggctcgccatggtgggcttcgtgtccgcgctcgccgtcgaggcgtcccgcggcgggggcctcctctcgcaggccggcagcgggtccgggctcgcctggttcgcggacacgggtgccgtgctgtccgtggcctcgctggtgccgctggtcaggggcgacagcgcctaggccaggagcggcgccggcatgagcgccaacgccgagctctggaacggccgcttcgccatgctcggcctcgtcgcgctcggcttcactgagtaccttaccggcgcaccgttcatcaacgcgtagaggcggttcagtacaagacagtgcttatatatttttggacgttggaactgcgtat

SEQ ID NO: 26087 - DNA, 537 bp, Zea mays
  unsure at all n locations
  Clone ID: cC-zmle189094e08d1
cgtccgaatagagcagcttcgctcagatttccaagagctttggttttcccttaagaagcagcaggaagatgtgtgactgtggcttgaagaatttggggcttcaagatgctaccgaaaatgatgggaacaaaggaaatggagacggcacaaatgaggtcttgtcagctaacttggggaacttgaaactggatggttcttctgaaaactatgatgaaagcagagagtcaaaggaggacaagttggaaaacaccgacactgctggtgatggcatcgtcgacaaagctactaaggagacgagctcaactgatgaacaattctaacacaggaaactgaactacactgttcgtgtctcagctgtagaaattctaggaacatcgatacatgagttcctgtaagagagcgagtccatgctttgctatggctcagtcgggttggttatggaactctattgggacctgtgagtcgtgaggatccaaatctcctctagaattgtgtaccaatngacagttacgatatggtatcatggacattttgctc

SEQ ID NO: 26088 - DNA, 516 bp, Zea mays
  Clone ID: cC-zmle189094e09d1
cgtccgggcatatgcgatgaaggctgtgagaacttgaaatggcttctaaattgaaggctctaagtttagggggggggcggtttacagatgcatgtttaattcatttaaaagatttggtcaacttggagtgcttgaacttggactcatgtaagattggtgatgagggtctatttcacctaaaaggcctcatacagctaaaaaacctggagctttcagacactgaagttggaagcaatggacttcgtcatctctctggtctgcgtaatttgcagagcatcaatctctctttcacattggttactgacattggtttgaagaagatctctggcttgagttcactgaagtctcttaatcttgacaatcgccaaatcacagatactggtttagcgtctcttacaggtctcactggattgacacacctcgacctatttggagctcgcataactgattctggcatgagcttgcttagaattttcaagaatattcagtccctggaggtctgcggtgggttgatta

SEQ ID NO: 26089 - DNA, 202 bp, Zea mays
  unsure at all n locations
  Clone ID: cC-zmle189094e10a1
cccccaacccctcnttttctttttatacagccaacgacaaaaaacggacganagtttttaaatgaattcacgggcacccccccatgaaaaaaatccttaatgtggttattgagtgctcatgcaaaagcttatactgggggggaataagacaaacatgttgttcacaggggaaaaggaaagaagttatgttagtggattcttg

SEQ ID NO: 26090 - DNA, 644 bp, Zea mays
  unsure at all n locations
  Clone ID: cC-zmle189094e10d1
aaaaacaaaaaaaaaaacaccaaaagaagggttttttttttatanaaactgatttattcatctcctatatatattttttattatttctttatttttattttttatttttttatatttataattttattaatatttaatttcctattttattattttttattcttttaatttattttcatttttttttttaaatatttttatttttttttattttttttatttttattattatatttttttttaactttttatttatatattcctttttataaattatattactattttttcatcttttatttttacatttgtagaattatttttttttttattttttttaaaaatttttattatattttcttttattttttttttttttttttttatattaattctttttatttttaaaatatttaattatattttttttttctatttatttttaatattaaattttctttttatatttaaccttcatttatttttaatttttttaatttataattattattctattatttatttataattttatatttttttctactatatttaatattatattattgtctgtttattttaaattatcattttattttctttatattaaaatatatttttttattgtatttatctaattattt

SEQ ID NO: 26091 - DNA, 702 bp, Zea mays
  unsure at all n locations
  Clone ID: cC-zmle189094e11a1
ccgcccttcnnnnnnaaanttttntttttaaaacacccacaaaaaaaaaaacacgtnnatttttttaaaatancaccaccaccccccccccattatttaaaaatgaatttttaaaataatatttaaaataaaacattcattaatttttattatacatttatatatattataataaaaaaattttttttttttaatattaaaaaaaataaataatatcttatttttttaaatataatattcataaattaatattattataacaactattaatatatatataattaatattcatattcattttcctatattattttattaatattatgaataattccaatattaatatttaaatttatattgttacaaaatttttaaatttataatttattcttgccttaataaaatatataattttttttttttttaataaattactattaattatttctccatatatttttatttatatatatatataaaatctatattaatatttttaatatctttatatttaaaattcatttatataatttataatctcactttataaaaattatatattatataatattaatttttaattttctatttaaatatttttatataataattataataatctatacattttataattttaatcttttttaaaaattaatttatcaatattacatttatttatactaattaaaattaaatttt

SEQ ID NO: 26092 - DNA, 432 bp, Zea mays
  Clone ID: cC-zmle189094e12a1
ccttcctttttagcggaagcatttcaatacattcacgcatactgttagacaaatatttatcaatccaccgtcatagatgacatgtttcctttcttaacaagaaaatgtcgatgagcaactaaaaacaaaatgagatgaaacacaggacaacttttcatttccagtacactattaaaatcgggcccctagcatggatgcctttaccgcttgccttcgatagggagtatttccaatccagccattcaagtaatgcaagccatttctgagataaatagccattggtttctctccttgtctccttgagataaaagccctactggccgcgccgctttctcgtaacttcctttgggaacttgagaggggctgggagcgtcatgaaagtagacttaaaagcaccatctgacacagatttgcatcccaactggtcatagt

SEQ ID NO: 26093 - DNA, 282 bp, Zea mays
  Clone ID: cC-zmle189094e12d1
attttattaaaccatactatccaccacccaatatgcaaatttgtaaaaaattattcttttaaatttacttttatgatctttcctatcacctcttaattttccaaatgaattttactaaatatcttttacttatataattattattattttaattatacattgatataaaccatatattatttatctcactaatttcttgcattacattattgttttaattttaaatatttattatttattgcatttttttaattcttccatgcttggatacctacttttaat

SEQ ID NO: 26094 - DNA, 522 bp, Zea mays
  unsure at all n locations
  Clone ID: cC-zmle189094f01d1
aaaaaaaagagaaaaaaaaacaaaaaaannnnttcaaaaaaaaaaaaaaaaaaaaaaaaaaaggnggggntttaaaaaaaaaaaaaccaccaaacaacaaccaaaaaaagaaaaaaaaaaaacaaaaaaaacaaaaaaaaaaaaaacaaaaaaaaaaaaaaaaaaaaaaaaaaaaaaaaaaaaaaaaaaacaaaaaaaaaaaaaaaaaaaaaaaaaaaaaaaaaaaacaaaaaaaaaaaaacaaaaaaaaaagaacaaaaaaaaaaaaaaaaaaaaaaaaacaaaaaaaaaaaaaaaaaacaaaaaaaaataaaaaaaaaaaaaagaaaaaaaagaaaaaaaaaaaaaaaaaaaaaaaaaaaacaaccaaaaaaaaaaaaaaaaacaaaaacaaaaaaatcacaacaaaaaacaaaaaaaacaaaaaaaaccaaaaaaaataacaaaaaaaacaaaaaaaacaaaaaacaacaaacaaaacaacaaaacaacaacaaaacaaaccaaaaagtaaaaaaacaa

SEQ ID NO: 26095 - DNA, 365 bp, Zea mays
  unsure at all n locations
  Clone ID: cC-zmle189094f02d1
cgtgcgggcggatgcttgggttactggtcttagtgccttgatttgncgaggacaacatggatcctaggtccagcatgtagtttgttatacggatcgctggactccctcccgattttccaagatcagagaggcaatttcatactgtgcaaaagcaatttcgctatgcaagtcacgcatacagaacctgaaaagttccaaggatgctttgttggctggtatagatggtggtgatgcatctgctgctgaaggaggctcagaaaaatctaccgttgaaaaagagctagagcagcttactagcatatagcctgatcttgagaagaagcttgaggacctgtctgaagcaaacccaagccctgacatggatg

SEQ ID NO: 26096 - DNA, 263 bp, Zea mays
  Clone ID: cC-zmle189094f03d1
cgtgcggaattggatattgtaataaacagtaaggaaaatggatagcctcaataaaccattgtatttgtagcatatggaaaattgtatatcaaggccatttgtgcctcattgctgttttccagtctaaaaaaaaaaaaaaaaaaaaaaataaaaaaaaaaaaaaaaaaaaaaaaaaaaaagggcgaacatatctaaagaaaacaaaaatacaaaacacatgcatccaacgataaagcttttaaataggagaacctaaatcaaat

SEQ ID NO: 26097 - DNA, 254 bp, Zea mays
  unsure at all n locations
  Clone ID: cC-zmle189094f04d1
cgtgcgcccacgcgtccggtgtttgtgttgcccatctnggttttgattgcaaggtcgctctgtgtcaggnttggtgctgtgttcatcctcggtttcagcacacccatgcatcaaacagcatggactgcggatcgatggatgctgttacccccgtcaggctttattctaagttaatcttaaggaaaaaatggtgcttcttggtgctgcataaaaaaaataaaataattaaaaaataaaaaaaaaaaaaacaaaaa

SEQ ID NO: 26098 - DNA, 358 bp, Zea mays
  unsure at all n locations
  Clone ID: cC-zmle189094f06d1
aaaaaaaanaaaaaaaaaacaaaaaanaataaaaaaaaaaaaaaaacaaaaaaaataaaaacaaaaataaaaaacacacaaaaaaaacaaaaaaaaaaaaaaaacaaaaaaaaaacaaaaaataacaacaaaaaaaaataaaaaaaaaacaaataaaacaaaaataaaaaaaaaaaaaaaaaaaaataaaaacacaaaaaaaaacatcaaataaaataaaacaaaaaaaaaaaaaaaaaacaaggggaggagggagaaaagaagaaaaacaaaaaaaaaaaaaaatcaaataaaaaaaaaaaaaaaagaacaagggagaaaggaagaaaagtgacaaacaaaaaagaagcaaaagaga

SEQ ID NO: 26099 - DNA, 223 bp, Zea mays
  Clone ID: cC-zmle189094f09d1
gcgcccaagccctgccgaccatggtccgccgtgccttctacttcgccgctgtctgctccaagaagaagatcaagaccgacaagccctacgggattgggggtggcctgaccgtcgacgtctacgccaacgggagaaagggcaagggcaagggcgtgtaccagatcgtcgacaagtactgcgcgaacgtcgacggatacagcccaatctacaacgaagatgactg

SEQ ID NO: 26100 - DNA, 363 bp, Zea mays
  Clone ID: cC-zmle189094f10a1
cctcccttttttttttgcgcttgacatttatttgggtgggtctcgagtgggaagggacacccaatcaaacatgcaaaacaacaagagctagcttattgatggctgcctgcttgtagcaaggcggacggacggaggagcatggaaggatccatcggctgtgccgctgtggatgagtctagtggatcttgcagccgcagttttcggggaggaagtcgcggcacctgtacttggtggcgcccttgtccgtggacacggggacgcagttcttgcaggtggcggcgcacttggtgaggaggtcgtcgcaggtccacacgcccgaccagctggtgcactcgccgcaccagcactgcttcttcgtcgtcg

SEQ ID NO: 26101 - DNA, 529 bp, Zea mays
  Clone ID: cC-zmle189094f10d1
gcttgcgttcttgtagtagaggtcggcagcaagcggtagtgcgataggtcgagaagatgaagagcagcactcgggtggggatcctagttctccaggcccttcccgtctctgcggccgtggccaaaggacctgcagggccgacgacgaagaagcagtgctggtgcggcgagtgcaccagctggtcgggcgtgtggacctgcgacgacctcctcaccaagtgcgccgccacctgcaagaactgcgtccccgtgtccacggacaagggcgccaccaagtacaggtgccgcgacttcctccccgaaaactgcggctgcaagatccactagactcatccacagcggcacagccgatggatccttccatgctcctccgtccgtccgccttgctacaagcaggcagccatcaataagctagctcttgttgttttgcatggttgattgggtgtcccttcccactcgagatggaataatataaatgtcaagcgcaaaaaaaaaaaaaataaaaaaaaagggggggccgttctaaagat

SEQ ID NO: 26102 - DNA, 627 bp, Zea mays
  unsure at all n locations
  Clone ID: cC-zmle189094f11d1
aaaanaaaaaaaaaaaaagcaaagaaaagtttatatttttattatcttttattccccacccctaaaatttaaataatttataatattttttatttatttaataattatttattaattatatatttattaaattatatttataatatattatttttaattatttattatatattttttattaaatttattattattaatataaattttatttttttttttaaataattatattttatattttaatattttaatatttattatatcttactatattatatattaaataattaattaattattttttattattaatttctataattatattttattatataatttttatatttattttaaattattattattttttatattatatttttattatatatataataaattttttcattatattatatatttaattttatatattaatttttaatatttttattttatttatatataatattaattatttattattaatttataaatattaatatatatttttttatctaatatatatattaaaatataataaaaatttaatattttttatttttaataattttaatataatctttttatatttttataaattgtatatttaatatattttta

SEQ ID NO: 26103 - DNA, 309 bp, Zea mays
  Clone ID: cC-zmle189094f12d1
aaaaaaaacaccgatccgccccaaaccaaaaaagaggggctttatataacaagggcaggccaaagctagaaaaaaaacggcggaagtggaacattgaaaccaaatgaaggatgagggaacaaaaacaaccacagccaccacatgggagggggggccgggcttgcctaaaccccgaaaaagaaaaacacaggggaaacttaaggggggccgaaaatgcaaaaaaacctaaaaattctcccagagaaaaaaaaaggggggggaggggggcgccgtgaagcccaaccaaacaaattgggaagaggccccacc

SEQ ID NO: 26104 - DNA, 588 bp, Zea mays
  unsure at all n locations
  Clone ID: cC-zmle189094g01d1
gcgtgcgattcttggtttgtcacatggatttctccttggacanttgcaatctctgggttttgatttccctaaaaggaggagtgtgattgctgtatgccccaagggaacgggcccatcagtcagaagactttatgttcagggcaaagagatcaatggtgctggtatcaatgctagctttgctgttcaccaggatgttgatggaagggcaacagatgtagctctagggtggtcagtagctttaggttctcctttcacatttgctactactctagagcaggagtaccggagtgacatttttggcgagcgaggtattttgcttggtgctgtccatggcatggtggaggctcttttcaggagatacacagaacaaggaatggatgaggactcagcatataagaatactgtagagagcatcactggaattatatcgaaaactatttcaaagaagggtatgcttgaagtgtataactctctgactgaagaaggaaagaagcagtttattgaggcctatagtgcagcatattacccatgcatggacatattggatgagtgctatgaagacgtctcttctggaagttgagatagaag

SEQ ID NO: 26105 - DNA, 415 bp, Zea mays
  Clone ID: cC-zmle189094g02d1
gcgtccgaggaaaccaaaccttatcaccatggccgcgcccgtgttgaatgcgccggtgcccgccagggcgcacacagcggttgctatctagaggataggcacgctcccgcacttcgctcctacgtgcatacggtcatccctcagccgccgtcaccggtccggaacgctataggggacggcatgctgaaatgtgttcggaaactacttgcaggcagcaacctatggcgaatcccatggaggcgggcgctcggttgcatttatctagctcgctcgggcacacagcatagggctcttactgacgcatgcatgcaagtagaactagacataacacctccgggtcaaagaacaatgaccgccgcaccaaatgacactgactcatgaacaactctatcagggacacatgacgggacgacta

SEQ ID NO: 26106 - DNA, 509 bp, Zea mays
  unsure at all n locations
  Clone ID: cC-zmle189094g03d1
acgcgtgcaatctctgtctcgcgctggcgcagcgcagggcatcgtcacgcgcgcctcatccggtaccggcatgacnagcngcttctagctcttcaccgcgcgccgcgccgcccgtggggcccgcctctccgacctcgacctggatccgcacgccgacgcgctccgggaccagcacggacttggcgcccggcaccggcgccgcgggtgccgcccgcgacgccagctcgacgccgccggggacgtgcggcagcacctgcacaccggggccccgccaccgcgtcgccgcgggtcgtacaccgtgaggatccctcgccccagtctctctcccgattgattattgtcgtatccgttgtgttgtggctggatcggagaatctccggcgttggcttatagaattcgtggacgctattaggattcggctcccgcgaaattcaatgatgaccggaaatgccgattttaatatcataattacatagctcgggaaatgggtatcaatagggattacgcac

SEQ ID NO: 26107 - DNA, 558 bp, Zea mays
  unsure at all n locations
  Clone ID: cC-zmle189094g04d1
ggaacgggccagctcagatcacaatcacatcctgatcaagctggactacccgcacgaggtccgnagctgcttttacgggtactacaacgcgtgcgccgaggaagggcccagggtgctgcgttcgctcaccctcgtcagcagccgggggaggtacggcccgttcggcgacgaggtcggcgcctacttcacctccgccacgacggaggggaaggtggtgggcttccacggccggagcggcctctacctggacgccatcggggtgcacatgcagcactggctcggggtcggggtcggggacgccagaaccgctcgcgcttccgctccttccaagtactacatttccaggtacctgttctgaagtgtatactatactagcagcgtcttctctgcatgcacgcggcaacaggttcactgtgcagttctgaacctcgtcatgtcatgtctaatgattggcggcggtagtttgctgcttttcggagccaatgatgtgttcctttcatgttctccacatgatattacaagccacgttcactggaaaaaaaaatataattaattata

SEQ ID NO: 26108 - DNA, 527 bp, Zea mays
  Clone ID: cC-zmle189094g05d1
gcggccgccgactagaaaacgtcctgatggaatgaatggctgtttcatcgattcgccacttctcgtgattgctagcgggagatcagtttgttccaaaaggacttatcgcacatcggaggacggccgaaatgtcaggaagctgcatggaagaacagaagagagccgcaggagctggaattcctggacattactattcagttccctctgtaaagcagcaacgctgttttgcaagcctcccatgctaatttcgcgctgccaaatattagcgtgatcgcgaagctagccagtcctggcgcgtctagtttgccgggttgtctgacaacaaaagttagtatgaatatgaaagggccttccttaatgttttttcccacttggtgctgtataaaggttcagtgtatattccattcaggagaatgagaaaaagttcaacactccagtgtgggtggattcaaaacaggcgacttttaattttgaaagtttcagtagatctgttagtttatagtttatactttgaaagtttcagtagt

SEQ ID NO: 26109 - DNA, 400 bp, Zea mays
  unsure at all n locations
  Clone ID: cC-zmle189094g06d1
accccgtgctccgggacttcctgctccggtcccanctcgccgccgccgccgacgcgttcatcctcgacatgttctgcgtcgacgcgctcgacgtcgcgccgcagctcggcgtcccggcctacttcttcttcgcctccgcggcgggggacctcgccatgttcctcaacctgccgtacctctaccccaccctgccgtcgttcagggacatgggcgaggcgccggtgcgctgccccggcatgccgccggtccgggcgatggacatgccgctgacggtgcaggacagggacagcgaccggaccaaggtccggatgtaccagttccgccgcatcccgggagggaagggcgtgctggtcaacagcttcgcctggctggagccccaggcactgagagcgctcggcga

SEQ ID NO: 26110 - DNA, 277 bp, Zea mays
  Clone ID: cC-zmle189094g07d1
cgtacgccacgcgtcgagcagtcaatgtgggactcatttatgaggcgccagtcgctggctcggggggggtgcctttgaactgtgtagcaccaacctaaataataaatgtgtttgattcggactcccttcgccagaaagaaaaaaagcatgatgaatgaatgaaatatacgtgatcagcataagagaacagatatataaacaatatgcactcggtctaggaaggaacactgacaagatacattcacaatggttccatgttatcatgatggctcattgg

SEQ ID NO: 26111 - DNA, 529 bp, Zea mays
  Clone ID: cC-zmle189094g08d1
aaaacataaaaaaaaaaaaaataaaaaaaaaaaacaaaattaaaacaaaaacaaaaacaaaaaacaaaaacaaaaacaataaaaaaataacacaaaaaaataaacaaaaacaaacaaaaaaaaaaaataaacaaaaaaaaaaaacacaacaaaaaataaaaaaacaaaaaaacaaaataaaaacaaaaaaataaaaacaaaaacaacaaaaaaagacacagaaaaatacaaactatacaatacaaacaaccacaaaaaaaaatacacacaaaaaaaaaataaaataccaaccacaaaccaatcaaatacaaaaaaaaaacaacaacataaaaaaaaacaaacaaaaaaaaaaacacaataaaaaaaaacaaaataaacacacataaaaataaaaaacaaaaaactaaaacaacaataaaaataaaaaaatataaaaaaaacatcaaaaaaaaaaacaaataaacaataacaataaaaaaaacacaaaaaaatacaaaatataaccaaacaaaaaaacttaaatacaaaa

SEQ ID NO: 26112 - DNA, 446 bp, Zea mays
  Clone ID: cC-zmle189094g09d1
caaaaaaaaaaaaacacacctttctttaaaaaaagaaaaaaaaaaaaaaacaagaggaagttaaatttaaaatactaaaacaccccccacccatataataaaaaaaaatattaattaaaaaattaacataatatctaaaaaaaaaataaaaaaaaaaaaacatataaaaaatataaaatcaaaaaaaaaaaaaaaaaaaaaaaaaaacatatacaaaaaaaaaaaaataaaataaaaacacataaacaaaaaaacaaaaaacaaaaaactaaataataattaaaaacaataaataaaaaaacaaaaaaaaaaacaaaaaacttaaaaaaaaaaataaaataaaaaataaaataaaaaaaaaaaatataaaataacaacaaaaaaaaaaaaaaattacttatacatatataaacacaacaaaaaaaaaaaaataaacataaataaaa

SEQ ID NO: 26113 - DNA, 570 bp, Zea mays
  Clone ID: cC-zmle189094g12d1
aaaaaaaaacaaagaaaagttttaatttaaataactgatcaaccctaccctatataaaataaaatataatattaaaaattcatataaaaaatataataaaattaaaaaattaaaaaatttaaaaaaaaaaaataaatattattataattatataatatataaaaaatataaaataaaatataaaaatataataaaattaaataaataaaataataaaataataataaataattaaaaaaaaataaataaatataaaaaaataaatataaaaaaaataaaaaataaataaaaaaattaaaaataataattttataataaatataaaaaattaaaaaataaaacacaaaatataaaatatttaaaaaatatatataaaaattaaatatatattaagtaaaaaaaaatatattaaatactataataataaaaaataaaaaattaataaatatttataatacaaatataataacaataaaaatattaaaatatattaatatataaaaataaatattaaatataataatataattaaaaaaattataaaataaataaataaataaattaaatata

SEQ ID NO: 26114 - DNA, 286 bp, Zea mays
  Clone ID: cC-zmle189094h01d1
agaggggaaaggaacagacaaagataagaaaacaaagaaagcaacaagaaatgagcaggaccgaaaacacgagcaaaaaccagaaaaaaaaggaacggagcagggaagaagaacagagaaggagcaaacgagaaagggaaaggcgagaaaaagaacaacaggacagcgggagccgaaaggagagaaacggagaaggaatcatcaaaggctgaaagggggaagagcaaggggaaaccgtaaccaaagaagagaggctaagagaaaaaaaaaaaaaaggaaggccgga

SEQ ID NO: 26115 - DNA, 530 bp, Zea mays
  unsure at all n locations
  Clone ID: cC-zmle189094h02d1
gcgtccgcccacgcgtccgaagcaagcaagcaagcagcgagacttacatactaggcagccaggcagccatggcggcgccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctncccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaagc

SEQ ID NO: 26116 - DNA, 495 bp, Zea mays
  unsure at all n locations
  Clone ID: cC-zmle189094h03d1
gcgtccggaggtgggctggcttctcctccccctcttaccatgncttcctcgggttagggttccttagggttttgggggggggctttggcggcggctgatgtggaccacagttgcttcgtcggcgggcttgcctgggccaccagcaacgagtcgctggagaatgccttcgcctcctacggcgagatcctcgactccaaggtcatcaccgaccgggagacggggaggtcccgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggcggttatggtggcgggcgccgtgacggcggttatggcggcggtggcggctacggcggtcggcgcgaaggtggcggcggcggctactgaggctgtggcggc

SEQ ID NO: 26117 - DNA, 457 bp, Zea mays
  unsure at all n locations
  Clone ID: cC-zmle189094h10a1
cccttcatttttattttattataattctattttgtgtgagctagtcttattgtatttttatatctcccctttttttttttttttttttttttttttttttttttttnaaaaaggccccatacatatggagtttacttctcaaatctagtaaaattaaatttcttgtttggattcttcaaatctgagagtccaaaatttagcaaaactgcaaaagtacatgctcatgtcccacaaaacccgaaggcatttgtaaagggagctacaaaactaccaccactgaggtgaaagctgttattcatcaactgtgaactttcaagttaaatcagggatctccaaccacacaaaaaactgaaggccatgacttgcacaagggacccaaaaccagtggtcgccaaaaatccacttttctataggggtagctgcatcttctaaaaacaattattgcgataattggacc

SEQ ID NO: 26118 - DNA, 511 bp, Zea mays
  Clone ID: cC-zmle189094h10d1
cgtccgcccacgcgtccgcggacgcgtgggcggacgctgtgtattgtattaccatcaaaagttgtttctctggggtggtgtctcatctggagcaggcattgccgccctcgtgcatccagtgcatggacaatggttgggttgtgccttgggagatattgcaggtccaattatcgctataattgtttttgagaagatgcagctaccactatgagaaactggatttttggcgaccactggttttgggtcccttgtgcaagtcatggccttcagtcttctgtgtggttggagatccctgatctaacttgaaagttcacagtttgatgaataacagctttcacctgagtgctcgtagttttgtagctccctttacagatgccttcgggtcttgtgggacatgagcatgtacttttgcagttttgctaaattttggactctcagatttgaagaatccaaacaagaaatttatatttactagatttgagaagtatactccatatgtttggcgccttct

SEQ ID NO: 26119 - DNA, 621 bp, Zea mays
  unsure at all n locations
  Clone ID: cC-zmle189094h12d1
atccttaaagcagccccctncaaanaaaattttttttaaaacaaaaaaaaaaaataaccaagagaagttttaatttaaaaaaaaataatcccccacaccttaaaaaaattaaaaaaaaaaaaataattattaaaaaatataaaataaaataataaaaaaaaacattataaaaataaaaaaaaaaaaatataaaaaaaaattaaaaaaaataaaaaatactataacaaaaaaaaataaaaaacaaatccccacttttaaaaaaaaccatattatctaaaaaaaaaaaaaaaaaataaacccttcaatataaaaaattaaaaaaaatataattcaaaaaaaaacttcataaaaaaaaaaataatacaaaaaaaccccaaaaaaaaaaaaaaataaaaatcatcgtcaaacaaaaaaattccaaacaaaaaaaaaaaaataactttatatcccaattacataaaaaaatataatctttgaagaaaaataaaaacaacaataaaacacaaaaaaatataatttaacattacttaattaaacaaaaacaactaaaaaaactaataatactattaataatacataaaaaactaattaaaaaaataatacacaccataaaatatatat

SEQ ID NO: 26120 - DNA, 422 bp, Zea mays
  Clone ID: cC-zmle189096a01a1
ttctctttttttttttttttttttttttttttttttgggttgggtttgaacaaaagcaacatccgttcataactaaaaaagaggggctctttattacaagggcatgcatatgcttgaaaaaaaatgtctgaattgaatcattgataccatatcaagtttgagtttacaaaatcaaccccagcccccccatgggatgtttggccaggtttgcctaaatcccgaaaaagtaaaacacaggggattcttatgggggcccgacaattctaaagactcttaaaattctccctgataacaaaaatgtttgttcaagttgtcgccgtgatgctcaaccaaacatattgggaagaggcctcactgccatgaatgcattgaccatttcttcggtcacttgagctctagctctctgggggctagcaacaatc

SEQ ID NO: 26121 - DNA, 585 bp, Zea mays
  Clone ID: cC-zmle189096a01d1
tccggagatactggattggtatgagaacgggcagaagttcaatctttacacggggagggggccctcgtcggaggggctgggcctcggccacctcatccccttcatgttcacaaaatacttgcaggaggcttttaaggtgcccctagttatacaactgactgacgatgagaagtacttgtggaaaaacttgactattcaggaaagtaaaaggcttgcccgtgaaaatgctaaagatattatagcatgtggttttgacattgaaagaacattcattttctctgatttttcttttgttggaggtgctttttatgaaaacatgatgcaagttgccagatgtgtaactatgaataaggctattggaatatttgggttcaatcttgaggatcacataggaaaggttagctttcctccagtgcaggcagtcccatcattcccttcttcatttccccatctcttcgctggcaaggaccaactgcggtgtcttatcccatgtgcaatagatcaggatccatattttaggatgactcgtgatgttgctcctagaattggttatcagaaaccatcactgattgaatctagattttt

SEQ ID NO: 26122 - DNA, 478 bp, Zea mays
  Clone ID: cC-zmle189096a02a1
ctaaaactgaagtttattgcatagaaagagttacatttattacaagtcccgatatactcaaagtgcataacttattacaatagcaggaaggtaggaaccctccaaagcttatacacaaacctaactaatcctcctccagacatggaaacgccttccagccacaggaacacttagagtactcctcatcacctttgttgcagtgaagaggctcaagacctttctacccaataaccagttagatagctccatccacttgatgaataggcaaaggagcaaactcctcttccacaaccacttcatcttaaatttacactccttctgttgggagctctagccacagtgatgtggacaatggtcaccacggagagggctggcgtgcttggctctagtacagatcaaggctagagactggggagaggaagttacaccatcttgacggcacaaggaccaccttacatatgcagggaatctagagctc

SEQ ID NO: 26123 - DNA, 508 bp, Zea mays
  unsure at all n locations
  Clone ID: cC-zmle189096a02d1
gcgggcggtggtaaaggatcgcactgtccttgagctctagattccttgcatatgtaaggtggtccttgtgccgtgaggtggtgtaacttcctctccccagtctctagccttgatctgtactagagccaagcacgccagccctctccgtggtgaccattgtccacatcactgtggctagagctcccaacagaaggagtgtaaatttaagatgaagtggttgtggaagaggagtttgctcctttgcctattcatcaagtggatggagctatctaactggttattgggtagaaaggtcttgagcctcttcactgcaacaaaggtgatgaggagtactctaagtgttcctgtggctggaaggcgtttccatgtctggaggaggattagttaggtttgtgtataagctttggagggttcctaccttcctgctattgtaataagttatgcactntgagtatatcgggacttgtaataaatgtaactctttctatgcaataaacttcagttttag

SEQ ID NO: 26124 - DNA, 253 bp, Zea mays
  Clone ID: cC-zmle189096a04a1
ttttatcataaaccgcgctcattcttctctcgcatcgggtcgtatcggaagcctaccaagggagcaacaggggtcccatctcctaatacaaaggtcgaacggacactaacacggtgacagatgcgaccggcaacacgatactatacatagataagatgactcggccggagccagtatgggcccacacatcagttcgtacaaacgtcgacgacgccgacgttagcgtcaccagcaccctcgtgccgtgcgccgt

SEQ ID NO: 26125 - DNA, 392 bp, Zea mays
  Clone ID: cC-zmle189096a04d1
cgctggaatcgctttcggagacccaacacaaccaaggtcctgtaatttgctttagtcccctactgctataaactcggggggggctgaatcaacggacgttatacgcacagcgctccaccatcaaaacccaaaccttccgaccagtagaactgcctgattatcactgaccgaaagcataacggcctaactcgaaggccatcacacactatcttcaaccacaactaactgcgggtgtttggcagaggtcgtctggcacatcacaggattgctccttcgatactattgttggacttgtcaccgttacttccatactggatgttaggttgtatatccgccctacggcgacctgccgttaaggcaaataacttagcttgcaaggctgaccactattt

SEQ ID NO: 26126 - DNA, 521 bp, Zea mays
  Clone ID: cC-zmle189096a05a1
ttttaattataatatgatcatatcagtttaatatgaagggactttacctgtaacaaacttacaagtaacatgtgtctcgtccccaaattggttacatgaaaattatcctttacagctactatcatctccaaagggcgggtaccaactaccaaccacgctacaacaactatacagcgggatgctactaattggaacatacatcttataagccatcttactcacttcatcattactataactctcttggaggggggaaaaagaagacgttcagtcttgttttgtcttctgctacataagtatgattttgcaattacttggcaacaatgagctcgtccagtgtcacaccgtcactgtccgtgctaagaggtggcagcaccaggtcatcatcggcagtgaaatggtacctttcgccaatggctctgaggagctggtaaacctcaaacatggttggcctctccttcggggtggcgagcgtgcaggaacacgcaactttcaggaactgcatcagctcaccatcagcg

SEQ ID NO: 26127 - DNA, 518 bp, Zea mays
  Clone ID: cC-zmle189096a05d1
ccgcgctgatggtgagctgatgcagttcctgaaagttgcgttcttgcacgctcgccaccccgaaggagaggcgggcgagtgtttgaggtttaccagctcctcacagccattggcgaaaggtaccatttcactgccgatgatgacctggtgctgccacctcttagcacggacagtgacggtgtgacactggacgagctcattgttgccaagtaattgcaaaatcatacttatgtagcagaagacaaaacaagactgaacgtcttctttttcccccctccaagagagttatagtaatgatgaagtgagtaagatggcttataagatgtatgttccaattagtagcatcccgctgtatagttgttgtagcgtggttggtagttggtacccgccctttggagatgatagtagctgtaaaggataattttcatgtaaccaatttggggacgagacacatgttacttgtaagtttgttacaggtaaagtcatttcatattaaactgatatgatcatatttgatt

SEQ ID NO: 26128 - DNA, 525 bp, Zea mays
  Clone ID: cC-zmle189096a06a1
ttttgatttaaagctctttgcatggtgataactagcgggtttacatcagcacgatacatctggtcattctggggttgcaagatacgacgacgaccaaacaagccaatgctattcgtatgctcaaggctgcatgcatcacgcatggttaaaccaaagcgtcatgaaaaggcagtgacactttcagtcagctcaagaaaacccgggggcgacattggtggcatcgctgcttcttcctgtgtgtcaaccatttccaggatctttctcacggttgcctgcaactttccatgactgccttccagtgtggactgaccagcagttccgtttggctggataggatccttgtttccgagacccatgtttgatgacttcgtttttgactgtgctttcgctgatgttactgcattggtaaagacgccagattccttgaggccacggataatagccatgggcgcatatatgcgtgtcaagacactcttccttaaaagtttcaaattggtgtctctatcggtccatacaacatgttcc

SEQ ID NO: 26129 - DNA, 568 bp, Zea mays
  unsure at all n locations
  Clone ID: cC-zmle189096a06d1
cgactgaggtttccatgttgaagaaaaattatgaccattttccataggatacatactttggcctgtacaaaggggcaggacttggtaatccaaactacttccttactcctggtaatgggaaatcagctgcaagggttcaggagcatttgcgtgcgaacggtgctcatagatggcataattacatgaaatccccaaatgaaatcaaattggaggaggctgctattctgcattacacctacacaaagttctcagacctaacctcaaggagggataggtgcggctgcaaaccaactaaagaagatgtgaagcgatgttttatcttggaatttgaccgtttggcctttataattgcatcaacagctactgaggaggagatgaggaactggtacaaggaacatgttgtatggaccgatagagacaccaatttgaaacttttaaggaagagtgtctngacacgcatatatgcgcccatggctattatccgtggcctcaaggaatctggcgtctttaccaatgcagtaacatcagcgaaagcacagtcaaaacgaagtcatcaaacatgggtctc

SEQ ID NO: 26130 - DNA, 355 bp, Zea mays
  Clone ID: cC-zmle189096a07a1
cacaaaagatcacagcctcattaatccaagagaattgccctgtaagttacatgtactgcctctgtgtagaattcacactagcttgattcaatgaagtaaaccctctattataaatacacacacagttatgtactccaccttctaaccacataatttcaatgacacatctacaacgtaagaatgaaaaaaaagaaaatgttaacttaaaatcttaactgcgggtaattgcaacaactgcacacacacacaccttttcttccttttcttttccctttttgatctgatacccaaaggacggtgagacgtgagaggtcagggacgcatatgtacagaacaagatgacgagcagagccac

SEQ ID NO: 26131 - DNA, 524 bp, Zea mays
  Clone ID: cC-zmle189096a07d1
ccggaaggtcgaatcgagatttcctccgacctacaaattcctttgataccagatgggtctctcagggtacgattcgggcgagaagaatagaatacctgcttggtgcgatagaatactatatcgtgatagccgttctgtatcaatgcctgaatgctcattagagtgtcctgttgtcgctgcaattacagcgtacgaagcttgcatggatgtcacagatagtgatcataaaccagtgagatgtacatttagcgttgatattgcgagagtagacgagctgataagaaggcaagagtttggaaaaatagtcgagtctaacaaaagagtacactctttgcttcgggagttgcattttgttccggacgctatcgtcagcacaaacaacattatattggaaaaccaagaagatgtcatcctccgaataactaataactgcgaaactagcaaggctgcatttcaaatcctgtgtgaaggccaatcaatcagaaagcaagatggaactaaatctgagccagtcataagggcat

SEQ ID NO: 26132 - DNA, 515 bp, Zea mays
  unsure at all n locations
  Clone ID: cC-zmle189096a08a1
ttttgatcaaaattttcctcaattgccattaaaggcggcaacagagtacattgttcgtccattcagagatcagttcacacacacgcacagacacagagagaggggggagctntattttgtttcggtctacacggtggtactcagccactgtaacagttcagtcacggtactcagccatgaacgcctcatggaaagccttgaagcgggtgatcaccgcggggattttatcttcctgcggcaggatcgtgcatctgacgtgccatgttccaggaacttggccaaatccagatccaggaaccacaacaattccagttgattcaaggagacggagcgcatagaatgcatcaggtgctttcttggcagctttagcagcctcaattgccttatgtggcagatggatctgagggaaaaggtacattgctccttcagccttgttacatgaaaatccctaagcgtgttgaatgcatcttccagtgcctttgcacggcgagctaaagactgaaggattccatctt

SEQ ID NO: 26133 - DNA, 558 bp, Zea mays
  Clone ID: cC-zmle189096a08d1
tggtttcgctgccccgattcgccacgaagccgcactgtgagtgagggacgcggcccgttgtcctcggctgggacgcaatccttccgtcgctgcgaagctgatccctcgtgttcgccatggcccccagcgtcgccgtggaaaacctcaaccccaaggtcttgaaatgtgagtatgcagtccgtggcgagattgtcatccatgctcagcgcttgcagcaacaactacaaacacaaccagggtctcttccttttgatgagatcctgttctgcaacattgggaatcctcaatcccttggtcagcaacctgtgacgttcttcagggaggttcttgctctttgtgatcatccatgcctcttggaaaaagaggaaaccaaatcattgttcagtgctgatgctatttctcgagcaaagcagattcttgcaactattcctggacgggcaacaggtgcatatagtcacagtcagggtatcaaaagattgcgtgatgcaattgctgctgggatcacctcacgtgacgggattcctgcacatgcagatgacattttcattacagacggag

SEQ ID NO: 26134 - DNA, 517 bp, Zea mays
  Clone ID: cC-zmle189096a09a1
ttctctttttacgggagcaaatcttttatttaaaagggtagggttcaaacagtgtcaaataatatcatctacgacatgatccagaagacggtccgaataaactgatgcggtagacttggtggtaccgagacttgcctacttggattcagctccagcctccaaaagagagagaaggctatatataagaagagcacccatccagccggccagcccaacctaagtagccgctggtagtagtggtagagctgagagctccagctaacaaccttgtgtccgctggcttggctgcttctctctcctccctcctccattgcttccactgcatgtgcgtcgtccttcatcataccccgatcaagaaaaaaaggctagctaatagctaaccaagtccagccgtccaggtgatatatcgatctccagcgagctagctatagcaaggctgtgcatgccgtcgtcgtcgtccatgggcatgggcatgggcatgggcaaggcggcggtggtgagcaagagctggcaggag

SEQ ID NO: 26135 - DNA, 647 bp, Zea mays
  Clone ID: cC-zmle189096a09d1
ggccctcgatgacggtctggacgacggtgacggcggcgagctccactgagccgatgtggcccacgaagcccagggtgactaattcgatggagaactggaagacggccgtcaggatggccgggaacgcgatgtgccacagcagcttcgactcctgccagctcttgctcaccaccgccgccttgcccatgcccatgcccatgcccatggacgacgacgacggcatgcacagccttgctatagctagctcgctggagatcgatatatcacctggacggctggacttggttagctattagctagcctttttttcttgatcggggtatgatgaaggacgacgcacatgcagtggagcaattgtaggagggaggagagagaagcatccaatccagcggacacaaggttgttagctggagctctcagctctaccactactaccagcggctacttatgttgggctggccggctggatgggtgcttcttttatatatagcccttctctctctttttgaggctggagctgaattcaagtaggcaagtcttggttcccccaagtctaccgcatcaggtttttcggtccgcttctggatcttgtccgaatgatttattgacactgttggacataaactttaattaaagatttgctcccg

SEQ ID NO: 26136 - DNA, 504 bp, Zea mays
  unsure at all n locations
  Clone ID: cC-zmle189096a10a1
ttctctttttttttttttttttgttttttttttatgtgttgggttttaaaaaaaaaaaaggaagaaccccaccaaaaggagagaaaagaagggggggcagggggggaagaaaaaacaaaccccacccggcacagggggacaagccagccccacaaaagaaaaacaaaaaggggggggctatgggcaaaccaaaaacccggggaaaaagagcaaaaaaggggggggggggagggccaaaaaaaagggaggggggggccaaaaaaaaaacggaaagggcagaaaccgccgcacggcaagggaaaagagattgggttaaaaaataaaaaaaacggatgcacggaccaaggggaaagaagaacacaacccccgcaaagggattgggggaacccggggcaagggcgtgggggccgccgccccaaaaacgggggctgcgtggtcacccggcacgccgggaaggggcacaccccaaccaaaggaaaaggngcgtcccccagacgagggggg

SEQ ID NO: 26137 - DNA, 467 bp, Zea mays
  unsure at all n locations
  Clone ID: cC-zmle189096a10d1
gtccggaacaccggactaggtcctttgagttgtggtgttaccatttcttttcttgtgctgtgataatcgatgtcaacgtctgggggatcaagggccagacagaaataacaggggaataccaaagcactatgcgaaacttgaggtcctcattgccattggtcagtgcaagagatgtctgcaatcctgagagaaagcaattgtgccaagccatgcccgagtttcagccttttcaggtgatatagaggagcggccatccatttgttacagctctcgccgccctcccttttatgcactttttacagaggcttggaattggcaaaaaagaccgaactttcaattgtacttctgtagcgtaagcttgtaccaataggcgtgtactaatttgtatcatcattcatccatggcaagacattgttaaactccttttcatcagtaaattaattttttgtttanaaaaaaaatataaa

SEQ ID NO: 26138 - DNA, 397 bp, Zea mays
  Clone ID: cC-zmle189096a11d1
aaaaaaaaaaaaaaaaaataaaaataaaaatataaaaaaaaataaacaaataaaaaaaataaacaaaaaaaaaaaaaaaattaaaaaaaaaaaaaaataaataaaataaaataaaaaaaaaaataaaaaaaaaaaaaaaataaaaaaaaactataaaataaaaacaaaaataaaaataaaaaacataaaaaaaaataaaataaaataaaaaataaaaaaaaaaaaaaaaaaaaaataaaataaaataacaacaaaaaataaaaacataacctatacacataaaaaaaaaaaaaacaatattacactaaatcaaaaaaaaataaaaataaataaaaaaataataatataataaaaaaaaacaaaatataaaaacaaaaaataaaaaaattaacaatct

SEQ ID NO: 26139 - DNA, 379 bp, Zea mays
  Clone ID: cC-zmle189096a12a1
tcctcattttttttttttgtttttttttttttttggtgtggggttttaattttttttccgggatgccccccccttttgttttttttttattttcgggggaaaaataaaaaaaaaggggggccttcaagggatggggggagagagggttataaaaattaaaaccctcaaaaagaaaaaaaccctaaaaattatttcaaaaagagggggggggggggaaaaacaaaagagatcagcaagggaaaagaggaggggtcaacaaaaaggggggattgggggggaaacacaaacccttgcccccggtggggggacaagaaagaaataaggctcccggggggaccaaaatctcgggaacaaaaaaggggcccataaaaaggggggg

SEQ ID NO: 26140 - DNA, 355 bp, Zea mays
  unsure at all n locations
  Clone ID: cC-zmle189096a12d1
ctggacacgtccttacaaaaccngcacataatttactgaccaggaaaagaccnngccaacncggggggcttaatcaaaaagtccgtgatcccacaccccaatcaggtcccagatacctggggcaaataatagttaaagactatgttattgacactatagatgacatgtccccatacataaactctggcgactatgaaagtaatgaatggtggtcataccaatttgaatcaccagatgctatacttgaacccccaaggtcatcgccacataaaaccctacattcacctaacattttctcatatgaaaggcaaaatttggcaacgataccacaaaacaacaaaataccaacccacat

SEQ ID NO: 26141 - DNA, 369 bp, Zea mays
  Clone ID: cC-zmle189096b01a1
ttttgaatttaaatagacaagatattaagtacatatgggggggtgaataacaaatagttcttcatgtcctacgagtagcacagcgctactttattattacacaaccaccatgcctggtaatagtagattaaagagcactaaggtctctgcgatgtgcagtgagagaggtgggggacgcggttggggaggggggcctgtacctaaccatggtagtgacactgtgaagtaatgacatctacatgagtagcatggtccaagacaataaaaacttatctgggggtccaatgggttaatgagttacacagaagagcttggttactacaaagccttctttggagatccaatactcggtttggacccacgccttcg

SEQ ID NO: 26142 - DNA, 382 bp, Zea mays
  unsure at all n locations
  Clone ID: cC-zmle189096b01d1
cgggggggagnagggggacgcacacaaccaaacacagtaatggttcttcaaagaaggctanggagtaaccaancagtnagttttattttattaacacaatggacccacacataaatttttattggcttgggccacccgactcatgtatatgacattacttttcagtgtcactaccatggttaggttcaggccccccttcacaaccgtgttcacatacctctctcactgcacatcgaatagaccttactgctctttaatctactattaccaggcatggtggttgtgtcataataaagtaacgctgttctactcgtaggacattgaagaactatttgttatttaaccctttgatatgtacttaatatcttgcctatttcacgtc

SEQ ID NO: 26143 - DNA, 439 bp, Zea mays
  Clone ID: cC-zmle189096b02a1
gaaacgaacaaggtcttagtcggtgttgtcatgtacagtcgaaggaacacacaagcgtgctcagccaggcctggcctagccaagctctctacgtagtgcgtgcatcccatcccatcgaagaaacaatattactgcatcatgcgacgctgaaggaggcggcggccttctcgactcccttcctggcgcccttgaaccacctcttgtcgccggcctgcgccttgcagatgtagagcttgccgtcggagacggtggccgcgatgagctggtgcttgccgccctcgtcgccgtccgccgtcctggtgagcacggacacggcgtagtactgcttgccgtcgatcacgggggtggagctctccaggacgttggcggtggccacggcgccggtctcgaacccgccctcggagtcggtcttgccgccgtaggcctgcctgccgagcag

SEQ ID NO: 26144 - DNA, 556 bp, Zea mays
  unsure at all n locations
  Clone ID: cC-zmle189096b02d1
cgggcacccacncacgctcttctccccccagtccggaccccggtaggagccaagccatggcgtccacctcctgctncgtccttcaccagtcaaccgcccgcctccgcgcctcgccgcgcctggccgccgccccgccgcgcagcgcccagctgctcgtctgcaaggctcgtaagcaggaagccgccgcggaccagagcgacgtctcgcgccgcgccgcgctcgcgctcctcgccggcgtcacggccgccgccggcgccaaggtgggtcccgccgccgcggcatacggagaagcagccaacgtgttcggcaagcccaaggcgagcacggagtacatcgcgtacagcggcgacggcttcaagctgctgatcccgtccaagtggaaccccagcaaggagcgggagttccccgggcaggtgctccgctacgaggacaacttcgacgccaacagcaacgtgtccgtcatcatccagcccacgtccaagaagaccatcgccgactacagctctcccgaggagttcctctcccaggtcgactaccttgctcggaggcaggccta

SEQ ID NO: 26145 - DNA, 466 bp, Zea mays
  Clone ID: cC-zmle189096b03a1
ttctctttttttttagacaaaatttcgaattgcatcggcaaattgagctaggcgcatcataacagtagcctacagtacaagaacttttgaacacaacaagtacataacaaaatattagtgaagagttccctcttcacaataagacacgatgatagaagctcagcaacacaaggaaagagaatggcaggtctaaaccagtatcagaacatgctatgatgctcccaacccatggaacaagcgtgcagtccacccgatacaacctcattagaaacctcgccgtggccgttcctttgcaacattcacccgcaaggcacggccattcaaactctgtccatcaagggcagcaatagcatcatccaattcgtcctgcgatgccatagtaacaaaaccaaatccccgcgaacgcccagtttctcggtcatagacaactctggcatcaactactttaccatgctcgctgaacaac

SEQ ID NO: 26146 - DNA, 561 bp, Zea mays
  unsure at all n locations
  Clone ID: cC-zmle189096b03d1
ccggctcctagaggctgtcgtgtggacagacctcccagactttctggccttctctcagaatttatgttggcagggtggcttggcaagtggatgattctagattggtggagttgttcagcgagcatggtaaagtagttgatgccagagttgtctatgaccgagaaactgggcgttcgcggggatttggttttgttactatggcatcgcaggacgaattggatgatgctattgctgcccttgatggacagagtttggatggccgtgccttgcgggtgaatgttgcagaggagcggccacggcgaggtttctaatgaggttgtatcgggtggactgcacgcttgttccatgggttgggagcatcatagcatgttctgatactggtttagacctgccattctctttccttgtgttgctgagcttctatcatcgtgtcttattgtgaagagggaactcttcactaatattttgttatgtacttgttgngttcaaaagttcttgtactgtaggctactgttatgatgcgcctagctcacattgtcgatgcaattcgaaattttgtct

SEQ ID NO: 26147 - DNA, 405 bp, Zea mays
  Clone ID: cC-zmle189096b04a1
tttctctttttttttttttaggataaatagttatattgggcagcaaacaccaaaacaattagaatctatctgcaatgattgggccattaaacaaccaaaatagcacaaaacatagacagtgcagttctgaagcatggaacaatccatagacgaccggaccatggctacaaaacttggtacagcaaggttacaaacaaaagtatcacagtttgatgattttgagaaatgggacttcgctgcaccgcagcaccttacgccttgagcttgccaaagaacctctgcttctcatcggtagtctggaagcgaccgtgcccaaatttggacgatgtgtcgatgaacttgagcttgatctcctccagcgccagccgggaagtctgcttcaggagggactggcggagggtcacc

SEQ ID NO: 26148 - DNA, 419 bp, Zea mays
  unsure at all n locations
  Clone ID: cC-zmle189096b04d1
gggngaccctcctggggtccctcctgaagcagacttccctgcttgtgctggaggagatcaagctcaagttcatggagacatcgttcaaatttgggcacggtcccttccagactaccgatgagaagcagaggttctttggcaagctcaaggcgtaaggtgctgcggtgcagcgaagtcccatttctcaaaatcatcaaactgtgatacttttgtttgtaaccttgctgtaccaagttttgtagccatggtccggtcgtctatggattgttccatgcttcagaactgcactgtctatgttttgtgctattttggttgtttaatggcccaatcattgcatatagattctaattgttttggtgtttgatgatcaatataactatttatactatggaaaaataaagtacaaaataatctctatg

SEQ ID NO: 26149 - DNA, 507 bp, Zea mays
  Clone ID: cC-zmle189096b05a1
gcgccaacgattgtagtggggagaaaggggatccaaaatcacgggtacaaggacacgaaggttctggatctccagtagtcctaaaaatctggtattctgaatctgcatgttttagctagctagaactccttctgaatcgatcaattgcggcgtaagaaacttatatactacaagtattataataagaagtccggttttagtatatatatagtatcaaatcatatcatcgtggaccaattaatatatggttacagcagatgcaatcggatcaaccaacatgcaggtagacacacgtacgtacatgagcacaaagactgacgccaaacatgcagagagagatagcaaactgaagaactctgtttctcttttctcacacacaccacacaatacctatgtatggcagccagctcggcctcgcttattattgttcaaccaccaccacaagctagatagataataatcatatccatggtcgtcgatcgatgtgatcagcagttgcaggggtcg

SEQ ID NO: 26150 - DNA, 585 bp, Zea mays
  Clone ID: cC-zmle189096b05d1
ccgagacgacttgtttgattgattcttgaagagatcgagcttcttttgcaccacaaggtcgaggatgtcttgcggcgggggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttggggtggtggttgaacaataataagcgaggccgagctggctgccatacataggtattgtgtggtgtgtgtgagagagagagaaacagagttcttcagtttgctatctctctctgcatgtttggcgtcagtctttgtgctcatgtacgtacgtgtgtctacctgcatgttggttgatccgattgcatctgctgtaaccatatattaattggtccacgatgatatgatttgatactatatatatac

SEQ ID NO: 26151 - DNA, 346 bp, Zea mays
  Clone ID: cC-zmle189096b06a1
ggggggtgtttatttaattttttgggacgggggggcccaaccgggaaaaccggaccgggacccgggggggagccaaactttccccaaaagggggccaaaaaaagacagggccaaccaagggcaaagggggttcccgggggaaaatgataacccgccaaaaaaccccacaaaaaaaaaagcggaaacaaaaaagggaaaacccggggggcccaaagggggaaccaacccaaaattaggggggagcccaaaagggcccctttcaaagggggaaacccggggggcccaccgcattaaaaaaaaggaaacccccggggaaaaggggtatagaaaatgggccccagggggg

SEQ ID NO: 26152 - DNA, 480 bp, Zea mays
  unsure at all n locations
  Clone ID: cC-zmle189096b06d1
cgaaaaaaaaaaaaaaaaaaaaaaaaaaaaaaaaaaaaatataaataataaaaaaaaaaaaaaaaaaaaaaaagncagaaattttttaaaaaaaaaaattaaatacccccccctttaaaaaaaaaaattttttaattacgcaacctaaaataaatttactggccttttatttaaaaccatattaattgaaaaacccttgctttaacaaaattaaatctcttaaaacaaaaccccctttcaccaaattgcctaataacaaaaaagcccttacccaacttcttttaaaaaaatagggccccccaaattgcaaatttgaaaacccctttaaacgctaattaaaaaaggggacttttcttgttacccccaataaaaacctttcaatttgcaaaaccctaaaacccggacctttacattttttcccttcctttttcgccaacttttccggttttccccttaaaactttaaaacgggggcctcctt

SEQ ID NO: 26153 - DNA, 356 bp, Zea mays
  unsure at all n locations
  Clone ID: cC-zmle189096b07a1
aaacaggaaaagaatttttgaacgggccactaaaacccgaaggggggcccaatcaaaggtcacgagttccaacaggggcccctgaaacaaaaaaaaaacccccttacccttttttcggggcctctaagggggcttaaatcccctcaaaaaaggccacaaaaaagggattttttttagtccccccccgtaaccaaagggaaaaaggggaaacaccggaatttggggggggggtaaaaaaaaagaaancctcttagccctaactcagggccctgccctttccaacccgggtcggaattggaaacccccctgggtgggacccccccaagggggaagggggcacctgggccccccccccg

SEQ ID NO: 26154 - DNA, 493 bp, Zea mays
  unsure at all n locations
  Clone ID: cC-zmle189096b07d1
ccgcgaagtggacagcaatgaaggctgctcctttaagcgcatgcttggtgcacagctgcatccttcccccttcgggaggtcctactcagctgtgtctccaattccgagccaggttggagatggcatggacctgagctagagctaacgagacttccttttcttcagccaaccacctaattccgttgtctaccctttttccctttggttacaggatggaactataagagattccttctttgtagacttttatgaagggatataagactccttagatgcaccgaataaatgtctatgtagtttctattctgtttcatgggaccttgttgtaactcgtgaactttgattgagcacctattcggatttagtagcacgttcagaaaatcattcgctgcttaaaaaaaaaaaaaaaaaaaaaaaaaaaaanaaaaaaaaaaaaaaaaaataataaaaaatataaaataaaaaaaaaaaataaaagggggcggccgtttta

SEQ ID NO: 26155 - DNA, 239 bp, Zea mays
  Clone ID: cC-zmle189096b08a1
ttctattttttttcttgtacactattttttttgacggggggggttttttatataaagctttcaaagtcaacaacacattatcatgcatgttgtacacgatattttgggccaagacgacatcctgttcctgtacggatatagtgaaattgatgtagaggtctttaacgcctaaacctactcgaccatagtgagaattagttatatttactaaatctagaatgttgggtagtaaaagggag

SEQ ID NO: 26156 - DNA, 327 bp, Zea mays
  unsure at all n locations
  Clone ID: cC-zmle189096b08d1
aaaaaaaatagaaaaaaaaaaaaaaaaaaaaaaaaataaataattaaaaccaaagaaaaaaacaacaaaaacganatttacattaaaaacaatttcactacctccccacaagatcaatataattcacatgcccaaaaaatacaacacaactactataaaaatctattgataacttaataaactctacttgtataaaatccatcttaacaaaatatcctgaacaaccacaatttcaaaaaaaaaaaaaatatgccaacccatatacaacatccaagcttacttacacttgcattcaacgtcatacataatctatactgataccaaaat

SEQ ID NO: 26157 - DNA, 500 bp, Zea mays
  unsure at all n locations
  Clone ID: cC-zmle189096b09a1
ttctcttttttttttttcatggttgccacactatattgggtgtatgtgaacacggcctctcaaattacctgaatttaaatacaaaagagaaaactatatttctctgcttgagtaacattgacccctacacacagaaaatgtatacatttgatttcaagacatatgagaaaatacaaatatctgtccagtagtaagaataatctggatccttttgtacggcagaatgctacatcacacgacgagcagccaaagacgtctgtgatgaaaggggaacatttggtggtttctcaacacggtccagatgttactgttaattctgttatcctgggaaactctcctctgcaaagggctggttctaatgccttgtggaataaaggtttccatcaaattttgtgacagcttcgttcggcttcggggcttccganctttcttctctcttcttcttttccctatccacgtattccttgagaagttccttggcttgaaccaactttgagagt

SEQ ID NO: 26158 - DNA, 540 bp, Zea mays
  unsure at all n locations
  Clone ID: cC-zmle189096b09d1
gggcgcactgcattgaccagctttgccctcntcggcggcgtagttcatcccgccgccgagtccggcgaaacaaccggctnttttttcagagtagtacctcatggccgccatatcgacgcttaccttcgcggcgctgcgcggagccgtcgagtggaggccttcgtcgacggcggcggccgtctccggcgccgtcgtgctcagcgcgaggtctcgccggggctcgcgctcggtggtgcgatgtgtcgccacgacgggtgatgtcccacccactgtcgcagaaacaaaactgaacttccttaagtcatacaaacgcccaatcccaagcatttacagtgcagacttacaagaacttttggtgcagcaacacctgatgagatacaaaaaaacctatcagtatgatgctgtgtttgctcttggcttcgtcactgtctatgatcagctcatggaagggtaccccagcaatgaggacagggattccatcttcaaggcatatataacagcatttaatgaagatcctgatcaatacagagctgatgcact

SEQ ID NO: 26159 - DNA, 378 bp, Zea mays
  Clone ID: cC-zmle189096b10a1
ggtgaatggttgggttgctttttcacagaacgtgtttaatatacataaccatatatgtaccttttgctaactattcataggcatacatcacctgatgattttgtttatgataaaaggacgcagcagatgattttacaattgtatcagatgcctgaccaagatgcctcttactacattgcatcttgtgaatccaagttttggcaaagacatacataaatatttacatgatttgctaaccattcatgcaagatttgactgcatttttcttttaccaaaaccagctgtgattgacaatagggtcagctgtctttggaagatggtttgtatactgtagcttgtggttccatattaaactataggggtgggggtacaacctat

SEQ ID NO: 26160 - DNA, 548 bp, Zea mays
  unsure at all n locations
  Clone ID: cC-zmle189096b10d1
ggccgngcaagcgggcgggctgngctgggaaggactcttttgttgtagctggcctagtgggttgtggtttggggaaaggactggtgtcaatatccgctgatctcatgcatgacttcaagactggacatcttacattaacatcacctacatcaatgattattgctcaggctattggcactgccatgggctgtgtcattggaccactgacatttttactgttctacaaggcttttgacattggaaaccctgatgggtactggaaggcaccatatgctctaatctaccgcaatatggcaattcttggtgtccagggcttctctgctctgcccctgcattgtttgcagctgtgctacggattctttggatttgcagtggcagccaatctgatgagggacctcttgccaccaaagtacggcaaatgggttccattaccaatggcaatgggggttcccttcctagttggtgcgagctttgccatcgacatgtgtgtggggagcttgatggtcttcatctggcacatcattgacagaagtaaagcatctttaatg

SEQ ID NO: 26161 - DNA, 529 bp, Zea mays
  unsure at all n locations
  Clone ID: cC-zmle189096b11a1
ttctcttttaatcgagggaagcaattcttattcattgggctgtcattcccaatttcacaaatcacaagttgaaaagctgcaggaccagggagtccatctatccattattccgacatcaacaacacactcagaatcccgaaagtgagaccctgcagcctgtaatcagaggctcgcgggcgttggagcatctccgacgacgaagtccaggaccatcacctcgtccagcagcggcctgaccgaggccttggcctcctccaccttgccgtccccttccacggcgtccagctcctccacgctgtcgaacaccgccaccatcccgaactggtaccccttggcccgcgccggggaaaagttctccccgaagctcaccttggcgtccccggcggcctgggtggccgcggccaccttctccacgagctgcgcgacctccaccccttccttcaccttcgccagcgtgaggcgcacggcgctgccgggggccacggnggacgggagcggcgcggcgtttacccagtcgacggcggtgatg

SEQ ID NO: 26162 - DNA, 518 bp, Zea mays
  Clone ID: cC-zmle189096b11d1
ccccaagggggaccggcgtcctacgcggccacttggttcacgtggccgccggcaggggcacgtcggcccgacgcgctcgacatcaccgccgtccactggctcaacgccgcgccgctcccgtcccccgtggcccccggcagcgccgtgcgcctcacgctggcgaaggtgaaggaaggggtggaggtcgcgcagctcgtggagaaggtggccgcggccacccaggccgccggggacgccaaggtgagcttcggggagaacttttccccggcgcgggccaaggggtaccagttcgggatggtggcggtgttcgacagcgtggaggagctggacgccgtggaaggggacggcaaggtggaggaggccaaggcctcggtcaggccgctgctggacgaggtgattgtcctggacttccgccgtcggagatgctccaacgcccgcgagcctctgattacaggcttgcaggtctcacctttgggattctgagtgtgtcgttgatgttcggataatggatagatgga

SEQ ID NO: 26163 - DNA, 349 bp, Zea mays
  Clone ID: cC-zmle189096b12a1
aaggaggatgcaatgggagggcggccgccttcacttttcttattgggggggggaggaagggataaggggtgggggtaataaaaatccggccaaccccccaaaaataaatttaaaaataaaacctccaaacaaaccaacaaaaaaaaaaaaaaaaatcaaaacataatacaaaacaaaaaaaaaactatacaaatatagagaaagaaaaacaaaaaaaaaaaaaaaaaaaggggggaagaaggagaaaagaagagaggggggagtcaccaaaggggagtgggaaaaaaaggagggggagagaaaaagggggggggggggggagggaaaaatagggggggggaaaaggggg

SEQ ID NO: 26164 - DNA, 394 bp, Zea mays
  Clone ID: cC-zmle189096c01a1
ttctcttttttttttttttttttttttttttttttagggggggggttgttttttttttattttatcccctttccatattctctttttaaaaaggggcccggggttttttgggaccccgggaaaaagccaaaaaccccggaaaaaagggaacaaacccagcccagaaaaagggggaaaaaacaaaaaaagggtttttcaaacaaaaaaacaaaagggggcccccggggcccaaaaaccaaaattgccttaaaccaaaaaaaaaagacaccccggcccgggggccaaaaaaaaaaggaacctttaaaaaaccccctcatggcaaaaaaaggacctaaagggggccccaaaaaaaaatttaaataaaagcggtggcgaaaacccaagggcccccccg

SEQ ID NO: 26165 - DNA, 604 bp, Zea mays
  unsure at all n locations
  Clone ID: cC-zmle189096c01d1
ccgagaactagncctgggatgctatatatgcactgtaataatggttcacaacagatccgagaaacatgaaatggatggaatgccttgttcttccaggcctatgcctatcggtcctgcagcaagtaggaaaaatacaggaggtgttgttcaagagagagtaccaaattctcaaggagctcagtctgagaatgatcctaacaataccactatatttgttggtgggcttgaccccaatgtcactgaagataccctaaaacaagttttttctccttacggtgaagtcgtccatgttaagatccctgttgggaagagatgtggttttgttcagttcgttaccagaccttctgctgaacaagcgctgctaatgctgcaaggggccttgattggtgcacagaatgttcgactttcatggggtagaagcctgtcgaacaagcaggctcagccttagcaggaatccaatcaatggggtgcggctgctggtgctggtggctactatgggggctatggacaaggttatgaggcttatggcagtgggtatgcacaatcccaggatcctaacatgaatgggtatggcgcttatggcgggtattcaattaccaacagc

SEQ ID NO: 26166 - DNA, 523 bp, Zea mays
  Clone ID: cC-zmle189096c02a1
tttttgactgttcaaaattcgtttcatactgataacgggctcagacaacctaacgcacactgtagaaatagctggcccaacacatcctcaagctattttcgctctagagaagtccatctccggatatttctgacgattacacgcgaactgatcaaaatttttgtttcatactaataacgcactcagacaaccaatgcacactggtagaaataactggccgaacacatcctcaagctattttcgctctagagaagtctatctccagatatttctgacgcattacatgcaaactgatcaaaaaatgtttcatactaataacgcattcagacaaacggccaaacacatcctcaatctaatttcgctctagagaagtccatctccgggtgctcagacatgaacttcttgagaatttcttgcttttgcatttcatcacttgttggaaggcccatctgcttctggcgctggtcaaacatcatctttttcacggttggtctagtctcaggatccaaatcagagagttact

SEQ ID NO: 26167 - DNA, 544 bp, Zea mays
  Clone ID: cC-zmle189096c02d1
ccgctgatcggttgatcgctccatggcgatcatctccgacttcaatgacgacgaggcaccggagcagcagctgggggggggccacggcgtcgaggtggccctcgtggcggcgttggagaggagcggcggcgcgctccccttcctacaggcggctatggatgtcgcccaccgcaggtccggcctgttccgcgacccttcggcggtgagcaaggtcaccgcgatggcggcggccgtcagggcgcacatcgaagccgaggagagggtgaccagggaggcggaggccaagaggaaggcggaggaggacgagaggaaggcggaggccgaggcgcagagggctgccaaggaggcggtaatggcgacggcagaggagaagccagagagcacggtggagaaggacagcatggaggtggataagaaggaggaagccaacgtgagacaaccaaatgctggcaatggtcttgacttggagaagtactcgtggactcaacagttgccagaggttaacatcaccattcctgtttctcaaggaacaaaatcaagattt

SEQ ID NO: 26168 - DNA, 220 bp, Zea mays
  Clone ID: cC-zmle189096c03a1
cgcgaataatccttatttaaattcaaacagaaaggcgcttcgtgttcttcacatttctctaggtcgttccgatcaactagatatgcaacaacacaccacgattgttaactgttcactgttacatttgcagaatatctttttcctctctacctagtatcaggctaacgtggcttggcacgttggacaagggaaaacggcattcagttgagaggttcataac

SEQ ID NO: 26169 - DNA, 570 bp, Zea mays
  Clone ID: cC-zmle189096c03d1
ccggataagttggtatgtaacaaaataaaagctaggctttttgattagtgagacttatgagttcaggtgcttcgccggtgtcagcagatgtcatggaattcctgaggatatgctttggtggtgaagttcttgaaggctatggaatgacggagacatcctgtatcatatctgcaatggatattggtgacagatcaattggtcatgttggatccccaactgcatcttgtgaggtgaaacttgtggatgtcccagaaatgaattatacatctgatgatcaaccttatcctcgtggagaaatttgtgttagaggacctataatattccagggttactataaggatgaagttcaaacaaaagaagtcattgatgaagatggttggttgcacactggagacataggtctgtggctacctggaggacgtttaaagatcatcgataggaaaaagaacattttcaagttagctcaaggagaatacatagctccagagaagattgaaaatgtctatgccaaatgcaagttcattgcccaatgttttatatatggcgacagtttcaactcttccttagttg

SEQ ID NO: 26170 - DNA, 55 bp, Zea mays
  Clone ID: cC-zmle189096c04a1
ttctctttttttttttttttttttttttttttttttggtttgtttggacccgggg

SEQ ID NO: 26171 - DNA, 461 bp, Zea mays
  Clone ID: cC-zmle189096c05a1
cttgacatgaggtgaatcatgataaattcgaaactaccactgtagtgccaatatttacatgcgctaggaattctggaaacactgtctgctgaccaatttaataaagtaataaatacaatttctgaatcaaagcttctaagattgagatctattggagttgaggatggattatctcaagactatccgtgacttggggacacgtgtgttcaagaatgagcttagctggctccatagggaaatcttggtaccatagagccgcacactaactgacttccttgatccttctttgacaaactccagctccctggatacaccacgctcagcatagctgcgttcttctagaaacggcaggtcgactgagccctcagactcgaggttcttcagccacccacggagcaggtagtttataacctcagggacctcatcatgaggacaatgaccagcggggctaattccataat

SEQ ID NO: 26172 - DNA, 584 bp, Zea mays
  Clone ID: cC-zmle189096c05d1
gccaccgtcgggattatggcaaaaccaagttcttatttcattgaggaggttatccgtgaaccaggggaggtgtggtgaactctcttggaggttctgttgctctgtattttgctgcatccagtccacaccttgtaaaaaggtgtcacactgcttaatgcaacaccgctttggggattctttcccaaccctgctacatctccccgattgtcaaagattttcccatgggctgggacatttccgcttccatcatttgtgaggaaaattactgaagcagtttggcaaaagataagtgacccaaaaagtattcaggacatactcaaacaagtatacgctgaccattcaacaaatgtggacaaagtattctctcgtattgtggagataacacaacacccagcagctgctgcatcgtttgcctccattatgtttgctccaaagggtcagatatccttccaagaggccatctctaggtgccaagaccaaggcattcctatatctctcatgtatggaagagaagatccttggattagacctatttggggccctaaagttaaacagccagtgcccgaagcaccttattatggaat

SEQ ID NO: 26173 - DNA, 428 bp, Zea mays
  Clone ID: cC-zmle189096c06a1
gacagcactagtggcgggggggggcgtattgtacagatcttaaaatatcgatgcagctagctattgaaggcgaagctatgctataaacaagctaggtcggtgtccatttggcagataatagaacgatcatcatttcttcctgaaggtaatagcgttaggctcttccgggacctgaggcacgcgctgcttatcctcctccacttgctcgagcagagcttgcagctcaacctccgacaagctctccagccgtttttccatgacttgcttctcgtaatccctgagctggtgcgcgtaggtcatgtccttgttggccacccggaacatgtaggtggagatccaccccaccgtcattccgagcaccaccagcagctgcacgacgttgccggcctgcaaggggtcaactcccaggagctcgagcccgtacttga

SEQ ID NO: 26174 - DNA, 506 bp, Zea mays
  Clone ID: cC-zmle189096c06d1
ccgggcaatggctccggcaccggtggccgctcccgtggcttcggtctcccgcgcggcagctgcgctcgcccccgggggggccgtacgctccgccaggggagcctccctgcaccctttccactcttgcaccaaaatccggctgctgacaccacggaccgccctgctcagatccgccaggcagaggcggcgcttggcggcacggagcagcacctcggagagcagcacggatgactcccaatccctgaaacaagacaaggcgccgttcgggtacacgaggaaagacgtgctgctgatcggcctcggcgtcaccgccttcggcgtcggcctcaagtacgggctcgagctcctgggagttgaccccttgcaggccggcaacgtcgtgcagctgctggtggtgctcgagatgacagtggggtggatctccacctacatgttccgggtggccaacaaggacatgacctacgcgcaccagctcagggactacgagaagcaagtcatggagaaac

SEQ ID NO: 26175 - DNA, 403 bp, Zea mays
  Clone ID: cC-zmle189096c07a1
ttctctttttttttttttttttttttttttttttttgggtgtgtttttttttttttttttttttttcccccttttttttttttttttccaaaccccgcctaaaaaaaaattttttttcccaaaaaccccccggggagccacccgcctttttttaaaacttcgcggggggggccccccccctttttttggaggccccccccccccccaaaaaaagtttgggttaggggccccccgtgcgggtttacccaaaaccccacgcgggggcccgggaacaaaaaaacaaattcagggcctaaggggaggggaaggggacggagtcccccccaaaccagaacaaccacccccgttttttcggggggggggggggttccccgggggggggccgggcaaaaaaaaagaagcg

SEQ ID NO: 26176 - DNA, 504 bp, Zea mays
  unsure at all n locations
  Clone ID: cC-zmle189096c07d1
gcgtccggaagacgagtgtcaagtgaacctgaaacttgcggtgtctcttgttggtagcctgagtgtgagtgagtgatggagcgagctgagctccgatcctcgctagctaggataccgccataccacaagtcttcttcacaagtttaagagtgacagcaacaagagatcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtccatcgggctggagaacacggaggccaaccggcaggcgtaccgcacgctgctggtcacggcgccgggcctgggccagtacatctncggcgccatcctcttcgaggagacgct

SEQ ID NO: 26177 - DNA, 395 bp, Zea mays
  Clone ID: cC-zmle189096c08a1
ttttcttttttttttttttttttgaaaatcgagcgggggagggttaaaaacgctcggggaccgattgattgctatattttatacgaatcctaccaaaagcatcttctagtgtaattaaaagaaaagaatgcctatttttttgttgggccaccccaattctgttctactgtactagcaaagcataaaaaagaagaaggcgccggatgaaaacaaaacaatgggtcgccggccaagccacgggggatcacgtcgcgcgccatgttgtccctggcgctactggtcgtctaggagcgcacggggttctccggcgtggtctcatcgtccaccacttgcgcaaaagatggttgggtccaccttctcgccccgaatctcgcacatgttgtgtgagcacgcaa

SEQ ID NO: 26178 - DNA, 442 bp, Zea mays
  Clone ID: cC-zmle189096c08d1
ccggaggagtgggtggaagagcagcagacaacgacaccgaatgattattagacaacaacagcacctcttgcgggggcgagctaaatgacaccgactctgacgactcctcagagacggaaactcgtccacgtatcagacacgaccccaacgccaaccacagcgctgtgggggtggcgaacggccggcgccggaagcagcgcggggcagaggacgccggagccgccggggaaggggaggaggaggccaagaaggacagcatgaagcgggccatcgtcaaactgcttacctctctggaggcgctggaagcggaagagcacgccgaccgcgcggacaccgcggacgcgggcaaaccgcagctggcgctgatcgagttcaacgccgacacccgctcgcatgccaccatggactactacgccaagatggcgagcagcttcgacgtcac

SEQ ID NO: 26179 - DNA, 372 bp, Zea mays
  unsure at all n locations
  Clone ID: cC-zmle189096c09a1
agcagnaacgcgtccttcatttttatggaattacaaactacacatctgctaacaaactatagggaatatatacagcaacgaccaatacaattgccaaataactttccgactatatatgtacaccggaaattgggcatagctatgtatctggaacgaccggggaacaactataatagggggataaggctggttcacctatgggtcaagaactaagacccccctgaggactggtaatggaaaccaattcgttgggggggaacgggtgaaatatttcgccttaacttatgattcttaagcgcttaaacccttggggattgaacttcaaggggtggaaagaatgctggtgcaagcctgaacaacgaactttgacac

SEQ ID NO: 26180 - DNA, 541 bp, Zea mays
  Clone ID: cC-zmle189096c09d1
cgcgtagatgtcctgaagaagaagcatgctgccgggaccttcatttgcctggtcttttatcttgaagcatgcgggatggggagcatctttgagggcctcctgccgaatgacataaatgtgtatgcgaccaccgcgtcaaatgcagaggagagtagctgggggacgtactgccctggcgagttcccgagccctccaccggagtatgacacttgcttgggagacctgtatagtgttgcttggatggaagacagtgatttccacaatctgcgaactgaatctctcaagcagcaatacaacttggtcaaggataggacagcggttcaggatacattcagctatggctcccatgtgatgcaatatggttcattggagttgaatgttaagcatctgttttcgtacattggcacaaaccctgctaacgatgacaacacgtttatagaagacaactcgttgccatcgttctcaaaggctgttaatcagcgcgacgctgaccttgtctacttctggcagaagtaccggaaattggcagacagctcacctg

SEQ ID NO: 26181 - DNA, 484 bp, Zea mays
  Clone ID: cC-zmle189096c10a1
ttttgacttaaaaacaatttaatcatgtgtatccttgattgggagcgctcacgtgacaccacatctataattagcttgcatcgaaactgcggtgacgcacattcacttcttcataacagaaaagacgactagcagatcggtgacggtgacgaagcattcaaagtcgccatgcaaagtttcttgtaggctcagttggctcccagtcttgatcggagctcagtagcgactgcgtcgatgaactcctcggtgttcaggtaatggcttctcgtgacgctggaagatccatggacaagaatcgccagatctttagtcatcttcccggactccacggtctcaacgcaagcagcctcgagtttgagagcgaagtcgagtagtctagcgttgtcgtcgagctttgccctgtgggcaagtcctcttgtcccatgcaagatcgaagcaatgctgttcgtgctggtttcgcctcctttctggtggacacggaaat

SEQ ID NO: 26182 - DNA, 543 bp, Zea mays
  unsure at all n locations
  Clone ID: cC-zmle189096c10d1
acgcgtccgagagactatgatttggggatactgcactgngatttcaactgatgacaaggtcacagtgggggctggggtggctactctcaagtacaacgtgcctactaagagtgcgaccattacttcagatgaaactcgggttaaggagttcaatctgaaacacatgtggaagagcccaaatggcacaattaggaacattataaatggcactgtgttcagagagcctattatatgcaaaaacgtgccaagacttgttccaggatggactaagcccatctgcattggaaggcatgccttcggtgatcaataccgaactaccgatgcagatctgaaggggcctgggaagctgaagctagtttctgagggaaaagaagaacagattgatctggaggtattcaacttcactggtgctggaggagtagccttgtctatgtacaacaccgacgagtcaatccgagcttttgctgatgcttctatgacaactgcttatgagaagaaatggccactctaccttagcacccagaacacaatcctgaaaaatat

SEQ ID NO: 26183 - DNA, 477 bp, Zea mays
  Clone ID: cC-zmle189096c11a1
ttttagttcacaaggcggtcatattattattcatcatgtaggatatagtacataaaaagctcagcgttaggaatgaaaagtggtagaaaatgatattgcttattacattcacattgggcgattgttgatccggtatatatatgtagatgcagaaaacagatagtactcgacgcattcacattgctcgggtgcatatcggtaggtacgtagtagtatagttatagtatatatatttatgatgatgcaggagtcggcgggccggtagaattgccttagccctagtttttcactttttccatgtgaggaactctcctgagacaaagtcgtagtgggcgccgatcagcttgagggtcccatttgcaagcccttccttgacgaaggggtaggtcttgaggttctccagggacacgttcacggcctccttctcgagaatggagcactggtcatcgaacggcaccgaggcgtgctctttcttac

SEQ ID NO: 26184 - DNA, 458 bp, Zea mays
  Clone ID: cC-zmle189096c11d1
ccacgcgtccgcgcacgcgtccgcccacgcgtccgctttcgctttcgaaggaggccgtgaacgtgtcgctcgagaggcttaagagctaccccttcgtcaaggcagggctggccggcgggacgctcaagctggttggcgcccactacgacttcgtcaaagggcagttcgtcacatgggagcctccccaggacgccatcgagcgcttgacgagcgggttccagcagttcaaggtcaatgtctatgacaagaagccggagcttttcgggcctctcaagtccggccaggcccccaagtacatggtgttcgcttgctccgactcccgtgtgtgcccatcggtgaccctgggcctgcagcccggcgaggccttcaccgttcgcaacatagccgccatggtcccaggctacgacaagaccaagtacaccggcatcgggtccgccatcgagtacgctgtgtgcgct

SEQ ID NO: 26185 - DNA, 505 bp, Zea mays
  unsure at all n locations
  Clone ID: cC-zmle189096c12a1
gtacatcaaagcgttcagtaataccctttcgtgggaggggtataaatatcaacatcacatctgctccttctcgcaatcgggtacaatacctgggcttnggccaataaggcaangggaggacaatcacnaaatacggcaataaaaatacccaggaataccaaaaggggagagaatattgaagacanaaagaaaacgataatagaaactacatttacacccgttgctaatctcagtatctattgcccagcgagcttcacnaacctccgacggaccttcnncaagcttatgccacctctgatgggccttctacattttctcaaaccatcttcacagtaattactaatgtcaaagttggtgactgcatgaacaccccgaagctcgatcgctgcgatgtcataagcttctgctgcctcttcttcagtttcaaaggtcccaaggtaaatgtctttggtgtctctactctcaccaatcctaccaattcttgcttgccatttaccatccttcc

SEQ ID NO: 26186 - DNA, 424 bp, Zea mays
  Clone ID: cC-zmle189096d01a1
ttctcttttttttttttttatatatatatagcatcagggttatgtaatgaagagtagcactgattattgttacatgacgaaggttgagcatccatggaggctagattatagacagacaccctgattttacatgacgaatcgcaagaagcgcatgcattggatatccttagccggagagggcgctggtgttgtaaacgaggagggcgccgccgccgaggatcccagcgagggtgacggcccagatcagaagcccagtggttccaccgacgtagacgtcgccggtgggagaccagtcatcctcgttgtagattgggctgtatccgtcgacgttcgcgccgtacttgtcgacgaactggtacacgcccttgcccttgccctttttcccgttggcgtcgacgtcgacggtcaggccacccccaatccc

SEQ ID NO: 26187 - DNA, 527 bp, Zea mays
  unsure at all n locations
  Clone ID: cC-zmle189096d01d1
cgcctccgctcctcgtcagctgtggcggtggcgcctcagggcctgttgcttttcggccgccgcgcctcctccttcgccggcgggtgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccctctccggctaaggatatccaatgcatgcgcttcttgcgattcgtcatgtaaaatcagggtgtctgtctataatctagcctccatggatgctcaaccttcgtcatgtaacaataatcagtgctactcttcattacataattttgatgctatatatttntna

SEQ ID NO: 26188 - DNA, 317 bp, Zea mays
  Clone ID: cC-zmle189096d02a1
tttttagcggaaacggactatcgttatcgggaacgatgtgccatccccggctgtagaagacaaaatgccaacatgcttcaggcaccccttgccctctacactccgggctagcacacacttcgtgagctgccctaaacgggcgggagaggaatagggtacggatgatgcctgcggacacaccgctaaaccttgccaaccacacaactaagctcggttctgatcactctgcatgagccggtgcttttatgcagcgaacgcttcagctgacctggacatgccggggccgtgcacgacgaccaaacaacggtacataaact

SEQ ID NO: 26189 - DNA, 379 bp, Zea mays
  Clone ID: cC-zmle189096d02d1
ccgcccgcgcgaacgagcacgcattcgcccacgcttacaagtgctttgtatgagcataggaagctcggggagaggggcgcctgtgcgattgagactgggcagaaccccgccctcatcgtgcggcacacggctgtagctatgctcgcgtttggtgacgccaagccgtgcacctcggtcaggcggacgctgtagctcgccatctacacgagggccgcgtagagggcgctctccccctagcgctccttcttatgaaccctaccccaccgggcacgcggcctatactacttcaccagtatcctctgccctgctctgactcgatacgtcgtccgtcgcctgtgctgtatacaatgcatctggtcaccgctttactccacgggat

SEQ ID NO: 26190 - DNA, 577 bp, Zea mays
  Clone ID: cC-zmle189096d03a1
tttatctttttttttttctttttttatattaaacgtaagggttgcttttttttttttatatttccctatctctttcctattaattatatttgcaacaccacaccacgattgtttacccgaaaccggggcaaaatcagagggccccccccctaaaaaaaagccccacccaaaaatggcttgtaacttcgcccacgcaaaaggggaaacccccaaaaagggtaaaaagaaggatccccccccccaaaaaaaaaaaaaaagggccacaatccaaacaaaaaataacctttgtgggtccacaagaagggggggcccccataaataccccccacattttgggggagaaaaaaccccccggtgtcccccccaaaaataaaaaaaaaagggggtttttttggggaggggatacccccccttctccccagaaaaaacccctaataaaaaaaaaagccccaaaaaaaaaaaccggggaccccccgaaatccaaaagggccgcctggcctttaaagaacccccccagagggaaagagcgaaccccccgggaaaccttaattcccggccacctcagccccaatttttt

SEQ ID NO: 26191 - DNA, 557 bp, Zea mays
  unsure at all n locations
  Clone ID: cC-zmle189096d03d1
ccgcggacgcgtgggcgagtggcaggccagacacggcacacttgttctctcggcagtcaaggaaatatcaaagtggaggtatgagctatgcccaagatacatgaaagagcgcaaattctggcgggtatattttttgctagtaaacagctatatagctccgtttgagaagaaatacttcgaggagctgaaagtgaaagcagaggaagagaaaaaggattcccagaaggaagcatcccaagcatctacaactgcagaaccgaaagacacaaaagtgccaagcaagacctcttcgacaaatccagaacatgacctggatgtatttctgctgggggatctgggtagcgatgatgaggcttctgttggtggtgatgatgggctagatgatgactttgataagattgatgcgacctcgggattggaaagtgatgacgatgacaaaaaggcagcaacagggaaggcagaaggtgtgtagtagtagactatggttttgagagatgacgccaatgatagcgaacttcaggattccatgatgatatngtatattagttgatcgcatg

SEQ ID NO: 26192 - DNA, 417 bp, Zea mays
  Clone ID: cC-zmle189096d04a1
tttttgtttaatcacacaactttattattgatcaaatggaaggatttaataatgcgaaacaacattagttatgtactgatgaaacaaaactgtaaggaaattgcaaatctagcgagcaggtcggccgcgcgcgctatcctttctggaacttggacttgaggagcttgatggtgtcggcgtccacctggaagctcttggccaggacgtcgtcagggatctccgggtcggccccgaacagggtctgcgcggcgagcacgacgccgggcagctggctgttgaagacggtcatggcgcgcgcggcgcctttgccgacgttgtactggaagtggaccatcccgcgcgggatgacgaagctcttcccggcgcgcaccaccttggagtagaacctgccctccgtgctgacgaagccgaccagca

SEQ ID NO: 26193 - DNA, 578 bp, Zea mays
  unsure at all n locations
  Clone ID: cC-zmle189096d04d1
cgcggacgcgtgggagcacgatcatcgacagacacacatatcngtctatcgtgtcacgccagcagagcacgagggcggtgctccaatccagagccatgtcgaaccccccgtcgtcttcgttcctcctcctgctgctgtcggcgacgctgctcgccaccgtctgccgcgccgacccggacccggtgcaggacttctgcgtggccgtggcgccgggcggccacaacaacgcgtcctcctcctccagcacctacccgggcttcccgtgcaagccggcgtcgacggtggtctcggacgacttcttcttcgcggcgcacgcgggcggcgcgagcacggacaacccgatgggcgcgggcgtgacgccgggcaacgtggaggcgttcccggggctcaacacgctgggcctgtccatcaaccgcgtcgacctcgcccccggcggcgtcaacccgctgcacacccacccgcggtccgccgagctggtgcacgtggaggccggcgagatgctggtcgcttcgtcagcacggagggcaggttctactccaggtggtgcgcgccggggagagcttcgtcattccgcgcgg

SEQ ID NO: 26194 - DNA, 441 bp, Zea mays
  Clone ID: cC-zmle189096d05a1
atctataactttttttttttgctttgggagaaatacgaccatggatggtgggtcccaatctatgcatatcaatagaccacagctataccaagagggggagcatattttttaacaaaattggagtcggagacgtcggcggatgcttaacggtggtatcagtgccagcctaatatctttcttataaatcaataccttttgggacgacatgttttttccttatggtacaccccaaaagacttggatgcgtgtccgcgcttttatgttcacttgcatagtatggggagggaactgacaaatgggggtgtatgccaactacttggtcgtattccatcacatatacatagggggcacgacagaaacttcgaacctgtatctcatagacaatgggcgcatgaactcgaagatatcaactacagtgtacattgacgttatcgttcagat

SEQ ID NO: 26195 - DNA, 390 bp, Zea mays
  Clone ID: cC-zmle189096d05d1
ccggatggcatagccggcgacggcacatcaaaccgcgctctaatttacgtactagccagatactacctccgggggcgaggaccatgtagacctcactcgcacaacctcgccttgctccaaccatcaactattaagtataaacaccatattgtaccgccggctcatatgactacacgctgcaccttcgctaagcatcttatacagatacccctccttcagcggacaacctatacaatacaagtgtccatcaccactcccatagcacccatgcctgccactcgatcatgcgctcggcacaccagcacactaaaggttcaacttcctaccaacaaccgtcagacactgtctataacaccacagaccatacagccaattattactcaaccactg

SEQ ID NO: 26196 - DNA, 79 bp, Zea mays
  Clone ID: cC-zmle189096d06d1
ccaaaaaaaaaaaaaaaaaaaaaaaaaaaaaaaggacaatctaaattttaaagaaaccaaacttacaaacacaaacaga

SEQ ID NO: 26197 - DNA, 519 bp, Zea mays
  Clone ID: cC-zmle189096d08a1
gataatgaagtgtcccgatccttggggggtcaaatgtgatacaattactagtcctaggaggctagtaaacacattccttacttcaaatagtacagagtttaaatagaggttattacaatgccggggtacaagctcgagagagccagaatataaagcgcagtaggaaaatgtactagcccaagccacaggcagaactgtgtgcagacacagccctctcaatcaagcatagcagaaaagaagtcttcggctgcttgaacgattttccattcaccaccactgcatgttactgggaatgagtaaataagtccggaaggaacaccatatgaaccatcggaatacacacccatggaaacaaatgtcccctcaggggttccaagaacccaatcacgaatatggtcacaagcagagctagcagctgagagagcgctggagaactttctcgctttgatgattgcagcaccacgctgttggacagttgtgatgaattcgccattgagccactcatcatcagcaacaagc

SEQ ID NO: 26198 - DNA, 539 bp, Zea mays
  unsure at all n locations
  Clone ID: cC-zmle189096d08d1
cgggtgactcaaaggcactccaaacccccgcttccagaaccttcnttaaactctccgcctcctcctctactcgggtggatggctaaggaaccgatgcgcgtgctccccactggcgccgcagggcaaattggatatgctcttgttcccatgattgctaggggagttatgcttggtgcagaccagcctgttattctgcacatgcttgatattccgccagcagctgaagcccttaatggtgttaagatggagttggttgatgctgcatttcctcttctgaagggagtcgttgcgacaactgatgttgtggaagcgtgcactggcgtgaatgtggccgtcatggttggtggattccccaggaaggagggaatggaaaggaaagatgttatgtctaaaaatgtttcaatctacaaaacccaagcatctgctcttgaagcccatgcggccctcaactgcaaggttttggtggttgccaaccagcgaacaccaatgctcttatcttgaaagaatttgcttcttcaatttctgataggaacgttact

SEQ ID NO: 26199 - DNA, 493 bp, Zea mays
  Clone ID: cC-zmle189096d09a1
tttttattattttttttttttttttttttttgacgaagccgggtcatcttcatcgtgaacccttaaccatttatcaggcatttataattggatccacatacgtatgatgatgatgagcacaaaggatttaacttctaatgatgacaacacatgaattgtactagaaagaaacgcaacaattccagactccaagaacaacagcacgactcgtttccaggctctaagttctatcgacttccaccgattttttgtctccagaaacagatacccatgcatggcaagactgcaggaccagcaggtgaaaacaattgaatcatagccaactcctgacaaggataaacataatgatgataccgcgaccagctgtagatcttagcagaagcccagattcgggaccaagaaaatgatgtgtgcctagccctgtaacccatctggctggcttctccgacgatatcatttgtcaatttgcccaccttaatatacctcgtatata

SEQ ID NO: 26200 - DNA, 340 bp, Zea mays
  Clone ID: cC-zmle189096d09d1
tcattcaacattttctatcagttcatctatggggcggggaaacacaatggaatcgcagagttattgcagattttgggaagtatcatcaatgggtttgcattgccacttaaggaagagcataaattgttccttgttcgagctttaattccacttcacaagccaaagtgcatcgcgatgtatcatcagcaattatcttactgtatcacccagtttgtcgaaaaagattgcaaacttgcagatacagttatcagaggcctgctaaaatattggccaatcactaatagctccaaggaggtgctgtttcttgggggagtgggaaaaaaattggaaagctccccac

SEQ ID NO: 26201 - DNA, 472 bp, Zea mays
  Clone ID: cC-zmle189096d10a1
ttttgtttcgataacagctccaactttagataagatgggctggatgttgcacagacacaggctacatgcagaattattacttattgtcgtcgccgttggcgacggtggtggtgatggccacatagaggaacacgccgttgatggagagcaggcgatggcttcttcgaagaattgtattctaactacttcctttccatgactgcgaccgtgccgtccttcttggcgacaatggcgacggtggccatgcccaggaacatgccgtgctcgacgacgccggtgatgcggagcaggcggtcgctgatgtcgcgcaggtcgccgcggatgccgccgtcgaagaacatctcgacgatgtagttgccgttgtcggtgacgaagggctgctgctcggagccttgctccccctcggggacggtggtggtcctgagcctggcgtggaaagccggcaggccgtggaagaggccgcggatgaagc

SEQ ID NO: 26202 - DNA, 479 bp, Zea mays
  Clone ID: cC-zmle189096d11a1
ttttcttttcttcatagattagggagggtacacattggtcggccatgttttatttccgacaatcaaatcccaacgagcatagcaccgaccgaactgacacatcgcatgcataatgtgttcatccctctctaggagggcaacaccgttctacaactaaaaaacccaaaccaactacaaatccaccgacccagagttgtcagttgacccattattattcctccgcctgatcaacattacacacttgtttccttcattcatctgtccgttcttctttttaggcctcttcctcaagcagcatctgatcgaagtgccacaccccgtgccccttgcccactctcctcagctgggcgacatacttggagatcttgtttatggcttccacctgctcctcgaggaactcactctcgatgaagtctgtcagctgaggatcattgcaccttgttgccacaccatgcaggttgtgcagcttttcattgacc

SEQ ID NO: 26203 - DNA, 481 bp, Zea mays
  unsure at all n locations
  Clone ID: cC-zmle189096d11d1
cgggtcaatgagaaggggcacaacctgcatggtgtggcaataatgtgtaatgatcctcagctgacagacttcatggagggggagttcctcgaggagcaggtggacgccataaacaagatctccaagtatgtcgcccagctgaggagagtgggcaaggggcacggggtgtggcacttcgatcagatgctgcttgaggaagaggcctaaaaagaagaacggacagatgaatgaaggaaacaagtgtgtaatgttgatcaggcggaggaataataatgggtcaactgacaactctgggtcggtggatttgtagttggtttgggttttttagttgtagaacggtgttgccctcctagagagggatgaacacattatgcatgcgatgtgtcagttcggtcggtgctatgctcgttgggatntgattgtcggaaataaaacatgggtgatgaatgtgtaccctccctaatctatgaagttgagaaaa

SEQ ID NO: 26204 - DNA, 303 bp, Zea mays
  Clone ID: cC-zmle189096d12a1
agtagagcgccctcccttctctattttttattaagagaacacaagataaaccgggggggcttaatttataatcgatccgcagaccacgctgttggatgcatgggtatgctgaaaccgaggatgaacacaatactaacaactgacacagagcgaccttgcaatcaaaaacacagatgggcaacaacaaacacgacacgaacgaagataaaccctctggactagggtaaacatcacggtagcgaacaggataacttggccgcgcgggccccaccgatcagttccttcaattcccgtcggagttgc

SEQ ID NO: 26205 - DNA, 337 bp, Zea mays
  Clone ID: cC-zmle189096e01a1
acttcctgagaaggatgaggtcagtcagctcaccatcgatacagatatacatgagcagaaactccaaaaaaaaaacaggtcgtaatttacaaaactcaagacacaacaacagtcgccgaagcttaaaacgagaggttgtcctcgacgaggcagccgtcgtcgaagctccacagcggcatgtcctggtccgccgcggcggcggcgttgctctgcacggcgtcggcgctgaacaggctgtccagcgactcgtacgcgccggcgtcgaagaaggcgaactggtcgccgaagaggagcgagtcgaacagcgcgtccgactcggagtcggaggcccggggcg

SEQ ID NO: 26206 - DNA, 518 bp, Zea mays
  unsure at all n locations
  Clone ID: cC-zmle189096e01d1
gcgggcgggcaaacacgggcgaanaaaaggagatagagtacttgttacagacaggcagagagcaaagatgtgtgggggggggatcctcgccgagctcatcccgaccacgccggcgcgccgcggcggcgcggcgtggcccgccggcaagtgcaagcggcggaaggcgaacgacttcgaggccgcgttccgggagttcgacgaggactccgaggaggaggaggaggacgacgagggggtggtggagagcaagcccgccttcgtcgtcgtcgcctcgtccgcggcgacgcagcccagggcgcgccaggagcagcggagccggcgccgggcgcccgaccagcagcagtacaggggcgtccggcgccgcccgtggggcaagtgggccgccgagatccgcgaccccgtcaagggcgtccgcgtctggctcggcaccttccccttcgtcgaggccggcgcgcgcgcctacgaccacgccgcgcgccacattcgcgggcccagggccaagctcaacttaccctact

SEQ ID NO: 26207 - DNA, 164 bp, Zea mays
  Clone ID: cC-zmle189096e02d1
ggggacgcgcaccgtagcggtgcaccaagcgcggaagggggagggggctacgcacagcgtgaacgggacaaaagccagcgacccagtgcccggtccaaaggtaaagaagataactcgaagggcgcgggcggcgggaatgcccgtccagctctaaaagaggagca

SEQ ID NO: 26208 - DNA, 469 bp, Zea mays
  unsure at all n locations
  Clone ID: cC-zmle189096e03a1
tttttcttgcccggcgttccaacaccagcacgcagaaggcattcacttcatcatcataattgcattaaagaaaccaagtccaagtccaggcaacagattacgcacgactactaccaccaccaccagtatcagacacccgccatcttccgtctgctgcccgccaccacccccgccacttgcttctcagcaatcaacagcctgtggaacattagcactagcaatccgccaccgccatggcaagcagcagcagcagctggtggacttgcgttcctggaggagctccggtgccatggccgggatttgctgcagccacactctacaattgtgtaggattcatcaggtgggtgggaggagtacaactgagctgctacattagtttcaccatctacgctcaacaactgatactgcactgactatcgggcctctctctctcacgttgctaaaacgaatcactttgctnctacctact

SEQ ID NO: 26209 - DNA, 608 bp, Zea mays
  unsure at all n locations
  Clone ID: cC-zmle189096e03d1
gcgtccgngaaagcgctcccctcgattgggcggcacgtaactcactatcaccaatacccggacccatcaagcaaggggggggtcgttccctgcaaagaccgcgcattccgtgcgtgccgtgtccacgcgcgcgcgcgcgcggtggcgttaagttgtcgagcgccagaggaggagcgccactagtcgtcggtcgatttgacccaggcgaggaggcgtaggcgtaggcgtaggcgcgtaggggagtctagctagctactggtgttgggtcgctagcttccgacgatggaggtgaagaaggagggcgcgaaggcgacgctgccgccggggttcaggttccggccgacggacgaggagctgatcgtgcactacctgcggcggcgcgcgctggcctcgccgctgccggccgccgtcgacatcccggacgtccgcatcctggcgcacgacccgtccgacctgctgccccagggttcggcgagcaggagcgctacttcttcacgtgcaaggagggccagtacgtgaaggccggcgcgcgaaccgcgccacggggggccggtactgtaaggcgacggcaaagagaagccggtggccgtggcggtccgggcgtgcag

SEQ ID NO: 26210 - DNA, 327 bp, Zea mays
  Clone ID: cC-zmle189096e04a1
ctcttttttttgtgtttagttttttttttttttgggtgggggtttaaggtatttaagggggggtccccggcccgaaagtaaaattttgaggttgaaaagggaccaaccaagaagacggtagggaatcggggacccgaaacagaggggggggggtatgaaaggggggggggcagaaaggaaggaggggaaaaaccgggcaaacaaaaaaaaggccgacggggggggggggggagccttaaaaaaaaaagaggaaggggcggaggaaaaaaaagggggggacacgaaccaagaaaaaatcggcgaagagggggggggggggggagaaaa

SEQ ID NO: 26211 - DNA, 607 bp, Zea mays
  Clone ID: cC-zmle189096e04d1
gcgtccgcccacgcgtccgcccacgcgtccgcccacgcgttttcgtacgcgtggggtttctatgtcaaatgaagcgacgggaaattcctagatccttccctgttcctgttaattcaggattggtttatgaagaagagagtagtgatgacgacgacgataatgatagtgacaatgttgggttgctggagactcaaccagattcaattgaaagtgaagctttaacatgtccggccgaggagcttgatttgcttcaagaaggtagcaaagaaagaatgttcttcttccagttcccaaactctcttcctttacccaaaaggtcgtccagtgccggcaaggaggtgatggaaggatccaacctgcagcagctgcctcagggttatttgggcaaaatgctagtatacaagagcggcaagatcaaaatgaagttaggagacatcatctttgatgtgaacccaggagtagaaagtaggatgctgcagcgtgcagtagctctcaacactcgagacaaacactgttgcttgcttggagagattgagaatcgtcatgttattgtgactcccaatggttgattctttgtgaacgacaagtatggaccaactgtagcagc

SEQ ID NO: 26212 - DNA, 423 bp, Zea mays
  Clone ID: cC-zmle189096e05a1
gacaaaatatagcatcatcttaggaaggacctttgaaacaaacaaagcagcctccaatgtcttaaactgagaagacgatcgagccagttaataatgcaagagggttcatgatcggatgttgagatgattgaaacagaatgagcacaattacacatgaagatttaatttccctgcagtttggacatatctagggtcgacaagacaggtgatgatctcctccattcccatcagacgctgctgctagctgcttcaccacttccagaaaacgttggagccgcacttgaacttctccttcccctcgcactcaatctcgaggtcgtcgctgatgaaggggactttcttctgcttggcgaggtcctggcacccagtgaagttgtaggggaactggcagctgccgaactccacggtgtaggcgcgcgcaaa

SEQ ID NO: 26213 - DNA, 481 bp, Zea mays
  Clone ID: cC-zmle189096e05d1
gcgtccgggccaacaaggagctgaacgacaagaagaggctgtccttcagtggagccaactttgcgcgcgcctacggcggggagttcggcagctgccagttcccctacaacttcactgggtgccaggacctcgccaagcagaagaaagtccccttcatcagcgacgacctcgagattgagtgcgaggggaaggagaagttcaagtgcggctccaacgttttctggaagtggtgaagcagctagcagcagcgtctgatgggaatggaggagatcatcacctgtcttgtcgaccctagatatgtccaaactgcagggaaattaaatcttcatgtgtaattgtgctcattctgtttcaatcatctcaacatccgatcatgaacctcttgcattattaactggctcgatcgtcttctcagtttaagacattggaggctgctttgtttgtttcagaggtccttcttaagatgatgctatattttgtc

SEQ ID NO: 26214 - DNA, 511 bp, Zea mays
  unsure at all n locations
  Clone ID: cC-zmle189096e06a1
ttttctagacaaatttatctcctctgagcatttgattgggaatagagaatgtatgcgttcttatatctaggaacatacagaatcatgtcagagctaaaaccttgagatacagcatatgtttctttagcattttctgaaattgccctcgaatcatttctagttctagctaatagctattatgaacatgctacagactgttttcgaataagagagggatcagcgatgactgaatgcagcatcactgctccgctcttcccacatggtataagatccaatccaatggagagaatttcaaaggacgaggcgaatgggtggattggatgtggatgaaaccagttatagttgctccagcagcttggtctcctcctccttgtcctctgcttcgtcttcgtccgaggaggaggtctccgacgagccgtagggctcctcgaagaaggtgtcgatgaaggaggagcactcctcggcccancancggcggttggcggaggcgcgccactgctggtcgcgatca

SEQ ID NO: 26215 - DNA, 550 bp, Zea mays
  Clone ID: cC-zmle189096e06d1
atatacccgcgcaccccggcgccagctatttaatatagacgacgcgccatcgcgcctccaccagccgaccctgaccccgaactcgccgtcgcaacccgccaagacgcagcagtagaagcaccaccaccaccaccaccggcacacgaccccggcggcagcgagtgccggttctgcgagatgacgcggcagcaccagccgcagtgcgcgcggcggctgccgaagcgcatcatcctggtgcggcacggcgagagccagggcaacctggacatgtcggcctacaccaccacgcccgactaccgcatcccgctgacggcgctgggcgcggagcaggcgcgcgccgcggggcagcgcatccgcgacgtggtggcgggcagcggcaactggaaggtctacttctacgtgtccccctacgcgcgcacccgcgccacgctgcgcgagatcggccgcgccttcccgcgggaccgcgtcatcggcgcccgcgaggagtgccgcgtccgggagcagacttcggcaccttcaggtggaggagcgcatgcgcgccgtcaggaga

SEQ ID NO: 26216 - DNA, 358 bp, Zea mays
  Clone ID: cC-zmle189096e07a1
ggaataagggagtgcaacgaagcacttgtggccttctggaataagtgtaattaataccaacagtaattaataatagttcccggttattatattatatcacaagatggatctgtctgtcgcttattctgcctttggtcgacagagctttgatgctgttttgagctttgtgctcgactcaaaagccttgctgctgctgccttgcaccatgcgtgccttcttcacttggaaaaggagctcgtgggcttcctcaaaatgagggctcgtggctttcttcaccttgtccatccagacaaggatcctctcatgagctcccaggaatcggtcacggacctcattgcaaggatcttcaactgcatta

SEQ ID NO: 26217 - DNA, 530 bp, Zea mays
  Clone ID: cC-zmle189096e07d1
gcgtccgcttatccgaggttgcgtgcagcagtggaaaagatttgattttagcagagcagcgagggtcggagaagcgtcgccaagcttcgaatcgctatgcagcccgtcaaggtgtacgccgaccggcggtcgcaaccctcccgagctgtcatcatcttctgcagggtgaaccagatcgatttcgaggaggtcacggtggatctgttcaagtctcagcacctcacacccgaattcaaaaaaataaacccaatgggacaggtacctgcaattgttgatggaagattcaaactatttgaaagtcatgcgattttgaggtatcttgcatcggttttccctggagtagctgaccactggtatccttctgacttgttcaccagagccaaaattgagtcaatcttggattggcatcactcaaatttgcggcgtggtgcagcaacccttgtaatgcacactgcattggctcccttccttggtcttacgacaagtcatgaggctgtgaaacaagcagagaagcttgtgatgcagtcact

SEQ ID NO: 26218 - DNA, 404 bp, Zea mays
  Clone ID: cC-zmle189096e08a1
ctctttctttttttttttttttgtttttttttggtgtttgttgtttttttgtttttttcttccttcccccccttttttaaaaaaacacactggccttcgacggctaaactgggggaagaataaacctacggggaggtacggaaggaaattctcggggggggcaggggacaaaaaaccccggggggggggggcgtctatgaggaattacggggcgggggggaaaaatggggaaaaagaatgatctttcggggggggcccccccccccaggggggtggaggcttacccaggggggggcgccgccccggggagaaattcaaggatacccccggggaacaaggcctggcgctgcttgttgggggcaaaggaaaggttcttgggcgtatctgggggatggatcgggggg

SEQ ID NO: 26219 - DNA, 499 bp, Zea mays
  Clone ID: cC-zmle189096e09a1
cttctctctacaaactctcttatggtacattcggggggaaagatcagacatacatatacccagtgtttgtcatctatctcacgccacagagctacgcttacagggattaaaatgccgcgaaatagctagctgccggttaataccgaaggtaccgctactgcttgttactgctcactacaagctggggctggggctggggctggggctgggtacacaaatatttacatcgcaaaggcagaggggagcaaatcagcaataacaataatactagcaataaaacttgctaccaacagcgagcttcggagaagcaggcggagacagtagtttctacgttcccaactaaaacccaaacggacgggggatggggctgcaacggacaagcaaaagatctcaggagtttttacttccctgggacccgggctggcaccacctcctgcacaaggaacgggttcatcacgcatgcatcatcgtcggcttcctccacacgacctagtcatct

SEQ ID NO: 26220 - DNA, 369 bp, Zea mays
  unsure at all n locations
  Clone ID: cC-zmle189096e09d1
gaggagcccagcaacatagcgcncaaganctacatttaaacaaaagaggaggcccaccccatgaacttgaaatcatccgtgccgatgaaaggaagaaccccccacagcatgcgaaggctgcgccgccggcgtcgcaaaagagaaagaagactgccagcactgaaacaagcagttttaaaagactaggtcgagtggaggaagccgacaatgatgcatgcgatatgaacccgtaccttgtgcacgaggaggtaccagcccgtgccccagggaagtaaaaaaaactgacacctatagctagaccaatgcaaccccatcccccgtccgattgggattttagatgggaacgtacaaactactgttttcgcctgc

SEQ ID NO: 26221 - DNA, 450 bp, Zea mays
  Clone ID: cC-zmle189096e10a1
ttttttttttttttttttttttttttttttttgggtggttttttttttttttttttttttttcccccccttttttttttttttttttttttttttaggggaaaaaaccccccccccggttttttttttaaaaaaaaagggggcccccccccccttgggccccacaggggaaaaccccccccattccccagagggcatttttggcccccccggaacaaaatggggccccccaaaaaaaaaaccccggggggaaaaaaaacccaaaattgggttaacctaaccccgggggggaaaaaaggggcccttgcaaaattatacccccatggggaaaccccccattccggggaaaaaaaaaccccccccgggtaaaaaccttaaaaaaaaggggggggggcccccacgggcccctttttacttaggggaaaccgggggttccctttttcccgccttc

SEQ ID NO: 26222 - DNA, 471 bp, Zea mays
  Clone ID: cC-zmle189096e10d1
cggccattttgacgtaagagatactagcaacaatccctaggatttcaaggagttcgctgatgctggtgaagccatcaatgacaatggggtcgtggcctgccgctgcctcgatagatgatgttgaagctgcgaataaggaaaacccggtattccctgaagtaaagaagtgcctgtgaggtccaccaccacttcttgataaggattctagccgggaggtgttttttttaccagtgaatgcggagtctgacaatgtacgtaacatattgcaagagcaccatctctccgaccacggttatagttagccgaatcttggcttctcttctcccatgcgattttaattttggcagtcaataattagttcagatgtagacatagatgcatgctggtagatggctagcgtcttcccatgttggctcaaacgtcggatgtacacaatgattcataaaaaatagaaacggatggtgagatttc

SEQ ID NO: 26223 - DNA, 105 bp, Zea mays
  unsure at all n locations
  Clone ID: cC-zmle189096e11d1
aaaaaannaaaaaaaaaaaaacaaaaaaaaccaaaaaaaaacaacaaacaacacaaatacaaaaaaaataaaaaaaaaaataaacaaaaaaaaaaaacacaatct

SEQ ID NO: 26224 - DNA, 364 bp, Zea mays
  Clone ID: cC-zmle189096e12a1
ctctttatttttttttatttattttttttttttttttgtttgtttaaattatttttttgggagtcccgaccaaatttaataaacttaaaatattgttggggattgggggtgagaagccgcttaacaaaacaaaaagggccaaggggacaatataaatttcagaagaaaggaaaagagacggacattttttgggggggggggaaaaagaagaaaaaaaaaaataaagagggggaaaaaactaaaagaagcaaaaaaaggggggcccccccatagtgttgttgggaagagaaagaaggggggctaaaaaaaagggggggggagaaggaaaaaaaaaggggaagcaaaaagggggggggggggatcc

SEQ ID NO: 26225 - DNA, 604 bp, Zea mays
  unsure at all n locations
  Clone ID: cC-zmle189096e12d1
cgggcgattgagaccgacaggcaacatanaaagtggaatctagatcatcaatagagcaacaatggcgaccaagatatgtttccttcttatgctccttgctctcctctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacattgaaccgtgctgcttatttgcagcaacaactattaccattcagccagctagctactgcctactctcagcaacaacaacttcttccatttaaccaattggccgcactgaaccccgctgcttatttgcagcagcaaatactactaccatttagccagctagc

SEQ ID NO: 26226 - DNA, 400 bp, Zea mays
  Clone ID: cC-zmle189096f02a1
tttttagaagaagaatttagaatccacgacatgcaagagctcgacaagacgtaccggccaccatggatcgggggcagtctaggccagccagagtgcatgatatgaagaaagaaaattaagcaaaagtacatgcatacgcgagagcagcgaggtagcagcgcaataaccagaagaagacgacgacggtgacgtacgatacgaggaccaagcaagcaaagcatgtggcagccatgccatctcatcgcggcgacggtggttcacttgatgaactcgatggcccaggcgttggcgtaaatgtaggtggccttgaacccggagaagccggcgccctttgcgagctcgcggaactcgcgctcgtaccgctccttgccgccggggttgtgcgcgagcatgatcatgt

SEQ ID NO: 26227 - DNA, 567 bp, Zea mays
  unsure at all n locations
  Clone ID: cC-zmle189096f02d1
gcggccgcggacgcgtgggcggacgcgtgggccatagcattagtgcgctcctcgagcccagcagagaaaggggggcgtacccactctctctctctctctctccagtctccaccggcagcgctaatcgtaatagccatgggctccaccgccggcgacgtggccgcggtggtggacgaggaggcgtgcatgtacgcgatgcagctggcgtcgtcgtccatcctgcccatgacgctgaagaacgccatcgagctgggcctgctggaggtgctgcagaaggaggccggcggcggcaaggcggcgctggcgcccgaggaggtggtggcgcggatgcccgcggcgcccggcgaccccgccgccgcggcggccatggtggaccgcatgctccgcctgctcgcctcctacgacgtcgtccggtgccagatggaggaccgggacggccggtacgagcgccgctactccgncgcgcccgtctgcaagtggctcaccctcaacgaggacggcgtgttcatggcccgcctcgcgctcatgaaccaggacaaggtcctcatggagagctggtactatctc

SEQ ID NO: 26228 - DNA, 218 bp, Zea mays
  Clone ID: cC-zmle189096f03a1
gggttggggtttttttttttttttttcccccggaaaaaaaccaaaaacttgggctcccaacaagtacagggcgggaccctggggaaaaggccccccggccaaacagtcccgtggatctccacattcctccgccaagggggaggcaggcccgtcccccccagttggctggcgcggaacggtgtttggagggcctttaacaagggggctgggccccccat

SEQ ID NO: 26229 - DNA, 614 bp, Zea mays
  unsure at all n locations
  Clone ID: cC-zmle189096f03d1
gcgtccggatcacagggccagtgggcaaggagatgctcatgttctagaccccaacgcaacaatcatcatgctcggagggggtaccggcatcgctccgttccgctccttcttgtggaagatgttcttcgaggagcacgaggactacaagtacaccgggctcgcgtggctgttcctgggcgtcccgaccagcgacaccctgctgtacaaggaggagctggagaagatgaaggagatggcgccggacaacttccggctggacttcgcggtgagccgagagcagacgaacgcggccggggagaagatgtacatccagacgcgcatggcggagtacaaggaggagctgtgggagctgctcaagaaggacaacacctacgtctacatgtgcgggctcaagggcatggagaagggcatcgacgacatcatgctcgacctcgcagccaaggacgggatcaactggttggactacaagaagcagctcaagaagagcgagcaatggaacgtcgaagtctactgatgatgatccttcattatactgttcagctcaagcaatctggtggtgatgagnttgcattgcattgtacgtagtattgtgagatcaatcgatcgtttggctc

SEQ ID NO: 26230 - DNA, 154 bp, Zea mays
  Clone ID: cC-zmle189096f04a1
ctaggacagcatcacattggggggagaaatcttcgacatctcaatccgtacacaacaatcgacaaccctgtgactgtgaagcaagcacatcactacaaggtcctcgcaactctagtctccactctccactctctccagcatgcgaacactatgt

SEQ ID NO: 26231 - DNA, 618 bp, Zea mays
  unsure at all n locations
  Clone ID: cC-zmle189096f04d1
gcgtccgcccacgcgtccgcgagttcatagtttttgctctttttctctcatggtcacaatgcttgcagctagttcgctggggaacagcaacctcgcttgctcatcaaggatatcatcctgttcagacttcacatatagccactcctggcgtcccatacatgctatgaaactccatcagatgcgtgctgtgagctcaatacgtataagttgtgctgccactaaacctgcaaagactcctgctgaagaagaatggaaagttaagcggcaactgctatcagaaaagcgggtacgaagtgtcgatgtgaaggaagcactgcgccttcaaaaggaaaacaactttgtcattcttgatgtcaggccagaagcagagtttaaagaggctcatccacctggcgccatcaatgtacaaatatacagattaatcaaggaatggacagcgtgggatattgcgaggcgtgcagcgtttgcgttcttcggcatatttgctggaacagaagagaatcctgagttcatacagagtgtngatacgaaggttgggaaagatgcgaagataattgtggcatgctctacaggagggacacttgagccaacgcaaaanttcctgatgggagcaatctc

SEQ ID NO: 26232 - DNA, 365 bp, Zea mays
  Clone ID: cC-zmle189096f05a1
gggttggggcatacaaactacagggacattcatccatagcataacttacagcacatgatacaagctaccgggcccgggcaaattttaatatataaaaaagacaattttggaggctcccatttgaatgggggctgataaaagaaaaaaaccaggggagggtttccccggaaataccgggaaagtacttttaacccagggccttttgactccagggtcttaaattttaaaaaagaaaaaagagccaagctttttttgcccaagattccattcaaaatgccctttctgggctggtaggggatgaacaagctttagctcttgtttgagggtttggatggaaagcccactgcctattttgacccccttgc

SEQ ID NO: 26233 - DNA, 476 bp, Zea mays
  Clone ID: cC-zmle189096f05d1
cgcgtccgcccacgcgtccgcgcagaatccaattaatgttgtttaatttgtgggcatgtcaaagctaagcatatgggagggtggtcaggagacagtgtctacttctctgtcgctaaatctgctagggggtcaaaataggcagtcggctttccatgcaaaccctcaaacaagagctcaagcctgatcatcccctaccagcacagaaactgcattttagatggaatcctgggcaaaataagctttgctcttttttcttcttctaaatttaagatcactgagtcataaggtcactggttcgaagtagcttctccgtatttgcggggaaagcctgccctggtttctctccttcatcagaccccactcatatgggagccttcaatattgtcttttttatatatttaagattgaccgtgctcggtagcttgtatcatgtgctgtaagttatgctatgtatgaatgtacctgtagtttgtatg

SEQ ID NO: 26234 - DNA, 379 bp, Zea mays
  unsure at all n locations
  Clone ID: cC-zmle189096f06a1
nnttttcattaaagaccacagcctttttaatttagggtggtttttttttaaggtacagggcccgcccccccataaaaatcacactagctggaggcaacgaaagtaacccttaatataaaaacacaaacaggtggtggaactcaacttttaaaccacataatgtgaaagacacatttacaacgtaagaatgaaaaaaaagaaaacggtaacctaaaaacttaactgcggggaattgcaacaactggacacacacacaaacattacttccttttcttttacctttttgaactgaaacacaaaagacggggagacgtgagaggttaaggaccccatattaccgaaaaaaaggacgagccgaggcactttcttcttcccccac

SEQ ID NO: 26235 - DNA, 457 bp, Zea mays
  Clone ID: cC-zmle189096f07a1
ctctctctttttttttttttttttttttttttttggttggggttttttttttttttttttctttcccccccttttaaaaaaaacccaacccggggggggtttaaaaatcccaagccgggcccttttaaagcaggggaagtccttcaggggcacattggaggctcgatcccccaccatgtctgggggatcaatacccttagagcccagggggggcccgggggtttcccgaaacaaaccacaatcttttgggtgacagggggaggcccagggggggggggttaaccaaaaaacctttccttatcggggccaaaggcgtctaagcttcggggcgcccaaagggcatgaggtgcaaacctggcttcgataacagcgggggtcggggaagggacacctttgaagggagggggggggacattgtctcaagatccgggagacaggaaaattccaaagggggggg

SEQ ID NO: 26236 - DNA, 360 bp, Zea mays
  unsure at all n locations
  Clone ID: cC-zmle189096f07d1
cgggggaaggaattccggggggctncacatanccngcattttgctaacggactcngacacaagcacgcatgggnnaggctgtgtttctaaccgtgctgctgaccacccccccccgcctatggattataatcagctcaggcctaaaaaaaaacctgcttgccaaggattagcatggagccaagtggaagattcgtcatatatataggggccagcctcgaaagcatctcttgactactggatggagttcatttgtcaaaaaaaagaaactgcttacaagggatgctgtgtaatttctccgacgagaaaactgtaaactaatgatggaagaacttacgcctattcagcataaaaaacacgccc

SEQ ID NO: 26237 - DNA, 512 bp, Zea mays
  Clone ID: cC-zmle189096f08a1
cagataaaattggatgggtggtttatgagtggactttaataagaagagaagtaaatggcccaagactagtaaatcccaataaaaagtagctcgtccaactgtagctaggctcctactacgggcatggtgccgctatagctgactagcatacacagttccaacttccaaaatatataagcactggcttggactgaaccgcctctacgcgttgatgaacggtgcgccggtgaggtactcagtgaaggcgagcgcgacgaggccgagcatggcgaagcggccgttccagagctcggcgttggcgctcatgacggcgccgctcctggcctcggcgctgtcgcccctgagcagcggcaccagcgaggccacggacagcacggcagccgtggccgcgaaccaggcgagcccggacccgctgccggcctgcgagaggaggcccccgccgcgggacgcctcgacggcgagcgcggacacgaagcccaccatggcgagccggccgttgatgcgctcgggag

SEQ ID NO: 26238 - DNA, 508 bp, Zea mays
  Clone ID: cC-zmle189096f08d1
gcgtccgcccacgcgtccgggccgagaaaagcgcagcaaagttactcatagcccacgccgctacagtgctctctggccgggcgctacgagccaacgactcgaacgcatacactccaatggcagcgacggtgatggcctccatgagccccctcgcctccgccacccccggcgcgcgtcgcgctttccctgtacggctgctccaggcttctacactcgcgccgcgccggcgcgccttggccgtgagggcccagagcgacgacgccgagccaaaagaggaggtggcctcctcctcgccttctccgtccgccaccccggcgccaaagtccaaggcggcggcgacggcgagccccgggctgtgggacgcgctggcgttcagcggcccggctcccgagcgcatcaacggccggctcgccatggtgggcttcgtgtccgcgctcgccgtcgaggcgtcccgcggcgggggcctcctctcgcaggccggcagcgggtccgggctcgcctggttcgc

SEQ ID NO: 26239 - DNA, 414 bp, Zea mays
  Clone ID: cC-zmle189096f09a1
ggcgaagtagtgctctacgggggaaacaaattgtgctttacaacaatttatattttccacctcaaaatcaacagatataattgttgaaaacttgacttcacatgatagggaataggatgcgcagtgagccagtgaattgtgtatcaaaaccaggcaagtcacggccagaccaggcctcatgtctaccgcagcacctggcactttcagcaaaatctctggcaaacatcaggcttcgccaaagtccattactcgaggttctgtaactgctgagctcatttcgcatagacattcagccttactcgcgctgtcacgtctgggtgaagcttgatctctgcaacatactctccgatttcacggatttctggaaccgtcaccagcttcttgtcgacatccctattaagttgtgactttatt

SEQ ID NO: 26240 - DNA, 422 bp, Zea mays
  Clone ID: cC-zmle189096f09d1
gcggccgaataaagtcacagcgttaatagggatgtcgacaagttgctgttgacggttccagaaatccgtgaaatgggagggtatgttgcagagatcaagcttcacccacacgtgacagcgcgagtaaggctgaatgtctatgcgaaatgagctcagcagttacagaacctcgagtaatggactttggcgaagcctgatgtttgccagagattttgctgaaagtgccaggtgctgcggtagacatgaggcctggtctggccgtgacttgcctggttttgatacacaattcactggctcactgcgcatcctattccctatcatgtgaagtcaagttttcaacaattatatctgttgattttgaggtggaaaatataaattgttgtaaagcacaatttgtttgaactgtagagcactacttcgcc

SEQ ID NO: 26241 - DNA, 334 bp, Zea mays
  Clone ID: cC-zmle189096f12a1
ctttttatacggcaacgcatacatatgcaaggacagtaagttttttgagctaaccatccggtccctcccaacattaagtagaggacaggcacgcccatgtaaaggtacattacaatattactattttgagcagtatcacaagctaattataacagcattcatcacagcccagtcctctaaacctcatgcaaggcctttattaggtatagcctgtcgaaattctgaccagcaaccctgatgatatggttgcagtaactgtagatctgactagttactagaaagccttacaatcgtgagggcctaggaataggcttaaatataagattggatggat

SEQ ID NO: 26242 - DNA, 414 bp, Zea mays
  Clone ID: cC-zmle189096f12d1
ttaattaataaatttatttattatttattataaaaatatatttttatttattaatttaataataaatttattattttctatattattttatttaataattaatatttatttaaatttttatattaataatatataataattattttattttaaatttaattaaattttttttatttttatattatattatatatttatatttatttatatatttttatattataatttttttttaataaattatttatatttattaatataaatattttatttatttatactatatctattttatatataaaataatttataatatatattatatttatttattattttataatataataatatatttataatatttaatataattttataaaatatattatatattaattctttatatattat

SEQ ID NO: 26243 - DNA, 292 bp, Zea mays
  Clone ID: cC-zmle189096g01a1
gattaaagactcatgcttttactggggtggggtgcctttcgactcaaaatgggtccaagccccactttttttttgtcactgggaaaaacaacccgccccgacacagggaaaaggggtttaccacaacacacgccgctgtgcagaaaaaacaattttttttataaggggcacaaaggggaaaacgagcacacgggggggcccccagaccccaaaatcacaacacagaatttttcccaaaggccaaatttagaaaatactacaaagaaaacctctgtgtccaggaacccacggg

SEQ ID NO: 26244 - DNA, 580 bp, Zea mays
  Clone ID: cC-zmle189096g01d1
gcgtccggccttaattctatgtgcaatctctttaccgctgtttcctttcttgctacggcctatatgtgccactggggggtttacatcattgacaatgaacttgacgacacaacacagatcaagccgatcgtgcgaacatcgctgttcctgcgctccagtgtttacattgccacaagtttctttgcttatctgctcttcggtgaaggcacactggacgacgtgctcgccaactttgacgcagatcttggcattccattcaggtcagtcttccacgacatagtgcgagtgagctatgcggcacatgtcatgcttgtctttccgcattgccttctttgccctccggctcaacttggatgggttgctcttccccacatcaaggcacatctctcgcgacaacaagagattcgccatcatcaccgtctctctcctcgcagtaatttatcttgctgccattctcataccaagcatctgggacgcgttccagtttactggtgccacagctggctgccttgatggttttatatttcctgccatggacatacttagggattcttactgaatctctagcaagcgcgacaag

SEQ ID NO: 26245 - DNA, 304 bp, Zea mays
  Clone ID: cC-zmle189096g02a1
tttttcacaagaaaaacgaatacatcgattgtggagcaggagagattattgagtccacggtgaatgaagcatgcaataaattacatgatgattgtggagattaagccattacaagattgatgttgtgacgctagcagctaacgtagcagctaggcagcagcctcacttcacaactacaaatcacacaggagcatggggtccttgagcagactggcctcactcatttcacctcgaggatctcgtccaaggcatagttgttggtagacacaccggcgtagttcaccttgttgaaccgcaccaccac

SEQ ID NO: 26246 - DNA, 311 bp, Zea mays
  Clone ID: cC-zmle189096g02d1
gcgtccggtggtggtgcggttcaacaaggtgaactacgcctttcgttttaccaacaactatgccttggacgagaggcgggaggtgaaatgagtgaggccagtctgctcaaggaccccatgctcctgtgtgatttgtagttgtgaagtgaggctgctgcctagctgctacgttagctgctagcgtcacaacatcaatcttgtaatggcttaatctccacaatcatcatgtaatttattgcatgcttcattcaccgtggactcaataatctctcttgctctaaaatcgatgtattcgtttttcttgtgaaaaa

SEQ ID NO: 26247 - DNA, 583 bp, Zea mays
  Clone ID: cC-zmle189096g03a1
tttatctttttttttttctattttaatttaaaggttaggggtgctttttgttttttatatttccctatctctttccgattaattatatttgcatcaccacaccacgattgttaaccgacacggggggagtatcagagggccccccccctaaaaaggagccccagccaaaaatgacttgtaactcggcccacgggaaaggggaaacccccaaaaagggcaaaaagaagggtccccccccccaaaaagaaaaaaaggggggccacaatacaaacaaaaaaaaaccattgtgggtccaaaagaagggggggcgccccaaaataccccccacattttgggggggaaaagaccccccgggtcccaaaaaaaaaaaaaaaaaaaagggggttttttttggggggggggaaaaaaacccccctttttttataaaaagtccctaaaaaaaaacacggggggaaagaaaatgtttttgaaccccgcggagccccctttacgcgctttttaaaaaaaaagcccccccgcgggggggaggaccccccccggggggccccaaaaaaacaggcggccccggggggcccctcttttt

SEQ ID NO: 26248 - DNA, 464 bp, Zea mays
  Clone ID: cC-zmle189096g03d1
cgtccgggctgaacgcctcgcagtccctggagctcgccttttattttgcagagaggctcaggaagaggaggatgggggcggggctcaacaacagcctgcctctgccaccactggctttctaagtagccgaagctgaacagagaaagtagagggatagttgcggcgactcgaaagattacgcctgtttatttgttgatgcttggtgtggaggcctggtgggtgctcttggcacaagttacatgctggggagctataggagggtacctgttgcgttgtggaagacagtagctagtattatgtgttgtaattgtatgccttcgtttcatgttctgggtgcgtgacttgtcgactttgctgcttctggggttctgaccttggtaaggagagaataaagagataatatgagtgcgagatgcttgctgaactggtgctcagtaaattgatcccttgattggaaaaaaata

SEQ ID NO: 26249 - DNA, 374 bp, Zea mays
  Clone ID: cC-zmle189096g04a1
gttgggtgtaaaacatcggatgaattggacactatgaatgcttatatcatctatcctacaagctgaaattggaatattacattctctgtatgtaaggcatttaagtattgacacgataaaactaactggcgcaaatgtatacgctgatttactaaactggcggcctgcagttcaagggaaatgaaatgaggcactaatctaccgatctgtagtccaatgggctcatattggttgttcatcttggaatataaccagttcttccctttaatttaccaccagaaagttgcagtgcgttagttcaatgagactgtgcttccagtaggatgttcgttgccacgttgatgtcatttccccacgcgtccgcggacgcctgg

SEQ ID NO: 26250 - DNA, 405 bp, Zea mays
  unsure at all n locations
  Clone ID: cC-zmle189096g04d1
gcgtccgcggacgcgtggggaaatgacatcaacgtggcaactaatttcctactggaagcacagtctcattgaacgagacggactgcaactttctggtggtaaattagagggaagaactggttatattccaagatgaacaaacaatatgagcacattggactacagatcggtagattagtgcctcatttcatctaccttgaactgcaggccgacagtttagtaaatcagcgtatacatttgcggcagttagttttatcgtgtcaatacttagatgccttacatacagagaatgtaatattccaatttcagcttgtaggatagatgatataagcattcatagtgtacaattcatccgatgttttacanannaaaaaaaaataaaaaaaatataaaaaaaaaaaataa

SEQ ID NO: 26251 - DNA, 488 bp, Zea mays
  Clone ID: cC-zmle189096g05a1
ggttacaacagccagctgagtcattcatcaggctggttatcatcaacttgcccaacactgacagaaacaggggggaatatcaggcaaaccataagcaactcttcagtgcgtacattttacatcgtaaacaaccagaccgacggatatgtcgaacaaacaaaccaaagaagaaaaaggagcaacgcctcaccaaacctatacagcaccaacaaagatcatcaaactgccaaaagaaaagaaacaacagcaatcaccaccgaatgacacgtcgtcaaaacaaaagaaaagaaaacactagccggagatgttagacacaaagtagttcatccctgcgaccacgagatgtaggcagaagaggctcttccgctgatgccatcttctccaggacaatgagaggttccttcccagtcaccagtcctaatccaagtaaggatcatcaaagccatattcggtcaattcctacatgccttcacatgttgcgcgccgag

SEQ ID NO: 26252 - DNA, 486 bp, Zea mays
  Clone ID: cC-zmle189096g05d1
gcgtccgcggacgcgtgggggaaaaggaggtcatttctctatggttggcgtgccacgaaaaggatcagagcctggggggggggacgacgcagttgagatgttggcacagaaagtagatactttgacaaaagctatggagtcagatgccaagaaatcgaggcgcgagctagctgctatggagaaggagctggcagctgtgcgcttggagaaagagcaggataacagggcaagacgttttggtagttcaagcggttctgccagcagttcgcagctcccacctggcaggactttacctaggagcggctcggcgcgcaacatgtgaaggcatgtaggaattgaccgaatatggctttgatgatccttacttggattaggactggtgactgggaaggaacctctcattgtcctggagaagatggcatcagcggaagagcctcttctgcctacatctcgtggtcgcagggatgaactactttgtgtctaaca

SEQ ID NO: 26253 - DNA, 315 bp, Zea mays
  Clone ID: cC-zmle189096g06a1
tttttaaccaaaaaagaaatgcattgaatttaacgtggaggctaaaccaacaaaagaatagagttagccatagtgtagcagctaagcctgtttacaggaaattacaagggaaaggccgttggtacagtgagagagataacagctaagctagctacatgctctaaacactagcggacatatcaaggtagcgaggttctctttaatctgtgtcactgatagccaggcatcaaagagctatcggcagtgacacggaacctccagcaacaagaatattatcacgtgtatcttctaagcgtgcccccagtggcctcaaat

SEQ ID NO: 26254 - DNA, 322 bp, Zea mays
  unsure at all n locations
  Clone ID: cC-zmle189096g06d1
gcgtccgatttgaggccactgggggcacgcttagaagatatttgtgntaatattcttgttgctggaggttccggggcggtgccgatagctctttgatgcctggctatcagtgacacagattaaagagaacctcgctaccttgatatgtccgctagtgtttagagcatgtagctagcttagctgttatctctctcactgtaccaacggcctttcccttgtaatttcctgtaaacaggcttagctgctacactatggctaactctattcttttgttggtttagccttaacgttaaattcaatgcatttcttttttggttaaaaa

SEQ ID NO: 26255 - DNA, 330 bp, Zea mays
  unsure at all n locations
  Clone ID: cC-zmle189096g07a1
gaaggatgcatcctagagagcggccgcacgcgacctatatccttcaacaagcccagacgcaaaacacatcggcncgcnagtcgattgaaagaagaccacagatccccccccgaggagggggagaaggagaaaagcggaggaagaaggcaacagacgacagaaggggaggggaaaaaaagaggcgcggcacacagaacgatggggcgagaacgcgccggaacagaactgagcacaaacgcggaacggaaaagacacgagcgccacatacacgcagacggaggacaccaaaacccggcaggggcacaacgagacaaaaaacaagaacaaggg

SEQ ID NO: 26256 - DNA, 525 bp, Zea mays
  Clone ID: cC-zmle189096g08a1
tttatcaaaagaaacaggagccgccgagccgggggctgtaaatgtatatcatgtacgtcacagtgcacatcaacaagtacataaattctgagaggaacaagagatagattactcagcacccgtatacaattctttcagcgtcaagctcttgataagcatatatcctcacggtcgggcacagcccgaaaacaaaaaaaaacaaaagaaaaacagaaacatactgagctagctataataccggaatcatacggtaatgaatcgcatcttcatcataactaccagctttgaaaactcaaaacgagcccacttgcagctaaactcagcagtcctgtagaattcactatccatagaatacttctttcttcgtggcaacaaagaaataggcaagagtgcacttcaccttactcgatcttgaccgatgagtaaatcagccttgtgaacaggaagcaagcatagaatccgattgtgccggtcaaggcgaagaatgcgtacgaggcaatgagcatgtaaccgaagtacataaca

SEQ ID NO: 26257 - DNA, 465 bp, Zea mays
  Clone ID: cC-zmle189096g08d1
cggccggccacgcatacgggcaaggctatcatattgactttcaatgtggatgacaaggagagcgacatcaagggggcgtgttgtttggacagctctctatagaccacccacgatcagatccactggaactctattgtgaatgctctcatgattgctcgcttgcttgctggaatggtggcaatgaccatgcttcgtaccctttaccgggatatctctaagtataaccaacttgagactcaggaagaggcccaagaggagactggatggaagcttgttcacggggatgttttcaagcctccgtgaaactcagactggctctgcgcctatgttggcaccggtgggcagctctttggcatgctgcttgtcactatggtatgtgcggttcttggcttcctctctgcatggcacaggggtggactgatgacagccatgctcctgctctgggtgttcatggggttgtttgct

SEQ ID NO: 26258 - DNA, 384 bp, Zea mays
  Clone ID: cC-zmle189096g09a1
ccagcttacccctcgggattcaaaaaaggctttcaataattcacaaacccatcccatcgatggcaacttttctggagtcaacaaaaccccaatgatcgggccccaattggtacctaaaaaaccggccaaaaataggattctggcggggttagatttaaatggaacagaacaatccgggaatcctacaaatcctaaaaaacggccattgtctttacccaggcgagggaaatgatcttttttaggcagcacggggcccagtacatttaaccataggcgacgggggggtttttcacccacacaggcagagtaatccccggaggccacactaaacacatttttcaagcagcagcgggtttgcccaactcactttccccatgggcaaag

SEQ ID NO: 26259 - DNA, 505 bp, Zea mays
  unsure at all n locations
  Clone ID: cC-zmle189096g09d1
cggccggctcagggaacggttgaccacatcaagcacgcttgcgtaatggtcacagagttgattgtccgcatcggtnggttatggtgcctccacaagcaaagaacaacccaggcagggggcctggttctcatgctgggggtcctgcaagcaacttcaagaccaagttgtgcgagaacttcaacaaaggctcctgcacctttggagacaggtgccactttgcccatggcgaaagtgagttgcgcaaacctgctgctgcttgatagatgtgtttagtgtggcttgcggtgattactctgcctgtgtggctgaataacaccacagtcgcctatggtgagatgtactgggccacgtgctgcctgagagagatcatttccatcgcttgcgtagagacaatggccgctttttaggatttgtaggattgccgtattgttctgttcgatttatatctaaccctgccagaatcctatttttgtaccgtttcttagctactaattggtgccagatc

SEQ ID NO: 26260 - DNA, 454 bp, Zea mays
  Clone ID: cC-zmle189096g10a1
ttttcttttgagaaaaaatgcccttcccccttgggggggtaagctatcggacattcaggaatgacagctcatcgagtccttcaacatgaagaaaccggtgacaactcatcaccaaatataccaacccactgttgtacctttgcacatgagagttttttttttcaatttcaaaggttgcgactaattcaaatgttgcgactaattcatagagtatgtactttttcattccttctgaagggcacatattttgtggggaagaagttgaccacattctaaaagcaaggcgtaaagaaaggcagatgtcagctaattatagagcccttcttcgtgccatatgtccaccaaaaaattaaccatcttagataatgggattcgttgcggaaaacgctcactctgcgtcaggaaatcatcatctgctgtggaccaacttatcactggctctcggggggtcttt

SEQ ID NO: 26261 - DNA, 215 bp, Zea mays
  Clone ID: cC-zmle189096g10d1
aacaaagacaagcggaagaaggaaaagggaacaaacatgaatattataaacagggctgggaacacagagactgatagatgcgaaaacgtgacaagacttgtgagatgatggactaacaccatctgcattggaaggcatggcatatgtgatcaataccgagatacctatgcagaactgaaggggcgagggaagcataagcaagcatatgagggaaa

SEQ ID NO: 26262 - DNA, 445 bp, Zea mays
  Clone ID: cC-zmle189096g11a1
ttttcttttttttttttttttttttttttttgggggtgttggtttttattgttttttgtggtttttcccttttttgtggtttttgttgtgtttgtttttttcccttaaaggggggaaaaaggtgggggaaaccccatggggggtttccggggaaaaaaaaaagggggggggttaaaaaaggggggaaaaggggggggttttaggggggggaaacaaaaaggggggggggccccccggggaattgggggggggggccggggggggcccccactttccctatggggggggttaaaaagggggggggggaaggggggaaaaactggtccgggggggaaaaggttttcgggtccaatatgcccacaaaaagggggggggggggaaaagggggaagcgggggggggcccaagggggggggcccccccataaggggggggggggaccgggg

SEQ ID NO: 26263 - DNA, 389 bp, Zea mays
  Clone ID: cC-zmle189096g11d1
gctcgcgagctagttactgccagctaatacccaacattttttttgcttttgtaaatccgcgcagatgtttgtttcagaggagaatgcaataaggatatgcagaactatattccttaaaaaaaaaaaaaaaaaaaaaaaaaaaagcccacaacaacaaaaaaaaaagaaaaaaaaaaaaaaaaaaaaaaaaaaaaaaaaaaaaaaaaacaaaaaaaaaacaaaaaacaaaaaaaaaggggcgacgcctataaaaaaaaaacctaacctaccccggcctgtcaaccacaaacacttcccaaaagggcaccgaaaacgcatgctccggcccccgtgtgaacacatcggggaccgtaaaaccccagcccgaccaacactaaaccgcttgcaac

SEQ ID NO: 26264 - DNA, 334 bp, Zea mays
  Clone ID: cC-zmle189096g12a1
ttttccttaagattaacttagaataaagcctggggggggtaacagcatccatcgatccgcagtccatgctgtttgatgcatgggtctgctgaaaccgaggatgaacacagcactaacaactgacacagagcgaccttgcaatcaaaaacacagatgggcaacaacaaacacgacacgaacgaagataaaccctctggactagggtaaacatcacggtagcgaacaggataacttggccgcgcgggccccaccgctcagttcctccagttcccgtcggagttgccgtagccgccgccacggttgccaccgccgtagccgccgcaccaccaccgta

SEQ ID NO: 26265 - DNA, 439 bp, Zea mays
  Clone ID: cC-zmle189096g12d1
cgtccggttggcttgtcctgcccctccggttcgggttcggttttctataggttctccggggttcgggttcgtgggggaggctatcttgatggcggcgtcggatcctgaccaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctactgcggtggcgggcgccgtgatggcggtggctgc

SEQ ID NO: 26266 - DNA, 384 bp, Zea mays
  Clone ID: cC-zmle189096h01a1
ttttgtggaacaaacaaaataagccatcacacgcggggcgcacgcaacaagtcatataatcgcattacacaatttctcccaggggtaatgacatcccaattgacaatgtggacccacattggcttaaatataactagaacatactgaagctttgatagaaaaggtagggagtttaacaacagaatgtagacaaatccattcgtaaacaaatcttagaaccaaaaatgtatccggcatcgagctcattgcatgtgtcatgcttcgatagagtgggctatgtttcagtttggaacaacaatattagtagagactaaaatacaaccgcgtcgagcatggttcctagggtctgaactatgtttgatgacatcaaattggacacatgct

SEQ ID NO: 26267 - DNA, 499 bp, Zea mays
  Clone ID: cC-zmle189096h01d1
ccccgcgtccgcgcgagctgagcagggcggaggcggcgggaccgttatttgagcggctgcagcggatctttggcgccgggggggtggggcagccgccgacggactcgccgctgctcgactcctccgagcaggtctacatctcctccctcgcgcttctcaagatgctcaagcacgggagggccggcgtgcccatggaggtcatgggtctcatgctcggcgagttcgtcgatgactacaccgtcagggtcgtcgacgtcttcgccatgccgcagagcgggactggggtcagcgtcgaggccgtcgaccacgtcttccagacaaacatgcttgacatgctcaagcagaccggcaggccagaaatggttgtaggctggtatcactcacatcctggcttcggttgctggctatcaggcgttgatatcaatactcagcagagttttgaagctttgaaccccagggcagttgctgttgtgatagaccccatccacagtgtgaaggg

SEQ ID NO: 26268 - DNA, 243 bp, Zea mays
  Clone ID: cC-zmle189096h02a1
gggggaaaaaaaaacccccggtttttcttggaaaccccccgggcgggggggggaacccccccccaaatctttttttttccccccgggacttttttggtaaaccgggggaaaaaagggggggggagggaaccaaaaaaacgggggccccctatacaaaaagccccgcccccagaagccgttaaaaaaaaggggggggtttcccggggccaaaaataggcccacccggccccgggtggccccccg

SEQ ID NO: 26269 - DNA, 443 bp, Zea mays
  Clone ID: cC-zmle189096h02d1
cgtcggttggcctgattgtggcccatggaagccaccacattcattgaactgctttcgtgagcatgtcgttgggtgtgctgtgaccatgcttcttcgtttgcattccaaaccttttttacgaactgtttaacaaaaatgatcttgtcggataaataatgattctggtgcgagtttaccagaacggcaaggagtttctcaagtaaatgcagcgtatttttctattcaaaaaaaaaaaaaaaataaaaaaaaaaaaaaaaaaaaaaaaaaaaaaaaaaaaaaaaaaaataaaaaaaaaaaaaataaaaaaaaaaaaaaaaaaaaggggggggccgttttaaaggacccaactttacttccccgggcttgcaaggaaatagtttttttttgggggcccctaatttaaattcatgggccggggtttaaaacggcggaatgggaaaaac

SEQ ID NO: 26270 - DNA, 245 bp, Zea mays
  Clone ID: cC-zmle189096h03a1
tttatcttttttttttctttttttaatttaagagtaagggttgctttttgtttttcatatattccctatccctttccgattaattatatttgcaacaccacaccacgattgttacccgaaaaggggggagaagcagagggccccccccataaaaaggaggtccagccaaaaatggcttgtaaatcggcccccgggaggggggaaacccccgaagggggtaaaaaaggggagccccccccccaaaa

SEQ ID NO: 26271 - DNA, 458 bp, Zea mays
  Clone ID: cC-zmle189096h03d1
cgtccgacccgctgagtttaagcatataaataagcgtgctgagtagatgcttgttgagaaagaaatggaggtgggccggtgtaaggacacggctaagtttgcgtcgacacaggacaaggagttgcaatgagcatcgaatttctcctgttctctttcaatcgtacaactcttgcgcacgatttcatcggctgtccatgatcaccgaccgccgaaggaggattttggtcaaacaaggtttgccatggcgaactgcggtttgtggaagatatagtcaacctgttcataccaaagtttagtgctagcatattacatctccagtgaacgttttgggctccggtaaaaatcagtagaatgctgtgtaacagtgtaagttagcctactggtgtacggatcaatatgagatttgatacttcatgtttctgtatgcgcattacatggatggattatgtgtgcaaaaa

SEQ ID NO: 26272 - DNA, 420 bp, Zea mays
  Clone ID: cC-zmle189096h04a1
ccttcccccctttctttttttttcttctcttttttttaaaaaggggaccccccggcgggggtttccctaaaaaacaaaaacaaaatctcgggggtggctccgcaaaaagaggtttaggggacccgcccccctttttcccccccgctggctggggaaggaaaacaaaaaaagggcccgccccgcccccccccccgtttctttttcccccccccccccccggggaaacccttgccccccccccgggggcggggggggggccccccccccaccggggataaccagggggccaaccccttttattttccgaacccgggggccccccccccccccaccacccaaaaatctccccccgcgcttggggaaggaaacaaaaaaaaaaacccgccccgcccccccccccggtcctatgccccacccccc

SEQ ID NO: 26273 - DNA, 612 bp, Zea mays
  unsure at all n locations
  Clone ID: cC-zmle189096h04d1
gcgtccgcgatggacatggggacctcgcacacgcactccctttcctaatcacactcgcactcgtggggcgagacgggggcgccagattcggagatcgtggacaacgacccgttcccggagctggactcgttcccggcgttccaggacccggcgatgatgatgacggtgcccaaggaggagcaggtggacggctgcagcgccaagagcggcaacctgttcgtggacctcagctacgacgacatccagggcatgtacagcggcctcgacatgctgccgccgcccggggaggacttctactcctcgctcttcgcgtctcccagggtcaaggggaaccagcccgccggagccgccgggttgggacagttctgagctgaggcgaggatggagccatggatcaggagatgaagacggttgcgaactctgtaaatacagcataggagtcgaacctgaccctgacccttgttggggttacaaggttttncgagtgtcggtgtagcgtacatggaagccgcggcgcggncgggccggctcattctttagtttcacttccaaagcagacgggtagatatatgtgtagctgatgcgaggatggagccatggatcaggagatga

SEQ ID NO: 26274 - DNA, 372 bp, Zea mays
  Clone ID: cC-zmle189096h05a1
ggggggggtaaatttcatggtctcattattccccgcctgtggccatgaaaaaaaaaaccttttccttcaataaacaaggagcccggtcccatgacgaaaaaaatacccacgtgatgaaaccagggggtttgcccggggaaaaaaacccccggagcaccaatttattggttacaagatccacctaggcttggattgccggctcaagcaccttgtcacggggcgcgcgggcaccaacccttcacaagcggggggggggaaccccacagggctgggggagggggctttggagggtccaccctctaccggaatggcgaggccccacaaaacctccggggcgccggggccacccattgatgcaccaaagacttcgtc

SEQ ID NO: 26275 - DNA, 569 bp, Zea mays
  Clone ID: cC-zmle189096h05d1
cgtccggattaacggagatgttaacttcaattggaaaacgcttttgtaaaataagactaaagaaattgttaggggagtggtgtgtatcagaggatccttaccagtgccggtgtgacaatgattgaaggggcaggcagtctaattgatgctcatactgttgaagttagccagcccgatggttcaaagcaaaggtataccgcgaagcacattttgatcgcgactggtagccgtgctcaacgtgtcaacatacctggaaaggatctggctattacttcagatgaggccttgagcttggaggagcttccaaagcgcgctgtaatcctgggtggcggatatattgctgttgaatttgcttctatctggagggggatgggtgctgaagtagatttgttttatcgaagagatcttcctctaagaggttttgatgatgagatgagagctattgttgcaagcaaccttgagggaaggggaatcaagttgcatccagggacaaatctctctgagttgagtaaaacggctgacggaataaaagttgtaactgataaaggagaagagctcattgcagatgt

SEQ ID NO: 26276 - DNA, 504 bp, Zea mays
  unsure at all n locations
  Clone ID: cC-zmle189096h06a1
cttaatacaagatactgtcggagaggtttggttgacccccttcactaccagctgatgaaccataccttccctatcttccaccatctgatcgatagagctatcatgactgaaaggaagcgccggaagatggaagacaggaaacgcaagattggtggaccataggctaggagaagctgtcgtccccgtttctcaggcaacccgccctagcaattcaagcagagtcaccctcaaggacaccagcatcagcatcaacgtcagcatcaatagtagttctagaggcagttcccttagaagcagtagcagtacagctagagcaaccaacagggaggaaaccagtatcagcgacaaaacatccaagcacctcgccttcctgccccagcaaccaatccgagcagccaagcagcctantgcaaggaggaggtcatggatgtttccactatgggcaacaaggtcactaggcgactcatttcccaaagaaagcagctcagcagcagtcagctccta

SEQ ID NO: 26277 - DNA, 528 bp, Zea mays
  unsure at all n locations
  Clone ID: cC-zmle189096h06d1
gcgtccgaaccctcataggtggatacatgggtgctactagtttgtgtgtgtttctacccatgatgcagtcacggagggtgtgttgctccagtatcaaataacacattcgtagaatgggattcgactgagaccgtacctagtgccactcctggggtctcctgaactgtgtcggcctccaggtgcttcacctttccgtattaggcacgaggctgtctacgattgctgactccttgctgaggtgcattctgtcttgcagtggcattaggagctgactgctgctgagctgctttctttgggaaatgagtcgcctagtgaccttgttgcccatagtggaaacatccatgacctcctccttgcactaggctgcttggctgctcggattggttgctggggcaggaaggcgaggtgcttggatgttttgtcgctgatactggtttcctccctgttggttgctctagctgtactgctactgcttctaagggaactgcctctagaactactatngatgctgacgttgatgctgatgct

SEQ ID NO: 26278 - DNA, 446 bp, Zea mays
  Clone ID: cC-zmle189096h07a1
ggggtggttgtttttgtagtttttgtgtttacccccccatagttttttaggtatattgcctcccccgtttggcgggcccgaaaaccaacggaccaaagaggatcaaggggggaaacgggggcacgggggagaagaagaaaaacaaaaacccaaaggaggggcgaaaggaaggaaaaaaacaggggaaagccggggggaggggggagcccccccccccccgacccgcgcggggccggggaaaagacaaaaaaaccgccatacccggggggggggggggggggggaaaacccccccttgcccagagcgcagggagggcaccgatgggaccgaaatccacgcgcgggctgggggggggggcgcggacccccggtgcaaaaaaaacaccaaccgagaagggacggccaaccgcgcaggggggggggggggggggcccgcaaaaacccagg

SEQ ID NO: 26279 - DNA, 509 bp, Zea mays
  Clone ID: cC-zmle189096h07d1
ggaggcgaggaaccccgtgggttgcgtggagaaggcaagttgttaatcgctcgtcggatgctcggagcgatgggcaggtcggaatcgccatcgtccttacaaacaccgattgggtttgtttatggaccgagagatgatgatcgagcagtgatgtggtgccacccacaagatgccgttggtggacgacctgaagaatggacataatcaggatgctcgccaagcgagtgccacccagcaaacactgtctaagtgttaaattaaaggtacttcttaggtcgattggttgatggtgtgacttggccttcatccctgccaccgggatagacggtcgagtgggttattgcttccgcaggagaggaccaggaggagtagcgtggctaggcttcgccatgttactcggttttctccgttagttatttccgctgcattaaaatttatggttattatttctgaaactccgataatgtaatcactaatgatacttattaaattgtggtattatgttttaa

SEQ ID NO: 26280 - DNA, 460 bp, Zea mays
  Clone ID: cC-zmle189096h08a1
ctaaaacactattttgcactattttgcagtggggactataactttcacatagtatagtttgattatagagatgagtagatagccttgcgggcagggtgacgtgtgcttgtgagtggggatgggggtggagtgtgtgtcaggatgtacgttttttttttgaacgcaaaggatgtacacatatggaaatgcaattgtccggtcaatatagcatctcgcggtatgtgtctacaatatgattgacgaaagttccacatgctgtaaattgccaacatctctttaacataagatgccattacaccatggttaaactcccaataatcatcgtggcatcttgcttcgaatgcttactgcaagaggagtgacctcattctcttcttgtcatccagatattagttcttgtatttcatggtctctttctcaaatccaattgttgggaattgtttgccaattcctctacatc

SEQ ID NO: 26281 - DNA, 569 bp, Zea mays
  unsure at all n locations
  Clone ID: cC-zmle189096h08d1
gcgctactacatggcgtcccgtccggcgacggaggagagattcgtantacctggactaagcagttgaacgcgggggtggaagaggtcgaccccgagattgctgacatcatcgagcacgagaaggcccgccaatggaagggtctggagctcatcccgtcggagaatttcacgtcggtgtcagtgatgcaggcagtgggttccgtcatgaccaacaagtacagcgaggggtaccctggcgcaagatactacgggggaaatgagtttattgatatggcagagtccttgtgtcagaaacgtgctttggaggctttccgtttggacccggcgaagtggggagtgaatgtgcaacctctatccggttcgcctgccaacttccatgtatacactgcactcttgaagccacatgaaaggatcatggctttggatcttcctcacggtggacatctttctcatggttaccagactgacactaagaagatatctgcaacttcaatcatttttgagacaatgccttacagattggatgaaagcactggattgatttgatacgatcagcttgagaaaagcgc

SEQ ID NO: 26282 - DNA, 453 bp, Zea mays
  Clone ID: cC-zmle189096h09a1
ctgaatattcagttaagaccagtcgaaggctccttttcgccatgcataaactaaaccaacaactaggataagcacaaaaatgaaagcttcgataaaaacggatacacccaatacgtcgaaactcattgcccaagggtagagaaagactgtttccacatcaaaaacaacaaaaactagcgcaaacatgtaatagcgtattcggaattgtaaccaagccccccccatgggttctatacccgattcataactagaaagcttctctggtccttcactaaccggggctaaaagtcctgaaatccaaaataccaaaataggaataaggcttgctattattagaaatgtccaaaaaatatcatattcgtaaagcagaaacataaatgtactcccattaatgtggaataggcggaactgaattagtcaattcaagttgacattgtcaatttatccagaact

SEQ ID NO: 26283 - DNA, 280 bp, Zea mays
  unsure at all n locations
  Clone ID: cC-zmle189096h09d1
atagatggcgagccgcctcccccgacccatttgatgctaatccccatancatnngaagcatatggtagcatatatattatataaatcgagccacttcccataaaatagaaaaaatcgaaagaaaaaaaaaatgaaagagtggataataaaacaggatattctgtttcataattcagaaatagagatcttctttttagtattactccgcattaggatgtatatattaaccatcctattctaatagatattaaacatcctatactaattaaggcctaatcca

SEQ ID NO: 26284 - DNA, 59 bp, Zea mays
  Clone ID: cC-zmle189096h10a1
ccttcttttctcggcctattttttttttttggggttgtgtttattaaaaaaccgcgcct

SEQ ID NO: 26285 - DNA, 336 bp, Zea mays
  unsure at all n locations
  Clone ID: cC-zmle189096h10d1
aaacaacacaacaacaaaaaaanaganaggataaaaaaaaaaaaccaaacaaccaaaccccgnnaaaaaaaacncaaaatctnaatatctccaaatacaacaaatccaaaaggcaaaaagaaacaaagaagccaccccaagaccacaaaaaacgctaaacaaacgcaaaccaacaaaacaaagacaaaaacaatcacaagaaacacaaccaattcaaaccacacaaaaacaaacaagcccacaaaaacaaagtgtacacaaaaaccaacaccacaaaaaacccataaaaaacccagaaccctcaacccacaaaaaaccaaaacgctcgcaacaaaa

SEQ ID NO: 26286 - DNA, 122 bp, Zea mays
  unsure at all n locations
  Clone ID: cC-zmle189096h11a1
tcctcccttttttttttttattatttaaaaatataaannaaacacaatgggggagtttttaataaaaaacccctcctttttccccctagtgtatataaatntttttccttttttttattttt

SEQ ID NO: 26287 - DNA, 369 bp, Zea mays
  Clone ID: cC-zmle189098a01a1
gattcttgatctatccagtggtcactgtcttcaaaagggatttcaagaaattccattgcccgttttcctgagttctgcaatgacatttctatacctcctagctcgccatatatcccaacagatgcgaaggttgttactcccattgacttcggagagctgtagttttaggacatctgaatgcatagatcgataaacttttgctgcttccgctggtacaccagcccttttagcaacaatctgatcatagaggtctctaattttcaacccaatgatggtctggaagagacctcgcccgttgttgctacctgggaagtctgcatgctttagcatttgtagcgtcacctctcccaaaaacttggttgaaaggtt

SEQ ID NO: 26288 - DNA, 330 bp, Zea mays
  Clone ID: cC-zmle189098a02a1
aacgcgaacacgggcggtattgtagttattactaggctgacacgcacgtttcaacgctcaccactttattccgtacacacagataacgactacggtcacacggtcgccgcaacagcagcacttactcgcacacgtcgtacgcctcctgcctgcttgcactttattatgtagcactaagattcgtgtgcggtgcacgtgtgcaaaacgagaccgagggtgattttttgattccgttcgggcgcttcacttccacttgttaaacttgccgccaccgaacgcgccggttttgcggttgcctcctccaaacatgccgccgccgcgcttgttctt

SEQ ID NO: 26289 - DNA, 462 bp, Zea mays
  unsure at all n locations
  Clone ID: cC-zmle189098a03a1
ttttctaaaatcagtttactgccttcagatagggcccggcacgctgatgaatcacagaaaattcctacatacgcactatcatacattcatacctcctactgcagaaagggaaccttaaatgtcacaaggcagaaactccagcagtaaaaatcgtttgcggatgtacagttttcatggcaagttacatcaacatctacacaacctttttggccttgacatcaccctctggtgaacctatcagttggggtggtagtatggagtaataggtaacaaatgagaggtaagcgcagcttgctacaacatagaccttgaaccacacaaatgagaaaagagttaggtacaaacagatggccgtcaagcatactactgttaagaagtttgccaggcacttnggcgtcgacagatctccttcagttccttcataggaaaagtgccccttcatgaagaaatctgcaggagctg

SEQ ID NO: 26290 - DNA, 380 bp, Zea mays
  unsure at all n locations
  Clone ID: cC-zmle189098a04a1
ttttagattgcatatacatacatacatacatacatgagggatatgggttgaattacaggacactcatgatggacggcgatggcgacagagtcaccagcatccatctttattcatgctcaacatattataacagaaccccaaattcgacaagtttgacccaaccctaaactcagacgcatattttcggatgcttgcgagcacacaacactgtaacataaaacggcatggcactaatgccgtgataaacagaagaaaaatcaagacacacagttgtgcgctgagttgccctaggcaccaccgtccattgccagtgacagagacggcatgctattntatgtagtttcattcaatataaagactcgcccgccccctcagccacg

SEQ ID NO: 26291 - DNA, 321 bp, Zea mays
  Clone ID: cC-zmle189098a04d1
gtgcggaactagagctccttcagagaactgccgtgccagttccaccgtttgccgcatcatcgttccgcccggctgagtgttcagtaacttcttccgatccatattatggcttcaaagcagcagcagaaacagttcctggatgaagccatgatcaagcagccgacaccgaacgaggaccgcgagggcccatggccctcagagctgacgatcatcggctatggattcctaaccttcaactcattcatggctgtgtacaggtcacatggagatgatggaactatctccctcgcggtcttcacttacctggtgcctccgtctgct

SEQ ID NO: 26292 - DNA, 389 bp, Zea mays
  Clone ID: cC-zmle189098a05a1
aaatacaacgctagcctactttatttagtgcatgggataaataacgatgcattctactacgttcgtctgcagacgggtgatttagcccttccgcagaacaaacagcagagccaacaagatatatatatatatttacaaataaaatattattattattgctaagcccacgagtcaacgaaggcacacaaagataatgtacaatcctggtaccgcgggggtgggcatgaatagattgagggtgatgctaacagtatgttgcgttgctacggactagggactacggttgacccgacggtttcaggaaactgtagcaatccagctgcagcatttctcctccgttgactggatcaaaccggcatctgtagaagctttcattcatgccaacaact

SEQ ID NO: 26293 - DNA, 444 bp, Zea mays
  unsure at all n locations
  Clone ID: cC-zmle189098a05d1
tacaacttcncggaccttaagctgttgcaccaaatcgactttttgtttttccccaagggcctctgcgcggggtcacaggagccctgttccattgtgcttgcttgccctgctgcccagaaggagcatgttacggtggaacactataagacaaggaataccaagtttatcaatgcacacacttaccgcatggcgtgctttgcattgtcacaagatgggaggctcattgcgactgctatcaccaaggggactctcgatagaatgtacaatgcaactgaatgcaatctcctgcaggaaataaggagaggtgctgatagagcagaaatatatagcttggctttctggaatgatttaaactatttggctgcctccagtgataaaggaacaatacatgtcttcaacttaaagataaatgtgggatcaactgcaaatgacaagcctatgcct

SEQ ID NO: 26294 - DNA, 392 bp, Zea mays
  Clone ID: cC-zmle189098a06a1
gaaagagtggtgaatgattttggtaaggcgacatataaataaatgagtactacaaaatacatgtcacttgtgcctgccctgacctttcacccaacagttttccaatttatatgtggagcatgatccgcttgctgccgtgtaacatttgataaggggagcaccaaccgtataataaggctggagtagaacaaaatgcagagcttacatagccaaatgggtccacaacgcatgtgggcccgacgctgatgcaccgaggataaactatcgtgcttctaagcttttagactttgcacagagccgctttaaatgtttgaatagggccctcatgattacatacaaaaattgtacacttttagaagatggggaaaccctaacccgtgctttaaaacatg

SEQ ID NO: 26295 - DNA, 458 bp, Zea mays
  Clone ID: cC-zmle189098a06d1
aaaaggatggaactaccagaaaacaaagagaggaagcattttcggattaacccaacaccacaaataaggggtcacaggcgcacatctcacgcgagagcaaccaatccgacttgtgaaatccaaaacagcggatgttcctgacaaatcaccgaagagctcagatgacatcgacaaggctccgaggagcaaagcgcttgggttggagaggcctatgctgtgcacagaccgagaaacagtacctgagtgaggatactataccatggaaatcaagccactttatcacatacatcatgctgcgaggaatgaccatcacacggtcctgcagtgtataggaaagaaccgcacacaagaaaacgaaccagacagctgccaccatcatacatcagagacaaacccacttgactgaaagcgtgtcgtctaccagtataattaacactgacactgacaccgccgacatg

SEQ ID NO: 26296 - DNA, 397 bp, Zea mays
  Clone ID: cC-zmle189098a07d1
aacatagaaagtggaatccagtagcaacaatagagcaactatggcgttcaagatattttccctccttatgctcctttgtctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaattagctctggcaaacctttctccctactctcagcaacaacaattt

SEQ ID NO: 26297 - DNA, 536 bp, Zea mays
  Clone ID: cC-zmle189098a08d1
gctactactagctagagctagcatgggaggtacaagcgcttcagtctttagccacggcctcgcctgcgcggccccgggaggcgtcactctgaatccgcgggcgcggcggcggcgcgcttcctcgggcagcggcggccacaggagcagtccccagcagccactgaggagcgacctgctacccccggctaccgtcgcctgccgagctcgctctcagtctgcttcctcgtctaatgtgaactttgggagaggggatgacgcggacaagttgctcgaggatttgctcaaacagcatggcgagggggcgtacagctcccgtggacctccggatcccaccggtggaggccgacaacaatcccaatgccttggccctttgccgtctccgttggctaaagctgcaagtgagataaaggctactgatatccgcgtactttgtgtgaagcggcttgtctactggactaggttcttcatcatcctcactgccttctcaaatgctcagatagatgctatcagttccaaaatgagggatattggggaga

SEQ ID NO: 26298 - DNA, 517 bp, Zea mays
  Clone ID: cC-zmle189098a09d1
gcccttatcatccgcgcctctacatttcttctctctctgctcctttgcctttttctgatccatccaagacaggggtcgccaggtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcacctgattgatatttctgaagatggatttgtgagccttcttacttcagatggcaacactaaggatgatcttagactcccaactgatgagactcttgtggcccacattaaggaagggttcgaaagcgggaacgatcctgttgtgactgtccagtctgcgat

SEQ ID NO: 26299 - DNA, 438 bp, Zea mays
  Clone ID: cC-zmle189098a10d1
agcaatccacacaagcacttcgacgtcacacgggcgctgtttacagactcaccaagcgtcggcaccaatgggttactagcaggaggtggactactgctcggaggaggtgaggtcggtggccccggccggcttctgccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcagggagagcttcctcgccagggctaactgagccgcccggcggccggcatccacgcccgttcgtgcttgcctgcgtgccttatgtatgtctgtggttgactggtttgtgcagggtcatcg

SEQ ID NO: 26300 - DNA, 254 bp, Zea mays
  Clone ID: cC-zmle189098a11d1
gttatcgcgctcgtctcgcctggcctagctagctgcctgttttcctttttttgcttgctacgtcctgtacggagcgatgtgaaggacaggagcaagaaaagaaagaagacagagagagagagagtccgttcctttcctcgaacttattccatggagacctcttctcacaagcgggcgcgggaggcggtccatcattccgccggcgccgccgccgtcggagaggccgcgtggccggagtccgactcatagaggct

SEQ ID NO: 26301 - DNA, 419 bp, Zea mays
  Clone ID: cC-zmle189098a12d1
gaagccgcttgcgcggccctggcggaggccggcacggtttagtactttaccgcgccctcggccgcgtgagcccgtggtctggcctttccccaccgcgcaccgtaccggtggccgcgcgctatatcttgtgtgcgagtggacatcgcggaacataagaagaatctttcactataaaggccttcgttttgggttggaattttggttttgaataagggggtcaaatttttaaccactacttttacccttgggtaagtggggagcttactatatagcttgcgcccatttcaaggtgccgcaagccttggtcaagaaatgggctaaaatgtttggcctgtaccgagggaatatgtgcatttttgctatttcgctcggcaacattatacaataataaaaaattcggagccccaaaattatggccc

SEQ ID NO: 26302 - DNA, 381 bp, Zea mays
  Clone ID: cC-zmle189098b01a1
gaccataacctatccatagtgggatggttgagtcaatggttatgatgatgattacatatattagtctagtctgccatacaaggggatgtggcaaccaaatcaaacctatccgggggggattattttcctggtaaacagtgcttggagtgggagtcctcacttgctctgctttgctggtgggcttggaagcagctggtaacaagcgatgagggagctggcgaagccaaacgcgcccgtgacgcggggggtcacctttttcggggccagctgcaggagccccacggccaccacgatgtccaggctcgacttgacaagcgccagcagccggtcgttcgacttgtgcagcttcatgcggtactgctcggtcttgtacagctcttg

SEQ ID NO: 26303 - DNA, 446 bp, Zea mays
  Clone ID: cC-zmle189098b02a1
ccgccttgacgcgcgcgttctcgtttcgatgcttggcctcgtagaaccgggtggggaggaagtcgagcaccagcgtggctagcgcagcggccatggcgacgaacccgggcactgggaaccgtcgccacggcgcggcggggaggcacgggctggacagcgcgtgctcggcgtcgtgaagcatgtggacgaaccccgtggccaggatgaccccggcggcgaacgccttggccgccaggaacgcggcgctgtccgtgcgcagcgcgcgccgcttccgccccgcgagcggcaggaccaccccgagcaccccggccaccagtatcgccgccatggccaccttcttgagccgcagcgccgcggcgtcgtcacgggaccccgccccctccgccttttgcacctccgtacgcgcagctcacggccgagagcgacgccgccataagctcattact

SEQ ID NO: 26304 - DNA, 250 bp, Zea mays
  Clone ID: cC-zmle189098b03a1
ggggggggacaactgttcttgttttatacagggggtttttagagagagagacagaaagcaagtgattttgtaggaacaacccccacggggaacgaacgcaagctttttttcttattacaaggaacgggggcatacctagggttaatgggtgagcactgagcaccgctggttttggatcattcttatgcctttcaccacgggtcctcgccggtcctgaaggtggtctccacccacgggacaaaaaggacct

SEQ ID NO: 26305 - DNA, 256 bp, Zea mays
  Clone ID: cC-zmle189098b04a1
aaaaaaaacccaaccccccccttttttttttaaaaaaaattttaccttccttaccaacctgaaaaaaaaacccaaggggtttttttcccccaaaaaaacttttcttttaaaaaaaaactcttttttttttttatttcccccctttccctttgaaaaatgaaaaccacttttttggggcaagggcccgtttttttttgaaaaaaaaaaaaaaaaaaaggggggtttttttaatttcccccggcccctggaccccggg

SEQ ID NO: 26306 - DNA, 371 bp, Zea mays
  Clone ID: cC-zmle189098b04d1
accgatgcaactaataaatatccttctttcccttctcattttccatttcgatgccgcgcactgctcccaggctgctgtgcgcaatttacaaacgcacaggcggcacatgaactagcacagtagctctatcttgaaaggaaaccgtatttgccgtacatgaaccatgagctgctattcttgagaccggtaaaccatgtaacatgctagataatcaataaagtgcgtcatatggctttcctgctcaaaaaagcaccggggcactaggcgtgcacataagattcgtgcgctcggtcaccatggactcctggaccgaggcgcaactccgaaagatggagggcggcggcttcaaaggacccaacgcctttctcaca

SEQ ID NO: 26307 - DNA, 89 bp, Zea mays
  unsure at all n locations
  Clone ID: cC-zmle189098b05a1
tttttatttttatttttttttcctaatcatatatagagggangagagacaaaactataccccaatcaatcaaagcttactgtacataca

SEQ ID NO: 26308 - DNA, 399 bp, Zea mays
  Clone ID: cC-zmle189098b06a1
tcctctatactgtacagcccttcgccctttttttttttttttttttttcacgcccccacagttatttggtgttggtttttatttatttcttcttttaaaccggaatggaaaaaattccaaatttttaacacccgccccaccagataaaaagatcccccttttccctttgctacgatctacccgcgcttggagaaaaaaaaaacttcctaaaccactccaaaggaaaaatttagtttaaatttttccccccgggcccggttggaggggttcctgaggccccttttttatccggaggagggaccttaacccccaccctcttcctttgcccaaaaaggggcccccccccaaaaaaaaaaattttggcccaagccttcgcccaccccttcgaggaccccgggg

SEQ ID NO: 26309 - DNA, 206 bp, Zea mays
  Clone ID: cC-zmle189098b06d1
cgcgacgcgtgggcggacgcgtgggctcaagttcctgctgctgtgtcggcgtttcacttctggcctacgtcagcaggtcggcgtcaccggacctcctgcccatcaagaagggacctcaggagccgccgcagccgggcccgcgcggcaagatctaagctcagcttctccatttgcatggtctagtagcttgctttgtactgctagcg

SEQ ID NO: 26310 - DNA, 445 bp, Zea mays
  Clone ID: cC-zmle189098b07d1
cgcctatgcaggctgttcagtctacaggtctggtcaaaacatgcttttcagttttaactcatcgaaagcgtccgcgtcctagcgagaaaggtacacctgcatgcacgcactgattaaccgctgaatattacaatttataaaagcacctttcttttggacctttttaaaaaaaaaggtacttctaaaggtaattgagaaaggatgcctaccctggtttaaggaaaggagcttacttcaacaccataaaatgaacagccaagtatctgtgccctgctgacatagtaccaccatacattgaagtgcatctaagtgagttggatgtaggacaaaaatcgcttgtgcatcatttgaaaagttcattctgcgattaaacttgttcatttgccacatcaacccatctgtaactttaccggatcaaagtctccataatagaagaagggaaaat

SEQ ID NO: 26311 - DNA, 478 bp, Zea mays
  Clone ID: cC-zmle189098b08d1
cgacgaagagggagaaggagaggcaggtggggtggacgagcgactttgttgttttgcttggggaagatgtgatggggcggggggtggagttcctggacgcgcgcagcgtggcacgatgcaccgcagtctcctgcgcttggcgcggggtagcggcagacaaccgcctctgggcacctatgtgtactgaattgatggcgggaaaggctcatatcccacgtttaacatcgatccgcactggatccaagttgtctacatattcaatggtcattatggatgggaaacggagtcggatcacaaaagaggatctctgccatcatgcgtgggaatatcgtttcaccatagcagcacctgattactggaggaaccttgatccatcatggaagcacactggtccacctatgcgacgctacttccaccccgatggctaccacagtgcagaccctcatgacgcccggtggggtggccctgagtgcaccta

SEQ ID NO: 26312 - DNA, 407 bp, Zea mays
  Clone ID: cC-zmle189098b09d1
gacggcggacggctaggattgctggatatgcactttcacgcggtttcgtgttttagagaggaatgatagggtgtggggtaagaccgcgtcaggctctatataccacaaagacaatgtggcgcctgtgtcatatggacctcaaagtgataagtgggcttggactctctttgaggccacattatacgcaccaatgaattctgatatcgtagttaaggcgggcggactcatgtgcaaacgttcaacccgagaaggtccaagacatatcgaatctgaggggaatcctcaacacgtcttggcatagcatcaaaatccacagatcttccatcgtcgaaagatctaagctgtgaaattacgtacgcatcttaccactctgagaaagcacactcactttaccattgtacctgaat

SEQ ID NO: 26313 - DNA, 315 bp, Zea mays
  Clone ID: cC-zmle189098b10d1
cgccgacgcgtgggaagaatctactcgtcgagtcaccaaagatattgctctattggactcggagtctcggacagcggagcaagtcaagagccgctactcaagtatagtctgacaccggccgaccctgccccaacccaagccatggcggacaacaacaaccggcggaaccacgggcagaccttgctcgccggcgcgggcctgggcctgctcgccgtgaactcgggcctggccatctaccgcgcgaggggcgacacggccgccgtcctcttcgtcggggggtcctgcgccaccctgctcctttttttggcgtgcctc

SEQ ID NO: 26314 - DNA, 463 bp, Zea mays
  Clone ID: cC-zmle189098b11d1
caactgcctcgcgccattcgtcaagatcttggacgaggttttcggtttcgtgaaggggaccatgacgacgacgcacgcgtacaccggcgaccagaggctgctggacgcgtcccaccgcgacctccggcgggcccgcgcggcggcgctgaacatcgtgccgacgagcacgggcgccgccaaggccgtggcgctggtgctgccgcagctcaaggggaagctgaacggcatcgcgctgcgggtgccgaccccgaacgtgtccgtggtggacctggtgatcaacaccgtgaagactggcatcacggccgacgacttgaacgcggcgttcctcaaggccgccgccggcccgctgcacggcatcctggaggtctgcgacgtgccgctcgtgtccgtcgactttaggtgctccgacgtgtcctgcaccatcgacgcgtcgctcagcatggtcatgggcgacgacatggtc

SEQ ID NO: 26315 - DNA, 225 bp, Zea mays
  unsure at all n locations
  Clone ID: cC-zmle189098b12d1
acggcnatccaattgtacttgctctccctccaacaagctaattttttccggttttccctcttctagctcgtttcggtatccgtggcggatgagaagcaccaccaccaccacctgtttcaacacaagaaggacgaggagcagctcgccgcccgcgggtaccgcgagtccgccgagtacacagaggccactgtgaccgaagtggtgtccaccggccaaaaccatttc

SEQ ID NO: 26316 - DNA, 322 bp, Zea mays
  Clone ID: cC-zmle189098c01a1
aagaaggaatcattgcagggtacagataaaaggtgctcatacagaagttttcaccaaatccacatacgcgggaagacagtacaccaagtacacagctacaggcagcagtctaaccatatcaccagagctgcgagagccatacgcagccatcgcagcagcagccaccggcggagagaaaacctctacattacctgtcatatccgccgccacccacccgggggcctccaccgtagcccctttctggcatccgatacggtgaaaccgatcggtccctccttgacctaccaccaccataaggaggcggcgagtagccccggccacc

SEQ ID NO: 26317 - DNA, 388 bp, Zea mays
  Clone ID: cC-zmle189098c02a1
aataaaaatgtataatagtaaattaagcggggcgaatcgaatctctcgtctccaggcacaaaaacatctttgtgcagttcaaagattgcacacgactaggatacaatctacgggtacaacaatagctcgacgatgcgcgaaggttgggttcagttgttcgccggggctggcttgctgtacgagcatcctttcctgttacacaccgtgcggaatgggtagttcaggttgttgcactctgggcaggtccagcttccttcaggggcttccttattgctgttggccttgcgagatagctcgtgttacctcccggagttggcctcggggctccacatctcttcatgttgcacgtgcttctgaaggaaaagttaacgttgtcgcatttgggaca

SEQ ID NO: 26318 - DNA, 338 bp, Zea mays
  Clone ID: cC-zmle189098c03a1
ttttgtcatggcgatccattgccatagatataagcttcttcacagagtaatgatgaaactgatcagatccaagacacttcagctcagaagctgccaattccacatctcctgtactaaaatactcctcaattattggaacgacaagctttctatactcatctaatgtaccaggaatcttgctattcccattagctagtttttccaactcctcagatagtaaagaatttacaccttcatgattgtctttttcagttttcccaccaacattggctttcttagtggggtggatgtgcgggagggtgtttgacggcgatccctccggtcgccggcgcgccccc

SEQ ID NO: 26319 - DNA, 244 bp, Zea mays
  Clone ID: cC-zmle189098c04a1
atattgaatggaccgtctagggtagggcggtccaacaatgatcaatgagtgtcatttttcttttttgctgaggggacacatcatcggcattaacctacattacatgatgtacgtgtccgctaggaatcaaatgggccagctggcatgcaatgcattaacttggtggccgaaggatggagtgaaggaaaaacaacctgcgtgcttcactgcagagaatatttagcagcgtccaacatttcaaggg

SEQ ID NO: 26320 - DNA, 505 bp, Zea mays
  Clone ID: cC-zmle189098c04d1
cgcccacgctccgaataatttgacacgaccatggaccatgttaggttctacaattgatagtggtgggcggtttagtgaatatatatgccagcattggatcctcccctctacttagtacataagtatacaataagtggtggaaacagtttactgtaatgaccgctacagcttcccccgtcgcatgattgggcttgtgcctttagtttcagccaatctggaacatggtggccagtgtatcttgtctgccaatgactgaatgctttaggttgaagcagtaccataactctagagagactgctgtacagcaacctcaggtttatgttggggatggtcggcaaaacgacgctcgtttggcactggctacggcagataccagtgtctggctggcatttgttgtggggagcacagaggaaaacaaattgttggttacactctgtactactgcgtcatgatattgtcggctttggcttttggaggaactggagatttatttggcagcctttgc

SEQ ID NO: 26321 - DNA, 377 bp, Zea mays
  Clone ID: cC-zmle189098c05d1
ctacctcgttgcgagcccgtcgaagagcagctcaaaatgttcaagatgagacgttgatctacttataggtcggcgcggttgaagttgtagctggtggtttttgcctggaggaactcttggtagtttgagctgagcgaaagctttaaattttacatttactcaccacaccatgaactgcaacgaagtgagcatctgttagaaaagtggaccagtaattttggttggttatttatttcctgtttctctgtcagactcttaactcggaggacctgtaactaggaaagttacttttgcttgaaagaacattttggtctaaaaaaaaaaacatagaggagggggagactattaatttctctatactaattaagaaattctgc

SEQ ID NO: 26322 - DNA, 186 bp, Zea mays
  Clone ID: cC-zmle189098c06a1
atacatccacccaaaaaaaaatataattttttttatcacacaaacttaaaacaaaaaacccaaaaacctaaactttcaaaaagaaggcacctacaaaatccataaacaatattttttaacctttgaaaaaaacttagcctttaaaaataagggcctccacagcaacaaacccttgcccaacacctt

SEQ ID NO: 26323 - DNA, 219 bp, Zea mays
  Clone ID: cC-zmle189098c06d1
tccacttgctttacaaacccatcatcctcctaccatttacacatttttggtggtgccctcttttaggttgcttagtagatgtaattcaataattaaacttttttcaatatatattttgcccaccacaaaaaaaaagtttcacttttcccagaaaaaaaaataatatttatttaaaaaaacaaatatatattataaaataaatatataaaaacaataatt

SEQ ID NO: 26324 - DNA, 326 bp, Zea mays
  Clone ID: cC-zmle189098c07d1
atgcggataacggtcaagctccggaggctctttggggttcgcaatggcgggtgatcggatggggatgggggcgttttgaagtagagaacccttcgattagtagaagggcaaccctgcgcaaaaggacaaccacatccctccacaacgccaataagcacctacaagcgaggtcctcgagtccaagaagcatactccatcgggagacgcagacggtcccgcagcttcagctatcgacaccttgtccacggaggacgcgatgcggaacgccatcgagggcatgaacgagaaggagatggactgccataacattaccggaaacgatgacc

SEQ ID NO: 26325 - DNA, 546 bp, Zea mays
  Clone ID: cC-zmle189098c10d1
cggcgggattgggaattttttgggaggggaggaggcgtgagcgttatgaaatgttaagagagagtagcttccgatgtggattgggccggtctccgtatcgggaatccaattcgcttccatccaacgcctgagatcggattccaacccccatttcggaccgatcgctttccgcagaccgatcggctttgggggatttttttcccgagcgatttttctggaggctcagatcgggtcggtctgagtttagttgatcgcggagcgatgctaatcgaggagcttccgggcgatccgggtggaggacgacgtgagggcggggaggatgagctgctgctgccgcgtcgcgaggatggcgactccgcggagggcgagagtggagtggtgatgcgggtggccgtcgacgcgaagcgcgcagcggtgggtgtaagcgctcggatgcttttctacccgacgcttgtgtacaacgtcgtgaggaatccgttcgagaagcactttcactggtgggatcagatcgacgagcatgtcctgctcggtgctgttccattccct

SEQ ID NO: 26326 - DNA, 526 bp, Zea mays
  Clone ID: cC-zmle189098c11d1
tggccgtagggagcggcggcggctcgcggcgcgcgcgtccgaactttctagtgacggggacgccgggggcgggggggacgacaacgtgctcgctccttgccgacgccgcaggcctccgccacgtcaacatcggcgacctcgtccgcgagaagagcctccacgacggctgggacgccgacctcgagtgccatgtcatcaacgaggacctggtgtgcgacgagcttgaggacatgatggaagaaggtggcatactagtagattaccacggatgtgatttctttccagaacgttggtttgacctcgtagttgtgctccagactgacaactcaattctgcatgatcgcctgacgggtagaggttacatgggttccaaactcgccaacaacatagagtgcgaaatcttccaagtgctcctcgaggaggcgagggagagctacagagaggacatcgtgatgccattgcgaagtgacaacgtggaggatattagtaggaacgtaagtgcactgacagactgggttaacaattg

SEQ ID NO: 26327 - DNA, 632 bp, Zea mays
  unsure at all n locations
  Clone ID: cC-zmle189098c12d1
aaagaaaaaaaaaaaaaaaaaaaaaaaaaaaaaaaaaaatttaaaattttaaaaaaaaaaaaacaacaaaagaaaaagggaaaaacaaaaaaaacaaaaaacccccaaaaacccacacccaaacccggcccccccncccaaaaaaccccccccccccacccccccccgcccgccccccaccaaacccacccaaccccccggcccccaacagaaaacacccccgggccccgccgnaaccccccccaaaacgggaaaaccccccggccggcccccccccacaacccccggcccccccccccccccacccccccccccccaaaaaccaaaaagccccccccccaccccccccccccccaaggcccccccccaaacccccaaaaaccccccccccaacccgcccccaaaaccccccgcggggggggggacccccccaccgaaccccccccccngccccgcccccacccccccaccccaaacccaacccccccccccnggacccccccggcccccgccacccccccgaaaccccaaaaaagagggcccccccccaaagcgcccccaaaaagggccaaagggcccccccccccccaaaacacaaattagagctgatgtcccccaccgggccccccccc

SEQ ID NO: 26328 - DNA, 380 bp, Zea mays
  Clone ID: cC-zmle189098d01a1
tttttcttgaagaaaactgaacacttgacatacacatgcgttagaaaatcgctgtccggagggcaactacaagaggatatcaggatatgcacaggtctactatacaaagctagctattactcattttacaacaaacagcagctacaagatccgcgtatgtacagctgcaggttttcctccactgctcgccaggtatttggtacacaagggaactgctggttactggttagagctaatgtaacggaactttcagcgtcaatgtacaactcatgtactggacacttccttggtttttatgttctccgaaggctccaatcaaactcttgttatcgattgttcgctctccatattttggtcagcttacattgttttgtttcgga

SEQ ID NO: 26329 - DNA, 368 bp, Zea mays
  Clone ID: cC-zmle189098d02a1
caggggaagtttactcaccagtcgtcagcatgtacaaagcagtaagtaggatagtgtattatactatcaccaattcaccagtgctaataggtgacgtttcatacagaagtggacgatgtacatgtgcgcctgcggccggcctactcctccctgggtatccaccggctccaccagatgcttttgcgctggctgttgagctcgtccatgctctccttgatcgttctcatgatcttcctctgcaggcgcagcacggaaggcaagcgcgttccgctgggtgctgcttttctttggttttaatttccctaagctcttgaagctgtgctttttgtaaagccttccacatctttcagttcctgaccttgccatga

SEQ ID NO: 26330 - DNA, 213 bp, Zea mays
  Clone ID: cC-zmle189098d03a1
gggtggttgtttggtttacggaggctgaaactgcaactgacagagtaaaacatctctctcctgtactatacgctacgacatgcgtgcgttattatgtttgcacttgcacaccaccagactaaacgggaactgaatcatcgtagataggtaggtagaagagacggatcaggcgacctccatctgctgcgtctcgaccgtcctccggagctagcc

SEQ ID NO: 26331 - DNA, 316 bp, Zea mays
  Clone ID: cC-zmle189098d04a1
aaaaaaaaaaaaaaaaaaccccccccggccccttataataaaaaaaaaccgccccgcacccaaaaaaaaaaaaaaaaacgcccccccccctttgggggggccccccccaaccccaaaattttaaaaaaaaatctccccctttttcccaaaccccccccccttttttgggaattctcaaaaccccggaatattttttttctccccaaaaaactctcccccaaatgtatgaaaattttccccttggccccgcggcctcttaatttttggggttatctccccccccccccggggtcccccccccaaatatccccccccc

SEQ ID NO: 26332 - DNA, 446 bp, Zea mays
  Clone ID: cC-zmle189098d04d1
tacggcgagatgcccgccgagatggagcgcaccggggccaaggtggttatgtcctttcagttcgggatgacgcttcggcggacgcgtgaaactttaccttgttcctagaattcccaaatgagtgtcgtcgtcgtcgtacaaatggcatgcatcttattgtaagttttggagtttgttgttgcacacgcaacgatggaccgcctgtgatatctttaataaatgtaaccgcagataataatgaaataaaaagaacgcatggctattgtattattaaaaaaaaaaaattacaaattaaataaatattacaaaattaatatatttatattaaattaataatatttttctggggggtggtccggtaactttaaataaaaaaataaaaaagggggccctctttaaagaaaaaaatttttttccccgggtgttcgggagaaatattttttttt

SEQ ID NO: 26333 - DNA, 262 bp, Zea mays
  Clone ID: cC-zmle189098d05a1
ggaaaatgaccagctttagtcaatttctgattcggttttctttttttcttctttttttacagccttcgatcgctcatacaaaacacagtttgaaaacaaactgctagctaagattttatatacacgcttcatacatctttctcccttttgggttcagaaagaaacatgcctttgtacaacacttgagagctcaagccacacagctcctccctccttcctcgtcacgtacgatccgtgtgtgctcttggatccgcgttcccag

SEQ ID NO: 26334 - DNA, 415 bp, Zea mays
  Clone ID: cC-zmle189098d05d1
cggcaagaacaccttccaggcggcagcggcggagacggccaagatttccgattttaagcagcagcagggaggccgggacgtgggggtgagcatggacggcgcgccctacctcaggaaggtggacctccggatgtacaagggctacagggagctcagggaggctctggacgcgctcttcaccaactccttctccgcggcggcagagggcggcggcgaccaccaccagcacgccatcgcttacgaggacaaggacggcgacctcatgctcgccggagacgtgccctgggagtaagtacaccggtcgggttcggatcagctagcatgctgctccgttctgtggatacgaggatacgttttggtgaacaaaaccctgattgtgattcttaatttcacccacttttgcagtatgttcatc

SEQ ID NO: 26335 - DNA, 394 bp, Zea mays
  Clone ID: cC-zmle189098d06a1
ttttgctttttttttttttttttttttttttgagccagggacttgcttctcaactcttcggatacatcaagaaaacattcaggtaccgcctaacactaacaaggattgaaccaccacagatttttaacaagagtcatcaacaagggccatgtataacatatctattccatcaggtcatcatcgtcatcggggaggggctgcgcagcggcagctgcaagctcagcttcatgctgttgctgcagggccatatcaatctgcacttctggtggcttcagagcaacagcttcaacaaagggaaggttctgatcccctgccagcttcctagcgagggaaaggaagggcttctcaaagttgtaattgctcttggcagaaatctcatagtactgcaagttct

SEQ ID NO: 26336 - DNA, 359 bp, Zea mays
  Clone ID: cC-zmle189098d06d1
ctttggcggactcctgggcgacatttgaacttttataaccacattcctgaaaagggatcttggtggcttttttgacaagaaatatcatcccaccattggtgttgacattcaccctctggattttagcaactaactgtagcaaaattcgcttttattgcttgtacactgctgggcataaaaagttctgtggccttagggatggttactacattcatggtcaatgtgccatcattatgtttgatatcacttctacgcttacatacaagaatgttccgacatggcacagggattctgtcatgctctgtaagaacatccccattgttctttgtggtaacaaggtttatgtcaacaacaagcaa

SEQ ID NO: 26337 - DNA, 539 bp, Zea mays
  unsure at all n locations
  Clone ID: cC-zmle189098d07d1
tacgccacgcgtccgcgtcgctcgtaaaatggaggtcgcgacggctattgatgttttctgcgccggcggcaagcgggggcgcggggcggcagatccacccgttcccgtggctagacgctgccatctcggagccctactacttcctgcaccttctcgccttcttctcttactttgcggcccgcagcgcggcgctctccgccaacgacggaggggagctctacgaccgcctcctccgtagggagatccaggcagtgctcgtgttcctggtgctcttcgtagtgaagattgtgaaagaggaaacctgggaagcagtaattgctgactcgttgctttatgcgaagggtttattgctggcagttactttggttattgattgttggctggcctttgcctactttctgggatttcttgttatatatgctgtagctcaacagccaccttatgatggcctangccattcacatcatttgaccccattgcaacttgaaagtctgctaactgaagaccaacatcacgattttggctggtagaattccaac

SEQ ID NO: 26338 - DNA, 317 bp, Zea mays
  Clone ID: cC-zmle189098d08d1
acgcgtgggcggacgcgtgggtgctgaacgaggcatcactttctagattagaagaggcaaaagagcacaggggttccgtgaatggcattgccagctcagagaagtggcacgtcttctatacatataacatagattgcacactatgtagtacagtagtatattctccaacctttcccaccctgtaaaaagcgcatagtatattgcgtggtctagaattagaagtaaggagaagtgaactgcagagaagatgctctttgctccctggactctggagccctgtgatggcacttgtgtgataggttcaattttttgggccc

SEQ ID NO: 26339 - DNA, 574 bp, Zea mays
  unsure at all n locations
  Clone ID: cC-zmle189098d09d1
ctatactctaggaagcaaggacaccaccgccatggcagtttaagatgcttgcattgttcgctctcctaggggtttgtggaagcgccactagtgcgacccatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtcttgccgagcatgatgtcgcaaatgatgatgccacaatgtcactgcgacgccgtctcgcagattatgctgcaacagcagttaccattcatgttcaacccaatggccatgacgattccacccatgttcttacagcaaccctctgttggtgctgcattctagatagaaatatttgtgttgtaccgaataatgagttgacatgccatcgcgtgtgactcattattaacaataanacaagtttcctcttatta

SEQ ID NO: 26340 - DNA, 588 bp, Zea mays
  Clone ID: cC-zmle189098d10d1
atgtacaacagtggccattcttcagggtcaccctggaccttctggattggttttcgccaagggagacccgggcattggcggcttgtatgacgagctgcttgtggcggaagaactcaagccctttgggaagcagctcagggacaaatacgtggagacacagcagcttctcctccacatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcgagtacccgcccggcctggaagacacgctcatcctcaccatgaagggcatcgccgccggcatgcagaacactggctaggcggcttctctttacttacctgcagagtgcaccgcaataatcagctttcggatggtggcgttttgtcagttttggatggaaatgccgaactggcagcgtctgttttccctatgcatatg

SEQ ID NO: 26341 - DNA, 387 bp, Zea mays
  Clone ID: cC-zmle189098d11d1
acgcctcgacaacgtgaaggctaacatccaggacaaggaggggatttccccattccagcagcgtctgatcttcgcggcaagcggctggaggatggtcgcacccttgcagactacaatatccagaaggagagcaccctccacctggtgctccgtcttcgcggtggttattaagccatcagtcgttgaagctgctgctgtatctgggttatctagggtctctgccattgcccatggatggtactggctttcaaagaatttgtttggtttgtgtcgtgagtcgtgactgagctggtttcatggaccagttgtgttctcgttacccaaaactatcgtgcgaccgcatatggcttaatcatgaataaaggttgggtttgaatttaaacaaaa

SEQ ID NO: 26342 - DNA, 294 bp, Zea mays
  unsure at all n locations
  Clone ID: cC-zmle189098d12d1
ggggaaaacaaacaaccaaaacacccccacccaaaaacaaaacaccggccggcgagggacaccgaaagcacaggcaaaacccggccgngaccaaacgaaaaacagggaaaacacaggccccacccaccagaaggcgcaagaaccaaaagccccgaacccaaccccccgcaaaacaaaagagcaccccgaaaagcgaacggcacacccccggaaccgccacaaaaaccacggggacccgccccgttaccccccaaaaaacccggacacttggcagctcccaaccacccggaccct

SEQ ID NO: 26343 - DNA, 394 bp, Zea mays
  Clone ID: cC-zmle189098e01a1
atgaaacaaaaaggttaaaaatccatatgtgggtagtgtaacatatactctccctcaattcagaacaaggtcagtgcaaggctgctggacatcgtgaagtggcagtggggagctccatccaaggctgatgtacattacactactactcagtccaagggaggtgcccagagtaaggcaccgggccacaataggagaacagacccttcagctctgggcaaccggcagggtatggaatggttcggtggaacgggtcccgcttcagcctctttacatgaagagatcctagacatccatacgggtcttcaaggaactgagctcggacagctgcttcgcctttcagagcagcctcccttgcaaaggcgtagctggtgtacctgagaagaagaaccttcct

SEQ ID NO: 26344 - DNA, 441 bp, Zea mays
  unsure at all n locations
  Clone ID: cC-zmle189098e03a1
ttttaaatactaacaggagtggcgatattaaagtagcaggcaactccccatttatcagtgggaaaatgccatgcgcctcatctccatcgccgtcggtttcatatcatactaccccgcgcccggtgcccagtggcatcatcgtgcccgcccaaattcccagggcacgcagccgacgtaggcggtaggccaaccaccgtcgcccgtccgcccggcgcaaatgcgacgcacgcatcaaagccgccagggagaagagccttctaaataacgtccaggtcctgcgacaggagcggcgtcggcgtcgccaattaattcgctcaccactggtacttcgccttgacgagcacgtcctcatacagcacggnggcgtggtcccagctgaggtcctgcgccatgccgcgcgcctgcaggccgcgccagctctccttgtagtttcggtccctg

SEQ ID NO: 26345 - DNA, 405 bp, Zea mays
  unsure at all n locations
  Clone ID: cC-zmle189098e04a1
ggcgttggagttgtacttcttgacgtgggacgtctccttgggaacgccccgcgctgtgaggaaggcgttgaggcggtcgttgccgccggcctccatcttgcggagctgcgcctcggtccaggagtccatggtgaccgagcgcacgaaactgatgtgcacgccgaggccccggtgcttgccggagcactcgaggcacatgaacacgccgtaggagacgctcgcccactgcgggttccgctgcgcgcagtccacgcaggtcttgttccccgtctgggcctgcagctcccgcaaccgcctcgccgccggggacgccatcgctggattggatctgcgcctcgcatccgcggctaggtgcgtggtgggcgtcncgccgggctggacgcggaggggaaaacggggagggac

SEQ ID NO: 26346 - DNA, 395 bp, Zea mays
  Clone ID: cC-zmle189098e04d1
gccggtggcgacttctctggctcgtcctccccgttttcttctccgttttagcccggcgcgacgccaccgggcacctgtgcgctgttccgaggcgcacatccaatccaccgatggcgtccacggcggcgaggcggttgcgggagctgcaggcccagacggggaacaagacctgcgtggactgcgcgcagcggaacccgcagtgggcgagcgtctcctacggcgtgttcatgtgcctcgagtgctccggcaagcaccggggcctcggcgtgcacatcactttcgtgcgctcggtcaccatgaactcctggaccgaggcgcagcttctcaagatggaggccggcggaaacgaccgcctcaacgcctttctcacagagcggggcgttcccaaggagacg

SEQ ID NO: 26347 - DNA, 368 bp, Zea mays
  Clone ID: cC-zmle189098e05a1
gaaagctgatctggggtcccatattagcgagcggatctgccacagatgatggcagaaatggaaacaaaagtgcaaaacatgtccagactcagcatgaacctggcgacatccacatttattctcggcatacacaagcagcaaccatccatgagaagcagggggaaaaccctctactgggtcttgaacatgtggcggatcaggtcgacgacccggttgctgtagccccactcgttgtcgtaccacgagacaagcttgacgaagtggtcgttcagagcgatcccggccttggcgtcaaaaatgctcgacctgctgtcaccaggaagtcggtagaaaccagatccttcttcaataacccatgatacccttga

SEQ ID NO: 26348 - DNA, 310 bp, Zea mays
  Clone ID: cC-zmle189098e06a1
caattaatatacttaaaaaatccaaaccgtctctctcggtaattcctaaaatttcccacccgaacctccaactttaccttctttccctaaaaaaaaacctattccaactttgcgaaaaaattcccccctctgtcccctttaaaaaaattaaaattcttaacaatttcacaaaccttaccaattgaaagcaaaacctgtaaacccttatgggccaaaaaactcacctaacttacattaatttcactttgctcattgtcccctttacaacaagaaaaccaaccctgcccaatatattaaccaaatctcccca

SEQ ID NO: 26349 - DNA, 311 bp, Zea mays
  Clone ID: cC-zmle189098e06d1
cacccgtccgtttgaatctaatatgtaaattatttgtaattcaatttaaaaatttaaaaaaaaaaaaaaaaaaaaaggaaaagagaaaaatttctaacgaatctaacaagaaccaacccttacaatcccatccaatccacgccctatcttttctatataatcacctaatattcaatttccttgccctccttttccacctgtgtaaacctggaaaacccccaccttacccaacttaaacgccttacccttcatttcccctttctacaactgtcataatacccaatatgccccctcctatctccatttccaac

SEQ ID NO: 26350 - DNA, 444 bp, Zea mays
  Clone ID: cC-zmle189098e07d1
gaaccacccgtccgcacagcaatccacacaagcacttcgacgtcacactggcgctgttcacagacacaccaagcgtcggcgccaatgggttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcagggagagcttcctcgccagggctaactgagccgcccggcggccggcatccacgcccgttcgtgcttgcctgcgtgccttatgtatgtctgtggttgactggttgtgc

SEQ ID NO: 26351 - DNA, 111 bp, Zea mays
  Clone ID: cC-zmle189098e08d1
cacgcgtacgaaaatttctaatgttatcttgtattagtagcaggttattgctttttgagtggaataccaccagttggtcagcagcagatattaaactccatgtgcatttgg

SEQ ID NO: 26352 - DNA, 515 bp, Zea mays
  Clone ID: cC-zmle189098e10d1
ggccgaaccacccgtccgcggacgcgtgggcggacgcgtgggcggccgacgacttgaacgttgcgttccgcaaggccgccgccggcccgcggcagggcatcctggatgtctgcgacgtgccgctcgtgtccgtcgacttcaggtgctccgacgtgtcctgcaccatcgacgcgtcgctcagcatggtcatgggcgacgacatggtcaaggtcgtcgcctggtacgacaacgagtgggggtacagccaacgcgtggttgatctggcgcacctggtggcggccaagtggcccggcgccgcggcggccggcagcggcgaccctctggaggacttctgcaaggacaaccccgagaccgacgagtgcaaggtgtaccaaacatgaggcccagggtcttttccacaacaaacctacaacacgggcgcgagggtttctttcctagagaatattttcagattattcgccaaagagacgtatgtatatatatgagttgtatgcagtcaccgaactggtacaggc

SEQ ID NO: 26353 - DNA, 417 bp, Zea mays
  Clone ID: cC-zmle189098e11d1
ccacccgtgcgcggacgcgtgggcggacgcgtgggaccaggggccttaccaggtttccgccggtgatggcgccgccggagtactgcgcgccgtcgcccagaagggagccgagcttcctggaaggctgcctggccgcgctgtgctgctgctgcttgatcgacgagtgctgctgcgacccgtccatcatcttcgtcagctagactagacgaggaagaacctattggtatatataatatgtatgtatccagttgtactcttagctttattcctgcaaccttcaagctcgagatgatctgtatctcggtcgagttggtgtgtatctgtcatggtattgcttctaatttgctgctgaatcgagaacatattcgccgttgaaaaaaaaaagaaaaaacaacataaatcatattagaataatgg

SEQ ID NO: 26354 - DNA, 539 bp, Zea mays
  unsure at all n locations
  Clone ID: cC-zmle189098e12d1
ggccgaaccaccgtccgaatgaagcgcctttctatacattgggtcctttgactactgattttgcacctggttatgatcacatcgcttcaggcattggtgctgccaacattggagctcttggcactgcacttctttgctatgtaacaccaaaggagcaccttgggttgcccaatcgtgatgatgtcaagactggtgtaatatcctacaaaatttctgctcatgctgctgatttggcgaagggtcatccctatgcacaagcttgggatgatgcacttagcaaggcaaggtttgagtttagatggcttgaccaatttgctttatctctggatccagtaactgctatggctttccatgatgaaacattgccctctgagggtgccaaagtggcacatttctgctcaatgtgtgggcccaagttttgttcaatgaaaatcacggaggatatcaagaagtatgctgatgaaaatgggtatggaacaggagangaagctgtgatacaaggaatgaatgctttgagtgctgaatttttggctgaagga

SEQ ID NO: 26355 - DNA, 395 bp, Zea mays
  Clone ID: cC-zmle189098f01a1
cccccccccttcccctttcccccccccccccccccccccccgcccttgccccttttccccttctccctcccaacccttcccaccccccctacaacccccctccccaccccaaaccaaaccaaaacccccaaaaaaaaaaaacaccaaaaaacaaaatccaaaaaaaaacaaccaaaaaaaaacccacaaaaaaaaaaaaaacaaaaccaaaaaaacccaccctaaaaaaaaaaaaaacaaacaccccccaaaaaaatttccaccccccaaaccaccccccccaaaaaccccccaaacccaaaaaaaataaaaacttcaccctaaccaaaccccacccactaaaaaaaaaaacctcccacctaaacctccccaccccccccaaaaaaacatttcac

SEQ ID NO: 26356 - DNA, 323 bp, Zea mays
  Clone ID: cC-zmle189098f02a1
tttttttttttttttttttttttttttttttgggttgtgtttttttttttttttttttttttccttttttttttttcttttttattaaaaaaaaaaacccggagccaatttttttttgctgtttaaaatttataaaaccccaaaatcttctttttcaaaaaaaatatttggtccttctttaaatccgggaccctttaaaaaccgaaccctccaaatcccaatacttttcccctatgcaatctcactaatcttacaataaccccccccagcattagaacttacccccccccccttgggccccggggggacttcatcctcttttt

SEQ ID NO: 26357 - DNA, 330 bp, Zea mays
  Clone ID: cC-zmle189098f03a1
gggttggggcaaaaatttgcgtgcccaaaacaacaaatggcagctaaagctgaaaaaaaacaagtgcttacaagtacactttttatgaaagggcccgggggggttattcttactacttacacgggttgcatacaaaattgaggaaaaagggttattggaaagctttccccaattggggcattacttgaaaccatctcccaggcccgcaggcatttccaggttttgtgccaagaaaaccattctttttttcattgcctggaccctcccttggggggcatccttttaagcattcttgaccaaccccgaaaggtttttagcacccaacttcat

SEQ ID NO: 26358 - DNA, 349 bp, Zea mays
  Clone ID: cC-zmle189098f04a1
ctcaaaaagaagtggattatgcatccattatgaagaaaatttgtttgctattatccatctacttcgcatgaatgctttttcatagacgtgtgctgcacgcatatcagcacatgcaagcctgcatacagaacactactcacattgcatcgaaggatgaagcaaaccaagcacatacacacacatatatattttgtctacaaagtacaaactcgcaatgttcagagccatttttttgaagccaagacaagaaaataaaaggggccgacacatagctgttggcacggatacatagtaaaataaggtgcacgtccagcgccaaattgttcttaaagaaagggactggacattt

SEQ ID NO: 26359 - DNA, 599 bp, Zea mays
  Clone ID: cC-zmle189098f04d1
ccacccggccgcccacgcgtccgcccacgcgtccgcgcaagctcagtttccctttaccccaccgtcccgctcactggagcccaggccgcgttcccacagcccagcgacagcgagcaccggcggcatccagccatgtgcggcggcgccatcctgtcggacatcatcccgccgccgccgccgcggcgggtcacggcgggccacctctggcccgagagcaagaagccgaggagggctgcagccggcaggaggagagcccccgtggagcaggagcaggaggaggatttcgaggccgacttcgaggagttcgaggtggagtccggcgagtcggagctcgagtccgaggacgagcccaagcccaagcccttcgccgcccccagcagcgcgctcgccagaggtggactaaacactggtgcagctggtgtcgatggccctgctgcaaattcagttaaaaggaagaggaagaaccagttcaagggtatccgccggcgcccgtggggcaaatgggctgctgagatcagagatcctcgcaggggcgtgcgcgtctggctcggtactttcaactcccccgaaaagctgccagagcttacgacgccgaggca

SEQ ID NO: 26360 - DNA, 246 bp, Zea mays
  Clone ID: cC-zmle189098f05a1
ggaggcattgggaccaaaactttattatgatcatgcatatattattgggcataccacacatgataatgtgggtcgccttactgcattattacagatatagatagagagggatggatagaggagatttcccaaatatcatgaatcaatattagggcggaatggcagcggaaaccccacaggaggtggggcggtagctgggcaactggtactggtagagtccacccatggccggcatgttctgggcca

SEQ ID NO: 26361 - DNA, 528 bp, Zea mays
  Clone ID: cC-zmle189098f05d1
gaaccacccgtccgcccacgcgtccgccaatccagatcagcaaagcggttttgcgtttagaggatcgtcgaacagaacaggatgaagggggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagacgagcgccatgtaccagccgctccggcaacagtgctgccagcagcagatgaggatgatggacgtgcagtccgtcgcgcagcagctgcagatgatgatgcagcttgagcgtgccgctgccgccagcagcagcctgtacgagccagctctgatgcagcagcagcagcagctgttggcagcttaaggtcttaaccccatggccatgatgatggcccaaaacatg

SEQ ID NO: 26362 - DNA, 397 bp, Zea mays
  unsure at all n locations
  Clone ID: cC-zmle189098f06a1
accaaggtccggagagggactcattattgggaaccatcaaattacacacgcatgcagtacagaattaaacaggtgtgtggttgtgtgcgccggagctagctagctcggtcgcgcgccggccggtactacggtcagccgaagaggtggtggtgcttcttctcgccgctggcctcctcggcgtccttgtggtccttcttcttctcgtggtgctcgtggaatacgtagccgccggcgccgacggccgccgcggcagcgacctcctccgtgatcttgtgcctgtgcgcgtgctcggggtccttcttcgcctcgtgcttttcgnaaagtgcgaaggcgccggcggcgatggcgccggcctcgccgaggtgctgcttgtgcttgtgctccttctcctccttct

SEQ ID NO: 26363 - DNA, 294 bp, Zea mays
  Clone ID: cC-zmle189098f06d1
aaagccaagtgtgtgtactagcaaccagctagctcgggcgtcaacaggcagccatcatgtcgggggaaagggaccaccactctttaaaccaccacaaaaggcccaagagcaacccgcccgccaagaccggtactcccagaaaccaagggggcacccccacccgcgagggcgaataccagaagtacaaaaaggaggaaaaggaacacaagcacaagcagcacctcggcgaggccggcgccatcgccgccggcgccttcgcactctacgagaagcacgaggcgaagaaagaccccg

SEQ ID NO: 26364 - DNA, 511 bp, Zea mays
  Clone ID: cC-zmle189098f08d1
gtccgcggacgcgtgggcggacgcgtgggcggacgcgttttttttttttagaacggacgaatgaagttcggtgctttgttcgtaatattctatggcacatactacacaattgatgtttcatgaatatatacatatctaccaaaaaaagggttacacctgcagagttgctgcggctaattgtacaatttacataacccctgaagcgatggaagggcgaatcagctctccaaggtctctagggctgctatctggagttgtcctttgaagcatctggtgtggaggtgctatcagaattccttgcctctgacttttcgtttgagtacgtcgacaatattgtgacccagacaagctccacacagtcgacccatagaagtctttgctcaacagggaccacaccatatgtaattaagtgtgcaaaaggccacaacttccattcagcggtaagcatgggccagaatgtagacttgagttcactgtagatagtggtaggtgattccaaccgaaagaaacc

SEQ ID NO: 26365 - DNA, 501 bp, Zea mays
  Clone ID: cC-zmle189098f09d1
ggccgaaccacccgtccgggaggaccccaactcctgcgccatctgctgatccttatacccgttcccgtattctttttgtacatcccgccatgccggtatatgtagctcgcctgcctgcctacctacctcaggctcgatctaccacgtcgtcggtgatcgccgggatcggggccagaccgccagagcggctgtggtggttgcctgctgctctgctcatctctatcctgcgggcgtgggccatgggctgtgggccgtggggttggtcgttggcccgtccacaggtcgttatacgatggctcgtgcaaaatcatacacgcgaccccccaaccatccaagagtagctagctgttgggggttttcactcttcaagctgttgctcatcaacgtcgttgtatagtgtgcactgtgcagtgcatataatatactccctctgtttctctttattttgtcactggatagggtaaattttgcactatccaacgacaaataaaaagaaacgga

SEQ ID NO: 26366 - DNA, 421 bp, Zea mays
  Clone ID: cC-zmle189098f10d1
ggccgaaccacccgtccgcccacgcgtccgcacatacatagtttcttctactactcgacgatttacatggggaagcctgcgaagagcggaggggggggtggatacgccggcgatcgtcgggatctgagggctactccggaccggctgatcgaggtgaaggtcacggcggacaacagcagctgcatccgctccatctccttcatctacatcggagccgatggcaaaccgtacgaggaggggccatggggtttcggccatgctggcacggagtacaagattgatctgtgcaggttcgacgagagcttgacggacatctccgggaccacgggcccagcctacaacattgacaatctggtcaagtctctcaaattcgtcaccaacaaacgcgcttacggaccgtacggcagggacgagggcaccc

SEQ ID NO: 26367 - DNA, 535 bp, Zea mays
  Clone ID: cC-zmle189098f11d1
gaaccacccgtccgcccacgcgtccgccgatcgacaccatgagggtgttgctcgttgtcctcgctctcctggctctcggtgcgagctgcacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcggcgttggcagcaccccgatcctgggccagtgcgtcgagtttctgaggcatcagtgcaggccgacggcgacgccctactgctcgcctcagtgccagtcgttgcggcagcagtgttgccagcagctcaggcaagtggagccgcagca

SEQ ID NO: 26368 - DNA, 604 bp, Zea mays
  unsure at all n locations
  Clone ID: cC-zmle189098f12d1
cacccgtccgaaaaggaggcccgttactcccaagttatgccccatttggattttgactggtgggagcttataatggacgtgggaagggattggcagatgcttataataacccccttggaaatggactggcaggtgcttatggtgtgctttccgctcgtgctgcacagccaatggtgtatgctccaggtgctcctcccggctcaacaatgatcccaatggtcctaccagatggccgtcttgtatacgtaccacaggccgcggggcagcagcctgtgcatgcgacttcacctctgccacagcaaggtggtcgtcgattcggtggtagtggcagcggtggtggcggatccagctcttccggcggaaagcggcagaggggagatgaccatggtagtaacagcaacaacagccgcaggggccggcaccgtccgtattgatgattgcaatgccgctgattagcaattagaagttagaaccgagcagttagcacattcgtcgcagtaccatgctggaaacggtggtttgaattatttatttaccatgctgganacgggggtttgcattgaataagacaaaagtttttgaaaaaaaaaaaaaaatggcggcc

SEQ ID NO: 26369 - DNA, 439 bp, Zea mays
  Clone ID: cC-zmle189098g01a1
ttttaattaccacacataaatcttaatccttgggatgtgtacccacttagcttcacaatgtacaacaacattagtacttagtactcgagcaactcgtaccacaatcccatttgatactatagcaattactactaagaatgttgatgaaatcttagggctactaaatgacttccaagaaccggtaaaagttgagcccttaaactgaagtatcacataatcatcaactacaaaagtcgacacaacatcctccctgtattctttcaacttaatctcctctttcctgctaggcaccatccccaagaggtcggatccaaggctctctgcctgccctgcttctaataatggtgaacagtcagaggaaacctgagcagctttgtagggattcatggtgctccccgcagcatccttcctctatgcacctgacttgaactcagcaagg

SEQ ID NO: 26370 - DNA, 179 bp, Zea mays
  Clone ID: cC-zmle189098g03a1
ttttagtttataaaccttagaatccataatggggaaggttattcatgatattacacaggtacggcaatctaagatatcatattaagtgcttgttcgattaggagtggattgaagagtattggaggggattaaagcccctctatttgtatagaaggaaatttaatcaccttcaattccct

SEQ ID NO: 26371 - DNA, 367 bp, Zea mays
  Clone ID: cC-zmle189098g04a1
tttttgttgtaaaaatcttgcattaaaaacagggcttggattattcatacagtagtgttacaaacaccttatggtccatatgttttgacaaacagcttaagcatagtagttcaagcttgactttttctttgcctggacctgtacgatcccttcattgaaatcctcgtgagttacctctgtagcatcccgccgtagggcaagcataccagcttttacacaaactgcctttagctgtgcttccgtgaagtcatcagttgagcgagcccaatcttcaaagttgaccataggatttacattcattttccttgaatggatttgcaagattttagctcttgctttttcggatggggtgagggaaactaaattt

SEQ ID NO: 26372 - DNA, 267 bp, Zea mays
  Clone ID: cC-zmle189098g04d1
gtccgcggacgcgtgggaaaatgtgttgttctgaagacctctcacaagttaaactatattccttcctgttggggggctgggggaccctgacaagctaaagcctggtgatctggttggagtcaataaagatagctaccttatactagatacattgccatcagagtacgattcacgagtgaaggcaatggaagtggatgaaaagcccactgaagattataatgacattgggggtcttgaaaagcagattcaagagcttgtagaggcaat

SEQ ID NO: 26373 - DNA, 377 bp, Zea mays
  Clone ID: cC-zmle189098g05a1
aacgcgacatgaatgcgaccgagagcggatcaagatcaatgaatgcaacttatgcaaaagcaggtataacgcaagccttctcatagtataatcttttcattaaacaagcaaactgagcacaaaactttggtgggttaattttgcaacccccactgggcctagccatcaacttatacacgacgaaggggccaaaatttcacgaatcgtcgacgccagtcatcggctcattatcctccttggcttcatccccagcgtcttcgtcttcaccatccgcggcgttcttcatttggtaatccaccttgaaatcgtagtccgcgtccattgtcgttcagcacactgaacctgttcgccttgcgccggttcttctctgctttcct

SEQ ID NO: 26374 - DNA, 566 bp, Zea mays
  Clone ID: cC-zmle189098g05d1
gtccgcggacgcgtgggccggcaattgacaaagagatgctttaggatttcagcaaaccaagtgaacccggtgaggaaagccgggaggagcaaatgtctgacgcgaacgacccacaaggaagcaagccagccaccgccagcacacagaacgacaagttgtacaccgccgagggcatactcgaccctcgcaagaggaaagcagagaagaaacggcgcaaggcgaacaggttcagtgtgctgaacgacatggacgcggactacgatttcaaggtggattaccagatggaggacgccgcggatggtgaagacgaagacgctggggatgaagccaaggaggataatgagccgatgactggcgtcgacgattcgtgaaatttgggccccttcgtcgtgtatgagttgatggctaggcccagtgggggttgcaaaattaacccaccaaagttttgtgctcagttgcttgtttaatgaaaagattatactatgagaaggcttgcgttatacctgcttttgcataagttgcattcattgatcttgatgcgctatcggtccgattcatgtggcgtt

SEQ ID NO: 26375 - DNA, 276 bp, Zea mays
  Clone ID: cC-zmle189098g06a1
ttttgatttaatcgaactcatattcgttaccgggggctgaaaaccagggtctcatagatccacccaaaaaaagatagaatatttcttagcgcagatagttgaaacaagatgcaaaaggacctaagcggtcagcaggacggcgcctccggcagccttgatcttcttctcggcgaccttggagatgagcttggccttgacgacgatgggcctggacggcagcatccccttgccgagcaccttgaagtagccgaactgcgttacgttgacgagcggggc

SEQ ID NO: 26376 - DNA, 406 bp, Zea mays
  Clone ID: cC-zmle189098g06d1
cacccgtccggtggcgtcgagcagcggcagcggcggcggcgattacgacgattctgaagaagaaccggaagaagggcgggcgggtgtctgtggggcacggccgcatcggcaagcaccggaagcacccgggaggccgcggcaacgccggcggcatgcaccaccaccgcatcctcttcgataagtaccacccgggctacttcggcaaggtgggcatgcgctacttccacaggctccgcaacaagttccactgcccgtcggtcaacgtggagcggctctggtcgatggtgcccgccggcaaggccgcggaggcggccggcgcggaccaagccccgctcgtcgacgtgacgcagttcggctacttcaaggtgctcggcaaggggatgctgccgtccaggcccatcgtcgt

SEQ ID NO: 26377 - DNA, 525 bp, Zea mays
  Clone ID: cC-zmle189098g07d1
cacccgtgcgcccacgcgtccgatcgaagagaagctgaggcctagctccgcattcgccgccgcatcagccatcagcgatggcggtggccgctcgcctcgtctcgcgctcccgtcagctacattcggttcaagcagcttttgcgaatggaggtgccactcaagttcgctcctttgccaaggatgcagctccagctgaccgtcctcctgttggtggggatgatctcctgaagggcatattctttgaggtaaagaagaagtttgagacagctctcggcgtccttaaaaaggaaaagatcactattgatccagatgaacccagcggcagttttttcattatgctaaagtcaatgaaaacctgtaaggaaaaaggcggaacctcttttctgattttaaaaggattaaatttaccattgaaaccttaaccaagggcatccttgatccacggcctaacttgattactcttcaacagctcagaataaagagtgggcttatagatcatattggaatcgaacctttgatgatgga

SEQ ID NO: 26378 - DNA, 574 bp, Zea mays
  Clone ID: cC-zmle189098g08d1
gggccgaaccacgcgtgcgcccacgcgtccgcccacgcgtccgtgactccttcctctccgcttccgcctcctcgacctccgggcgcgctccggcgccgtgcccccgatggccaccgccgctgccacggctgatctctcggctgccgatgataagcagcgggactcggcgcttccggagctcacgacggaattcatggtggacatgaaatgtgagggatgtgtaacagctgtgaaaaacaagctgcaaactcttgaaggaataaaaaacattgaggtggacttgtctaaccaagtcgttagagttttggggtctcttccagtgaagacaatgttagatgcccttcatcaaacaggtcgagatgcacgactgattggccaagggaacccaaatgatttcttagtttctgctgctgtagctgagtttaaagggcctgttgcatttggtgttgttcgtctggcccaagtaaacatggagttggctagagttgaagccacgtttagtggtctatcacctggtaaacatggatggtcaataaatcagtttggggatttgacaagaggtgcagaaagcact

SEQ ID NO: 26379 - DNA, 486 bp, Zea mays
  Clone ID: cC-zmle189098g09d1
gtccgggtcgatcgatcgatggccagcgttatcgacggctttggatgtttgccggctggtggtgacggagctgggccagctcaaggagctggcgatgcagctggaggggcacctcggcggctcctcgccggacctctgcaagcacctcgcctcgcacatctcctccatcaccgaccgctccatcagcctgctcatcaccgccacctcatcaagcccccacggcggcgcctctgacgcgccgcccttcatcaaggctactaccaagaaaaggaagaggatggacaagaagaggcatgaggtgagggtgggctcggccggaggcggcggcggtgaccatccggccgacgacggctacagctggaggaagtacggccagaaggagatccttggagccaagcacccaaagggctactaccgctgcacgcacaagagctctcagggatgtgcggcgacaaagcaagtgcaacgcaccgacgaggacccggc

SEQ ID NO: 26380 - DNA, 531 bp, Zea mays
  Clone ID: cC-zmle189098g10d1
gtccgggcaacgtaccaggtggtgcagcccatcaacggcttatctccgtttttcggcagcctggagacgccggggacctcgagcccgctcgtggcgtggtacctctccaacctcccggcctaccgcaccgccgtgagcccgctgctgcggggcgtcgaggtcggcctcgcgcacggctacctcctcgtggggcccttcgcgctcacgggcccgctccgcagcacgcccgtgcacggccaggccggcgcgctcggcgccgccggcctcgtcgccatcctcagcgtctgcctcaccatgtacggcgtcgcctccttcaacgagggggacccgttcacggcgcccacgctcacgctcaccggcaggaagaaggaggccgacaagctgcagacctccgacggctgggccaagttcaccgggggattcttcttcggcggcatctccggcgtgctctgggcctactttctcctctacgtgctcgacctcccctacttttcaagtagatatcatcaaagatgcgtatatatagctcct

SEQ ID NO: 26381 - DNA, 362 bp, Zea mays
  unsure at all n locations
  Clone ID: cC-zmle189098g12d1
ccacccgtccggggagctccgnggnctcacctccgcaggcaagaatttccgntttctgcgtggcaagggccacactgaccacaggaataggccgtcgaggagggccacctggaagcgcaaccagaccctttccctccgccgctaccgttgagcacatacaacttgatgttctgctactgtggaacctacctcatgcatgctctgatagtatttggtatttttgttgcatcgttaaattttgctacccatgttacaagctccttgaactctgttatcagtgtaccatggagaaatggaagcgaactatgtttgtggttatcctgtgttatctcgatgaaaatgatggcttagttgagtatttg

SEQ ID NO: 26382 - DNA, 211 bp, Zea mays
  Clone ID: cC-zmle189098h01a1
agaaacaaaactgggaaccggatatggctcaccagatgttcggataagtcttaaataacactctggttttaacgaaaataacagttctaaatcgaccaggcaaacgttgcgagcatagttcagacaatgacgtgaacaagacgagatattttacgtttccactagggattccttaagcaaacacagaaccagccagacacatcatttcttt

SEQ ID NO: 26383 - DNA, 259 bp, Zea mays
  Clone ID: cC-zmle189098h02a1
ttttggtttaaacaattgaagtggcattctccgtttggattcatatcattattacaagtatgttacccaaggtaacatatagtgcttattgtttatgcaaccaggcactggatgtaacatgacagcaagtacacattgtactacttgctatagcataatgaacatccgtatccatcatgatgcgtcaattacatacagcttcatattttatcttccaccagaaagtatatgaataaactgtggaaaattctggatggta

SEQ ID NO: 26384 - DNA, 420 bp, Zea mays
  Clone ID: cC-zmle189098h03a1
aaaacaatacaccatcaagcttataaaaggatgaatgcggctgctcgacataactcaaccgatgctgtaccgtgaccgtgagtggtcatgtgattcaaccaagcctcaactccctactacatcatgtgatccaagaacaacacatttattaatgccaaaaaagatcagactcagacatctcattggaaaaacaaactacttgcaccaagatgcaggcagcaggctctccggttgcaaaggcgatgtgtcatggaactgatacgccgagagatttcaggcttgtaaatatgtaaaagcaacgcgaatttacattaaaattcaatggcatggatttaaccggttccgagccttcgctccaaaactgaacggaagtaagctttccacaacagaagtcattagccaaattggaaacaacaacat

SEQ ID NO: 26385 - DNA, 267 bp, Zea mays
  Clone ID: cC-zmle189098h04a1
aagcttcatcctctagagcccccgcccttttttttttttttttttttttttctctctttttttttttttgtttttgttttatttaaacccaacacacctccctttccccctatcacaaaaacaaaaacaccaatcatctatcccccaacacaaacaacccacccttaaaaaaaattaaaaaaactacaaatcacaaaaaaaaaaaaaaaatttttttcctcttccccccaatacccccccataaaaacccaatattctcctccctac

SEQ ID NO: 26386 - DNA, 337 bp, Zea mays
  unsure at all n locations
  Clone ID: cC-zmle189098h04d1
tccgctgaaaaaaaagtctctttcttttctgctatattgtatcttaatttcgattctttctagctcggttggttttgatgcgtgtaacagaaatattgtactcatgtatatgtaacttgcaaaaggagtaatgtatggtgttatggtaaaaaaaaacatataataaccaaaacattaaaaaaaaataaaaaaacaaattnttttctctgtttaaagtatacctaggtttcttcctcatgtgtggggggctattacatattttatattgttaataaaatataaataggagagtttctcttgtctaaatgaacattttggaaacactttatccccccag

SEQ ID NO: 26387 - DNA, 269 bp, Zea mays
  Clone ID: cC-zmle189098h05a1
ttctttatatttctcaactgcaccacaaaaaggaaaaagtataatatctactttctatctataaacactccaaatgataacataaataataatttttaaatactatttttataaaaaaatctaataaattcatattaaatcttcatccattatcttcacattttaaaatattcatttttaaaatatttaaaactttaaacaaaatctcttctttctacataaaaacttctttcccttactttaaatttttctataaaaaattttaaact

SEQ ID NO: 26388 - DNA, 206 bp, Zea mays
  unsure at all n locations
  Clone ID: cC-zmle189098h05d1
tcttgncctccaaaattttaaatataatttaaaaaaaaaaccgccgggcgctctggagaatttaaacaaacatacccctccattccacatcatatatcttctataattataactaaattcaattcactcaccctcctttaacaacctctttactaaaaaatccctttcttcacccaacttaatcacctttcaacacaatccccttt

SEQ ID NO: 26389 - DNA, 156 bp, Zea mays
  Clone ID: cC-zmle189098h06a1
aatattcagttaagaccattccagggctggttttcgccatgcataaactaaaccaacaactaggataagcacaaaaatgaaagctttgataaaaacggatacacccaatacgtcgaaactcattgcccaagggtagagaaagactgtttccacatc

SEQ ID NO: 26390 - DNA, 169 bp, Zea mays
  Clone ID: cC-zmle189098h06d1
cacccgtccggatgtggaaacagtctttctctacccttgggcaattagtttcttcgtattgcgtgtatccgttttggtcgaaggtttcatttttgtgcttatcctacttgttgccttagtttatgcatggcgaaaaggagccttggaatggtcttaactgaatattcag

SEQ ID NO: 26391 - DNA, 520 bp, Zea mays
  unsure at all n locations
  Clone ID: cC-zmle189098h07d1
ggccgaaccacgcgtccgcgagaacatcgccatcaccagctgccactcgcaccttccgtctttccagaactatctcgctcgtcggcgttcaggtcagctactccaatttcgcaacaagttgcaagcaataaccgaccaaggacgacgaacgggtcgatggccacgctctcctcctgcagccgcctgagtagcggcaccggcgccgcggccatccaccggcagccggcccgtgctggagccgtcctcgtcgtcacctgcaggcggagctcctccgcgaccgtccgcgccgcagccgctgccacggcggcggcgccggctgccgtagagctgcagaacaaggggtaagtgtatatatagtggtgtaacaaataagctggctgctgctcttgtagctaattgatcgatgctgctgctgctgctgctggacgcgcgtgcgtgacctccgaccgacttgcaactgncaaagggtgtcgctgccgacgtgggccgggtntcgagcttcgggcggcgccggtctact

SEQ ID NO: 26392 - DNA, 452 bp, Zea mays
  unsure at all n locations
  Clone ID: cC-zmle189098h08d1
gaagcttcgggccgaaccacccgtccggtccacaccacaatccggaggataaacaccaacgcttgcgatttagangaaaagaccccaccagggggctggcgcaccatcaaggaaataacgggaagcaggcacagaaccgctacgcgagcagagatgaacacatgaaaaacaagcttgaccgctatgaacagtacagcgaaatcagaggagccagacagaacaccattagccagcaccaaagcgacctatctgaaacagataaatggactaccccagaggggccaacacatcccaatgaaatgcatgggtaccacaacactgaaagagacaacgaaacagcatactaaacataccgccatggaaagaatgttgcaaccagacaaagttcatacgaccaccatggaagaaacaattcacatcttcaaaggactgtaagagaaaaatgaacttca

SEQ ID NO: 26393 - DNA, 520 bp, Zea mays
  unsure at all n locations
  Clone ID: cC-zmle189098h10d1
tccgctgctttacttgatgcgtacctttattttgttgtctattctttcnnacggaatgacacattgcgtgcagtggggaaacatgtgtgttatcagaaccaatcctgagcactgagcaactttgcacaatctattacatagcatccacatgaggaggcacancaatgataataaagggtcgatttccagttccaagactagttgtctgcgaccaacatggctcgcaggcaaggtttttgttggctaagctgaatccatcggccacatataactcagctcatgatgttgctcctggttctgacatcattttcaccgatgatgttagcttccaggtcttctgtgagcacctacaaaggctggctgttcagtcttgaggacctacctgtatgcaaaggttgtacaccctatttgatagttgctcataatgcactgggttcttaggttggagttgtgagaacttcccttttctgtttctctttggccatagttttctgagatcagacatttttttcgggaaact

SEQ ID NO: 26394 - DNA, 514 bp, Zea mays
  Clone ID: cC-zmle189098h11d1
caccgtccgaatttctcttgcaaaatttctccatggcttgctacttgttgcttctctccacggttcatgtatgaggagttggggaagcatgctactaaagcaattccttttgggtcaacacccaagaataatgatggcacatctgatgctggaacaaattggttaatgtttgagttgctgtggagagatttcttcaggttcatcacaaagaagtacagctctgtacagaagacatctgaagttgccactggctgcactcccgccccagcgcttgcatgaacttacttagacaagctgattgccagctgcttttttggggtgataaacttatgtgcattttcaatggagtcttttttttgccgccaataatgttggtagtcaaagtgaacgccgaatgcgcattcctgcgttttggtttggtcgatgtatttaatgctgtcgacatccctccaaatgactgttgaatgcaaatgatactgtgagcaacctatcatctgctgcgtaaatgtgttct

SEQ ID NO: 26395 - DNA, 219 bp, Zea mays
  Clone ID: cC-zmle189098h12d1
accacccgtacggccacgcgtccggtaacgtgtgcatgttttgaatattctttgtttcaagcaccatagccttcatgtggttttttgttgttggaccaccttctaggtggtggcgttcgtatcataaacataacttgaagtttagtgcagcagaaacacatgtatattgcgttgcgtttacgaccttctattggcgttaaagcctcacgttatttggtc

SEQ ID NO: 26396 - DNA, 396 bp, Zea mays
  Clone ID: cC-zmle189099a01a1
ttttataattggccatgctgataacaggatggaccacaacatcgggtaagcataggatttgacattgagtattacacaacatacccgaaaacacacggaattattcaacaacataaaacattattaagctttccaaagcatcgattgttccatctagaacgcggtcatccttgtagtagccacaaagtgctttattaatttgcactgaaatttcacttcattgtggccagacgattgatgaacacattgaaggcttggtctgtgtcaaccatactaactctgacagcccttgcatccactccaaaccttgtgccacctcgagtgataatctttttctcgagtaggaaggcctccacatcttcaatatcatccttgctgtagcgaaaccatgcaaat

SEQ ID NO: 26397 - DNA, 345 bp, Zea mays
  Clone ID: cC-zmle189099a02a1
agcaaggaaacaaaaagagtgctttttaaaaaaaaaaaaggaattcaccacatcacaactacaaagaaacatcaaatttgaccacgtcattgacaacacaaacttggatttcccatacccttgtaggattggcaaatcctaacatttattccttgccatgaaccttgccaatttgccacagctggtctccaaaccataagctccagaccataagcactgataaagcttgaaaaacaggtcctggtgttcaaaagacactctcatttcttcaatggttgtcttcttcttcgcagaatttcgagttcttatcatcatccatgagccaattgaggtcacctgaattgc

SEQ ID NO: 26398 - DNA, 418 bp, Zea mays
  Clone ID: cC-zmle189099a03a1
ttttgggttaatttttgtttatagccagggtactagtaagaatggacttaaacatgaacttgggggccctgtgtatggccaaaaaaaattgcataaaaataataataagatccactttgtaattgacgcaattatttaagcaaaactacatatataagaatttcctcatttagtcgacttcttagatcttgggtccagcaccgctgccaccagacggctaagcatcccgatccatgccaccggccatgtcaggaccagcggcgccctgatacatatttccgatgatggggttgcaaatgccctccagctcctttatcttgtcctcaaactcatcaacctcggcgagctggttgctgtcaagccaattgattgccccctcgacggcggcatcgatctttttcttgtcgttcaccggtag

SEQ ID NO: 26399 - DNA, 466 bp, Zea mays
  Clone ID: cC-zmle189099a04a1
ttttgggtttaatggaacggcttacagaacggggctaatggagggatgctcctttcggttgctacaaatggtgaaaaaacatgcccaggtttttgtttgtttgtttggagtatgaaaagcttcatcaatcaatctgcaccagctcttccactgatcagctgcttcttattcctttttttcccatttccactgcatgtaatctatagtatggccacgagagcactcttcaagaccagtaaagcagtaacccctacttgtcccactcgtgtatcttccactccggcaactgttgaatgatcatctgtccagtcgaatctgcgttgcccaccgttgcctggcacgccaatcttcacgttttgggtttccttttgagcaactccttttccacattaatttttgggacaggatttccttgccttcaaccacctcgacgatgcaagttccgcacacgccggcccctgagcag

SEQ ID NO: 26400 - DNA, 333 bp, Zea mays
  Clone ID: cC-zmle189099a05a1
attcgaagacatacttcaatacctctgataatggcaatgacatactattaacataacacaaaatcaaggcaatgacattctattaacataacacaaaatcaaggcactaaaaaaagctgcaaccttattggcatatatagtacacgaagcagtgacacaataagcccctaccattcacaggaattccaaatggcaacttctgaactgggtaaacaatgtatttcatcataaagttagatgcaaaagctacaactaacagaaccaccaaagttgtttaactaccaataggttacagccataatccttccccacgctccgcggacgcatggttca

SEQ ID NO: 26401 - DNA, 373 bp, Zea mays
  Clone ID: cC-zmle189099a06a1
gatcctctacagcgaccgcccttcctttttttttcccttctttttttttaaaagagacctcaatcatataagtaaggtttaattaaataaatccgtactaccccacatattccactttttccttccttaacctttaacccaacaatttccaaatcataaatataacatcttcacactttttccctattaaaaatcaaaaattcaccacaatacccataaaaatcccgtaatacataaatattcaaaactcacattatcaaaaaaaatccaaaacccttaaaaatccctattcttattcacctactataaactatactccttctatacttaaaaactttaaacaatacctctttataatttaaaataattccct

SEQ ID NO: 26402 - DNA, 364 bp, Zea mays
  Clone ID: cC-zmle189099a07a1
accataatacctttttacttaaaaggcgggtgaaaaccaaccaacccccatcaaaatattgtaacgctgccacacacgaaacactaccgtaaagggagcaattcctaattctgaacagccttgcaacagaatcacgagactgaccctgaccatttcgtccacctccccggtcttggggccacaaacaacgcttctaaaccaagcaaactggaaaattccgccttaatctttcatggcgggacccgttcccgggacatcttaggtcactattttgattcaaaaactttccaggaccccatcttgctatcgaactccaaaagctagccgacctccataacctgcaacctgctcatgagcccttttt

SEQ ID NO: 26403 - DNA, 384 bp, Zea mays
  Clone ID: cC-zmle189099a08a1
atggcaaaaaaaaaagtggggggctgccactttcgatcaaaggctaccttacagttctacataaattgctgaaaatctgtttttgacaaaatgcaagcatcaagatgcacaatgatcaaggaaccctttgacataacatttcccttgtcaaaaaaaaaatcgcctgtacaaaactcttcaaattgtcttcaagccttgcgtaaatttgtgaacatgtatttttgtttgaaaatactttgtacacttcattcattacacatcagctcttgacatggcagatcttggtccttcctttctttccaaagccaatatttttgccagaagcaaccattctgctgcatgtacacttaatggcttgtgtcttctttgttccaaagtggatct

SEQ ID NO: 26404 - DNA, 319 bp, Zea mays
  Clone ID: cC-zmle189099a08d1
tataaagtgaaattttttttctaggttaatcatctctgccggtttttaactaatcttgcctaatataaacatctaaattttcaaggatatttctaatgtggacttaatattctctgatgacatccattacatgtttatcagctgacaactattcacgttgatttgacaggaaaaccaaaatccaggaatggcatagctgcctccaacttcaagaatttaaaaaagcaaaggtttaaaccttctgcactctcaacacgagcagattttctatactaaactgactatcacacaattttgtgctaatatcgcttgagacatc

SEQ ID NO: 26405 - DNA, 360 bp, Zea mays
  unsure at all n locations
  Clone ID: cC-zmle189099a09a1
ttataaattgaattactaacaatataatataattaacatgatcgatggatcatacatcatccataaagcaacaatagggaactgagatcataagcgcgccagccaatcaatcacgatctcatgaaaccaaggccagaactttagactgacaaaatgattatttgctaacctacccgcatgaatgtagaccgtcactcatgctttcggttcaacaatacagatgctaaagccatgccgctaggcattcccaccactgtcccaatatagccatccgacgagcagtcatggttccttgatacccgaggttgatactattgcgctgcacatacagcataccttatactttgcccnggnggntat

SEQ ID NO: 26406 - DNA, 470 bp, Zea mays
  unsure at all n locations
  Clone ID: cC-zmle189099a09d1
gcgaccgcccacgcgtccgcngacacatgggggagtgcattcaatgattcaccctcctccaagcacttatgccatgctgaatgcagacactggttaatcaccataaccaanctaatgccatgaaggaaccaggaacctgtgggtatggctatgggacgaaaaatgacaagaataaggatgtggatacaatagcttcggacttcatcaagctgaagcacaatgcttgggcacttcagaagagcacaaccatgtaccaaccctctacctaaaggtgttaatagttcaagaagttgatactatatacttatgcttgtctctgtatagtctataagtcctaagtgggggggggggtgctgcatgcaaccctggaaatttgccgatgccgagtagaatttaccattgcatccttgctaagaaaaagaaagtcaatggggttataaggagatgtgttaaaaaaaaaaatccaattt

SEQ ID NO: 26407 - DNA, 315 bp, Zea mays
  Clone ID: cC-zmle189099a11d1
cgcggacgcgaggggtttggatgcaaatcgttgttagttaactttatagtttttaagtaactgtttggttgagaaagtgcgtgtctatcttctattttctctgctccctatagcaccaagctgatttgtgtctaatttatagggacgatgttagcgaaagtcaatttaatcaggtgttcatcattgggttgcaacaaatcatcggtggagactgagtcaccgcagccaaaaaaccacggactcaatttgaggagttcttccatctatgtttgctagaaggcataatgcctatttatctcttgcatttcaacattt

SEQ ID NO: 26408 - DNA, 245 bp, Zea mays
  Clone ID: cC-zmle189099b01a1
gcagcagcatccaacgcaaaatggggccgagtcaccatttttttggcattcagaattacagcctccaagcggcacaatacagcattcagcaccacacggtgcactgcactgcaaacccaatctgatgcatcattatacagcacaggatcgaatacacggagacacgtccagtctccagtccaggtccaggtccaggaacacaacgcagcagcggcaattccggcggacccccaaagggccaggcg

SEQ ID NO: 26409 - DNA, 361 bp, Zea mays
  Clone ID: cC-zmle189099b02a1
acccacaagccaccgcatccattaggtaggactaacaaggcggctcacttgattaccagctaatcactcgctaattaattctctctctcctcgctcgagagaggacgggttcaccactccggcctgggggctctcagcagcctttgggcgcgaaccccacgcgctggccgtcgccgtcgaacaccacgcggaacccctgctgctggatgttgccgatgatggacacgccgccgtcggtgcccgcgaacgcgaagcaaaaggtgcccctggagtccacggggatgaagtagttctcggggggcaaatgcggcctcggcgccgcccgcgaagtgcattgacaccgtcgggacctttaccaccc

SEQ ID NO: 26410 - DNA, 411 bp, Zea mays
  Clone ID: cC-zmle189099b03a1
ttttaatattaagttccggttttagtatatatatagtatcgaaggagtatcatcgtggaccaattaatatatggttacagcagatgcaatcggatcaaccaacatgcaggtagacacacgtacgtacatgagcacaaagactgacgccaaacatgcagagagagatagcaaactgaagaactctgtttctctctctctcacacacaccacacaatacctatgtatggcagccagctcggcctcgcttattattgttcaaccaccaccacaagctagatagataataatcatatccatggtcgtcgatcgatgtgatcagcagttgcaggggtcgcacttgcagttgccaccgcagctgcagccgtgggcggtctcgccggactccgccgaggacttgacgaactcgggcgc

SEQ ID NO: 26411 - DNA, 258 bp, Zea mays
  Clone ID: cC-zmle189099b04a1
agcatcaacgtatccttcaagtgaaacaggggggaagtacaacctgatcacaatttgcaatgccaggtgcgcctgtcttggtttaacgtttaaaaatacatgaatcactatgggtatccccagatatgctctctgcttgatcacatctccaggtgagtgcagtaagaatttgatcagaaacagtagtgctgaaattgctacgctaagtagacagtgcgtcgtgaattaacttgtttgcaacctcctttgacaagccca

SEQ ID NO: 26412 - DNA, 491 bp, Zea mays
  unsure at all n locations
  Clone ID: cC-zmle189099b05a1
tttttcttttttttttttttttttttttttttttttttttgttagtttttattaaatttttttttttttccctacatattaatatttaaaaaaaaaattttttttcctaaaaaaaaacaataaacaaaaatctttctaaatcaaaaaatcattcttataaaaaaaaaaaaaaattaattttccccaaaaaaaaaaaataaaaaaatttttgttccaaaacaaaaaaaaaaaaaaaaaaaaaattataaaaaaaataacccctcctataagccaaaaaaaaaaaaaacccaaaaaaaaaaaantaaaaaaaatttaagctccctttttaaaaaaaaaaaaaatttaaaaaaaaaaaaaaaatctttaaaaaaaatatccggcaaaaaaaaaaacccctctcgaaaacttcaaaaaaaaaaaaaacttttttcaaaaaaaaaaaaaaaaattttttttaaaaaaaaaaagttaaaaaaccaacctctttttct

SEQ ID NO: 26413 - DNA, 522 bp, Zea mays
  Clone ID: cC-zmle189099b06a1
tttttttttttttttttttttttttttttttttttttttaggtttgttttaatattttattataatttctccataataaaattaatctttttaatttacaaaaaaaaaaatttttttcaaaaaaaaaaaccccctcaaaataaaaaaaaaaaaaaactcttaaaaaaaaaaaagcgaaaccctacaaaaaaaaaaataaatcaaaaaaaaaccccaaaaaattaatttttgtggttaaaaaaaaaaccccaccacctacaagatatttgtccccccttttcccttaacccaaaaaaaaaaaaaaaaaagggtcaccctttagggaccacaaatcaaaaaaagtctaaaaattcccccacaaaaaaaaaaaataaacctcactttttccccgggctctccacaaaaaactttaaaaaaagcccccaccccaactaaaatatacacaacctttttccacacaacgaaaacaatgtttgtctggacttcaccatctaaaaatataaacgggataaccccgttttt

SEQ ID NO: 26414 - DNA, 306 bp, Zea mays
  Clone ID: cC-zmle189099b07a1
ttttaggttttattattacgaagaagttttattcaggtcgggagcttattgtcgtaattcgtacaggagctgagtgcgtgcacgtacgatagccaagtacgatgaccctgcacaaccagtcaaccacagacatacataaggcacgcaggcaagcacgaacgggcgtggatgccggccgccgggcggctcagttagccctggcgaggaagctctccctgcgctcgtggacctcgccggtgcaggtgttgatgtcctcttcgaccctggtctcgcgcaccacgaagccgtggccgccggacgcgtggg

SEQ ID NO: 26415 - DNA, 305 bp, Zea mays
  Clone ID: cC-zmle189099b07d1
cacgcgtccggcggccacggcttcgtggtgcgcgagaccagtttcgttttaggacatcaacacctgcaccggcggggtgggcgagcgcagggagagcttcctcgccagggctaactgagccgcccggcggccggcatccacgcccgttcgtgcttgcctgcgtgccttatgtatgtctgtggttgactggttgtgcagggtcatcgaacttggctatcgtacgtgcacgcactcagctcctgtacgaattacgacaataagctcgtgacctgaataaaacttcttcgtaatactaatacctaaaa

SEQ ID NO: 26416 - DNA, 504 bp, Zea mays
  unsure at all n locations
  Clone ID: cC-zmle189099b08a1
cgggctcaaggaccacgacagcagattctgggacccttacacaaaacatttttcctgtttctagttacagtgcggttctattacatggcaggcgcaaactacaaatctaacaaatcagcaaccacacaaacccatggcagttgggtgttcaaagcacgccgttctcgtacatcgagccatctctggtagtagcatcttcggccatgtcgagctcgaccaaggcagcatcaacaagagactgcagcctctgttcagctgttttgaccctatcattgtagtcctgaagttggaggaaatgtttgtacaggtctgtaaccgccaactgtcgttctgaagagactttccgtgcggcaaccagttcatcctctagtttctgagctttcttctgcaaatctgcaatgtgctgttctttcccagatattttatccttaatctggntaatctcattttcaaggtcctcgcgcatctgaatagttttatccaactgatgctttccatcatttt

SEQ ID NO: 26417 - DNA, 527 bp, Zea mays
  Clone ID: cC-zmle189099b08d1
tcaagttccagtgatggtcttcaaaatgatggaaaatttctttggataaaactattcagatgcgcgggcaccgtgaaaatgagattaaccagattaaggataaaatatctgggaaagaacagcacattgcagatttgcagaagaaagctcagaaactagaggatgaactggttgccgcacggaaagtctcttcagaacgacagttggcggttacagacctgtacaaacatttcctccaacttcaggactacaatgatagggtcaaaacagctgaacagaggctgcagtctcttgttgatgctgccttggtcgagctcgacatggccgaagatgctactaccagagatggctcgatgtacgagaacggcgtgctttgaacacccaactgccatgggtttgtgtggttgctgatttgatagatttgtagtttgcgcctgccatgtaatagaaccgcactgtaactagaaacaggaaaaatgttttgttgtaagggtcggagaatctgttgtcgtggtccttgaagcccg

SEQ ID NO: 26418 - DNA, 218 bp, Zea mays
  Clone ID: cC-zmle189099b09a1
aacaaaaaccagcaatcactagatctgtttttattaactattccacacaaaaccaatcacccctaatgttcattattactccaatcccacacacactaactcatcataaccattcatcaccattaatttttcttacttaataatttttaactcactctccccattcccaaaactcacccatttttttttttaacacacatatgcaaaaataactatat

SEQ ID NO: 26419 - DNA, 355 bp, Zea mays
  unsure at all n locations
  Clone ID: cC-zmle189099b10d1
gggagaaaaaaagggcgaaannnngaaacacaacaacgtatttcttttcgggcacttcaagaagcactggcggaacgtgtttttatacatggttcaaccaccccccccccaagcagaggcgcctcattatacgtcaaaagaaggctgtgaagatatttccacgaccaactgctggccctcttcgtcccattgttcaatgccagactctcaagtacaacatgaattcaagggctgggagaggctttacccttgaggagttgaaggcttcgggcatttcaaaaaggcttgctccaaccattggcatttttgtggatcaccgccgcaagaacaaatcccttgaggggggtgcaggcca

SEQ ID NO: 26420 - DNA, 446 bp, Zea mays
  Clone ID: cC-zmle189099b11d1
gctcgccagccgggcgccgccacgagaggggatgtcgtctgctttcggcgtatccgctggctccgtgctggaggggtcctcctttcgggtgccggccaacacatctctgcctcggagaacagccgctggtgctccggctggtaacttttttgtgaagagagatattatatataatagaagctaccaccaattcttaccattgaagcatataggaggcttgcaagcagcagtacttccaggtactccaccactattagatggtgaggggaaaaagaaacaaatggctgaagagtatgggttcacacacattggagatgaactaccacatgatattactctggaggaggtcatggatactttacctaaagaggtatttgaaatcaatgatgtgaaggcttggacatcagctttgatatcagttacttcttatgcgctggggttatatt

SEQ ID NO: 26421 - DNA, 429 bp, Zea mays
  Clone ID: cC-zmle189099b12d1
aagcacaatactgtaccaacaatggcagctaaatattttgcttcctatgctccttggggttggtgaagttttgctaccgcgaccattttcccacaatgctcacaagctcctatagcttcccttcttcccccatacctatcaccagcggcgtcttcagtatatgaaaacccaattgttcaaccctacaggatccaacaggcaatcgcaacaggcatcttaccattatcacccttgttcctccaacaaccgtcagccctattacagcagttacctttggtgcatttggtggcacaaaacatcatggcacaacaactacaacaacttgtgcgtgccaacctttctgcatactcttagcaacatcactttctttccttcaaccaactggctgcattgaactctgctgcttatttgcaacaacaactaccattc

SEQ ID NO: 26422 - DNA, 336 bp, Zea mays
  Clone ID: cC-zmle189099c01a1
aaaataaaaaaaaaaaacttttttttattttgtaaaaattttgggaaaaacaaaaaaaaaaaaaaaacttttcttttttaaaaaaaacttttccaaaaaaaaaaaattttttaaaaccctcatttggaaagggccccaaaaaaaccagccccatttgttttttaaaaaaccctttttttatttccccccccctaaaccaacaaaaaggggggggggcccttccttttaaaaatttaaactccttaaggggcccccatctcccatcttttttcccaaaaaaaaaaaaacttttttttcccggaaaaaccccccccaaaacccttttttccaccccaa

SEQ ID NO: 26423 - DNA, 398 bp, Zea mays
  Clone ID: cC-zmle189099c02a1
aagaaaaccgaacgagaatcatctcatgtgaggtctgatatatacacattggctaacagattcaacctatgtcaagccacgatggagcttggtgacgacatcatcttttcaacacaaaggaaaaaactcaattacaggttgatcaaatctgcccacatcattgggaggatcagacgaccatttcagcctccttcaaactagaggggattcctatgtctagtctcatagtggctttatacttctccggaacttttgcgccaccctgaatgcacatctcaacaactgctggtgcctgaccgtagaaggtctttagctccctctgcagttcttccccggattccggcatgtgccacacgtacctaggaggtatcaggtcatcgagcaccgctgcttgccat

SEQ ID NO: 26424 - DNA, 401 bp, Zea mays
  Clone ID: cC-zmle189099c03a1
ggggcaacaaagcaatcatgggcaagcatttgtgtattcagtccttagataagttcttccataatgtacaaatagtttagataacttcttccaggctctactagcgctactcaaaacacttcgcgccttagttccaggccaaaaaaaaaaggaaagagaaaaaaacaacaacaacatcacactagacctcaccaccctatggctagctcgcttcaacggactggaaggcgttcctcgttaaaaatgtcggaaccatgtgtcgctggagctgggggcttgctgaatcttagccttctcttctctcagttgatcagagacaaataacaaactgaaaaaaaggaacacatgaaaaaggaggggtacaagcaaaaaaaccatagcagcaaataccaaccaaacca

SEQ ID NO: 26425 - DNA, 345 bp, Zea mays
  Clone ID: cC-zmle189099c04a1
ccaggccccgaacaaaatagcatccttgtcattgtattaaaaacatacccattggtgcattacaagctttaaaacagggctgaccatgcccaaagcagtttataaacgatccgtcccttatttttacatagtactgtactatacacattcggaaaacctgtgccatacagccatactaaacaaagtctttttgattctaataccccttcacataaggcccaaggtgtgtgtcgccccctggtgagtgccaaacccagggccatgtacctggtaagtctggctcgccacaacctggaaaacacctggttgctccttaaaacccttgacctgctggggggggagctt

SEQ ID NO: 26426 - DNA, 576 bp, Zea mays
  unsure at all n locations
  Clone ID: cC-zmle189099c05a1
cctctctttttttttttttctcccctttcccctttcttcccaggcctggcttttttctaccataacctcccccccccccccccctttcccccccaaaaatcccccacccaaaccacaagaacccccaccccttccaaaaaaaaacccaaaaaccaaccctaaaaaaaaaacaaataaaaaccccccccaaaaaaaaaacctaaccccaaaacaaaacaacaaaaattccccccaaaaaaaaaaaactcaaatcctgtgctacccaaaaaatacccccccccaaaaaaaaatnccctcccccccccccccccctaaaaaaaaaaaaaaaacccccccccccaaaatataaaaaaaaaaccccccccccccccagaaaaaaacttcctcccaaaaaaacccccaactttttttttttccttccccccacaaaaccctcaaaacattttttcccccccccccccctccccaaaaaaaaaataaaaatcccccccctccttttcccaaaaaaaaaaaaaacaaccccttattcaaaaaaaccttataaaaaaaacaaaaaatttttaaaaactccccccc

SEQ ID NO: 26427 - DNA, 438 bp, Zea mays
  Clone ID: cC-zmle189099c06a1
ttttttttttttttttttttttttttttttttttctttttagtttagattttctttttcttttttaaacaccaccccatcccttttttttgaaaaaatccaaaatccttcactaaaaaaaaaaaaacccccttcccaataaaaactcatacaaaaaatttgcaaaaaaataaaaaaaaacccaaccccccctaaaaaaaaactcactttaacccaaaatatattaattccgggaaactaaaatttaaaacaaaaaaaaacccccccaaaaaaaaaaaacctccccaccccatataaattaaaaaaaccccaaaaaaaaaaaaaatttttaaccaccaaccccccttttatcacaaaaaaaaaacaccaatgttttaaaacaaaaaaatttcccccaacttttaaaaaccccctacaaaaaaaaaaaatccccccttct

SEQ ID NO: 26428 - DNA, 416 bp, Zea mays
  unsure at all n locations
  Clone ID: cC-zmle189099c07a1
aacaaacacatgcagaaaccagtgacccaagtacttataacactgacgacaccggtacatcacaggcacacatngcctgcttgttcttattacaggcacgagcatcacgttgctactatcacaaccagtcctgatgcacgccatgcctgatacgactgtattatagtagaaccagtattatactggtattagcacagccacacactgctatcaagcaccactactagtagtataatattgcagtgatataagcagggagcccagcccggccgagcacgagcagagtgcctgccactgccaggctctcccgccgccctttttatgagcgagcagcagtgtgggctggcctatcagcgccgcgcggctcacgcggcggggggcggcttcttgacgtcctcgagcgggcggaaccacac

SEQ ID NO: 26429 - DNA, 365 bp, Zea mays
  unsure at all n locations
  Clone ID: cC-zmle189099c07d1
gcctgcctgtccactgntggcttggtgacttcctatgcttttctccgctcccctccgctcccgaacgttcggtctttgcatggcagcagcagctggctccaaggggcgggcgatcgctggaagcttcgtcagccgcgtcctcgccggcaaggccgcctcgccgaggagggccgtgcacgcctcggcgtacgacaagaacctggaggaccaggtgcgcccggcgttcgtgccggacgatgtgatcgggagcccccggagcccccgcaagtactggagcccccaccccaagaacggcgtctttagccccgcggccgaggacccccaactggccgctggtggcgcgccggacacctgccccgatgctg

SEQ ID NO: 26430 - DNA, 469 bp, Zea mays
  Clone ID: cC-zmle189099c08a1
gttcattaaactctggcttaaaactcgtcaatgatatgggaggccttttgcaaaattcccagcacgctaagcatagaaatggggctgttccattactgaatattacatgtccatcacacccgatgggccaatatgaggtatcaaaagaaagcaatctgactgcagtcatcttttattcgacgatgctcttaaagaaacgcaagggtcaaatctcaaacagcttttgtttggacaaaatacctaggtgaaaactaccacctgcttgatggccaactgtcttttcataaacaaggatgccgtggagcagtctggttctagaaaaagaagtgtattggattcatctgcctcaccaaattcttattttcagaaccacaaggcatccttagtgatgtccatcatcttcatcgtcatgaccatctggatcaccaccatcaccaatgaccttaagcacaaagtattgcgagcagac

SEQ ID NO: 26431 - DNA, 433 bp, Zea mays
  Clone ID: cC-zmle189099c08d1
cggggctggatgaaaaaagatgagccgcatgagtgtccagtctgcatgtattactttgtgcttaaggtcattggtgagggtggtgatccagatggtcatgacgatgaacatgatggacatcactaaggatgccttgtggttctgaaaataagaatttggtgaggcagatgaatccaatacacttctttttttagaaccagactgctccacggcatccttgtttatgaaaagacagttggccatcaagcagggggtagttttcacctaggttttttgtccaaacaaaagctgtttgagatttgacccttgcgtttctttaagagcatcgtcgaataaaagatgactgcggggagattgctttcttttgatacctcatattgggccattgggttgtgatggacatgtaatattcagaaatgggacagcccccttt

SEQ ID NO: 26432 - DNA, 296 bp, Zea mays
  Clone ID: cC-zmle189099c09a1
attacgaagaagttttattcaggtcaggagctgattgtcgtaattcgtacaggagctgagtgcgtgcacgtacgatagccaagtacgatgaccctgcacaaccagtcaaccacagacatacataaggcacgcaggcaggcacgaacgggcgtggatgccggccgccgggcggctcaattagccctggcgaggaagctctccctgcgctcgtggacctcgccggtgcaggtgttgatgtcctcctcgaccctggtctcgcgcaccacgaaaccgtggccgccgtggtgaccatggtg

SEQ ID NO: 26433 - DNA, 505 bp, Zea mays
  Clone ID: cC-zmle189099c09d1
gacgtcgcacgggcgctgcacacagacacaccaatcgtttgcaccaatggcttactaccaggagggtgagtactgctcggaggaggtgaggtcggtggccccggccggcttcggccgccacggaggcggcgtccagcagcacgtcgtcaaggagaagttcgaggaggtcgacacggtctcacgcgccggcgccaaccaccaccaccaccaccatggtcaccacggcggccacggcttcgtggtgcgcgagaccagggtcgaggaggacatcaacacctgcaccggcgaggtccacgagcgcagggagagcttcctcgccagggctaactgagccgcccggcggccggcatccacgcccgttcgtgcctgcctgcgtgccttatgtatgtctgtggttgactgcgtgtgcagggtcatcgtacttggctatcgaacgtgcacgcactcagcttctgtacgaattacgacaataagctcgtgacctgaataaaacttcttccgtatt

SEQ ID NO: 26434 - DNA, 128 bp, Zea mays
  Clone ID: cC-zmle189099c10d1
aaaaaaaaaaaaaaaaaaaaaaaaaaaaaaaaaaaaaaaaaaaaatttatttataaaaaaaaaaaaaaaaaaaagggcgccgggtttaaaataacaaaacttaataaccccaccaaacaacggcatgc

SEQ ID NO: 26435 - DNA, 479 bp, Zea mays
  Clone ID: cC-zmle189099c11d1
cgcggacgcgtgggcccgagcgttacgaccgcaatttgacggagtttactttgaaggctatcccgcttattacaaagattgggcatgaccgtatgggaaaacacatctcaaacagacataaacctggtaaacgcaaggagatggaaaaggattccaaggagctggagcaggacatcggcatgctcccgaagaagcttattatcaaccatctcgcggctgagaaaacgaaggtcaaggttgaagttgttcagcagcagacagaagataacgcgatggaagagtagtgcgtggcatttcgtgtgcttgcgttttcatgtctgatgcagatccttttgtatttgcgtaagaagctatgtagttgatgaaagatgtttatttaatatatatattaatggatggattcgtggactgaatatcagcacgtttgttgttctggaatgtaagcttgctctgcttatgctattatatgcttggcatgt

SEQ ID NO: 26436 - DNA, 438 bp, Zea mays
  Clone ID: cC-zmle189099c12d1
ggggacgggaagcagagtgccattcacagctcacatcacaggcactctttgttctggaaaactcgggtgccacgtagttgggtatgcatgataatagtagctagctactgctcttgatatgcaggatgatttcttgattgtttaattaatccatggagacagtagctttgttcagcagaaagttagtgtgtatctcagtacgacggttcatgtgtgtgtatccaggtgttcagtcctggcgtagcgaactccctggcatttcagatgcgggcaagtctgtgcaatctgtatttgcaatgcttgttgcccgcagaggaagcttgcttaccagtgtttgtaaccgagggtggtgcagctcatgatctatgcatgttgaataatgagtgtgtgtatattatatataacaggtataacgggagcactgagcttccattagtt

SEQ ID NO: 26437 - DNA, 403 bp, Zea mays
  Clone ID: cC-zmle189099d02a1
agggaattcagtttattccacttgccgggtatatgttttattggctcttacgtgtggcatcacatccatataactcttggaatagtggtgctagtacatataggtgcatgcacaggtgaataatctatcacttcaattgtcgccgcacttgacaaactggtagttgactgtgaggtggccggcctggaagccctggccgttggtgtcgatgggcttgaacgccgtgtcccagtccaagtccaggccgccgttgctgcactggtccaccatcctcaccgtgatggacgcccccgtcgcactgttagtcacctgcatcatgcatcagtacaccattattaaccccgatcgagcacgggtctcatcactcatgcatggcttcatttcatcagctagcttgagctca

SEQ ID NO: 26438 - DNA, 467 bp, Zea mays
  Clone ID: cC-zmle189099d03a1
gattacttgcctgcgacagccttcaaatcactggcatggcacgtcatttaataaaagtaaaactcacatgaagcaaattaccttaccacggttctcaaactactctagaataacctgggctagcaataaacagctcacgatgttacaacaaaaggctttccatatccatggcctgctcatattcatcacttgtactccaatcagctttctttcgttcgggccaacaagttgctgcatttaagctttgctggtttcagggtttgtcacgccaccacccttcccagttcccaccaaggttggcaacttggcaccattctgtgtcaacttgactgggccaaaattaaatcacatctacctcaaagattttctagtagtgcacaaccactgcccgggcttttcaatatcatcgcctgttgttgttggtacatgccagcttccatcttcagattcctgaataacaattgaat

SEQ ID NO: 26439 - DNA, 426 bp, Zea mays
  Clone ID: cC-zmle189099d04a1
gtcggacttgatccagtccaaaggagacgttgaatccaaaccaaaagcgttcaaggacacaagtacttcatgtttctcatgaatcttcggaggaacttggccacatttaaacttgtaaaaagcgttacacacagcatcgtcctggatcaaaccccgcaccattagccaattcatttggggggttagttcatctgggatttctctgctgcaaggattagttcgtatttacaggtgtattgtacagcagcaggttaacatgtcgatgatggtgtcagcttttaagagtggtggcgagcgcaaaccctccccgttcatacatgcgctggatttcctaccggtactcagacagaaacttgtcagggagcgcaagctttagtttcaccacgttggccatgctgagcttactatttgggtcgcttatgggct

SEQ ID NO: 26440 - DNA, 212 bp, Zea mays
  Clone ID: cC-zmle189099d06a1
cgaacaacaacaaaggggggatgattcacaaataaacaagtccttgctggcttacatgacgcacttcctacagaagcaaagcagcgccgacagagaaaccagcaacatctaactacaacacaaggggaacattaacacaagaaaagcctacaaagggcgagcgtgcagcctaggaggaggtgaacttggtgacggccttggtgccctcaaaa

SEQ ID NO: 26441 - DNA, 334 bp, Zea mays
  Clone ID: cC-zmle189099d07a1
tttttaacttagttttcgtcattactcacttatcatccagcgaggcaatgcaaccagcattgacatgcactgtcacttaacaaacacggcagatacaacgttcatttgtcaagatacaagggcctcattttgtctctctccagggccacgaaaaaggcaataatgtttacagctgcatacccatagaaacaaaacagacaggcacaaggcatataaacctccattccgttctcacgaccagctcctgctggcattcatggccgcccggacaaaaccttcgcatgtcgcataaccactcgagaatccatccgtcaatgcccccatcacatcaaag

SEQ ID NO: 26442 - DNA, 284 bp, Zea mays
  Clone ID: cC-zmle189099d07d1
gaagaaggaaaataatggggatggcttccttggagagaagattcaatagttgcggcacgctacaagggatgagattgttcggggtgctcttgagaaaagagtgatgctacttcagggaatgggaatgcgccaagaatttgcttctgatggaggtagacgtattgttgtatctcagcctacaattgaaggtttggatgatgtggaagaagaagaggatggtgtaacctgtatggcttgttgagaagggtacaccttaagaccaacagacatgttgggagtctatg

SEQ ID NO: 26443 - DNA, 540 bp, Zea mays
  Clone ID: cC-zmle189099d08d1
cgggacgcgtgggcggacgcgtgggcggcgaccgctcctgctactactgttgcgaggccggccacatcgcccgcgggtggggtacgtgaggtgtgtccgcgtccgtccgtccagccagatcagatcggatcgctccaccacctgctggtctgatggcgccgcccccttctagatctcgcttaaaaaacacccccctctcgctgtgtgtcggagtaccgctttagttttgccgatccgggcacgagtgcccgctgcctctttcctctcatgcgtaagaggatcccgtccgccgttttcagatttcgttcggttcgtagaagaactctcaagttaagttaagttgtgatggtgtgtgcttggtcgttgttccgcgtcggcgctaaggttttaagagatgatttggtcctgtgttgccgaggggaaggcgaatctgctttttctttttttgggggtcgtccacccagactgaggaatgagatgagatgattattttccctctttagacaaatacactaaattatttcttttattctttccttt

SEQ ID NO: 26444 - DNA, 414 bp, Zea mays
  unsure at all n locations
  Clone ID: cC-zmle189099d09a1
tttttctttttctttcttctcatcaacatcctcaacctttgcttgctcagcatctttcttctcttcctcgtcttcgncgncagaaatttccttctctgttgtcttttcagnccacagggagatggggtagctgatgaactcagagtgcttcttgaccacatccttgaggcgacgctcctcaaggtactccagctgatcgtccttaaagaacagtgtgatcttagtgcccctgccaagctgctcccctgacgtgtcacgagtaacagtgaacgacccgcccgcttgggactcccacacgtactgctcgtcatcgttgtgcttggtggtcacgacaactctatcggcgacgaggtaagcagagtagaaaccgacgccgaactggccaatcatggacacatcagcgccggcagcaag

SEQ ID NO: 26445 - DNA, 463 bp, Zea mays
  unsure at all n locations
  Clone ID: cC-zmle189099d10d1
ggacgcatgggagagaaaagngaacaaataacctaaataaacaatggatattaaaagaaaaaagtattgttcctcgaaagaataaattaaaaaaaaaaaaaaaaaaaaaaatttaaaaaaaaaaaaaaaaaaaaaaaaaaaaaataaaaataaaaaataatataaaaattaaaaaaaaaaaaaaaaaaaaaaaatatctttaataaaaaaaataaaaaaaattaataaattaaaaaaaaaaaaaaagggggccctttaaaaaaaataaaatttatttttcctttttttaaaaaaaaatatttttttttaatgtactaaaaaaaaaaaaatatataccctctaaaaaaaaaatgggaaaaaaaaaaaactccttttaaccaaaaataaataaacttttaaaaaaaaacttttttttcctctttttggtaaaaaaaaaaaaaacccacccctaaattttttttaa

SEQ ID NO: 26446 - DNA, 406 bp, Zea mays
  unsure at all n locations
  Clone ID: cC-zmle189099d11d1
acgcgtccgnttttttttttttttactagtataatagttcatactttatttgcgtgtgacacatacatacacggaaggcaatccaacccatctgttcatcgtttcgggccctcaaccaccgccactgcaccaccaccattattattactccactattcttcgtccacctcttctcccaatcccattcccataggacaaatatttttttaaaaaaaaaggagattaaaatcaaaggaacagcgtaataataataacaccgaagaccttgtccgcacgccttcctcctccccttctccgccctgcgagcctttgngctgtgaccttccttccttcccgtcatcagaacctaacgaccttggccgcgcgcaccaccgggttctcccgggcgaaggcgtcccgggcggcg

SEQ ID NO: 26447 - DNA, 434 bp, Zea mays
  unsure at all n locations
  Clone ID: cC-zmle189099d12d1
acgcgtccgggcgttcaagaagcagaaaggcagcgcacttgtangtactggaggcacaggtagcacagataggaggggagaactcttcgctgctaaggcgactcgctgacgttaatcagaagttcaatgaggctgctgttgacaatagggtgcttaaggcagatgttgaaaccttaagagcaaaggtgaagatggcagaggactcagtgaagcgggtaactggcatgaacacattgttccctgccgtgtctgatatgtcgtccctcagcatgccattcaatggctccccatccgactccgcctctgatgccgccgtacccatccaagatgacctgaacagtgacgtcgccattccaagcgagatcggaggcagcgacgggtacatgccagatatagcttccttggctcaagaggacgaccattttcgtcaacgg

SEQ ID NO: 26448 - DNA, 212 bp, Zea mays
  Clone ID: cC-zmle189099e01a1
gttgatagcctaataaagcccattagcgggaggtgagcatatttgttttcacagatgaaccgtgtgctataattgtgagcagtaacattttacttgctcaaattagtcagtacatgcgtatcaactactatacatcgatgtggttcctacaagctgggctctccattgctttgggattgctcgctctgacacaaaacaccgaaaagcttacc

SEQ ID NO: 26449 - DNA, 435 bp, Zea mays
  Clone ID: cC-zmle189099e02a1
gaacagaactgaactgcatagctgacggaatttttaacagatctgagcaactcaaataacataccgaaacacaccgccagcgacagacaaagtacggcatggtcgctcccatctccacgccccagttcatgcggccacaggttgtacatcaaagcagaaaaatacaaaataaaaacaaagctacaccacagaccaacacgttctcctatcgctctataagacgacacgggaccatttgatcaaaacctggagacctatgtaacgcagacacagcaggtcttgtctaagcagtccgcagcaggtttccgatctcacagttggacgtccctaccgtatacccagctgaaaggcagcgtgccggctttcttggctctgctctgggccctctctccagcctcctgattcttgaagcaagggtgcaaaggtagtcctgcg

SEQ ID NO: 26450 - DNA, 402 bp, Zea mays
  Clone ID: cC-zmle189099e03a1
aggcaagggcgtgatcagactgcagactgatacgaaggcacattgaccacaacaaatcatagtcaaacctgcacattacttttgagctcgtttcagtgacttaggcagggtacaatcttgctttattctatattatatcattgatggtgataacacatattcccagactgacacgtgagcaactcatttacataccaccacagcaaggtaagcttcgcaatccaatagagggctgcttaaaaataggcctaaatcatctcatctcccccttgaagagatatatcacagtacagaaggctgacaggcaatgccacagagatcattacaccgtgtcgttatggaaccaccatctagtctcctttggcgacctcccgttgcggcagtttctaacataacggtcat

SEQ ID NO: 26451 - DNA, 240 bp, Zea mays
  Clone ID: cC-zmle189099e04a1
aggcaaaaatacatactgatcccaaccttgaacataaagcctttcatttgaggcgcgaccacgtttttttccaaataaaaaaaccggctcgctacgcaacaacaaccatttgatttttacattgccaatggaaaacaatcttattgaatggggggggacccaaataaaactggcagcgaccaacaacagggttaataaaatgcaatttacacaggtaaactacaaaacttttggtttaaa

SEQ ID NO: 26452 - DNA, 335 bp, Zea mays
  Clone ID: cC-zmle189099e05a1
ctggaggactgggggcttttttggtcatctctaccaactaaggcgagataaatccgactaccaatactagcagccacacgctcgtagaagcccagccaggcccagaggctatgcatttagtaaagaccctttggtggggacatgctggccttgatggtcaagctgcccacgttctgccagcccttcttcaggagggagacgaggtacttgatggccaacatgatgtttccgatgagctcatcctcagtcatgtccacgttgccgacagccacacccatacagagcaccttcttcaactggaacttgatggtcgacttgacctcggcgatctttcc

SEQ ID NO: 26453 - DNA, 435 bp, Zea mays
  unsure at all n locations
  Clone ID: cC-zmle189099e06a1
tttctctttttttacatcttttttcttttttttaagcctggttttttttcttgcgnaccaacctatcccttacttactcacaaacccttaaaaaaaatacaaattccccctttaaacccaaaacatcacattatttcacgtaatttggcagcatttaaccttcttccttttatcatgcatccatatcccacacctatagtttacccatccacatttttacatcctttatttaacttaacctattttaaccttcagctttacatttatatcccccatttcaaatttttacggatcaacatttacatccaactttcttttgtcccttaatcctttccaacattttccgattattctttaacccaccaaacgaaacttcccttttttacaagtttaacctttttcttttaaaatggaaaaccccccctttcttttttt

SEQ ID NO: 26454 - DNA, 386 bp, Zea mays
  Clone ID: cC-zmle189099e07a1
gaaaaaataagatgggagtacttgtaggcctggacgacacctcaagacaagtttggatacctgaaaatacaatgcattttgagagaccataccacaagtttaaggacttcggaatgatcaccaaacaagaaaatctgaattaggccattggtaatggggtaattcctttgaactatgcctctttatgtatctgtggggtagccacagggctttaacatgagcaagctatacaacatgccacatcacgtttagctaacaatatttctttactctagttggtgcaagtggttgccgcggcctctgtcttctttccaggcgcgaaagatttgccgcacccacaggtttttgttgcgtttggattctggaacaagaagccgccaccaatg

SEQ ID NO: 26455 - DNA, 427 bp, Zea mays
  unsure at all n locations
  Clone ID: cC-zmle189099e07d1
ccggcaatttcattgactgaaaaggccttgaaacatctgaattttattatagctgaacggaatgaacttttgtggttgggaattggagtgaaacagggtggatgctcaggcatgtcttacaccatggaatttgaaaatcgagagaatgccagccctgatgattctgttgtagagtatgatggttttgcaatagtctgtgaccccaaaagccttcttttcatgtttggaatggagctggactacagcgacgccctcattggtggcggcttcttgttccagaatccaaacgcaacaaaaacctgtgggtgcggcaaatctttcgcgactggaaaggagaccgaggccgcggcaaccacttgcaacaactagagtanagaaatattgctagctaaacgtgatgtggcactgcgtatagcttgctcatgtt

SEQ ID NO: 26456 - DNA, 436 bp, Zea mays
  Clone ID: cC-zmle189099e08a1
acacatctcctcatggccacggtactttcttattcttagcaaggatgccatggtaacttcactccgcatccgcaaatatccaaggctgcaagcagcacctgttatttgaattaggacttatagactatacagagacaagcataagtatatagtatcaacttcttgaactattgacacctttaggtagaaggttggtacatggttgtgctcttctggagtgcccaagccttgtgcttcagcttgatgaagtccgaagctattggatccacatccttattcttggcatttttcgtcccataaccatacccaccggttcctggttccttcatggcattagcttggttatcctgaaatttaacgtgtttccactgggcttgggaacgagggggctgggcttgagacattggtccttgcttaaggtattgaaaaaatggaa

SEQ ID NO: 26457 - DNA, 385 bp, Zea mays
  Clone ID: cC-zmle189099e08d1
cgcggacgcgtgggcttccattttctcaataccttaagcaatttcctatgtctcaagcccagccccctcgttggcaagcgtagtggaaacacgttaaatttcacgataaccaagctaatgccatgaaggaaccaggaaccggtgggtatggctatgggacgaaaaatgacaagaataaggatgtggatacaatagcttcggacttcatcaagctgaagcacaaggcttgggcacttcagaagagcacaaccatgtaccaaccttctacctaaaggtgtcaatagttcaagaagttgatactatatacttatgcttgactctgtatagtctataagtactaatttagataacaggtgctgcttgcagccttggatatttgcggatg

SEQ ID NO: 26458 - DNA, 245 bp, Zea mays
  Clone ID: cC-zmle189099e09a1
tctatttttataacgaaagaaatcacccaacagaaagatttttttaaataaaaccctcccaccacacaaaaatatccgctaacacacaccctaatgccctgcaaacataacatccaaccacacttctaaatcatctaacacccttaccttataattacacactcgactatcccggttataagagctaactaatacctttgcttccactcacatactctaaaaggataccgctagacatacccatc

SEQ ID NO: 26459 - DNA, 316 bp, Zea mays
  Clone ID: cC-zmle189099e10d1
cgggagagaaagagggcgaaatggtgaagcacaacaacgtttatttttacgggcacttcaagaagcactggcggagcgatgtcaagacatggttcaaccagcccgcccgcaagcagaggcgccgcatcgcacgtcaaaagaaggctgtgaagatattcccacgaccaactgctggccctcttcgtcccattgttcaatgccagactctcaagtacaacatgaagtcaagggctgggagaggctttacccttgaggagttgaaggctgcgggcattccaaaaaggcttgctccaaccattggcatttcttgtgatca

SEQ ID NO: 26460 - DNA, 446 bp, Zea mays
  Clone ID: cC-zmle189099e11d1
gacgggcggatcagccaaagctggggttttcgaccagtatttcgtgaagagcaaggctaacaaggaacttgactggcggaatatgcttgccaccagcgctgccaactttgcgcgcgcctacacagtcgagttcggcagctgccagttcccctacaacttcactgggtgccaggacctcgccaagcagaagaaagtcctctttcttaacgacgacctctagatcgagtgcgaaggtgaggaaaagttcaagtgccgcttccacgtctttttgaagtggagaagccgcccgcgtctgatatgaccgaaacctgtgtatctagaagatgcattgtcccagactgcagggaaaaataatttcaaatttactggtttttcttgcaaaaaagaaaataaagctttaaaaattccttttgattccaattccttctaatctcttaattataaaa

SEQ ID NO: 26461 - DNA, 322 bp, Zea mays
  Clone ID: cC-zmle189099f01a1
gattagatatttttattaaattattcctttaccttcccccaccaatatgctttcccaattatattacttcttaatttaaaacgaaaagaattttttaaaaaaaccattcctcactcgcaaaaaaccgcaaacgaagaaaaagcttacttattcacaggtggggaaatcttattaaaaaaaaaacccccccttcaaaagcaaaaaaaaaaagggcgtaaaaaaaaacgctctcaaaggcctttaacaacattatacataaaagctacgcccgcaactaaaaaaaattgacctcgaaaaaaaaaaaggaaccaaatgggctttt

SEQ ID NO: 26462 - DNA, 416 bp, Zea mays
  Clone ID: cC-zmle189099f03a1
atagggaatagtttcatttttggtagggtggaaaattacagctcagattgacgaacaagaaaattacagctgacggcagttcgtacgtacgtgcgtgtaaatgtaaaagacaacacagtacagctccaagtttttttctcagggatgattcacgttcacggggcggcgattcgttgaagcggaggccggcggtacgccaggcacccccggaggaagaaccggcaccaggggtggaagaagctggggcggcggtggcggcggcggcggcttaaccaacggcaacaacggcggtattaccgacgacggcggtggctgtgggacaagcggtggcaggacggacggcggagacggggtaggcaggagcggcggcacgagggacggcggggctggcgtgatccggttgggcgggatgggca

SEQ ID NO: 26463 - DNA, 355 bp, Zea mays
  Clone ID: cC-zmle189099f04a1
ataataaatttatttttttaaaaaaattgtgccaactaaaattttacaaaaacccacaactcccatctgaaaatttcacatgtatgcctctcctttcgtctgaaaaaatttatacaatgtttattatacaattattatacactctaaatccaccgttcaaacccaattttttccaattttaacagttaaaattatgcacctctactgtgggttcttatttttcccttttattcgggaactgacaaaccgatcaacccattttttttcttccctttcaaccccttcccaccttttttaaaaatcacggagctcggatccccattttattccaattttttttcccattataaggccc

SEQ ID NO: 26464 - DNA, 329 bp, Zea mays
  Clone ID: cC-zmle189099f05a1
caatcgcaaagatcggatggacatattgcaaagtacatcagatgttcgctatgacacggacatgctcaaatagtcttgacaagaaaagacacttcaacagaagctggcgttgtcaaatggttatgcttattttcaagccaaatctccacagaattcactttgccatgctcttcagagagtgagttttaaaaaacatttggaaaaaaaaactttattgtttacacgtaggaactacttctggacgacaactctgatctggcccttgtcaagcatgtcggacaaggatctaggtttcctctgctcgttccaaaggtgcatcttccacatac

SEQ ID NO: 26465 - DNA, 459 bp, Zea mays
  Clone ID: cC-zmle189099f07a1
atcaaagattgtaatccattagggatgatggagtcgataagatacatcattataatatgtctttctggcacaatagggatattttgccagtaacacttaaaccttataggagtacatattccattgtatacccgtgctgcagttctcaacagcacggcagaacttgtctcatgcgcaggggatgaatgcagcccacttggtgatctagcagaagaaatcaactgcacggggaaggactgaaaacttggtcggcagaaagccgaaatgctctccgtcagattgcacaaagacgccaccgctagccaccacctctgctacttcaattgattggaccctcattgacgaaacaccattcactgatagatgtgtacctccatagagcctgtgtagcttcagaatagagccgtaccatttgaaatcttgaagaataacaacctcaaggttgccactaaacggatc

SEQ ID NO: 26466 - DNA, 431 bp, Zea mays
  Clone ID: cC-zmle189099f07d1
ccggcaatctcataggctgaaaaggtcttgaaacatctgaatttaaatagagctgaacggaatgaagttttggggttgggaattggagtgaaacagggtggatgctcaggcatgtcttacaccatggaatttgaaaatcgagagaatgccagccctgatgattctgttgtagagtatgatggttttgcaatagtctgtgaccccaaaagccttcttttcatgtttggaatggagctggactacagcgacgccctcattggtggcggcttcttgttccagaatccaaacgcaccaaaaacctgtgggtgcggcaaatctttctcgactggaaaggagaccgaggtcgaggcaaccacttgcaacaactagagtagagaaatattgatagctaaacgtgatgtggcatgttgtatagcttgctcatgttgaag

SEQ ID NO: 26467 - DNA, 310 bp, Zea mays
  Clone ID: cC-zmle189099f08a1
caaaaacaccatacattatcttggggaaagttatatctaactactcgcacataaaatctatcaatccaagataaaacccatacttatagactcataacaaaatgctagctgcaccagttactatcacacacttacaccgacccattaatgggaacacccactactcttatgcaaaggccaccaaactttgctctcaacataacaacaaacaaccggccttatgcgtgcaacatcttctcaaaaaaaaacccaacgctactaacaatcaaaccacttgatctagcacgaacctggccattcatccaaacac

SEQ ID NO: 26468 - DNA, 441 bp, Zea mays
  Clone ID: cC-zmle189099f08d1
tgcgcggacgcgtgggcttccattttctcaataccttaagcatgtacctatgtctcaagcccagccccctcggtgcagggttcagtggaaacacgttaaatttcaggataaccaagctaatgccatgaaggaaccaggaaccggtgggtatggctatgggacgaaaaatgacaagaataaggatgtggatacaatagcttcggacttcatcaagctgaagcacaaggcttgggcactccagaagagcacaaccatgtaccaaccttctacctaaaggtgtcaatagttcaagaagttgatactatatacttatgcttgtctctgtatagtctataagtcctaatttaaataacaggtgctgcttgcagccttggatatttgcggatgcggagagaagataccatggcatccttgctaagataagaaagtaatgtggttatg

SEQ ID NO: 26469 - DNA, 231 bp, Zea mays
  Clone ID: cC-zmle189099f09a1
ccccccccaccaatttttgggaaaaaaaattaatttccaaaaatcccctttgccaaaaaatccaaaaaatttttatcctttcaaaaaaccctttttttttttttttaaaaaccccaaaaaaaaaaaaaaaaatcccccccccggggtttaaaataccaccccgaaataaaaaaatctccccccaaaaaaaaaaccaaaacccccggggggcgaaaaaaaaacacccccccc

SEQ ID NO: 26470 - DNA, 484 bp, Zea mays
  Clone ID: cC-zmle189099f10d1
gggagagaaagagggcgaaatggtgaagcacaacaacgtttttctttacgggcacttcaagaagcactgggggagcgtggtcaagacatggttcaaccagcccgcccgcaagcagaggcgccgcatcgcacgtcaaaagaaggctgtgaagatattcccacgaccaactgctggccctcttcgtcccattgttcaatgccagactctcaagtacaacatgaagtcaagggctgggagaggctttacccttgaggagttgaaggctgcgggcattccaaaaaggcttgctccaaccattggcatttctgtggatcaccgccgcaagaacaaatcccttgaggggctgcaggccaatgtccaaaggcttaagacatacaaggccaagctggttatctttccaaggcgtgctcgcaggtcaaggctggtgactctactctgaggagctaccactgctacccaggacagggtgactacatgccaatta

SEQ ID NO: 26471 - DNA, 368 bp, Zea mays
  Clone ID: cC-zmle189099f11d1
cgcacggccggatcagccaaagctggggttttcgacgagtacttcgtgaagagcaaggctaacaaggagcttgacgggggaataggcttgccaccagcgctgccaactttgcgcgcgcctacacagtcgagttcggcagctgccagttcccctacaacttcactgggtgccaggacctcgccaagcagaagaaagtccccttcctcagcgacgacctctagatcgagtgcgaggggaaggagaagttcaagtgcggctccaacgtcttctggaagtggcgaagcagcgcgcgtttgatatgacggagacctgtgtatctagatgatgcatgtgcccagactgcaggaaaaatgatatcaaatttgact

SEQ ID NO: 26472 - DNA, 312 bp, Zea mays
  Clone ID: cC-zmle189099g01a1
ttttttttttttttttttttttttttttttttttagtttgttttttttttattatattttacaacaccaccattacttattaactaaacaacccaaaccaaaaacccactaaatactaaaccatcaactactaataaccaaaaaaaaaactaattcctcctaaaaaacccccacaaacacttaaaagtccacccctaaaacataaaattccccaaaatatcaaaaaaaatacccaaaaaaacatcattccttaacaaaaaaaaaataacccccctctaaaaaacaaaacaccaagcccaaaaaacccacccc

SEQ ID NO: 26473 - DNA, 392 bp, Zea mays
  Clone ID: cC-zmle189099g02a1
caacgaatatccccgcacatgtaaggttaggtactacaaggtaagcatttttgcttcacttagaccgactgtagaggcttaattgggagggcaaaacggcactgttaacacctcaaacagtgattgcctgcccagagaaatgtatactgtctactacaactccgattatatacaacccactgactggctggctgactgactgactgatagagaaacccagagtgctgctctacatgctaatagaaggagctaagcttgatcagcaacccgaaaggactcggcgccttcgcaggcatcaggcatcagccgatcttctccgtgctgctgtcgtcggttggccagatgaccggcttcatcagccgctcccgcatcagcgccaggttctcgtcgga

SEQ ID NO: 26474 - DNA, 369 bp, Zea mays
  Clone ID: cC-zmle189099g03a1
ttgtacattggcaggatcctttcaattcatgagaggatgggtcaacaaccgctacattacgacagccaccaccatgagcaaccggggctcttgatgggggcagaacgacgacgacagactacaaaccaatcactggggttcttcaatgtttcgacaagcctggcgaaccagaaacacaaggagtgggtgtgtttttttttcacgctttcttattgtgcccctatcgggcacggcgagcatccttatgcactagtcggctgtccagctctgctccacgatctcacggactttgcggttgtactcccgcttgttctcgctgaacagtcttgctgcttctgagtttgcaggggagtttgggtttggaacacc

SEQ ID NO: 26475 - DNA, 381 bp, Zea mays
  Clone ID: cC-zmle189099g04a1
tttttgtttaccaatacaaaagtgattttacatgtgtggggagtctgaaacaacaaagttagaaggcacaggttggcacgtttattcaggatggtgtgattgttttacatctgtatacaacgtagcaagaagctcttctcgcctatgaacatggacagagcccaccgtcttcctctatggtagaaatgggttctgagaggaacacagttccttttgccgttgatacgctcttgatgcgctgaaggcgccaaaagaaactgctgcaaacattatgagtagaaacggggctttaaccaacgttctatttgatcttccgtggctagttggaacaccagaacgcataacatgaacttccatcctactccctgatcttcttcctgc

SEQ ID NO: 26476 - DNA, 465 bp, Zea mays
  Clone ID: cC-zmle189099g05a1
gccagtaatccaggggcatgaataccacaatataacaagtttgcaaatcttgcttcgtttacaggctcggcaacacggcaaccaaacctcataccaatagagcttagatagcgcttcagctagtgtcatgcatagcgactaaatgatatgcttacaggaacttattaacaaacaccacggcgggagcttcatcgttgataattgaatttgcatctggctgaaggttcacggccctccacaggtcccttcaaaaggagaaccagcttcagtgagcccgctcccggagaacctcgatgtccacctccgatgggtcggtcgcctggatttcgtaatggaacccgtaagctcgtacttgatgcggtccttcgacgtggagtacagcatcttagcacgtatgcgggatgtcgatggggaccaagcaatgaagaaaatcttgcttttcttcacattcttcccagtaacaaa

SEQ ID NO: 26477 - DNA, 255 bp, Zea mays
  Clone ID: cC-zmle189099g07a1
gggtcttcctcctgcttctcctttcggagaacatgccctggtaatcgaacgccgcgtcgggcccatcgtcgaacgggtccagccacgggttcttctttttggcagaccatgccgccacgctccggcggtggccggtggaggggaggaggaggtacctgcagcattgccgcggcggcgcggggggcttcgctggcgccgtggtggccatggacgtcgacatggtcggcgtctgcatggcgcgctagcttagctttc

SEQ ID NO: 26478 - DNA, 310 bp, Zea mays
  Clone ID: cC-zmle189099g07d1
acgcgtccgcccacgcgtccgcccacgcgtccgcccattcgttcgaggcaaacaccaagaagctaagcgagggggccatgcagacgccgaccatgtcgacgtccatggccaccacggcgccagcgaagccccccgcgccgccgcggcaatgctgcaggtacctcctgctcccctccaccggccaccgccggagcgtggcggcatggtctgccaaaaagaagaacccgtggctggacccgttcgacgatgggcccgacgaggagttcgattaccagggcatgttctccggcgggaagcaggaggaagaccc

SEQ ID NO: 26479 - DNA, 156 bp, Zea mays
  Clone ID: cC-zmle189099g08a1
attatgaccatgcatatatgatggggcataccacacatgataatgtgtgtcgtcttactgcattattacatatatagatagagagagatggatagaggagatttcccaaatatcatgaatcagtagtagggcgtctccgctgccattccgccctac

SEQ ID NO: 26480 - DNA, 161 bp, Zea mays
  Clone ID: cC-zmle189099g08d1
cgggagggcggaatggcagcggagacgccctactactgatttttgatatttgggaaatctcctctatccatcgggtgggtatctatatatgtaataatgcagtaagacgacacacattatcatgtgtggtatgaccaataatatatgcatggtcatacatg

SEQ ID NO: 26481 - DNA, 211 bp, Zea mays
  Clone ID: cC-zmle189099g09a1
cttccgaggcaaacccccaagtaaaattccaaaaacaaatgaggcatgccccaacgtaaaactcaaaatttggaaaataagtgatcaaaaacaaaaggttgatgaataaaaaaaaaacaagtccttgcttggttacatgacccaattcctacaaaaacaaaaccccccccccaaaaaaaccacctacttttaactacaaaaaaaggggaac

SEQ ID NO: 26482 - DNA, 280 bp, Zea mays
  Clone ID: cC-zmle189099g09d1
cgagccaacatatctcctcgcatttccttgcaaccgattgtctttttcttctcccaacccaagaccgatggcggggggggtcgataagaagcccgcggcgaagaagccggcggaggaggagcccgcggcggagaagacgaccgccgggaagaagcccaaggcggagaagcggatccccgctggcaagtccgccggcaaggagggcggcgagggcaagcgtggcaagaagaagggcaagaagagcgtggagacgtacaagatctacatcttcaagggtgct

SEQ ID NO: 26483 - DNA, 378 bp, Zea mays
  Clone ID: cC-zmle189099g10d1
cgcccacgcgtccgcccacgcgtccgttcgtctccgcctttctacatcctctagaattcgattccctttcccgggaggcaagaacccagccccccaccatgacgagctcctcctctccttccagaaaggcgctgagcaagatcgcttgcaatcggctgcagaaagagctcgccgagtggcagcaaaacccccccgtcgggttcaagcacaaggtctccgataacctccaaaggtgggtaattgaggtcaccggagcggcgggcaccctttacgccggcgaggcttaccagttgcaggttgactcccctgagcattatcctatggaggcacctcaggtcatttgggtgaatccagcgccaatgcttccacacttttaca

SEQ ID NO: 26484 - DNA, 300 bp, Zea mays
  Clone ID: cC-zmle189099g11d1
atcattccagcaacgatcgtataatttataaactttcctataaggattcgaagcgtaccaaagaggcgagtgatacttaagatttaaagcataccacaaactcacaggattatgtttttctggggtaataacttacaaatttcaaaattttagtgaagaaacttatttttttcacaagaatacatatattcaatcataaaggaatacccatatctgaaaataagagctttcgttcgtaacatttgaccaaaaagaacactgattcacaggcgtgcgcgacatatagtcatcttgtccaat

SEQ ID NO: 26485 - DNA, 430 bp, Zea mays
  Clone ID: cC-zmle189099g12d1
cgcgagtacctctccgacgccacggcaggaagcctatcgacttatttttacgtcggcggcgtgctgggagggggcggggcgggccacatctacgaccgcctgaacgcgcgcgcgatcacggacgcgagcttcacttactgcgcgatccccgcgctctttctgtaccgcacgtacgggagcatgtcgatggcgtggaacgtctcgctcatgttcgtcacggggatgttcgtgaacgggccctacgcgctgatcacgacggcggtgtcggccgaccttggcacgcacagctcgctcaacggcaacttccgggcgctggccaccgtgacggcgatcatcgacgggacgggggtctgtcggagccgccatcgggccgctggtgacggggtccgtcttgtcgaggagctggagcgcccgtgttcaccatgctgat

SEQ ID NO: 26486 - DNA, 308 bp, Zea mays
  Clone ID: cC-zmle189099h01a1
ccgaaacactactttagacatatgcatgtatattggtcttcaagtatctggctagtttacagcatctggtcgcgcaagcagtacggaacctgggatggagtctcctggcgtgctactattatttacaaggagaaactcctatacatggtagatctctttgctgctactcagaaacaccatgcccgggcacatctacatatttacaagaggctgtggcttccgagcatgggtatctgcgctcctaaatcttcaacatgccttccaacacgcgaagaacatcagcgcgggtaactatacctattactttt

SEQ ID NO: 26487 - DNA, 455 bp, Zea mays
  Clone ID: cC-zmle189099h02a1
cttaatattcagttaagaccattccaagggtccgtttcgccatgcataaactaaaccaacaactaggataagcacaaaaatgaaagcttcgataaaaacggatacacccaatacgtcgaaactcattgcccaagggtagagaaagactgtttccacatcaaaaacaacaaaaactagcgcaaacatgtaatagcgtattcggaattgtaaccaagccccccccatgggttctatacccgattcataactagaaagcttctctggtccttcactaaccggggctaaaagtcctgaaatccaaaataccaaaataggaataaggcttgctattattagaaattgtcaaaaaatatcatatttcgtaaagcagaaacataaattgtactcccattaatgtggaataggcggaactgaattagtcaattcaagttgacattgtcaatttatccagaact

SEQ ID NO: 26488 - DNA, 153 bp, Zea mays
  Clone ID: cC-zmle189099h03a1
catataacaatacaccatctatcttataaaaaagataatttttaatttctacataactcatcccaaactatacctttaccccaattcaacttttaaaacaaccaatcctcatactccctactactataatatcaaccacctaccatcacattt

SEQ ID NO: 26489 - DNA, 279 bp, Zea mays
  Clone ID: cC-zmle189099h04a1
aggcaggaaaggacatatttgccagctagagggttaacatccacatattaattacatgcatcacccttcaatagaacaaagcaagttgatgacgactgctggaagcaactgttacagcataaacatgacgcgagttgcgagacttgattcctcctctccagggacctactaactgacactctgatctgccgcccaatgcatgaaacggcacggcgagtcaacaccccaaggcagctagctctgcccctaagcatttggcggccagagctttgggtcttg

SEQ ID NO: 26490 - DNA, 290 bp, Zea mays
  Clone ID: cC-zmle189099h05a1
ggggagcaagttttcatggacaacaacaaatttactgtgtcaaatcacttcgttcaaagtcacttttcgatggtcctcgccaaaaatttattttgttcggaacaagcacattgttggcaaatggcacaagaaactagtccctacccagcgcagcaaagtgtgaaatgacataagacataaccgggaagactcatctttaccccttcacttgaggaggagcatcgccttggagggggggatctgatttgacggcatctagtgtcttgaagaactcctcaggaaaagcaacg

SEQ ID NO: 26491 - DNA, 348 bp, Zea mays
  Clone ID: cC-zmle189099h06a1
tttttttttttttttttttttttttttttttttttgtttgttttttttttttttttttttttttttcgaaacgggaaccccacaaaaatttccccccaccaaattttgtttttaaaaaacaaaccattcttttcaattttaaaacaattggaggaaatactccccccaacaaaaaaaaaaactttccaaaatcttccccttttccccgggttaaaaatttgatcccaaaacaaaaatgtccccaccaaaatttgctttttggctttaccggtttaaaaagggaaccccctatagggcaagcccctccccctccataataaaccaactaacccccttttagcttttagg

SEQ ID NO: 26492 - DNA, 136 bp, Zea mays
  Clone ID: cC-zmle189099h07a1
gggcataacaacttcccctaataagggacaaagcagactcctgggaaaaaaaggtaacagctaacaattccaaaaaaaaaacaacccgaaacaataaaaggaaaaacctgggccgccaaaaaaaggaccaaaccca

SEQ ID NO: 26493 - DNA, 308 bp, Zea mays
  Clone ID: cC-zmle189099h08d1
cgaaaaaaaaaaaaaaacagaaaaaaaacacaaaaacacaatttttataattaaaaaaaaaaaaaaaaaaaaagggaagtattaaataaaaaaaaaaaaaaaaaaacaacccggccgcctttaaacgaaaccaaggttacttccccgtccacgtcaacaaaaatattttttatgaggccaacaaaataaaattctctggccccaattaaaaaaaccactaacatgaaaaccatgggggtcaccgatttaaagtgctctagaacaatatcccttatgacatcttcaccaacaccgaaaaagtccacaac

SEQ ID NO: 26494 - DNA, 614 bp, Zea mays
  unsure at all n locations
  Clone ID: cC-zmle189099h09a1
cttttttttcttttctattttcattttttaatctttgggtttgtgataatttaacaaaactaaaacaacaaccccatcaaaaaagaccttccaaccggccccccaagcccccaggccaaaggcctaccccacaaacaaacaaaaacttaaaaccaaaaaccttaagagaccctaacaaaaaaaaccaaaattaaaaccctaaaaaaaaaacacgaaacaaaaacccacaccaaaaattttacctctcaatttgttacaaaaaaatataaaaacccccaccctgagaaaaaaacaaaaaaaaactcaaaataaagggggggtaggtaaaaaaaaaaaacaaaaaatttaaatcaattaaggaaaaaagcaaaaaaaaaaccccgccccgacaactcaaataaaaaaaaaaaccccccataaaaaaatttaaaaaaaatttttttttccacacaaccaaagaaacccggggcttttaaaaaaaatccacaaatataaaacccgaacccccncaaccaaaaataaaaaaagcccacgtcttttttttttaaaaagggataaaaaaaaaacagggtcttttacataccctttttttttggaattttttaacccccccc

SEQ ID NO: 26495 - DNA, 173 bp, Zea mays
  unsure at all n locations
  Clone ID: cC-zmle189099h09d1
gcccacgcgtccgcggacgcgtgggttcaagcgccaattattttctttggacaagttgagctattggtacagtgtntgcacaaactactggggcgccatctacaaacacaaggctcacaagcatctcaagtggaaagctggctatgagtcagacaacaggcttggatgggcat

SEQ ID NO: 26496 - DNA, 296 bp, Zea mays
  Clone ID: cC-zmle189099h10d1
gcgcctgccgccgccacgccgcccgaaatccggaggggaattttttttgacgacgtagcggccagtggcagggggggcgatggcctcgtccaactccgccgccccggctcccgccgacgggggcgacgacctcgaccagctcctcgacagcgcgctcgacgacttcaccaacctcgatctctctgcctctgccgcccccaaaagctccggcgaggcatcggggtcaggatcgggaggcaaggggccagtgaaggggctggggctggggcttccggaccccaaagcgcctaaacggc

SEQ ID NO: 26497 - DNA, 388 bp, Zea mays
  unsure at all n locations
  Clone ID: cC-zmle189099h11d1
cggacgcgtgggcgaaccanaagaaagataccattgatgtttaatatgaagatcagttggagcctttgacagcaggggagcatgaagagaaggaacacttattagaggagggttttgcgtcatggacaaggagagacttcaacacatttattcgtgcatgtgagaaatatggtcgcaatgatattaaaagtatatcatctgaaatggagggtaagacagaagaggaagttcaacgttatgctagagttttcaaggagagatacaaggaactgagtgattatgatagaattataaaaaattttgaaaggggggaagcaaggatattcctcaaggatgagattatgaaggccattgggaagaagctagaccgctacaagaacccatggtt

SEQ ID NO: 26498 - DNA, 316 bp, Zea mays
  Clone ID: cC-zmle189099h12d1
ggaaagcatcgagatcccgaagtacgtcgacacagttacttttttttacaagccaaagtttgatgctgagagggcgggattaaaggaggctgagaaagagcatcataaggagtcagaaaggatagagaaggaacttgctgaaatggaggaaatgaggaaaaagatcagtacaatgacagcagatgattactttgagaagtaccctgaactcacgaagaagtttgacgatgaaatccgtaacgataactggggatattgaagagattggagagaactcttatgatgccatttccatgtccgcgaagaaccaataatt

SEQ ID NO: 26499 - DNA, 326 bp, Zea mays
  Clone ID: cC-zmle189100a02a1
tttttttattatttttttttctttttttttatttttttttgtaggatttaaaaaaaaacaacccctcaaccccccacccaaacaactaaattaaaaccaaaaaaaacaaaacccaacaaacaaaaaaaacaacttaaaaaaaaaccaatcaaacaacaacaaatcccaaacaaaaacacaactcgaaaccaaattaaaatataaccccccaaaaataaaacacaacaaaaaaaaccaaaacaaaaatccccaaaaacaaaaatactaaacaaaaaacccaaaaaaaaaaaaatacccctaaaaaaaaaacccgatggccgggtgcc

SEQ ID NO: 26500 - DNA, 465 bp, Zea mays
  Clone ID: cC-zmle189100a02d1
tcccccccgcgtcctcccacgcgtccgcccacgcgtccgaaaaaaatttattttttaaaaaaaaaaaaaaaaaaaaaaatagaaagatattaattaaaactatatataacctcccatctctcttacactttccttccactttattatttcttctttccccctcttttaaatatctatttttccccctcctttttcacccccactacttttttttttccttccctccaaacccttttttcctcccccacatttccccctttttcccttaaacattctcttcgttaccccccttatttatttctcttcccaatcccttttttcccattttttttaatttaattaaccctttatccaatctttttttctcaattttttttctcttttttccctaatttaccctcccctctttctgtccctttaccccccctcctttttggtttttcccctccttgttcccttcctttt

SEQ ID NO: 26501 - DNA, 409 bp, Zea mays
  Clone ID: cC-zmle189100a03a1
ggaagaccggaccaacttggtgaaataaattatttttgccaacttccatttacaaaaatttttacaacaacaggatggggaagttgactcctcaatttttatttgtgacaaatgcatcccccggttagctttgaatgaaacttactcacaacggaagttacaaggcctatttcacaggttaaatcattgacaaaaaattcccaggggtgggtacaaacgcatgaccgatttttttatgcgggcaggcccatgttttaccttttttttaggagaaaaaccccacggagcctgtgccgtgcatcatgaatttgaaaggaaatttttattaagaagttaacaacattggtgatctctttggccctttttactaagatcaaccccagggttttacttgcagatttttttttta

SEQ ID NO: 26502 - DNA, 518 bp, Zea mays
  Clone ID: cC-zmle189100a03d1
gacgcgtgggcttttacacgactagttctgcgaggctaagattagaaaaaactccacctgcctggctgatttcgtgaggttcggcggcttggagaagacgaagctgctccagaatccgataggaagtttggtgctcgcgtgttgacgggttgatttcggtgcgccgatggggcaggcgttccgcaagctgttcgatgccttcctcggcaccagcgagatgagggttgtgatgcttggtctggatgccgccggtaaaaccaccatcttgtacaagctgcaaatcggggaggttttgtcgactgttcccacgattggtttcaatgtcgagaaagttcaatacaagaatgtgatgtttactgtttgggatgttggtggccaagaaaagttgaggcccttgtggaggcactacttcaacaatactgatggcttgatctatgtagttgattcattggatcgggagaggattggaaaagctaaagctgcatttcaggcaataatcaatgatcctttcatgctta

SEQ ID NO: 26503 - DNA, 387 bp, Zea mays
  Clone ID: cC-zmle189100a04a1
ttttacttctcttttttttttttttttttttttttttttaggttttggtttttttttttttttttcccaaaccttcctctactcttttttttttcccttttattttctaaaaaaaccccgcaaacataacatttttttaaaaaaggagacccattaaaactttgcggaattttttccaatcacccaccccctttaaaaaaaaataaaaaaccaatttccccccctatatcggccctaaaaaaaaaggtttaaaacactgggtgctaaacaattaactttctcaaattaaaaagccaaatcttttcttccccctttcccaaaaaaaaacaccacccgccccccttattaatatatttatcaaagccccgggggaggggtttttcccaa

SEQ ID NO: 26504 - DNA, 464 bp, Zea mays
  Clone ID: cC-zmle189100a04d1
caccgtccgggacgcgcggaaaaaaaaaaaaaaaacaaaaaaaaaccaaaatttttttcatacataagcaccaaactctttggggagtgggttaataacgcgacaattttccctaaccactcacaagctcccataccttccattttttccccataccttacatcaattataactccagtatgtgaaaacccatctacttcaaccatatatgctaaaacacgcactttccccaagcaacatacctttatcgacctccgcgtttcaacaattgccagccctatcaaaagggccgccactggtaccaaccataacagcacaacagcttgaacaactaatgctacctgccatcaaccaagtaattaaggcaaacctttctccctactatccgcaacaacaccttcttacattcaaccaaccctatcacactgaaccctgctgtttattcgcagctacaactattacca

SEQ ID NO: 26505 - DNA, 381 bp, Zea mays
  Clone ID: cC-zmle189100a06a1
tttaaattggactcacaaacaatagtttaatttattagggagtggaaatttcttgaaagaataacatgactctctgatgtactacaacaagccacgagttccatttcatccaattcttccggacgcacacggtacacacaacagttacaggcaccataacgataacgatgcaacaacatatctcgcccacttcttaggacagccttataaaggcaccttctcacctgacgctactatgctcaccggaccaaaacctttgtttcccgtcagaggggacacgtcggaggggagctctctagctcactagctgctggttgccatatagcgggtacgtgccatacgctgcagcgtacatgttttggtgtggcaccggggaggcat

SEQ ID NO: 26506 - DNA, 589 bp, Zea mays
  unsure at all n locations
  Clone ID: cC-zmle189100a06d1
attcatnggttgaaccacccgtgcggccacgcgtccggcttttctccagcaagtaccgctcggtgaaagtgtgctaaagttattattgatgcaaacacagggcgtggcaggggctatggatttgtcaggtttggagacgacaacgacaaatctcatgccatgtctgaaatgaatggtgtatattgctctacgaggccaattcgtataggacctgcgactcccagaagatcttcaggtgattctggctcctcgactcctggtcattcagatggtgattcttctaacagaacggtatatgttggtgggcttgaccccaatgtcagtgaagatgaactgagaaaagcctttgccaaatatgatcttgcctctgtgaaaattcctctaggaaagcaatgtggctttgttcaatttgttagcagaactgatgctgaagaagcactacaaggattaaatggatcactcattggaaagcaggcagttcgcctttcatgggtccgcagcccatcgcataagcagtctaggggtgacttcgtcaacaggaggaacaacatgtactatggcacaccattctacngcggatatggctatg

SEQ ID NO: 26507 - DNA, 324 bp, Zea mays
  Clone ID: cC-zmle189100a07a1
gggcaaccaaaaaacaattaaggggaatccccaaaaacaaaaaaaaccaaaaaccccttttggcacctaatccggccaaaaaataaaaaatcacccccaaaattttttgaccacaaaccaaatagttagctacagcaacccctttttataggttataaaaaagcataaacccccccttaaaagggggtcacccttttaacctaattggtggttgacacctgtttcgaaacttgcccaacaatccatttgcaaaaactgataatactgcctcgggccaatccttaactcccaaaaaaagaaaccacctgcttttaaaaaaggaaa

SEQ ID NO: 26508 - DNA, 400 bp, Zea mays
  Clone ID: cC-zmle189100a07d1
tccggctcatcaggttgtcgaggatgggtatgaattctttgctgacagtcagcttgtcaccatattctcggctcccaagggttggggtgaatttgataatgctggcgcaatgatgagcgttgacgaaactttgatgtgttccttccaaattctgaaacctgctgagagaaaacaaatttatggggccaaacaaaatgtgagatagtgaacccattttgcttccagcagctctgaggctctcctgtggatgcatcaagacaacagcatgatggcgccaaacttgaggtcagcattgggcaagggcaactaccagagcagagaaaccaaataatataccatacctaactgttcgcctggaagttactcttcatggcaagtgtttgaattttctcttgttact

SEQ ID NO: 26509 - DNA, 312 bp, Zea mays
  Clone ID: cC-zmle189100a08a1
aaacccaaacctttttttttataccaagggggaccagtttttaagccaggcaacctatacaaaagccatttttttatttttttaaaaaaaagccctttccttttcttttcttttctaaagtttcttaaacccaaggcccaccctttgtttggaaaaaaagccccacaaaaaacttttctctggtgagaaacttttccttcggcccctgcccctgcccctccccccttcttagggtttttttaaaggaagcaaagcattccttggaaaccccccccttaatcccctttccctcccatttaggccctcaaaagg

SEQ ID NO: 26510 - DNA, 461 bp, Zea mays
  Clone ID: cC-zmle189100a08d1
gttgacccacgcgtgcgcgggaggagaggacatgggcagagactgcaagtaacaactgagaggacatatgaagggatggattatggatagagggtacgtgtgagtgagcagaccataccttgtgttgcatccaagaagatgctctgctgggccgccgccgccgcctcctcctctactgctgctgatgctgctgcgttggagtcggagtcggaggactccatctccaggtccaggagtaggagcaggagtgcagtcgtgtagatggagattgagatgcagcctactgcctactgcctgctgactgcctagatgggagggaaatgggattgatggttgggtctccatggattgctttgcttcctttatacatagcactaggaggggggaggggcaggggcaggggcaggaggaagagctcaccagcagagcagagtcatcagtgggcactatttaccaaacaa

SEQ ID NO: 26511 - DNA, 100 bp, Zea mays
  Clone ID: cC-zmle189100a09a1
tttattttttttttttttttttatatctctttccgggaagcaaaaatttaaccactccattatcattgacacactttacatttacatacaaatgaaatta

SEQ ID NO: 26512 - DNA, 256 bp, Zea mays
  Clone ID: cC-zmle189100a09d1
ggggattgacctggctactagctggatattgtcaccgtgattgtattatttttttgtttaacaaaagggtaggagtcgaggtccgagccggcgaaagaaaaaatactggagaaaaaaaaagagtgcacgaaggagacggaggcgagcgaacaggctggcctaatttcatttgtatgctaatgttacgtgtgtcaatgatgatggagtggttaaattattagtgaaaaaaaaaaaaaaaagaaaaaaataacactag

SEQ ID NO: 26513 - DNA, 369 bp, Zea mays
  Clone ID: cC-zmle189100a10a1
ggcactgatacaactatattccaaaacaggggcgcggaatctaagaggcccattacaatccggcacgatttatgaagcaggcaagctagctactggcctttgttcacccgacgagaacatcaacgatttcacagcacatacataggcggggaggggaggggtagaggacacgacgaagaacccttgtaagaaggggagacctaacaaatccgtggacgctggaggctgctcaattgctggtgaacttggtgacggccttggttccctcggagacggcgtgtttggcgagctctcctgggaggacgaggcgcacggaggtctggatctcgcgggaggtgatggtgggcttcttgttgtaccgggcgagct

SEQ ID NO: 26514 - DNA, 380 bp, Zea mays
  unsure at all n locations
  Clone ID: cC-zmle189100a11a1
tttttgtttgaactttagtgtactgacagctaataagggggcgggtctactcttccacatgaataggaagacctataggtacggtattgtattggcatgtatacaatgactatgcatctctcgcactcggtactgtgcaagaagagcagccacaaaaatcaaacaatagcgctactggcaccatacgaaatgaatgaacgaatagtgcgttccacttccaccgctgaactcggcagctgcggaccaaaatcttggacgggtgatgagatgagatccgccgcccgcgcgcgcagcggtttcactctgtcatgaggaggcggtgcttcttgaaggcgagggggctntgaaccttctcgtnctccttccacattttgccgggc

SEQ ID NO: 26515 - DNA, 359 bp, Zea mays
  Clone ID: cC-zmle189100a12a1
ctttttcttttttttttttttcttttttttttttcttttagttcgtttttaatttattttccctttccaccccccccttttctttactttttttaccttttttcttcccccccaaaaaacaccctctaaaaatataaaaaaaaaaaaatcccccttcaaaaaaaaaaaaaaatccctaaaacacaacatcccccccaaaaaaaaattaaaaaaaaaaaaaccccccccccaaaactttaaaaattcttccaaaaaaaaaacaagcctaaaaaaaaaccatggcccacccccccttttataaaaaaacaccccctatttaagattccccccctccccccccctttttttcccccttttcc

SEQ ID NO: 26516 - DNA, 407 bp, Zea mays
  Clone ID: cC-zmle189100b01a1
gaacagggaaaagtacatgcatgcgggcaggtatatatatatagctagaattattgaaaccacacgtctcatctcctgcgcgggcggtactgcatgtggtggcacaagacgacgggccctggcggtgtatagctagctagaattataggaggtcatcctccttgtgcgtctcgatgacgacgtcggaggtggggtacgcagcgcaggtgagcacccaaccgtcggcgacctggttgtcgttgaggaagctctggtcggactggtcgacggagccagagacgaccttgccggcgcaggaggagcaggaccccgcacggcaggagaagggcaggtcgatgccttcctcctcggcgaagtccatgaagtagacgttcgtcgggcacctgcaactccacctccccctccgc

SEQ ID NO: 26517 - DNA, 354 bp, Zea mays
  Clone ID: cC-zmle189100b01d1
ccacgcgtccgtgtcggtagtgtgtagtcgcagcagctagtttcttccggccgccaggaatcatacttcttggcattcaatggccgcaccgccctagcattacattcttccgcgccggcggcctgctttttgtccccactaagcttagggtcgcggttttcaaaaccctttggggccccatatgcggccacattttttgcgcgcacaccacatatacaacgaaaagctgatcacgccggagggggaggtggagctgcaggtgcccgacgacgtctacatcctggacttcgccgaggaggaaggcatcaacctgcctttttcttccctgcgggggtcttgttctttctgccccgc

SEQ ID NO: 26518 - DNA, 286 bp, Zea mays
  Clone ID: cC-zmle189100b02a1
gaacagggaaaagtacatgcatgcgtgcgtgatatatatatatagctagaattattgaaaccacccgtttaatcttctgcgcgggccgtactgaatgtggtggcacaaaacaacggcccctggcggggtttaacttgctagaattataggaggtcatcctccttgtgcctctcgatgaccacctcggaggtggggtacccaacgcaagtgagcacccaaccgtcggcgacctggttgtcgtttaagaaacttttgtttgacttgttcaacgaacccaaaaccaact

SEQ ID NO: 26519 - DNA, 533 bp, Zea mays
  Clone ID: cC-zmle189100b02d1
gtccgcccacgcgtccggtgtcgtgtagtgtgtagtcgcagcagctagcttccgttcggccagtcgagtgagtccatcctgcatgggcatccaatggccgccaccgccctgagcatgagcatcctccgcgcgccgccgccctgcttctcgtccccactcaggctcagggtcgcggttgccaagccgctggcggcccccatgcggcgccagctgctgcgcgcgcaggccacctacaacgtgaagctgatcacgccggagggggaggtggagctgcaggtgcccgacgacgtctacatcctggacttcgccgaggaggaaggcatcgacctgcccttctcctgccgtgcggggtcctgctcctcctgcgccggcaaggtcgtctctggctccgtcgaccagtccgaccagagcttcctcaacgacaaccaggtcgccgacggttgggtgctcacctgcgctgcgtaccccacctccgacgtcgtcatcgagacgcacaaggaggatgacctcctataattctagctagctataca

SEQ ID NO: 26520 - DNA, 219 bp, Zea mays
  Clone ID: cC-zmle189100b03a1
ttttacttatattttttttttttttttttttttttattctgggggggggtagacccgaccaccctatacaaacaaaaaagatattgccaatcttccatttacaaaaatttttacaacaacacggtgtggtacttttttctattagggccacatcttaaaaaaggaaccccagcgttgtcttttaaaaaactccccccccatggaaatttcgggggccct

SEQ ID NO: 26521 - DNA, 481 bp, Zea mays
  Clone ID: cC-zmle189100b03d1
tccggggacacgcggtatcaaccacaaatcaacaatggagaccaagattttattcctccttatgctccttgctctttctgcaagggttgctaactcgacaattatccctcaattctcacaagctcctatagcttccctttttcccccataccttgcatcaattataacttcagtatgtgaaaacccacctcttcaaccatataggcttcaacaagcactctcagaatgcaacatacctatatcgtccttgtggcgtcaacaaaaaccacccctatctttggtgcagccattggtacaaaccatcaaggcacaacacctgcagcaactcttgctacctatgatcaaccaagcaggtgtggctaacctttcttcctactctccgcaacaacactttcttgcattctaccaactgtctacactgaaccctgctgcttatttgcagcaacaactattaccatttagccagctagctactgcctac

SEQ ID NO: 26522 - DNA, 373 bp, Zea mays
  Clone ID: cC-zmle189100b04a1
aaggcacacaggtattgttcgcgagctaaggtgacattttcaatagtacatatgcatataaccatttggaaatctacaagggcacggtacccttaaaattatattgttcgcaaagcaaattgacatggagatggcccaagagagcatggaaccaaaaaatcaagagtacaaataatctgttgctaaaacaaaatccatgctcatgtcttgcggagaaagtataatgcagctacaacccaccttaatgccagagcgaatattacaattgaagattagaatgtgccacttatttacatacatacgccaaatacgtggcattgagtaccttttaatttattcccaccaataaacattaacttatttcatttgtgcc

SEQ ID NO: 26523 - DNA, 528 bp, Zea mays
  Clone ID: cC-zmle189100b04d1
tccggagcatggctgcgccacttgtgtgggcaactctggtgacctggttggatctgtatgcgctgctatcacagaaagggatatggttgctgctgcggtgctgtcggccaaccgaaacttctaggggcgtgtgaaccctttcactcaggctaactaccttgcctcgccgcctttggctgttgcctatgctcttgccggcactgttgacattggttttgaggaagagcccattggagttggaaagggtggcaaggaaattttcttgagggacatatggccttcaaaccaataaatcgatgaggttttggagtccagcgagcacactcactcgttcaagaaagtgtacgactccatcatggaacgtaaccctaggtggaaccagctgtcggttccaaaggaggcactgtacccatgggacgacaggttcacctacaattcgcaggcccactttcctggagggcatgttcatgacgctcgctggcccgcccacggagacggaggcctactgactgctcaaccttggagaca

SEQ ID NO: 26524 - DNA, 406 bp, Zea mays
  Clone ID: cC-zmle189100b05a1
tatcctctagaccgcccgccctttttttttttatttcttattcttttccatttttttattttttttcgctcggtttttttttatttttccctttccccctcccttcctaaaaaaaaaaaaaaatacctttcaaaaaataaacccataggcccctcttccctctccttggttaaaaaggccacccccccttaaaaacctatttcttataaacctttcaaaaaaacaacccacgaaaggctccaatttttttttctttattaaacccacccccccctaaaaaaccaaattttacggattgtcaaacaccccccttttaaaattcccatttctttatccataaagaaaagggcccccccaacctaaaaaatttttttttttttttttgcccaaaaatatcaattccttc

SEQ ID NO: 26525 - DNA, 358 bp, Zea mays
  Clone ID: cC-zmle189100b07a1
atataaacacacgtaaattcggattgttcaggacatctctcgatacaaaaaaaaagagataaaaattaaaaaagaagatatatgcacacacaccttattcaaggcctgatttgatcttgatacaagaacgccgaggaccgaccaacacagttcctacgtccatgcaaatatcggtagcccaaatcaaggcctggccggcacacagtagacgaagacgaggctggaagaacagatggaacagcaaccgcgacggatcagttgtgggcgtgcttcttggcgtccttcttctcgtggggctcgtggaaagcgaagccggcggagcccacggcggcgacggcggccacctcctccttgaccc

SEQ ID NO: 26526 - DNA, 495 bp, Zea mays
  unsure at all n locations
  Clone ID: cC-zmle189100b07d1
acccgtccgcggacgcgtggggtcatatctagctatagtagctcccttgagaatcatttgagggaggagccatgtctgaggagaggcaggaccaccacctgtttcaccaccgcaagccanaggaggagggcgcctccggcgaggtcgactacgagaagaaggagaagcaccacaagcacatggagaagctcggcgagctcggcgccatcgccgccggcgcgtacgccctgcacgagaagcacaaggccaagaaggacccagagaacgagcacgggcaccgggtcaaggaggaggtggccgccgtcgccgccgtgggctccgccggcttcgctttccacgagcaccacgagaagaaggacgccaagaagcacgcccacaactgatccgtcgcggntgctgttccatctgttcttccagcctcgtcttcgtctactgtgtgccggccaggccttgatttgggctaccgatatttgcatggacgtaagaactgtgttg

SEQ ID NO: 26527 - DNA, 360 bp, Zea mays
  Clone ID: cC-zmle189100b08a1
aaattgacaactacagaatacatttattggggagggcacgtacgtaagaagggactacacaatatataataatacatctaggtctagctagctcgcgcacactgaaaaggaaaggtaactgtcacgctcgctcaccatccggtgcactacactacactacctagctagactaataacaggcacacatttacttgcaactgcaggtgggtattacattacacacataagcatcgatcaaaccgggtgctgctactacgtactgactccacaccagcagctatcatgcatggtgcaactgggcgtgcttttttttttctttctttacacatctcatatcgaccacgttacgttctgctacaa

SEQ ID NO: 26528 - DNA, 394 bp, Zea mays
  Clone ID: cC-zmle189100b08d1
ggctgggccagtccgtgacggattcagatactgtttaggtgccctacctccaggcggaggggaaggaagagctactcctgcacccgccaagcccactgctctactgggcgcgcctcgacacctcatacgtgcacataggcaggtaccttgtgcccatgggcaccatcggcatggtgaacatgttggccataacccatgaccccatgctgtggactgagccaatggagattaagcccgagaggtacatgggccctgccgtcaaggacgacccgataatgggttcggatctgcggttcgcgcctttcgctttccacaggcacgagctgaccaaggacgtcactaacggcggctaccgctggattctggggcgtcaccctgctgtacgagttcaaat

SEQ ID NO: 26529 - DNA, 363 bp, Zea mays
  Clone ID: cC-zmle189100b09a1
ggcacttagctagctaccatgggcggtatgattcaaacaggccaacacccacgaatatttatgaataaagatcacagaataattcaccccaattagcactggtcactggagtatttagaactacagttcccatgataaaattggaccattacactacaggtgaagttattggatccaactattcggctacacctgttcaatcaccaacatagcatcgcgtctgcgattgtatacagtgtcaccgggaacttggtgaccatcagtcctacacatctgacgttaagtaaaactgttaatgcttcaaacagctttcccaaacgatactgacagacgatgaacgagcagaatttttcagattcattt

SEQ ID NO: 26530 - DNA, 577 bp, Zea mays
  Clone ID: cC-zmle189100b09d1
gcccgtgaacacctcaaacctcacggctcacgccaccgtcctccattcccgttctccggcgatcctgtcattccagaggcgggtccgcccctctcggtccaccaccccgacgccgccacatgtcgacgcagtccatttcgccggcctctgcgtccgcgcagttcacctacccggcggcagcggccccgtcttacttccccgtgcccttccacctccagaacgcgcaatacaccgcatggaccgcagccgcgccggcggtgcctgtgtacaacgccatctatcccatgccccaagtccagcaggcccaacagttgttccaaaaggactcgaagataattactcctgaagctctagctactgttaaggctgctattgcaaatagtgagaaagacaagaaggttgatgcaacaaaaaaggcagtgcctcgaaaggcagctgggcaaagttgggaggaccctaccttggctgattggcctgaaagtgctcaaggatgtgatgagcccaacagattgccacacgtgatttagatgatttccgtttgttctgcggcgatcttggaaatgacgtgaatgatgat

SEQ ID NO: 26531 - DNA, 374 bp, Zea mays
  Clone ID: cC-zmle189100b11a1
ttttgaatttagcttacttggatattgtattaacttagggggtgggatgctattacacacgactctagctatagctagctcatatacaaaccatcgcatgatatatagatacacatacgcatgcatcatgcatgcacatatatatagtatgtcctaatctataatacttaattacacgcacgcgcgctatctttcgatcgtgaataaaagagattgctagctttattccagtccaatgatgatggaggcacatatatatacatagatccttggttctacaataccttgacagtaatctgaatatatgcttcgtgtagcggttttggttggctcttattgtctcaaccgccgtcgccgtcgaggtggatgacgac

SEQ ID NO: 26532 - DNA, 304 bp, Zea mays
  Clone ID: cC-zmle189100b12a1
attattcccatttcatccttggatcgtaaaggatcccgaacttataaaaatatatcctaaaaaagatcactatcccttttaacttctcttataacaaacaacaacaaaactgggacagaacgattttattttacttggatcttaaaccaaacacttccttatcttacaactaaaccaaaattttttccaaaaaagaaatcaattttttctgcccctacccacaatttttattaaagaaacataattttagacccgtcactaccccttttgccctttttaatattgaaagactccatttaacctt

SEQ ID NO: 26533 - DNA, 428 bp, Zea mays
  Clone ID: cC-zmle189100c01a1
ccaagaagtcgtggatcctttcttttaagagcgacgccgagttcatcaacggggggtggctcgacggatcgctccctggcgacttcgggttcgatccgctggggctgggcaaggacccggcgttcctcaagtggtaccgggaggcggagctgatccatgggcggtgggcgatggccgccgtgctgggcatcttcgtggggcaggcctggagcggcatcccgtggttcgaggccggcgccgacccgggcgccatcgcgcccttctccttcggctcgctgctgggcacgcagctgctgctcatggggtgggtggagtcgaagcggtgggtggacttcttcaacccggactcgcagtccgtcgagtgggccacgccctggtcccgcactgccgagaacttcgccaacttcaccggcgaccagtgctacccg

SEQ ID NO: 26534 - DNA, 124 bp, Zea mays
  Clone ID: cC-zmle189100c01d1
ttttggtcccatgtttcgttccagactactatacactacatggtgggtgcgcggaagaagaagaacaaaaaaaaaactcccccattttgttggatgcgtctgatccgatgcagccgtaccacga

SEQ ID NO: 26535 - DNA, 321 bp, Zea mays
  unsure at all n locations
  Clone ID: cC-zmle189100c03a1
aacttaacngaactctataactggttggtgganaggcattttaaggcccaaattacataaaacaatttaactgtgagaatcttaagcagagctcaaaaactgccgagctcaggggcatacatcttacatacggaaataccaacccaaccctaaatatccagcaccatcatcatcatcatcatccaaaagctcctagatgatccaaacctcgcttgacaatttaggacttggttgcaatgttgctggacagccagtccaggccttcatacaatcccttaccccgttgtagcacaagtgctttgaatgtacccatgacccttg

SEQ ID NO: 26536 - DNA, 557 bp, Zea mays
  unsure at all n locations
  Clone ID: cC-zmle189100c03d1
tccgcggagcctctccttcccggtctcctccgcccgttgccttcgtcctctccatctccggctgcgtcgccggcgagccgcgcagcgcgaatcggatccgccgacaaggtgagagggaagagatggggctcacgttcaccaagctgttcagccggctgttcgccaagaaggagatgcggatcctgatggtgggactcgacgccgccggaaagaccaccatcctctacaagctgaagctcggcgagatcgtcaccaccatccccaccatcggattcaatgttgaaactgtggagtacaagaacatcagcttcactgtctgggatgtcgggggccaggacaagatcaggccactgtggaggcattacttccagaacacgcagggtctcatctttgttgtggacagcaatgatagggaccgtgttgttgaagcaagggatgagctccaccgaatgctgaatgaggatgagttacgtgatgctgccgtgcttgtttttgctaacaagcaagatctntcaatgctatgaatgccgctgagatcactgataagcttggactgc

SEQ ID NO: 26537 - DNA, 382 bp, Zea mays
  unsure at all n locations
  Clone ID: cC-zmle189100c04a1
tttttgtacttcaattgaatgcattgattcatcactggtgggatcgtatattacaaaccaccaagtcccagcggtagctctcctaattaacgagatctccattaacaaaaggatcgatcttgtcatcctctctctcccactcatcacaaaacgagaccacgcacgacgggttgatccatccccaggctcatagagatcgtagttaattaatccaagaacacgttccggtcgatggacggggcggagcaatggcgggcttaagaggaccctccgaacgtgtcgaagatggtagtgtggagcgggtcgctcaggtgggtggcccanttgttgagcggccccttgccggtggcggcggcctgcacggcgaagccgaggaaggcga

SEQ ID NO: 26538 - DNA, 430 bp, Zea mays
  Clone ID: cC-zmle189100c04d1
attcctgggttgacacacccgtccgatctcgacgctcatctggatcgaggtgctcgtgatcggctacattgagttccagcgcaacgccgagctcgacccggagaggaggctgtaccccggcggctcctacttcgacccgctcggcctggcggccgacccttaaaaaaaagagcggctgcagctggcggaaatcaaacacgcgcgccttggcatgggcggctttcttcgctttccccggcaaggccgccgccaccggcaaggggccgttaaacaactgggccaccaacttaagcaacccgttcaaaattacaattttgaaaacgtccgaagggtcctctaaaccccgccattgttccgccccgtccatcgaccggaacgtgttcttggattaattaactacgatctctatgagcctggggatggatcaacc

SEQ ID NO: 26539 - DNA, 403 bp, Zea mays
  Clone ID: cC-zmle189100c05a1
taaccttcatcctctagagccaccgcccttcccttttttttttttttttttttttttttcctcttttccttttttttttagatttgcttttttttctttcccctccacaacccacaccttaccaaaaacaccaaaaccttaaccaaacaatcaaaaaattaacaaaaaaaacattattttacaaaccacaatctcaaatttccaccaacattacccatcccaaaccaaccccccccctatcccataaacaaccccacccaacacaaaaatattccaacctcccaacaaaacaccacttaatcaccaaatttaacccccctttcaaccacaaaccttattaaaaacccctatccctccttaccaaacacactatccataaaccaccaacctcctataaaaattt

SEQ ID NO: 26540 - DNA, 239 bp, Zea mays
  Clone ID: cC-zmle189100c05d1
agataaatctcagtcaatatattgattatttctaggaaatacatgtcggtatgagggcaccattgtcgagggcatgtcatatgtaatctaaaagatggcacctccaacgatgggttgctgcaaggcagggttcatcaaagagaactggttgtatggcagcaattgttgttgctgctgcaggaaggtagcgaccaatgggttagccactgccaatggattaagtaactgttgtcgctggt

SEQ ID NO: 26541 - DNA, 201 bp, Zea mays
  Clone ID: cC-zmle189100c06a1
ccctcccctaaacaacccccttaaaaaaaaataaaaaccccttccaaattttaaccaaattaattaaaaaaaaaattcagtacccaaacaataccctaatcaaaacccaaaatttccaccccccccccgaaacaaaaacaatttcatccataaaccataaccccgtgaataatttccttcttaccttcccccccccatttt

SEQ ID NO: 26542 - DNA, 438 bp, Zea mays
  Clone ID: cC-zmle189100c06d1
ggagataaatctcagtcaatatattgattatttctaggaaatacatgtcggtatgagggcaccattgtcgagggcagtgtcatatgtaatctaaaagatggcacctccaacgatgggttgctgcaaggcagggttcatcaaagagaactggttgtatggcagcaattgttgttgctgctgcaggaaggtagcgaccaatgggttagccactgccaatggattaagtaactgttgtcgctgttgtaggtacgcagcagagtttgacacagccagttggttgaatggaagcaactgttgtaagtaggcagcagggtttgccacagctagctgagtcaaagctggtacaatttgttgcagcaactgttgttgtaggtacgtaggtgcattgcccaccgcgagcgggctagatgaagaataatgttgtattccgctggggtt

SEQ ID NO: 26543 - DNA, 400 bp, Zea mays
  Clone ID: cC-zmle189100c08a1
gggcggcgcggcgttcgaccgttgcctgctggcgctgtacctcatcagcccggtcagggttctggcgctccgcttcatctccgcgccgtacggcaagctatcccggccgggctggggcccccgttctaccggccccactcgcgtggttcctcatggagagccccaccctctggctcccaccgctcgtcctcctccgctggccgccgccgccgctctccggcccactcgccgcactccccgccgcgctctacgcgttccactacgtccaccgcacgctggtccacccgctccgcctcgcccgcctgcgccgcgccccggcccccgtgccgctcctcatcgccgcctgcgccttgggattcaatatcctcaacgcctacctacaggcccgctccttcgccct

SEQ ID NO: 26544 - DNA, 341 bp, Zea mays
  Clone ID: cC-zmle189100c09a1
aagcttggacaatgattagaaaagggaggggtacattggggaatatcatgggacaacacattcctttggtgcttggggcgcggggaaaaggggtaaaaattttggttaccctgaagtccgctatgcaccaagataaaaatacattccggccaaactgaggatatatcattaatggctgacatctactgttcactatatatataaagagataatggacggccaaaaaccaactaccagtgtacacaactaactagcaggcgagcttaagtctgaaagagcaacccaaaccctatagacacaggtggccctacaacccagcaagaaagttgctgatttgccct

SEQ ID NO: 26545 - DNA, 500 bp, Zea mays
  Clone ID: cC-zmle189100c09d1
aggaggataaaagaaatagttgcgcaaaataaagggaatactgttctttaattgcaacaaagatctattgaattgagtggcattatacaaagacatcaatcgatgaaatcatctttgcttgaacggatgcctgtattggatgaagctaattatttggtgaagagagctgcttctatacaggctgcagttccatctgtaaattctgctccagcagtcacttctggaggcccatttaagcttcctaatggtgttggaaagcctgcagctcctttagctgatttgcttgatttgagttctgatgatgctccagtgactacctcggcccctacaacagcacctaatgatttgctacaggatctgttgggcattggcttgactgattcgtctcctataggcggagctccgtctacaagcactgacattctgatggatcttctatctattggttcatcttctgtacaaaatggaccaccaacggcaaactttagccttcctggcat

SEQ ID NO: 26546 - DNA, 342 bp, Zea mays
  Clone ID: cC-zmle189100c10a1
ttttaatattacggttacggttctgcattcaagaaactggggagagcccactgtgaacacaccccttgtgtcaaagtactccaaggtgtttggttattaagaaattaaaaaaaagggataatattgatcctcccatctgtgcgacatgtatctcttggcttcgatgtggtcctactcgcaaccatctgttattattcacctgcttggaatctggccttcgaatgcagagctaacagcttgactccagcttccgcttcttggtagcaggtgctggctcaacgatgatcccagactccagctctctgtcgatccaatcatcttcactcaaaccatcaaaagtga

SEQ ID NO: 26547 - DNA, 382 bp, Zea mays
  Clone ID: cC-zmle189100c11a1
tttttttttttttttttttttttggcaaacaaacattctggcaccggtgggaacccatagccaggtattttaaaatcttagcttacatgtcatgctatatcattttttcctaccatttaaactttcacctttactgaatacattactttggggagatgccttaatggaaccaagctgttttaagctgattgcggcaaaacaatgggtgaaacaactcaaaattgggatgcagcaaaccaaacttggatcgactagccagataaaaatcccctgcacttaggaaaacttgctttcctatcagtaaactgaccgggggataaccctttgtgcaatccaattttatttattcccttttcaacttggaactggttctttaatttgg

SEQ ID NO: 26548 - DNA, 399 bp, Zea mays
  Clone ID: cC-zmle189100c12a1
gcacaaaacttgatcctctacatcgaccgccctcttctttttttttttttttaattttattttcccttttttttttttttaaggtttgaggatatatttttttataccaattaatatatccttacatcatatgcaatccgatcaaccaacattcacacagacacacgtacgtacatgagcacaaagacttacgccaaacatgcacagagagatatcaaactgaataactctgttactctctctctcacacacaccacacaatacctatgtatagcagccagctcgtcctccctcattattgttcaaccaccaccacaagctaaatagatactaatcatatccatgggcggcgatcgatgtgatcaacacttgcaaaaggaaacacttgcccttgccacc

SEQ ID NO: 26549 - DNA, 349 bp, Zea mays
  unsure at all n locations
  Clone ID: cC-zmle189100d01a1
gacacaacccatccaataatctttggtgaggacagtgtcggagtcatcggccaatttcttcaaaattatcattaatttatgatgttcatgtaactatagtcgtaggataaggcagggccggtttggtttcatcacgcggatgggagcaccttcttgacgatctcatcactgagcgaggcgatctggacgtcgagcgccttaacagcctcctccttctgcgcctcgaggttggcgagcgcctttacgagctcggcctccacacggctgcgcccctcgtccagcttggcctccagctccgcgggggtctccttcttcatcttgntaagcgccgccgcgacccacgcgttcg

SEQ ID NO: 26550 - DNA, 335 bp, Zea mays
  Clone ID: cC-zmle189100d01d1
cggcggcgcttaacaagatgaagaaggataccaccgcggagctggaggccaagctggacggggggggcagccgtgtggaggccgagctcgtagaggcgctcgccaacctcgaggcgcagaaggaggaggctgttaaggcgctcgacgtccacatcgcctcgctcagtgatgagatcgtcaagaaggtgctcccatccgcgtgatgaaaccaaaccggccctgccttatcctacgactatagttacatgaacatcataaattaatgataattttgaagaaattggccgatgactccgacactgtactcatgaaagattattggatgggttgtgtcc

SEQ ID NO: 26551 - DNA, 398 bp, Zea mays
  Clone ID: cC-zmle189100d02a1
aacgggttgtcagattaatgtagagggagggtggtacacctttttccaagtacaatttaatctgaagcacaggaagactcgacaaagattagacatgatgtgcagatatccaccatcataatctcattgagatataagatcccatttcagaaccttgaacctaagatgtcttccattattcagtaaaatttccaacagaactaaaggtcctacaacacatacatttttttaaaggaccaattcaaaatcctggacctcaaactgccaacgcattacaagaaacagggtgtaagatcatctaatgtttgtcgtccttgggcacagcgtctttcttggcagcttgggactccaacctcttcactgaagactgttcagtagatttggcggcggcggcggac

SEQ ID NO: 26552 - DNA, 181 bp, Zea mays
  unsure at all n locations
  Clone ID: cC-zmle189100d02d1
tccgggcacgcgtccgcggacgcgtgggcggacgcgtgggtggtccttttagttgtaggcgagctggggaagacgcagcgtnacgtgtgttgcgcgcgaggggtcgtcgtactaccgacaaggacgagcggtataggcgcgtgcatggggctcacgaactttatcctcacagaggtggggg

SEQ ID NO: 26553 - DNA, 273 bp, Zea mays
  Clone ID: cC-zmle189100d03a1
gacaatgaacacaattattcctgggcgggggaacaatagtttacatcatggtacaaaccgaaaaccagcgtgcgctcacatgcatccggacacctaaaggtcaccggcggcgccttcctcacttgccggggaccaacttggtggcgtaggtccaagcgttgttgttgacggggtctgcaatggggtcagggaggttctagagcgggtccttacttgagaccatggcctggacgaagaattcaaacatggacaacattgcaaggcagcccttct

SEQ ID NO: 26554 - DNA, 428 bp, Zea mays
  Clone ID: cC-zmle189100d03d1
tcccaaaaaaaaaaaaaaaaaaaaaaaaaaaaaaaaaaaaaaaaaaaaataaattaaaaaaaaaaaaaaaaaaaaaaaagggcgagctttaaaaaaattcttccttttctttcccttccttccacctacttacctttcattttccttccctttacttaaataaacttgccttaatcttacctctccccaacttaaaaaacccttccttcacccacctttttcaatttcaattaataccccctattcccacttccctctttttcaaaaacaccgaaaccaattgactttcccaccttacccccccccctactttccattataccccccccttttccaccttattccccccggtacctgtgcactttacacccccctaaaccccttccctttctaacttttccatccccttcccctcaccttccttcctt

SEQ ID NO: 26555 - DNA, 330 bp, Zea mays
  Clone ID: cC-zmle189100d04a1
attggaaaaattcggctgccccccccccctggttttaaaaaaaggaaaaaccggggccaccaggaaaaaatttgcaattgcacctatttgaaaacccaacaactttttaattcccgggccggctccctatctaaaaaaaaggacaaaaaccaccttgccctgcaattcaagggacatttaacaaaacaaacacgttcttttataaccagggaaacattttaacattttttttggaaaaagggtccccattgggaaaaaaaaaaaaaaaagcttaaaaatgtgaccccaaatcccaaaaaacggcacccttttttacaagtttaataaaaa

SEQ ID NO: 26556 - DNA, 456 bp, Zea mays
  unsure at all n locations
  Clone ID: cC-zmle189100d04d1
tccgcgcacgcgtccgcggacgcgtgggcgaatacactgtcagctgaaatggaagctgctcgctcgtccactcaattccggcggaggtggaaacatttcttgtataaaacctgtaaaaaaaggctgccgattctgcggacttgaggtcacatatcgaagcgctgtgtttttttttaaacaatggcgaccctttctccaaaaaaaatgtaaaaatgattccctggttatagaagaacatgtctgattcgatagacgtgccttgcatcgcagggcaagctggttgttgtaccttattctagataagtagcacgcccgcgaatcaacaagctgttcggctttcaaatagctgcagctgcaaatttttacctgttgctacagtatttcctttctatataaccaggcggcagcagcagccgaatgttgccagtnnaaaaaaaaaaaaaaaaaaaaataaaa

SEQ ID NO: 26557 - DNA, 365 bp, Zea mays
  Clone ID: cC-zmle189100d06a1
gacatcaatacaaaataatcgggggcggaaacattccatgatcaacacttcttccgcaaggaactcaatgtgttcacgatttggtcagtttcatgtgcagaatactggaaattaatgtctccacaactgacttgcagagaattggaaaaaaacccaattctgtatcaacatgacttcaataatagaggtcgaaggcaataagtccgggtatgcgatcttattgatgttcctagaaattccaattcatatgaggggatatcagatggagccacccagcataatagcctcaatctcttcttcagtcagaggtttacgcttaggaaggagtgaagctggaccttctacagcagtatgcgacggtgggg

SEQ ID NO: 26558 - DNA, 493 bp, Zea mays
  unsure at all n locations
  Clone ID: cC-zmle189100d06d1
attcatgggttgaaccacccgtgcggcgacgagcccgagtatcgtctttagactcctcattcctcaacctgacgcggcggtgtgcccccctgcttttttgggccgctccactccgttggcgacgcatacatccggcgagggagcggaagaagtcagtaaattctgtcgctccaatccggacgaggagatgccgcggatccctctgatcaagttccccaagcggaatctgaaagccccatccgcgccagtgccgtcgcaacccgcagatcagcacgcgaccctcatgtcccggttgggggctaaagcagaggcaccatcttctggagggattaaaaattaccgctttagttcagatgtgccttccccaccgtcgcatactgctgtaggaggtccagctttactcctttcttagcgtaaacctctgacttgagaagagattgaggctattatgctgggtggctccatctgatatcacctcatatgaatnggaatt

SEQ ID NO: 26559 - DNA, 368 bp, Zea mays
  Clone ID: cC-zmle189100d07a1
gaactgaaaactgaatatcggttcctgcaaaactgtacttgattggtaacttacaataaccagggtaaggtgagcctaacaagatgaaccagcaagccccaccacggggaggggtatggtcggcagaagacttccaggccaacatccaaatgaaaactgttcgctgtgtcgatagcaaatatgtatctttagtgtcctgcagcttcaaaagtcgtccggcagccagagaagagagaactcatataagtctcagctcatattcaccagccattgtgatatatctaacccaggggagtgcctgataaccactcttttcaattatcttcagataacggacctgaatacctgatacggtgaaatatggtatt

SEQ ID NO: 26560 - DNA, 223 bp, Zea mays
  Clone ID: cC-zmle189100d08a1
attactattaacacattttttgctgggttttgaacaatattccacattatcccacaaacaaaaaaacaaaaaactctcactattcatccacacaccttttggctaaatgcagccctcccttacttgccggccaccaaaatgccaacttaagcccacccgttgtatctgacaaacacaacaatatttatagccactacctcaatccaaaccttcctctattacc

SEQ ID NO: 26561 - DNA, 406 bp, Zea mays
  Clone ID: cC-zmle189100d08d1
cagcaatccacacaagcactttgacgtcacacgggcgctgcttacatacacaccaagcgtcggcaccaatggcggactgccattaggtggactactgctcggatgacgtgaggaccgtggccccagccggcttcagacgacacgggggaggcgtgcatcacaacgtcgtcaaagagaagttcgaggaggttaacacggtctcacgcgccggcgccaaccaccaccaccaccatggttaccacggcggccactgcttcctggtgcgcgagaccagcgtccgaagaggacatcaacacctgcaccggcgaggatcacaagcgcagggagagctttctctccagggctaactgagcctcccggcggccggcatccacgcccgatcgtgcttgtatgcacgccttatgta

SEQ ID NO: 26562 - DNA, 332 bp, Zea mays
  Clone ID: cC-zmle189100d09a1
aaccatagactgaggattttatttgggcagatatagactgagaagcgagaggatcttacagaatttgttggagggttaaattagcagctggaggaaatcatgtccatatcgagacgagtattcttatgcaacatatatagttttttgctgcaggtgtcttaatttgataactcgatacacatccatcttcaggtagcaggggtacatgtatgtgatagcgcaataataataataataatacatccactagtcttggcttgtattggtacaaaggcggacacgggcacgggctatacatatatatatgggagtatgcccatgcgtggtggtct

SEQ ID NO: 26563 - DNA, 332 bp, Zea mays
  Clone ID: cC-zmle189100d09d1
accaccacgcatgggcatactccatatatatatgtatagcctttgcctgtgtccgcctttgtaccaatacaagcgaagagtagtggatgtattattattattattattgcgctatcacatacatgtacccctgctacctgaagatggatgtgtatcgagttatcaaattaagacacctgcagcaaaaaactatatatgttgcataagaatactcgtctcgatatggacatgattccctcagctgctaatttaaccctccaacaaattctgtaagatcctctcgcttctcagtctatatatgtttaaataaaatcctcagtctatggttgaat

SEQ ID NO: 26564 - DNA, 356 bp, Zea mays
  Clone ID: cC-zmle189100d10a1
ctcttccttttttttttagctttgattttaagtatcagcacattctaaatgggactggtcaaccaagacacccgaaaccaacagcaacaggatactacaaactggcggacctgacttgccacattcaaaaatcaaaaccatatcaaaatgtgaaaactaaccagaaaaaaaaagcctatcatcattatactatatacacgcaagcattgtccccttatcaatggcttcctcttgtctgctactgactgaagaggaacataacatttattctctgccctagagctccattcttttgtctaaactcaaaacgaatttttcttgtgaaacgatccttatgtgcaaaagagtaccataca

SEQ ID NO: 26565 - DNA, 284 bp, Zea mays
  Clone ID: cC-zmle189100d11a1
aaaccactgagagggttcatatatttatgaccacttaaccccttttaaaacgtttaaatgcacgccacaacaaattaaaggggctttccaacacaacctgaccacacttcaacatcccccgccttaaaaaaggtggtattccaagttctttccccgcatattcttatatagggagcccccaaattttccctacaaataaatattacacctgttgtacaagcggctcacccaaaaaaccagggtccaaatcacatctcataacgtcattatacatcagcaaacac

SEQ ID NO: 26566 - DNA, 235 bp, Zea mays
  Clone ID: cC-zmle189100d12a1
cgcaaaagcaaacagcatgggaagggccactccactgaagcacaccaatcagtgtgctcttaaacacaaatagtgctggcccctgtttctcttataattaagcacgactgtttcacaaataccatgaaagaggaaccaagcacagcatagacgaacattgcacttacttaataggtaggtcgatcttaccacacaataaagctccatcatagtcggttcacaaaacgactgactg

SEQ ID NO: 26567 - DNA, 267 bp, Zea mays
  Clone ID: cC-zmle189100e01a1
cgcattacagcagagcgccccttccttttttttttttttttgtatataacaccgaaaaaaacccacatgcgcgcggttatatttatatatctcacataatacccaccacccataatatttaccgcaccactttacttcctcaaattagtacaaaaataccgacccactcctataaaacctagctagaattacaagatggcatcctccttgctcctctcaataaccacttttacacaaaatatacacaacccaactcaccacccaacc

SEQ ID NO: 26568 - DNA, 191 bp, Zea mays
  Clone ID: cC-zmle189100e03a1
atatatctccaatcatcaataatacgtaggtgtcattataaacactttcattcacagtcaaaatctttttatatattgccttcacaaaaatataaacaatcgtaaacacacactcattgtttctaatagaccaactccttaccaagggaaccttatgtataatagttaaacattaccattataaagacatt

SEQ ID NO: 26569 - DNA, 417 bp, Zea mays
  Clone ID: cC-zmle189100e03d1
gaccacccgtgcgggcacaaagccacctacaaaacccccccgatcagctattacattaccaagttccagccggcgctggctgggccggggcacaccctcgaggcccactcccccacctaggtataagacggcgtacgacccaccgtccaggcatccagaggtaccggcaccgcagctgtccacgtgagctgattctctcttgtggcatgcagatataaactacggatgagccagtagcgcatgatgatgctagatatgaatacatcatacaatcatttcgaaattgtatcaaagtgtgcatgtgaaagcactgatctccacgtcagctggcggaaggcaattagcctcaaaaaagacgagggggtgatcattaactcgctcttccctttcgagcgagccaccactggtggtggtgta

SEQ ID NO: 26570 - DNA, 245 bp, Zea mays
  Clone ID: cC-zmle189100e04a1
ccatttttaaattttttacttttccctttttaaaaaaaacatcccaaaattttaattttttaaaaaaacaaaccccccaaaaaattttgaactttaaaaacaaaaacccaacgggttttaaaaaaaaaaaaaaccctttttaacccccaaaaacaaactttaaaaaaaccgctaaaaaaattttgggggaaaaaaaaaatattaaaaaaaaaaaaaaacacctttttaaaaattacccccccaaa

SEQ ID NO: 26571 - DNA, 394 bp, Zea mays
  Clone ID: cC-zmle189100e04d1
cgacccacccgtgcgcccacgcgtccggtgggggtgcgagaagagcaagttcctttggttctactccgccaaggagacgtgctacgtgctgcaggggaaggtgaaggtgtaccccgaaggccacggggaggagttcgtggagatcggcgcgggagaccttgtcgtcttccccaagggcatgagctgcacctgggacgtcgccgaggccgtcgacaagcactacaacttcgagtagccgccgccgccgactagccctgcggcgctcgatgtagacttgctgtgctcttgtactctgaacctatgatgctccactccagagttaacagaccgtgtaataaagctccggattaggggactccaaggctgtcctatcttgttaaaatcccgtccggtt

SEQ ID NO: 26572 - DNA, 376 bp, Zea mays
  Clone ID: cC-zmle189100e05a1
tttttttttttttttttttttttttttttttttggttggttttttttttttattttttttttttttttttttttttaacccgattcaaaaaaaaaattttaatacgggaggggggggaactcccgattacataggaaatttaacataaggggtggaaaaaaaaactcttcccccattaaaaaatttccaagttattaccaaaccccaaaaaatcttttaaagggtaaggggtcccccaaaaaatttgagttgcccccaaagtgaaaaacccccatccacaagggaaaccttttatactaagccaaaaaaaaagctttactaagggggaaaaaaaaactttttaactgggggcactaatttaggattttttttcacc

SEQ ID NO: 26573 - DNA, 394 bp, Zea mays
  unsure at all n locations
  Clone ID: cC-zmle189100e05d1
tccgcgtgcttctccgccgtcgaggccgcgtcccagtgcgaagtgactacgactcagatggccagccgctgggggcggccggaggtgtacccgctgttcgcggcaacgggcgtggccgtcggcatctgcggatttcagctcttccggaacatcaccggcaacccggaagtcagggtaaacaaggcagggagggcagctggtgtgcttgagaaccatgaggaggggagacgttacgccatgcatggcctaagaagctttgtgcacgacaagactcctgacatcatgcctgcagttaacaagttctttactgaccctaagtgaagcatgttgattggcatactactactactactacttgctactgnggatttacactttgcttgcaactcaatat

SEQ ID NO: 26574 - DNA, 395 bp, Zea mays
  Clone ID: cC-zmle189100e06a1
ttgccgtcgccgaacgtgtcctcaaacgcctccccgccgctgccggggacccggccctgcaggtcggtcaccaccaggtcgcccggccgcgggacgtccccgccaccgacgcgcatctcgtagtaccggatcccgttgggcaacacgacctcgtgctcctgctccacgtccttggtgttggcctgctgctgcgcgacctcgaagcgtgtcttgagctgctccgacacgacgccgacggccaggaagccggcccacgccagccccgcaccgattccggaccggcgcgtcaacgacgaggctatccagtcagtggagtccgcgacgcccgcgtgcttcggtctcgccgacgccgcctgctgtggctgcgcttgacggagtgccgctgtttttgtggt

SEQ ID NO: 26575 - DNA, 314 bp, Zea mays
  Clone ID: cC-zmle189100e06d1
cacccgtgcgggcccgttcctgggaagctcaccggcgctcctcgctcgttccattgccaagccgacatctcctgcgcgcggacggcgcgcccggcaattgcccagaaccagacgccgtccagcgagcagccggaaccacagaaacagcggcactccgtgcaagcgcagccacagcaggcggcggcggcgaggccgaagcacgcgggcgtcgcggactccactgactggatagcctcgtcgttgacgcggcggtcctgaatcggtgcggggctggcgtgggccggcttcctggccgtcggcgtcgtgttcgagca

SEQ ID NO: 26576 - DNA, 307 bp, Zea mays
  Clone ID: cC-zmle189100e07a1
aaaggggaaaaactttcccaatttccacttcacgggtaaaaaaacaataaattattaaaccccggttgagggtgaaaaagggcaatctttttttttaaaaacaaaaataaagggattgggttcttaaaaaaaagggtgggcccaaaacgggaaaaatttacaaaggaacaccaaaagggggaacaccaccggtcagggggaacaaaatggcccccccttaagcaacccagttgtggaagaggtggaaaaaccaaaaaaacacccaagcctccccccttaaaaaaatcacccccatcttgagggaggg

SEQ ID NO: 26577 - DNA, 300 bp, Zea mays
  Clone ID: cC-zmle189100e07d1
accacccgtgcggtgcttccccccgatccatttcagccgccgccgcgcgtatcaagtaggagcagcaaggatgccggctggcggcgggctgcgctcgcggacgcgcgacctgttcgcgcgccccttccgcaagaagggctacatcccgctcaccacctacctccgcacctacaagatcggcgactacgtcgacgtcaaggtgaacggcgccgtccacaaggggatgccgcacaagttctaccacggccgcaccggtcgcgtttggaacgtcaccaagcgcgccattggcgtcgagataaa

SEQ ID NO: 26578 - DNA, 288 bp, Zea mays
  Clone ID: cC-zmle189100e08a1
aaaaccaaaaagggggagggtttgaaaaacaaacttttaaaccccggggcccgtttggaagttttccctgacgggggaaaaaaaggccctgggattgtaccttttaaaaccccccctcccaaaaatggccacaaagaagggctctcaaaaaaaaccggggaaccccccaacccccaacaggaggcaatcccggtgccaaaggggggggctcccaaaacaaacccctttggtggagcccgacccctgggcccccccctgggtcaccccggaaattccggacccggcccc

SEQ ID NO: 26579 - DNA, 265 bp, Zea mays
  Clone ID: cC-zmle189100e08d1
ggaacgacccacccgtgcgcccacgcgtccggctgcagctcaggtgcttgtctgaggctgccttctcattggcaaccggattgcctgctggtgggggatgtggtgatcaacagtattattacagagccatgctatgtgaacattactagtagcagtgctcataaaagctacaatcccatgtcctttttttccccagtcatgtaaaacttccaaactgctccatggttcaaaactctgttcttcaatacatcatcaattatcgatt

SEQ ID NO: 26580 - DNA, 373 bp, Zea mays
  Clone ID: cC-zmle189100e09a1
ttcttttttttttttttagtcagacaatttatggcgtgcattgatatatagatccccttggtataccaaattctgtttactacaaaattgagtgaacaaacataaaggggcccattaagcccaatagcactcttagcaactgataataagatgatcatatagaagtctgaacatattccaacaagctctcaaacgatggcgtttgctgcgctagcaatcctaggccaaagatcagcacactccttgccgataggtccagtgatagcggaacctttcatctcacccttgggattcacaatcactccagcattatcttcgaagtacatgtagacaccgtccttgcggcgccacagcttgcgctggcggacgatga

SEQ ID NO: 26581 - DNA, 254 bp, Zea mays
  Clone ID: cC-zmle189100e09d1
tccgcaccagccgccgccatgtcgaagcgaggcaggggaggttttgctttgaacaagttccgcatgtcgctgggggtgcgggttgccgcgacggtgaactgcgcggacaacacgggcgccaagaacctctacatcatctccgtcaagggcatcaagggccgccttaaccgcctcccgtcccgctgcgttggcgaaatggtcatggccaccgtcaagaatgggaagcccgacctcaagaaaaaaggggatgcccg

SEQ ID NO: 26582 - DNA, 369 bp, Zea mays
  Clone ID: cC-zmle189100e10a1
cctgcaatcctcgcatgcttgcaagggaaattttgtacacacagtataaaccgagttttttttgtcagcgggatgatggcacctacaaaaaggatgcacacaagacagaattacaaaacttgctctgatacaagttattgtcgtgttagcattggacgaatcaacactggtcgtgtgaacacataggtctacccaaatcaaattagctctgcttcaatgtgctccagatctttccaatctgttgagcatgataccaagaacaagggcatgcaccttcgtggataacaaggctgcaaccaaatgccttaacgacaactgccagcaacttccataggtccaatcactaactgtatgccatgaaaatgacat

SEQ ID NO: 26583 - DNA, 372 bp, Zea mays
  Clone ID: cC-zmle189100e11a1
tttttaagttgaataacaatctctggtccgattggattgggacaacctactacactgacatcctcggcagcaggatcatatgaggtcactggatgaaatggtcatggagaggaaggagatcgtgcatgacattgacacctgatgttattaagaggaatggagaaaagaacagccaacgctgtgctccatcccccccgttccgaacaacttgttgagatccctaaagctaaaaagtctccccccaaatgttagctccttgtttgaagatctatgtccaagcaggagagaaagaaagaaagaagaggaatctttttttttttggttgaaggatcctagctcctaacatagcaccacacgcagtcaccgtatccg

SEQ ID NO: 26584 - DNA, 345 bp, Zea mays
  Clone ID: cC-zmle189100e12a1
gtgagtggagtaatctttattaactacatcatatataaacaatatatatgaaggcactggatgacaacaccttgacagaaaaaaactaatcagcatgacatagacaccttatgttattaagactaatgaaaaaaaaaacaaccaacactatcctccataccaacccattaaaacaaaaagctgagaaccctaaaaaaaaaaaaaaactcacaaaagaaaacttgcagggctaaaacctatgtacaatccggaaacaaagaaataatgagggggcatgtgaaattgttcccctgtcacaactacaaactaccttcgaaccataagcaaaaaccggaaacccttgga

SEQ ID NO: 26585 - DNA, 222 bp, Zea mays
  Clone ID: cC-zmle189100f01a1
aatcacctaaaaaaacccatttgcgtgctgttatctttttatatttcacacaataaccaccacctataaatatcaccacccacactctacttgctcaaattagcacaaaactaccgtccaactactattcaacgaagctagaatctacagacttcattctccattgccttctcaataaccactttgacacaaaacatctacaaatcatactcaccacccaac

SEQ ID NO: 26586 - DNA, 305 bp, Zea mays
  Clone ID: cC-zmle189100f01d1
cgacccacgcgtgcgcccacgcgtccggaacaaagtatcatcatgataccggtgtttctaatgtgaagatttggaacctgccactgatggggtccaaataaaataaatatgaccacagattacagatttgatatccagggactttctaatcagcctattagaatctgaagataaatcttgtagcacctgtccggtgacccatagtaatattattttactcttgctgtaagcagaggttaacactaaaaaaagtattgtgattggtctgaactttttgtgcggtataaagcatgtgattcagctca

SEQ ID NO: 26587 - DNA, 66 bp, Zea mays
  Clone ID: cC-zmle189100f02a1
gtgtggtaaaaacccaaacaactttttaaactaaaaattaaacccaacacttcactttataccaaa

SEQ ID NO: 26588 - DNA, 402 bp, Zea mays
  Clone ID: cC-zmle189100f02d1
gtgcgcggacgcgtgggcggacgcgtgggccaccgcgccaccggtcgattctcctcatcctcctccggcggaggggggcgcggtcacgccaagccgttcgagaccgtcggggttcgagcagctagacgggcgagtcaaggagctgacctcgtcgcaggcggagttgctggagaggatccagaagctgaaacatgaggtgcagaactggcgctccaatgtagagacgcaggtcaagacataccagaatgaactccaggatctcaagaaaggacttgactctgaagtggaacagctgaaatcggaaatgaaggcggttaggtctgcggtacaggaagagaaaggcaatctacctgcacaaaataccgactttagagacgaacaataaaaatgcaggacaagctt

SEQ ID NO: 26589 - DNA, 170 bp, Zea mays
  Clone ID: cC-zmle189100f03a1
atatcgccatcatcaaaaatacgtatgttttatataaaaaatttcaatccactccaaaaaacttttattttgtgcctcgactaaaaaataaacaatcgttaacacacacttctttgttcttatagaccaacttcttatcaaaggaaccttataaccaataggtgtacatt

SEQ ID NO: 26590 - DNA, 598 bp, Zea mays
  Clone ID: cC-zmle189100f03d1
gaacgacccacccgtgcgcggacgcgtgggtggaagggccttcagcaagcaatgggtaccattctagatttcagcactgcttatcaccgccaggcagatggtcaaacagagagagtcaacaaggtccttgaagatttactcagagcctgcgtattagccttcgacagagattgggagtctagtttgccgtacgccgaattcacatacaacaacagccatcaggccagcatcaaaatgtcaccattcgaagcactgtatggaagaaaatgccagactcccctaatgtggtccaatgtaggggaaaggacactagaaggacccgactttgttaaagaagccgaagaaaaagttgctttgatccgcagaaggttacttgaagctcagagtcgacagaagagttacgcagacaataggcgaagggaactcagatttgaggaaggagattttgtttatctcaaggtttccccaatgcgtggggtcaaaaggttccagatgaaaggaaagctagcaccccgtttcgacggtccttaccctgtcatttcccgataggacccgtggcataccgtcttgagctacccagaatcatgtcagatattca

SEQ ID NO: 26591 - DNA, 346 bp, Zea mays
  Clone ID: cC-zmle189100f04a1
caggggtggggttttttttttaatagcgcacatgcaaatccccacctgtacatccaaaaataccaaccttccccataatgagcttgcatgcaaaccttatagaaatatggaattaccctttagcctatgtaaacttattatcctctacccaattaaaacaaaatccaaacaaaaaccataaaaatttatggcggggaaaccaaaaggcaaatccaacccaccttaattgcataaccaatactccaatcttataatagaataaacctctcatttacataaataagaaaaaaacccgccacggacgacaaaataatttattcccaccaagaaacaggtctttttttat

SEQ ID NO: 26592 - DNA, 170 bp, Zea mays
  Clone ID: cC-zmle189100f04d1
cgtccgcccacgcgtccgaaaaaaaaaaaaaaaaaaaaaaaaaaaataaataaaaaaaaaaaaaaaaaaaaaaaaaaggaaagtgtttttctttcttttacataccacactatacttcttttattccgaacctaaatttattttattttcccacctaaatacaacttcat

SEQ ID NO: 26593 - DNA, 301 bp, Zea mays
  Clone ID: cC-zmle189100f05a1
ccgctgtggttttttttttttttcccttcctttttctctctgagaaaaaaaaacattcccttggaaaaaaaaaacccaggggggcctttccctcaccttggatacaacgggcaccccccccaaaacccccttttttcatcaccctttccccccccccccccgggcaggcgtctaaatgctccttctcacctgaccccaccaccctcaccagaccaaaacctttgggttccgtcagaccagcctcttcaaaggccagctctctatctcactagctgctgggccccctagacccagtacattc

SEQ ID NO: 26594 - DNA, 413 bp, Zea mays
  Clone ID: cC-zmle189100f05d1
gacccacccgtgcggtgacaacagtgagatagccgatatagcgaagtcattaaagagaaaggcgaaggaatttagaaagaacggggcccaggagagtgtcatagctgaatcatatatcgcaagtaatgatgaattgcggcaaaaaaagaaaaagaaatcaactaagtccaagtagccctaatcctcatgcataatgacactggcaattgagaaggattgcatgagccatccctataattatgtcattcatgctgtgatcgtattagatgatgaaacaaaattcgaaccttccgctggtctgttgttgcaacagttcatatgcaataggtttttaatgggtaactgccatgataaccaaggaacagaaagagccctcaagcttatcattctccaaagatatatattttcatcct

SEQ ID NO: 26595 - DNA, 349 bp, Zea mays
  Clone ID: cC-zmle189100f06a1
ctcctccccttctttctttggtctggttttttttcttctccccccccccccttttggggaaaaaaacatttttcctccgaaaaaaaaaaacccgaacggctcctcctcatcccgcggtatcaggggcgctcccccaaaaaaaccctttgcccacaacccgtggcccccccccacccccgggggggtcaaactttcttacacgccttaaccccccccccgagcgaacgcccccctttaggggggggcccgtcccccccccctcaaaacccccgtcccttttccctgggggaaagggccccccgcccacaattgcctcctctttactttccggccgcaaaaaaaccttacc

SEQ ID NO: 26596 - DNA, 404 bp, Zea mays
  Clone ID: cC-zmle189100f06d1
gtccggtgacaacagtgagatagccgatatagcgaagtcattaaagagaaaggcgaaggaatttagaaagaacggggccgaggagagtgtcatagctgaatcatatatcgcaagtaatgatgaattgcggcaaaaaaagaaaaagaaatcaactaagtccaagtagccctaatcctcatgcataatgacactggcaattgagaaggattgcatgagccatccctataattatgtcattcatgctgtgatcgtattagatgatgaaacaaaattcgaaccttccgctggtctgttgttgcaacagttcatatgcaataggtttttaatgggtaactgccatgataaccaaggaacagaaagagccctcaagcttatcattctccaaagatatatattttcatcct

SEQ ID NO: 26597 - DNA, 287 bp, Zea mays
  Clone ID: cC-zmle189100f07a1
aaaaacaaaaagggaaaatttttgaaaaaaaaactttttaaaacagggacccgttgggaatttttaaacgacggggaaaaaaaagggcctgggattggtcctttaaaaaaccccggcaaaaaaaaaggccaaaaagaagggctttgaaaaaaaacgggggtgaaacaaaataaccaacagcaggcatcccggttcaaaaagggggggccttctaaaaaaaacccttgatgtggagcccgacccttggacgccccccgggtccaccccggaaatttcggaccggtccc

SEQ ID NO: 26598 - DNA, 258 bp, Zea mays
  Clone ID: cC-zmle189100f07d1
gaccacccgtccggcacgcgtccggctgcagctcaggtgcttgtctgaggctgccttctcattggcaaccggattgcctgctggtgggggatgtggtgatcaacagtattattacagagccatgctatgtgaacattactagtagcagtgctcataaaagctacaatcccatgtcctttttttccccagtcatgtaaaacttccaaactgctccatggttcaaaactctgttcttcaatacatcatcaattatcgatt

SEQ ID NO: 26599 - DNA, 200 bp, Zea mays
  Clone ID: cC-zmle189100f08a1
gacccagggggccaccccggaatcaccgaccaattccggacagctaaccagaggcccctaaaagtgagccgtaaacaagcccgctgaaaacatggccaaagcactaccctacgtgaaattggtatacgaataaaatgcccccaaacattcaaacctgaaacaattagtgcaaaacccggggaacctaaggagagacctaa

SEQ ID NO: 26600 - DNA, 262 bp, Zea mays
  Clone ID: cC-zmle189100f08d1
aacgacccacctgtccgaaaaaaaaaaaaaaaaaaaaaaaaaaaaaaaaaaaaaaattataattaaaaaaaaaaaaagacaacacatttggggcgtccaaatttacttccccctaccttccacttcataactattatatagccttacctaaattcaatctaattaccatcctttacaacttccttactgtgaaaaccctggtataacccaacttaatctccttttaaaacattcccctttcaccacctttcgtaatattaaa

SEQ ID NO: 26601 - DNA, 308 bp, Zea mays
  unsure at all n locations
  Clone ID: cC-zmle189100f09a1
gaaaaaaaaatcatttttacttacccctccccatagggccaaaaaaagagaacatcccctttaaaaagcccaaccctacccccctaaacccatccttggcaaacaaaaattttttttcttaccaaatttttagaccaaaaaaataaccggccttttcccattggtcccctggtgtaacccggaaaatcccacccggtccccgtgagacccccaactttccctatantaaaacgattaaaaccttcaccaaataatgcgaaaaactgtttccgaggaaaaactttttttcgttcccaaatccccaaaaa

SEQ ID NO: 26602 - DNA, 164 bp, Zea mays
  Clone ID: cC-zmle189100f09d1
tccgatggtacatggaccgttacgtatgttgcatgaaatactgtactataataagatctttgtatgccatgtatggtatgagtgtgcatgtgtctggcttttgaaaggtgtactcgttatttatggacttatatgtatgtatagataaaaataatatttttatc

SEQ ID NO: 26603 - DNA, 366 bp, Zea mays
  Clone ID: cC-zmle189100f10a1
atatgtatgcatgtcctggttcagtgggatgtgtatatatattacaaaactatccaagtaatatatatattcacctcctcgatcctatgccggcctcgcgcctagctagcaatagcaaagagttgctttctacttgaagaaggagccagtcttcatggcgtcctcgttggcttcaccaagagcagcctcgttgaggtacttgtcagcaagctgcacacgcttgacgttctcctgctccgccaccagcatgtgtccgtactccaagagcttctcgatcgttatcttgggctgctcgaacgtgggcgggccctccttggagttgacgagcttcctgccgatgttctcgacgccggtctcgctcaccca

SEQ ID NO: 26604 - DNA, 195 bp, Zea mays
  Clone ID: cC-zmle189100f12a1
gaacccgtcataccaaggctcactggataggtaattaataacaacttgctgtacataattgcttgaatcaaccatctagaccgtctaccatcaaattaaaaaaaaactcactaatcattgtgcagttgaaagcaatagttgctagtatcggagtaacggaagggatggcaactttcaaattcacagcaacattgc

SEQ ID NO: 26605 - DNA, 391 bp, Zea mays
  Clone ID: cC-zmle189100g01a1
aaaaaaaaccccccaaaaaaaaaaaaaaattttattaaaaacaaaaaataaattacggggcccctggaggcaaatctaaaacataaaccatctcctatttccttcttgataaacaaaaaaatgagatacaacacaataaatatatcgtgaaaaaaaaccttttttatctaacccctcaactttcccttttctctttaaaaaaaataatatgcaacacaaattaacctttattttttttaaaaaaaaaaccggtgggttggatcttaccatttggtctaacaaaaaaatccgaacccccccccctgacccccaactttttaaaaataaaaaaaaaaaataacactaaagaaaaaaagaaatatatttttttaaaaaaaaaaaaatttttcca

SEQ ID NO: 26606 - DNA, 267 bp, Zea mays
  Clone ID: cC-zmle189100g01d1
gacccacctgtgcggaacgagctgcaggctctcaagaaagacaaggagaagtgtagctgccgcggcaatcgtccagcggggagaggacggacgtacgtaggctaaaaacaatgggttctcggcaacacattatagaacggcattgcagacattgttgtcagacagcagcatcagaaggtggctgctgtggcatattggcttcagcagaccggtcgagatatttcatattcgttaaaaacttagtattttagtttgttcgatggtttt

SEQ ID NO: 26607 - DNA, 389 bp, Zea mays
  Clone ID: cC-zmle189100g02a1
agaacgatacatacagagtgctcagggtgggttagatagacagatacaaccatacacgcagttgcccgaaggttcatcatttgcgttatacacaaagctcgcagatctttatacacacaatacatactaacatacatacatgaacgtgcacgaaagggaaaccctgagcaaggaaaacacccaagaacgccatcagtcgtcaagagcatgcaccacatgtcgccggtcaagaactcgatcacgcaggactgcaacgggaagcttcagaagtagtaggggaagcgcgccctcatggccgtgccgccgggactatggtcacctacggcagcctgctcttcgccttcatctgctgacgatctgccttgaagcctgaagaggtccctgtgata

SEQ ID NO: 26608 - DNA, 409 bp, Zea mays
  Clone ID: cC-zmle189100g02d1
gacccacccgtccgagagatatcacagggacctcttcaggcttcaaggcagatccgcatcagatggaggcgaagagcaggctggcggaggggaccatcgtcccggcggcacggccatgagggcgcgcttcccctactacttctgaagcttcccgttgcagtcctgcgtgatcgagttcttgagcggcgacatctggtgcatgctcttgacgactgatggcgttcttgggtgttttccttgctcagggtttccctttcgtgcacgttcatgtatgtatgttagtatgtattgtgtgtataaagatctgcgagctttgtgtataacgcaaatgatgaaccttcgggcaactgcgtgtatggttgtatctgtctatctgacataatttgagcacactgtatgtatcgttctc

SEQ ID NO: 26609 - DNA, 253 bp, Zea mays
  Clone ID: cC-zmle189100g03a1
gacaacgaacacaattattccttggggggggaacaatagtttacatcatggtacaaaccgaaaaccagcgtgcgctcacatgcatccggacacctaaaggtcaccggcggcgccttcctcacttgccggggaccaagttggtggcgtaggtccaagcgttgttgttgacggggtctgcaatggggtcagcgaggttctagagcgggttcttacttgagaccatggtctgaacgaagaattccaacctggacaa

SEQ ID NO: 26610 - DNA, 438 bp, Zea mays
  Clone ID: cC-zmle189100g03d1
gacccacccgtccgcccacgcgtccgagccaccatcgatctgcaagtctcgctacgtatcagtgcaataaaaaaaagcagccgcaagggggagcagcaccatggccctctcctccacggccttcgccggcaaggccgtgaacgtgccgtcgtcgtccgccttcggcgaggcccgcgtgacgatgcgcaagacggcggcgaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtctttccggagct

SEQ ID NO: 26611 - DNA, 279 bp, Zea mays
  Clone ID: cC-zmle189100g04a1
acaaacaaaatatttttttttggcagagggttaaataaaccacattttcaattccaaccctttatatatttaacatttgcaggcatggggcacaataaaagcccccatcttattatacacaattttcacaggacaaatcattttaccatcagcaccactaccattattaaaaaatggagccatcacaaaacaaaaggatacaattgtcctttatacgttaagattaccttggcaagggatcatatcttctatgccaccataaaaaggtcgcgatggacc

SEQ ID NO: 26612 - DNA, 311 bp, Zea mays
  Clone ID: cC-zmle189100g04d1
ccagaccataccaatggccctgcgcctatcattttcagcggcccacgaactggcctaggggccgcggccaatttacagtacgacgcgccacccactcccatgggcgacaggcgaacttcataataagagactgctgctggcaagggcctctgatacaaggggagtcgcacatgtgaggtacagtgggatcgatacaagcacgcgtgtgtctgggatgtgaggccttcaccggacaagtctctaatgtcaacaaagacacctactgacccaacgtctaggtcgccggtgacaacggatcgtactccacatgt

SEQ ID NO: 26613 - DNA, 341 bp, Zea mays
  Clone ID: cC-zmle189100g05a1
tttttacatctgagacttcataacatttcggagagaagaggcacttgatctttacaacgcaaatttatatatattaccacgggtacaacgtgcatcttcgttatagcatacacaggacagaggaaacatagtagtggaatctccaagcacaaagctacgtctagctcgtagatcaaagaaaaaaagggtagctatggcaataaacacaggaactgaacacaatatatggtggtgctgagaagctccaaacttcaatcaccatgtaaagcatttgacggggcctgactttattggtagtacctacgccggtattcgatcacaggatcgagatggatcgtgca

SEQ ID NO: 26614 - DNA, 423 bp, Zea mays
  Clone ID: cC-zmle189100g05d1
ccgcccacgcgtccgcggacgcgtgggctcgagtcgagactcttgatgcacctgatctttccttcccgtcttgggccggcacgtccccatcaccattgctgcgacgagagtgagcgggagagggtaggtggcgaggcggcggagatggggcgggggccggtgcagctgcgccggatcgagaacaagatcaaccgccaggtgaccttctacaagcgccggaacgggctgctgaagaaggcccacgagatctccgtgctctgcgacgcagaggtcgcgctcatcgtcttctccactaaggggaagctctacgaggactctagccattccagcatggaaggcattcttgagcgttaccagcgttactcattgaagaaagggcagtacttaacccacgtattgaagaccaggcaaattggggagatg

SEQ ID NO: 26615 - DNA, 331 bp, Zea mays
  Clone ID: cC-zmle189100g06a1
aaaagaaataaaagggggaattatttggggcacttcctttgtttgacagcaaaaacactagtaaacttactgctttgattcttacataagaaggggagggacacagtcagtacacaaacagtaacaaaagcaggactcgaaagttacacttacacctggtaactaatagcagttcatgcattaaccatagccccagcagctagctagctagctaattacccccaccagttgatcgcacagtacagtaacagtaaagttcactttcatggttagtcaccaccacgtttgatctgacctaagtttttccatttaactagcaaattactaaacc

SEQ ID NO: 26616 - DNA, 354 bp, Zea mays
  Clone ID: cC-zmle189100g06d1
gcggtgtttcaggtttagtaatctgctagtgagatggaagaactgatgtcagatcagacgtggtggtgactaggcatgagagtgaactttactgttactgtactgtgccatcaactggtgggggtaattagctagctagctagctgctggggctatggttaatgcatgaactgctattagttaccaggtgtaagtgtaactctcgagtcctgctcttgttactgtttgtgtactgactgtgtcactccactactatgtaagaatcagagcagtaagtttactagtgtctctgctgtcaaacaaaggaagtgcaccatataatctacactttaattactctagggggggggggtg

SEQ ID NO: 26617 - DNA, 237 bp, Zea mays
  Clone ID: cC-zmle189100g07a1
aatacaaagggaatgggacggggtatcttgattcacccatacatgggtacggacgcagagcatgaacctagcagggactccttcctttccttctctttctatccattattcttctttcttcttcctaataaaaagctacggagggggttcaaggagggcttttgtttgagaggcagtaggggtgggctaatcaagctccatccgtcctacaggtagatctgcccctaaccatacatg

SEQ ID NO: 26618 - DNA, 408 bp, Zea mays
  unsure at all n locations
  Clone ID: cC-zmle189100g07d1
gtccggcgacggctacggctacgagcggtcgccggcgcacagctacgattccgagcggagcccttgcgctaggccggcgagggcgacggcctcgtcctcccccgccgcagcaccggggaagaaagcggggccgcgcaggctcaagcttctcggtaacatcaagaagctgctgccggcggtcggcaagagaagccactcaaaccacgggcacgggcacgccggccacgatggcaggaaggcgccggcgcccgcttcggctcggagggacgagtacctcgacaggccatgcagtggctgtcggcccacgacgtgctcgacggcgaccactcntacgtgagcacgccgctgtcgtcgtgcgagaggactcctctgagcagcgccacgaccagcacgaccggggactcacgc

SEQ ID NO: 26619 - DNA, 286 bp, Zea mays
  Clone ID: cC-zmle189100g09a1
gggcaagccaattttaggtgctggaactctcgttacaaacatccagtaacacaggcaccggcattttgacggcgccttaaatacacttccaatagtattagtataaattattcctccattcgcactcatatcctgtataaccaaatgatatcgaatttccttctcttgaaatccttgcctgcactgcatactcttcttccctgaatcctgaccgaatggttgcatcccacgcgccatggaacaatccgctcttgtcttctgagctagttaggcgtcaagacataca

SEQ ID NO: 26620 - DNA, 559 bp, Zea mays
  unsure at all n locations
  Clone ID: cC-zmle189100g09d1
gatgggaagggcatcttcttctcgctgtgcgaatgggggttgcataaccctgctacctgggcaggcggcggggggagcagctggagaacgaccgatgatatcgccgacaactggggcagcatgacgtctcgtgcagaccagaacgacaggtgggcttcctacgccggacctggcgggtggaacgatcctgacatgcttgaggtgggcaacggcggcatgtccgaggcggagtaccgctctcacttcagcatctgggcgctcgccaaggctccgcttctgatcgggtgcgacgtgcgggcgatgagccagcagacgatgggcatactcagcaactcggaagtcatcgccgtgaaccaagatagccaaggtgcgcagggaaagaaagtgcagtccagcaatggcttggaggtttgggctgggccgctcagcaacaacaggaaggccgtggttctctggaaccggcagggataccaggcaaccatcaccgcacagtggtcgagcatcgggctcgcttcttccactgctgncactgctcgcgatctatnggcgcactcgtcgt

SEQ ID NO: 26621 - DNA, 319 bp, Zea mays
  Clone ID: cC-zmle189100g10a1
gacaacaccaacacatgggaggggtcgtctttgttacacatgacatgatgatgatatatatcctgggttttcatcttcaccaaccattacagcacagcaactgatgtcgagtggggagacgatgttcgacgcgtgctcagctcagctcatgggttccatcagtcgtaagtttcgcgtgcctcctaccgactgcagcaggaagaagacggcaaggccgacgactagccccgacactggcagcgccagcttcgtcgccggagatacccacacccaagttctgaatgaagcccttgccggtggccacctcaacggcgatcgc

SEQ ID NO: 26622 - DNA, 214 bp, Zea mays
  Clone ID: cC-zmle189100g11a1
ttttaaattttaaaagccccaaaaaaaaattggggtctggaaatagccctaataaatgcatgaaatcccgtacgtttcacttgtgtacacaacatatctttttgcggagattcatttcataacgtttcttagaattaaccattccacaccataacatggaacatttgcgatacttctgctgcaggtatcaaaacgcatcgagatcaactctaaa

SEQ ID NO: 26623 - DNA, 311 bp, Zea mays
  Clone ID: cC-zmle189100g12a1
ttttaatattaagtccggctttagtatatatatgggatggggtcatatcatcgtggaccaattaatatatggttacagcagatgcaatcggatcaaccaacatgcaggtagacacacgtacgtacatgagcacaaagactgacgccaaacatgcagagagagatagcaaactgaagaactctgtttctctctctctcacacacaccacacaatacctatgtatggcagccagctcggcctcgcttattattgttaaccaccaccacaagctagatagataataatcatatccatggtcgtcgatcgatgtg

SEQ ID NO: 26624 - DNA, 222 bp, Zea mays
  unsure at all n locations
  Clone ID: cC-zmle189100h01a1
actataaccagacatcaactctgtttcatcggggggtcacagcagataacaaaatagtctcagactctaagcgcggcagggcactacatcacaaatattgttcaaaaacaggtgcatttgacaactaaaacaaaataaaatattgaagtcgctgctattacagtagacgaatngatgattaaaccggcagatgaaacagtatcaccaacagcccaaaatttt

SEQ ID NO: 26625 - DNA, 534 bp, Zea mays
  Clone ID: cC-zmle189100h01d1
ggacgacccacgcgtgcggcactggctgaggagaacatgcgtggaatttgctttgaggtctgtgatgtcgttcttcatgctgatgctgggcaggggggtggtggtcaggtcattcccactgccaggagggtcatctatgcctctcagctcacggccaagccaaggctgctggagccagtctacctggtggagatccaggccccagaaaatgcacttggtggtatctacggtgttctgaaccagaagagaggtcatgtctttgaggagatgcagaggccgggtaccccgctctacaacatcaaggctttcctccctgtcatcgagtcctttggtttctccagccaactgagggccgcaacctctggtcaggcgttcccccagtgtgtctttgaccattgggacatgatgggctcagatcctttggaggccggctcccaggctgctcagctggtgctggatatccgcaagaggaagggtctcaaggaacagatgacccctcttctgagtttgaggacaagctctaaaattttggct

SEQ ID NO: 26626 - DNA, 176 bp, Zea mays
  Clone ID: cC-zmle189100h02a1
tttttacataaggttctgttcacttcccaaattggggacggtatatacatttttatttggttttattgactaccacgcgattaccaggaaaaaaaattgtattttggaatacatgtatgcaaaaaacccacaaaaatttaccagctgatagcccccgtctctctacctctccattc

SEQ ID NO: 26627 - DNA, 508 bp, Zea mays
  unsure at all n locations
  Clone ID: cC-zmle189100h02d1
ggacgacccacgcgtgcgcggacgcgtgggcggacgcgtgggcttgcggtaactctatatgataacatagtatattacttatacctgcgggagaatcggataaggcaacaaaatggtttgtacaattcatcagaaagctctcttaatggtctcaaaagtgagttaacactagccatgagaaattcagaaaatgaaggcataaaattttctgaaacatttcgatctggtgtactgaattgcctttctactgctgttgagcaagctgagaatgactttttatgcatggttgaacaagagatggatgatagaccagatttagtttcggtagggtcttgtatcctggttgttcttcttcaaggaacagatctgtgcatcttaaatatgggggacagtagagctgngcttgcttccatgccatatgtaaaaaatggtgctttgaaggctactcaactgacagagacccactcgcttgaaatcctttggagtaccaaaaacttttagctgaaca

SEQ ID NO: 26628 - DNA, 271 bp, Zea mays
  Clone ID: cC-zmle189100h03a1
gacaatgaacacaattattcctgggcgggggaacaatagtttacatcatggtacaaaccgaaaaccagcgtgcgctcacatgcatccggacacctaaaggtcaccggcggcgccttcctcacttgccggggacgaagctggtggcgtaggcccaagcgttgttgttgacggggtcggcaatggggtcagggaggttctagagcgggtccttacttgagaccatggcctgaacgaagaatgcgaacatggacaacattgcaaggcggccctt

SEQ ID NO: 26629 - DNA, 322 bp, Zea mays
  unsure at all n locations
  Clone ID: cC-zmle189100h07a1
ctggcgctccgcttcatctccgctccttacngnaagctatcccggccgggctgggggccacgtcctaccggccccactcgcgtggttcctcatggagagccccaccctctggctcccaccgctcgtcctcctccgctggccgccgtcgccgctctccggcccactcgccgcactccccgccgtgctctacgcgttccactacgtccaccgcacgctggtccacccgctccgcctcgcccgcctgcgccgcgccccgggcgccgtgccgttcctcatcgccgcctgcgccttgggattcaatattcctaacgcctacctacag

SEQ ID NO: 26630 - DNA, 54 bp, Zea mays
  Clone ID: cC-zmle189100h07d1
aaaaaaaaaaaaaaaaaaaaaaaacaaaaaaaaaaaatttttttttttacaccc

SEQ ID NO: 26631 - DNA, 382 bp, Zea mays
  Clone ID: cC-zmle189100h08a1
ttttgaaggtaattaaattcattcctagtcaaaggggaagggaagataatttaatccttttccatccagacacgactatacttcagggtcgcaaattcgatacaaacaaaacgcatctagaaaatagtagtacaaatccagacaggggaaaaaacccggaacttcgtgtattcaggggtgtatggtaaaaatgtcactcggtattaatattacaactagtaaaataagttcaaatggaaatggacattaaattaaggggagccctcctccggcatattcaacctcccgagcaggagccagagaagacacccaatctgatggatttgttggaagaaggcccaatgtattaagcttccatatacccaatcccatggcagccaaa

SEQ ID NO: 26632 - DNA, 471 bp, Zea mays
  Clone ID: cC-zmle189100h08d1
gacccacgcgtgcgcggacgcgtgggcggacgcgtgggcggacgcgtgggcggacgcgtgggcagcgccagacgcagacggcccggagggccggcggcggagcatcaggtcgtcgacctccgagcatcgacccgccgcgatggagaagggaaagggcctcgctcgccgctgggcggtggagctccccgacgcctcctcctcctcccccgccgtccccgacccgcccggcttcaccagatccgcgcccgacgcggacgacgccgctggagcgcgccagcgcaaggactccgaggctgcatggaaggcgcagaaagcttgggaagttgcgcaggctccgttcaagaacctgatgatgatgggatttatgatgtggatggcagggagcactgtccacctcttcagcatcggaattaccttctctgctctgtggcaacccctcaacgctcttcgatctgttgggaaagtttttga

SEQ ID NO: 26633 - DNA, 400 bp, Zea mays
  Clone ID: cC-zmle189100h09a1
ctcgtcttcttctttgaaagtttcggttacaagaaccgatcgaacacattggagctggtgcactatgaacacacggtttgtgtcaaagcacttgtaggtgtttcgttctgaacaaacaaaataaaaaggattatattgatcctcccatctgtgccacatgtatctcttggcttcgatgtggtcctactcgcaaccatctgttattattcacctgcttggaatctggccttcgaatgcagagctaacagctttactccagcttccgcttcttggtagcaggtgctggctcaacgatgatcccagactccagctctctctcgatccaatcatcttcactcaaaccatcaaaagtgatcgcttgctcatttcttggtccgaccacaatccctgactcgagttc

SEQ ID NO: 26634 - DNA, 330 bp, Zea mays
  Clone ID: cC-zmle189100h10a1
ccttaaaattaaggtagagtaaagcctgacgggggtaacagcatccatcgatccgcagtccatgctgtttgatgcatgggtctgctgaaaaccgaggatgaacacagcactaacaactgacacagagcgaccttgcaatcaaaaacacagatgggcaacaacaaacacgacacgaacgaagataaaccctctggactagggtaaacatcacggtagcgaacaggataacttggccgcgcgggccccaccgttcagttcctccagttcccgtcggagttgccggagccgccgccactgttgccaccggcgtagccgccggcaccaccaccg

SEQ ID NO: 26635 - DNA, 374 bp, Zea mays
  Clone ID: cC-zmle189100h11a1
tttttaccaaatagcgtttattcaaacatgttcggataaagaagcaagccatcgaggttcgacggagcctcgtagtacaagattcgacacgacggcaacaagcatacacgcagggagggggctatatgtgttatgtgtaataggaggaacgcgcaggcggcgtactaggcctgcttgtagtacacagccagatagatatgctccacctcagatattatatataataagctggccctgcatgcagggttggtttgctatggacccggcggttgctcagaaaccatgaatcttgatgtgctccttcttcacaatgccggcctggacgaggaaattcgagacgttcttcctctgatcaccctggagctgaatgacct

SEQ ID NO: 26636 - DNA, 382 bp, Zea mays
  Clone ID: cC-zmle189100h12a1
cgtgtgatgacatgttttacacggtacgctataggatcttacttcttcttgccatccagatccgagtagaaattccatccaaagttagcactcggatcattgaacctcaactttttgtcaatcttggcaatctcctcaacatcctcactaggcaattcaaaatcaccctccaaatttgccttgatcctcgactctgtcttactctttgggataacagagtggcccatggcaataccccaagccagcgcaacctgcgcgcctgtcttaccatgcttctttcctatctcaacgagcactgggtgcgccatgagtttgttcatattcttcccggagtcgtagatttcattctggtttccaaaaggtgaatcactgtgttacatgg

SEQ ID NO: 26637 - DNA, 411 bp, Zea mays
  Clone ID: cC-zmle189101a04d1
gaacaggatcagtagagttttacgagtcatcaagggatgctgtgacactttatgctgtcaaagttaaagtgtttgttcattcggactacgagaaagccaagaagttttctaagccttacattgatcaaattgctgagattactaaaccacatgttgagaaaaatagaactactctgaagccatacactaagagagcagttcatgcatatgggtcatttctcaagtcggcaaccacataccatcgacaggctcaagcaagcatcatggactaccttcaccagcatgatataacaaaatcattggcaactaaggagttagttttggttcctggcttctgctttgctggctctgcctgtcttcattatatacaggcttctagtagggaccttctgctccaaaaagaataaaagg

SEQ ID NO: 26638 - DNA, 119 bp, Zea mays
  Clone ID: cC-zmle189101a06d1
ggacacgtgaacggacgcctcggaaaaaaaaattttatattttttgaaaacaaaaaacaaacatgccgcggcgctcgttacaatccaaccttactttcccccccctccaaccaaatatt

SEQ ID NO: 26639 - DNA, 507 bp, Zea mays
  Clone ID: cC-zmle189101a07d1
cattttacaacaactacaacaacttcttctaacaaaccttgctgcctactctcaataacatcaatttcttccattcaaccaactagctgcattgaactctgcttcttatttgcaacaacaacaactaccattcagccagctatctgctgcctacccccaacaatttctttcattcaaccaactgacagcattgaactcttctgcttatttacagcaacaacaactactaccattcaaccaactaactcgtgtgagccctgctaccttcttgacacaaacacagtttgttcctttcttaccacaacactgcccttaacacttatacccttttacaactgtaacaattgttgtcatttaaaccactttctttaacaaactccaccaacttttaaccaacaacccaaatttgtttgtcccctcttttaaatttcttaataaatatactttaaaaataaacctttttgccttatttttgggccttcccaaaaataaaaaaatcttttttat

SEQ ID NO: 26640 - DNA, 497 bp, Zea mays
  unsure at all n locations
  Clone ID: cC-zmle189101a08d1
ggccatgggcctcctgcccaaggtttcaatggccctccacctccacctttccataaccagatgccatcccaccatggtcagggcaacgtgcctccgcaaccaccacatgctggtggcggccaaccaaactatcagccccaaatgcaaaacccacagacgggctacaaccctggcggtgctcctcactaccagcaaggtgctgctcctggctaccaaggtggacctccggggtatcaaggtggtaaccaagggaacccaggccctgcctaccaaggtggtaacactggttatcaaggtggcaacccaccacctccctaccaaggaagcaacccaccacctccctaccagggaagcaacccaccacctccttaccagggaagcagcccaccagggccaccacctccctaccgaggaggcagcccaccagggccaccacctccctaccgaggaggcagcctcaacgtaccgncatattcgggtggtggcaatcctggcta

SEQ ID NO: 26641 - DNA, 345 bp, Zea mays
  Clone ID: cC-zmle189101a09d1
agagacagaagcggggggagatcgaagacaagggaggcctcatttgcattacaatcttcggtcgcacaaatgggttgtgtgggtattgatctgtaagctacaaatgtatgaagggcagtgagtgcttcccatacatgttccttctggggctatgtccatatgctataagcccctcgaaaacattgtcgcagccatatattcatgcagaggattttaatctcttacgtatattgtatttgctgatattaacattgatattattactacttttctccaaggaggaaaaaaagaaggcacaactaaaatcgcggactgatgacgcactgtttcaatagccaccgatag

SEQ ID NO: 26642 - DNA, 508 bp, Zea mays
  Clone ID: cC-zmle189101a10d1
cgcccacgcgcacgcgtgggtcttgatagggctcgttcgtcttggagtgaacttttagaacttcccgtccttgccaggaccggccgcggtggccgcacttttccatgctgggataggagcagtcctgatgctctacgttctcttctggatcaagttggaccttttcacaactctcaagtacctcggcttcctcggcatcttccttgtgtttgtgggccatagggctctatcctacctttcctcggcgtcgacaaaacagaagacggcatgagtggacagagctttttccgaccatccatttcttgagggggggccattgcaggcccttgggcgtcttatgagggagggctcggtttatttcacttggctttgcagaatactgataactaaaaaaagtaataagacctcaccttcgtgtattatgatgatgcacatacaattttctgagtagaatggatgttgaatcatagaactaatgtcttgtaaagaaacagtgaactgcttcagg

SEQ ID NO: 26643 - DNA, 285 bp, Zea mays
  unsure at all n locations
  Clone ID: cC-zmle189101a11d1
accaacctgagccaccaaatgttccactggagaattcagttcagcctgacctcccaaaccagaggatggggtatgcctgtgcactgaagcctaacccatcccaaaccgctgatatgttggtctgttgccactgcaagccgagaagaanaagagaagaagaaaaaagaaggcgaaaagaaccgctccggccaaaacggagtacaagtttgtgccctacccgacccgctgcaaccccggatgtgcccagctgccgtggcagtgcccgcctagcagcaggccagtgct

SEQ ID NO: 26644 - DNA, 264 bp, Zea mays
  Clone ID: cC-zmle189101a12d1
acgccaatgatttttttttttagggtatggctggaagaaaactgtgcgtgtgttctatttacaaaacacgatttctacctaagcattctactataactagaaacactttcttgtaatcaacctcactgcgtcatcttttttgttacacgcactgcaggacaaagatcttctgttaaaaactctctatgtccctcatttcctgaagccaccccatatcattcctgggagctacctaacacaaggatgcctatctttacttggcaa

SEQ ID NO: 26645 - DNA, 429 bp, Zea mays
  unsure at all n locations
  Clone ID: cC-zmle189101b04d1
ggccctggggtttgagcacatcaggaacattgtaaggataatgaagcttttaatgtttgcaccaattgactcgtgaggaccggagatgcgtgtaaattattctttgagaccttgctgtgggagtcgagatgatactttttcacttctcccccatacctggagatgatgattttagagtagcatctccaacacatgtgaaactcttcggaggaaaggcctgctcatagtggcagaataatcctacacggataacactgaacaaacagtgcccgcctggacagaagtgtctgggccaccgntggtgtatgcacatgtacctgtataaagagtatctgaacttgctgcttctatttcacggcacatgctgtgctggtgctgnccaccatgcttctgtaccatactgaattttcaaaccattctttgttgctc

SEQ ID NO: 26646 - DNA, 326 bp, Zea mays
  Clone ID: cC-zmle189101b05d1
cgcccccgggccacaacgacatggggttcctggggtcggcgggacacgacccgcttttctactcgcaccactccaacgtcgaccgcatggggcgggtctggtcgaccaggctcggcggcgggcagggcatcacggaggcggactggctcgacaccagcttcgtcttctacgacgacgtcaagagcccgcggaaggtgcgcatcacgttccgcgacgtcctggacacgcgcgacctcggctacacgtacgacgccgagtccgacaaggacctgccatggctgcgctgcaagatctcgtcgctggtgccccacggcaaggacagcccg

SEQ ID NO: 26647 - DNA, 485 bp, Zea mays
  Clone ID: cC-zmle189101b06d1
ttatagatcatattggaatcgaacctttgatgatggaagcttttgagtatattgagaaggatattaagaaaccgggtttagggagtgacaagaagaacatggccacccttatggcagagtttgacaagattaacgcaaagcttggcattcggaaggaggatcttcctaacatcgagaaagaacttgaattggagattgccaaaagtgagctgactgaacttaagaaggaatgtgttgaggcaatggagactcaactcaagagggaggagttccaagatgaggagatgcctgatgtcaggaaactggacatacgaaacttcctgtaggcctgatcgacgataacctttgaggcattgcaaatcacccagcccacctgtgattcttttttctttggttatggcttcaagtttatcggtgctgtaagctacacctatgaatgctgctcctttctttttttgtaataaaaaaactgcaccgaggtacac

SEQ ID NO: 26648 - DNA, 234 bp, Zea mays
  unsure at all n locations
  Clone ID: cC-zmle189101b07d1
ggacccgtgagcggacccctnncgactacatcttttatcgttatcgcctccctttcttttatttttgggggagcgtagtccttctagtgtgcactcgttgcaatctccaaatacatggccttctatctctccaactatcttcctcacgcctgatcaccacatccaacatcaaccctttcaggaccctcaccaaacttaattctctctccactacgaacaactagaccttcaatc

SEQ ID NO: 26649 - DNA, 338 bp, Zea mays
  Clone ID: cC-zmle189101b08d1
caagctcacccgcccggaccttcaccacctgggcaaggccggcgccccgtcgatgcgccacctgcaggagtttcggctcaccgtcgtcgacgccttcgagcccggtcagcccctcgacttcgccgacctctttaaggagggcgacctcatcgacgtctccggcaacttcatcggcaaggggttccaaggtggcatcaagaggcacaacttcaagcgctggctgatgacgcacggttccaagagccaccggcagctgtcttccatcggagccgggacgacgccggtcctcgtgtacaaagggaagaagatgcccgggaggatgggaggaaccaagacca

SEQ ID NO: 26650 - DNA, 499 bp, Zea mays
  Clone ID: cC-zmle189101b09d1
cgcgtgggtcttgatagggctcgttcgtcttggagtgaactttttgaatttcccgtccttgccaggaccgaccgcggtggcggcacttttccatgctgggatacgagcaatcctgatgctctacgttctcttctggatcacagtggaccttatcacaactctcaagtacctgggctttctctgcatcttccttgtgtttgcgggccataggactctatcctacctttcctcggtgtcgacaaaacagaatacggcatgagtggacagagcttattccgaccatacatttattgagggggggccattgcaggcccaagggtgtcttatgatggatggctcaggttatttcaattagctttgcagaatactgataactaaaaaaagcaacaagacctcaccttcgtgtgttatgatgatgcacatacaattttctgagagaatggatgttgaatcatagaactcatgtctttgtaagaaacaatggactgcattaggggcg

SEQ ID NO: 26651 - DNA, 437 bp, Zea mays
  Clone ID: cC-zmle189101b10d1
ggcccttcaagctactgaagaggatatctccctccttctccaagctcattctcatatcggaactaagaatgtcgagaagaagaggacgccctacgtctggaagcgtcgccaagacggtgtcaacgttatcaacgttggaaagacctgggagaagatcgtcttcgccgcccgtgtcatcgctgccatcgagaaccccaacgatgtttgcgtcatctcggctcgtccttacggtcaccgtgccgtcctcaagttcgctgccaacactggagctcaagccatcgctggacgtttcacttccggtaacttcaccaactacatcaccaagtcgttcaaggagccccgtttcgatcgtcgtcaccgacccccgtgtcgaccaccaaaccatccgtgaagcttcgtacgtcaacattcccgttatcgccatttgcgataccgac

SEQ ID NO: 26652 - DNA, 410 bp, Zea mays
  Clone ID: cC-zmle189101b11d1
ttgctcttatgcccacacctccgtgctcggctcgcccacggctttggattttcttcctccgcacaaagtacccgaggggacgcgccttaaaacaaataaaaggtaatttaacacgacaacggtcacccatttttactatggtttggtgttcgaaaaacaaacaaaaataaaaccaaaaaaaaaggaatgcaacacgaggacttcccaggaggtcacccatcctagtactactctcgcccaagcacgcttaacttcggagttctgatgggatccggtgctttagtgctggtatgatcgcatccgtcctatcctgcgtcctccttcctcttatgcccacacctccatgctcggctctcccaccacactggacatccttcctccgcacaaagtaccctaaaaacgccccttaa

SEQ ID NO: 26653 - DNA, 524 bp, Zea mays
  Clone ID: cC-zmle189101b12d1
acgcccacggcctggagaagccatcctggattggccttcaaggaaacgggtggctattggtatagctcgtggactggagtatctgcatgagcactggaaccccaagatcatacaccgtgatgttaaagctgcaaatgtattgcttgacgaggatttcgagcctgttgtcggcgattttggcctagcaaagctagtagatgtgcagaagacgtctgtgacaacacaagtccgcggaaccatgggtcacatagcacccgagtacctgtccacagggaagtcttccgagaggacagatgtttttggatatgggatcatgcttcttgaacttgtgactggtcaacgggctattgacttctcacggctggaagacgaagatgatgtgctattgcttgatcatgtaagtcttttttttcacttccaaatattggatagctttgccctttgcctatttggttacgaatttttttaaactggctccattcttgatgtaatctgattcctgcgatgcacctgtaactaaatac

SEQ ID NO: 26654 - DNA, 204 bp, Zea mays
  Clone ID: cC-zmle189101c04d1
tgcaactttttattccatcgacttctagtgaaacattctgctatttgtttttgctgaaaaaggcaatgtacttccggctttcttcttccctccagtgtgttttcagaactgccctttcatgtgaacttgtaatgattgccctctctgctgcgtcttgattgcagttaaaatcatatgtagtttcaccccacccacacatcaaaa

SEQ ID NO: 26655 - DNA, 549 bp, Zea mays
  Clone ID: cC-zmle189101c05d1
tgataatatgtataaatgtggaaggtgttctgcctatgttatttctagttagcaactgagcgtgcatcgaggtgccgggacagtggttaacagttgttcttaaaagatttcactcacgaaaatatggcaagatcaacaaatgtgttacttttcctgatatgttggacatggctcccttcttgactgggtctggtgacaatccccctctttatttcttgtacgccgtggttgtacatgtcgatacagaaaatgcatcattctctgggcactatatatcatacgtcaaatatatgcaacgtacatggttgagaattgatgattcatacgtccaggttgtatcagtgaatcacgttatgtcagaaggtgcatacatgcttttctacttgaggtcttttccccgaccaccaaggatatacatcgagaaggggctgccggttacatccttaaagcggcacactgtcaaatctttcaagggctttaaacactatcgctagcagacagagttactctttttctgcaaacgatcaggcatatggcgtctatgatttc

SEQ ID NO: 26656 - DNA, 483 bp, Zea mays
  Clone ID: cC-zmle189101c06d1
cgcgtggggatcaatgtacacattgcccgtccgcgccaccacattcagcttcgtcgccagcctcgccacccccgcggggtctgctccttcggctccggctccggccgccccaggcccaggctcatccggaacgcccccgtcttcgccgcccccgccaccgtcgtgggcatggaccccaccgtcgagcgcttgaagagcgggttccagaagttcaagaccgaggtctatgacaagaagccggagctgttcgagcctctcaagtccggccagagccccaggtacatggtgttcgcctgctccgactcccgcgtgtgcccgtcggtgacactgggcctgcagcccggcgaggcattcaccgtgcgcaacatcgcctccatggtcccaccctacgacaagatcaagtactccggcaccgggtccgccatcgagtacgccgtgtgcgcgctcaaggtgcaggtcatcgtggtcattggccacagctgc

SEQ ID NO: 26657 - DNA, 252 bp, Zea mays
  Clone ID: cC-zmle189101c07d1
aaccaaaaaaaaaaaaaaaaaaaaaaaaaaaaaaaaaaaaaaaaaaatttatacattttaaaaaacaaacaaaaaaaaaacatgcggcccggcgaaaatcccaacaataaaatacccaaaaccccccacccactaaaccacccactctaaccaaccactcctttacaaccccctaccttaccaaacctaacccccaataaaaacaaacccctccccccaaacacacccaccaactaaaaaaaaacccccccc

SEQ ID NO: 26658 - DNA, 443 bp, Zea mays
  Clone ID: cC-zmle189101c08d1
ggccacggaggtacgcgacgccgtgcgcgcgcacggcggcgaggtgtttatgttttcgctggcggagatgccgctggtggggtcgcgcgtgtactaggcgctgcgcatcgagccccccgtggcgatgcagtacggccgcgccaagcatgacaagggtgttggagagccacgactatggcttcgaggtgcgcgagggggagatgctcttcggctaccagcccatggccaccaaggacccgcgcgtcttcgcgcgcgccgaggagtacgtgccctacaggttccttggcgaggacagcgcgcagctgctccgccacgtcgtctggtccaacggccccgagacggcctctcccacgctgcaagacaagcagtgcgcttgcaaagactttgtcgtgctcatagttcgcctcctcgtcgccgagctctttcttcgctacgacttcttt

SEQ ID NO: 26659 - DNA, 396 bp, Zea mays
  Clone ID: cC-zmle189101c09d1
cttaaattctcttatataaacatatgtattttcacattattcaggacatctctcgggacaggggaaagatataaaaattaaaaaaaaagatatatgcacacacacttattcaaggcctgatttcatctttgaacaaaaacgccgaggaccgaccaacacagttcctacgtccatgcaaatattcggagcccaaatcaaggcctggccggcacacagtaaactaatacgaggctggaagaacagatggaacagcaaccgcgacggatcagttgtgggcgtgcttcttggcgtccttcttctcgtggtgctcgtggaaagcgaaaccagctgagcccacggcggcgacggcggccacctcctccttgacccggagcccgtgctccatctctgggtcct

SEQ ID NO: 26660 - DNA, 261 bp, Zea mays
  Clone ID: cC-zmle189101c10d1
tgcagaatagcgccaaggggagggaggtcgtcgagcggattttcctgttcctcgaggccgagtccgccggcgccgggcgcgtggtaacctgatctcgtttgcacatctttgcttcatccgaacggatccaagggtttctctatctgtgctgcgtgcccctggataaaatcgaaccccgcctgctaggcgcttgcttttcttcattttttgtgtgtgaaatgatgagctgaattcggaatagaataaagcttctggtcaaaa

SEQ ID NO: 26661 - DNA, 516 bp, Zea mays
  Clone ID: cC-zmle189101c11d1
agcaacatagaaagtggaatccagtagcaacaatagagcaactttggctttcaagatattttccctccttatgctcgttgctgtttctgcatgtgttgctaacgcgacaattttccctcaatgctcacaagctcctatagcttcccttcttcctccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaaccttttctccctactctcagcaacaacaatttcttccattcaaccaactgtctacattgaaccgtgctgcttatttgcagcaacaactattaccattcagccagctagctactgcctactctcagcaacaacaacttcttccattta

SEQ ID NO: 26662 - DNA, 264 bp, Zea mays
  Clone ID: cC-zmle189101c12d1
gggtagccgtagaacatgtgccaggccaagagcctattgtttcatgttttgctacatgttgtcaggtctgccgtggggcttgttgtattatctttgcggttcttgattcatgaaatactaaccgttcgtgtgttgcgtgtgtgtttggggtaattgaagaggacactcggcttctcgatggtgttggtctgtgatgtatttagtaataagaaaataaaaaatgatttctcgttttataataataatataatatttatttctcat

SEQ ID NO: 26663 - DNA, 392 bp, Zea mays
  Clone ID: cC-zmle189101d04d1
acgcccacggccacgcgaacgtcgaataccattcatactccgactaccctccaccttttttatttgcgcgctccgatccaaaatatgggggtgccggtgatgccaaataaaatcgttatgaaacctccctagccattgatgacgccccatgtcaaccgatataaatgccttaagcaaatctgcagcaggccaaagggtctagactccccaatcagcaggaacttcaagtgcatgtaccttgcagcccaacattggatacggatctgacaaattaaccatgctctacctgcccacccagtacaagaactcagaggtgcacaacgtctttcacttgcagttactcatgatccacaacagaacctactgcgcctaaagcgcctacaaccttttaa

SEQ ID NO: 26664 - DNA, 587 bp, Zea mays
  Clone ID: cC-zmle189101d05d1
gacctagctagtcatcactactcacgttcgtccaccagagacaacaatggccattgagacgtgcttcagagcgtgggcgcggcactgccccgctggcagcaaggacaggctcctcatcggcaacctgcaggtgctgccgtcgaagcgggcgctcgcgccgctgtccgtcggccgcgtcgccacgcgccggccgcggcacgtctgccagtccaagaacgcagtggacgaagttgtggtggcggacgagaagaactgggacgggttggtgatggcgtgcgagacgccggtgctggtggagttctgggcgccgaggtgcgggccgtgccggatgatcgcgccggtgatcgactagctggccaaggactacgccggcaagatcacgtgctgcaaggtgaacacggacgacagccccaacgtggcgtccacctacggcatccgcagcatcctcaccgtgctcatctttaagggcggcgagaagaatgagagcgtcattggcgctcgtccaaagtccacgctcaccaccctcatcgacaagtacattggtagctcatgagcatgccatgcatgcatgcatcgacgactaaaca

SEQ ID NO: 26665 - DNA, 510 bp, Zea mays
  Clone ID: cC-zmle189101d07d1
gcgtgcgattacatatactattctgatgagactagaagtatttttgctattttcaacaacatctatgcattctgtgggttgggttctggcgagcagttttattcatctgagagtcttgatgatagccaaaagctgtttgctgatgcattggttaaagaaagcatacgataactggatgtatgtcattgaatatgatggcaaaggtcttttgaaccctaaaccaaagaaaaagtctgcatccactggtcaagtggagacacatgctcctgcgggtggcccgacttcatatcaacaatacctctcttcgatgagcatgccagggccatcaccatcaggtggaactgattctgcagggtatggcgtctaccaaagcgcaacacatccatctcagctgcagagttcatccaccaatgtccaggcaccatatgatgacacattttcgttcttaccacctaacatgctgacagggtctgcaaatgatgccatgggtctggaactgggccagttgca

SEQ ID NO: 26666 - DNA, 538 bp, Zea mays
  Clone ID: cC-zmle189101d08d1
caaacccgcacgacacgacaccaagtcgaggagctcgagggttccaattatggccggcgtgaactccagcgtcggggggcgaagccctccgcggcagtgccgcaggccgccgccgcctcatcgccggcgaagcgggtgcagctggcctcgcccgagggccgccgcgccgctctgctcggcctggcggccgtcttcgccgtcacggccaccaccgggtcggccaaggccaccatcttcgatgagtacctcgagaagagcaaggccaacaaggagctgaacgacaagaagaggctggccaccagtggcgccaactttgcgcgcgcctacaccgtggagttcggcagctgccagttcccctacaacttcactgggtgccaggacctctccaagcagaagaaagtcccctttatcagcgacgacctcgagattgagtgcgaggggaaggagaagttcaagtgcggctccaaccgttttctggaagtggtgaagcagctagcagcagcgtctgatgggaatggaggagatcaatacctgtctt

SEQ ID NO: 26667 - DNA, 155 bp, Zea mays
  Clone ID: cC-zmle189101d09d1
cccataaaaacacacaacaatcagcgtcccgttgatatattatatccaccatcataccaaatgtcatatataaatatactttaatcaaaaaatgataaattatctttaaattatgatcctacattccaactctcaaatactaaaaaattttatct

SEQ ID NO: 26668 - DNA, 524 bp, Zea mays
  unsure at all n locations
  Clone ID: cC-zmle189101d10d1
acgcgcacgcccacgcgtccgcttcctcgcagcctcctagctccctcctctcccttttatggttcttggacttctccttctcggccatctggagcggtgcgcccagcccagccgcgccgagtttcgccctcgccatggccggtgccttctttgctctcctctccagccgcgccgagctcgacctctgcttctcttgcgtcgcgcgccgagctccatccatggcgggagctccctccctgctcggatttcgccaggcccgcgcagctccctggcgcccctctcctcgtaactccctcctctcgctccagctcgccgcgcactcctctgctcggcgcctttcctgctccccatgtctggtgccctgctgcccagcgccgcgcccctgctcctgttcattctagcagccgagtttcttcttccccggcacgtcgctctctctccctagncttctctcccctgcgcgctagtcgctcgtcttcctgcgagcgcccctgctccctctgccctctccctgacgcgcgccc

SEQ ID NO: 26669 - DNA, 463 bp, Zea mays
  Clone ID: cC-zmle189101d11d1
aggaacttctcaaggaatacgtggatagggaaaagaagaagatatgaatttatatcagaaaccccaaagccaaatggagctgggacaaaatttgatggaaatctttattccataacgcattacatcaaccctttgcagaggagagtttcccagtataacagaattacgtgttgagaaactaccaaatgatctcctttcaccacagacatcttttgctgctcgtcttgtggtgtagcattcttgcggtacaaaaggatccagatcattcttactattggacagatatttgtattttctcatgagtcttcaaatcaaatgtatttattttctgtcagtctgaaagtatatgaagcggcgtgtagggttaatgttactcataagcagagaaatatagctttctcttttgtactttgtggagatactttacgagccctgcgttcacttacatgtttttgcaaccatg

SEQ ID NO: 26670 - DNA, 276 bp, Zea mays
  Clone ID: cC-zmle189101d12d1
gggtagccgtagaacatgtgccaggccaagagcctattgtttcatgtttggctacatgttgtcaggtctgccgtggggcttgttgtattatactttgcggttcttgattcatgaaatactaaccgttcgtgtgttgcgtgtgtgtttggggtaattgaagaggacactcggcttctcgatggtgttggtcttgtgatgtatttagtaataagaaaataaaaaatgatttctctttttataataataattgtaatatttatttcttattgtgggcgg

SEQ ID NO: 26671 - DNA, 446 bp, Zea mays
  Clone ID: cC-zmle189101e04d1
cggccaggcgcagcggcagcagtgttgccagcagctcaagcacttggagtttcagcaccggtaccaggcgatcttcgggttgggtctacagtccatcctgcagcagcagccgcaaagcggccaggtcgcggggctgttggcggcgcagatagcgcagcaactgacggcgatgtgcggcctgcagcagccgactccatgcccctacgctgctgccggcggtgtcccccactgaagaaactatgtgctgtagtatagccgctggctagctagctagttgagtcatttagcggcgatgattgagtaataatgtgtcacgcatcaccatgggtggcagtgtcagtgtgagcaatgacctgaatgaacaattgaaatgaaaaaaaaaaaatattgttcctaataaaaattccaaaatctttatttgttatcatagtcacataaaatataaa

SEQ ID NO: 26672 - DNA, 365 bp, Zea mays
  Clone ID: cC-zmle189101e05d1
cgacccacgcccccgcaagaacggacgcctcgccatgctcgccgtcatgggcgcttgtttccatgccgagtacaccggcaccggcccagggacgggctcttcgcccacctcgccgaccctggccacgccaccatcttccaggccttcacccccaaatgaggagctctgatgaacttggcagttcgaggagtgctaccacacatgcatgcattgttaggtttgatggccgatatggaactttttctttttgttgggggcggactactgggtagactgtcaacgatgatgatgatgatgatgaaatgttcgtggtgcgatgcatggtgtacttgtactatgttagaactaatgtaaaaatgcaatgg

SEQ ID NO: 26673 - DNA, 669 bp, Zea mays
  Clone ID: cC-zmle189101e06d1
tccgcccacacgtccgcctcaaaaaaaaaaaaaaaaaaaaaaatttttatatttttaaaaaaaaaaaaaaaaaaaaaacccgaaaactgtttaatttaaaatattcatattttcccctttccttaactttttttcttttataatttatatcttattttttattattttttatttatatttatattttctaattcttttttaatttcttatattattataaaatttattttcttttcatatttattatcctttttcttaatattttctcttttatataaaattattctttttttcttaaaatatttttctcttttttttctttttttctataatatctacatattttatttcttttttattatcctccatattttattttatctcttttttttcttattaccatatttctattttctctcctctttatttttttttttttttttcttaatttttaatattctcctcttttttatattcccttctctttttactttaaactctcttttttctctttttcctcaaaaaacttcttttttttattatttttttttttttttttcccccttatttttttttaaatcttttttctttataatatttttatttatttatttttcctttggttccttttccttttttaatccctttttattctattatttttttttt

SEQ ID NO: 26674 - DNA, 434 bp, Zea mays
  unsure at all n locations
  Clone ID: cC-zmle189101e07d1
cgaccacacgcctccggatcgnggagccggagatcctgctggacggcgagcacggtttcgagttcacgttcgaggtggcgcagaaggtgggggccggaaccttctacgccatggcggagaacaacgtcatgttcgagggcatcctgctgaagccgtccatggtgacgcccggcgcggaggccaaggacagggccaccccggagcaggtggccgcgtacaccctcaagctcctccaccgccggatccccccctccgtgcccggcatcatgttcctctccggcgggcagtcggaggtggaggcgacgcagaacctcaacgccatgaaccaggggcccaacccgtggcacgtgtccttctcctacccgcgggcgctgcagaacacctgcctcaagacctggggcggccagccggacaaggtcaaggcggcgcangac

SEQ ID NO: 26675 - DNA, 102 bp, Zea mays
  Clone ID: cC-zmle189101e09d1
ccgaaaaaaaaaaaaaaaaaaaaaaaaaaaaaaaaaaaaaaaatttttatttatataaaaaaaaaacaaaaaaaaaaaaagagattgttataattttaaaaa

SEQ ID NO: 26676 - DNA, 253 bp, Zea mays
  Clone ID: cC-zmle189101e10d1
cgacccacgcctccgctgcagctcaggtgcttgtctgaggctgcctcctcattggttaccgttttgcctgctgctggtggatgtggtgaggaacaggtattattacagagccatgctatgtgaacattactagtagcagtgctcataaaagctacaatcccatgtcctttttttccccagtcatgtaaaacttccaaactgctccatggttcaaaactctgttcttcaatacatcatcaattatcgattaaaa

SEQ ID NO: 26677 - DNA, 359 bp, Zea mays
  Clone ID: cC-zmle189101e11d1
cgacccacgcctccgcccacgcgtccggatcgatgtgctgaggaggaaaagagaattatattttagggattattaaagttctgtcacgtgtttttgctgccggctatcgatcatgtggagcctggtgcggcgatggcgatgggggcggcggaggcggacggcgcgggtggtggacgagagcgcgctcggcgcagacggcgatactgacggtggcgccgccgctccggccgcgggcggcgcggtggtggcgccgacactgggtggcgctctagccagggcgctgctggcgctggcgtgcgccatccgcttcgacggcgcggacgtcagcgcgaccgaggaagcgtgggccgtcactgcgt

SEQ ID NO: 26678 - DNA, 567 bp, Zea mays
  unsure at all n locations
  Clone ID: cC-zmle189101e12d1
cgaccacgcctccgggacgcgtgggggaaccaagatcggagtctgtctctgttttagaattttccgtcttggatgaatctgacgatgaaatgcgttgtggtgtttctggcaaggatgaggaagcacatgtggaggagaaaactgtaactattgctgttgacaaggtaacaggaggttctgcacatttcgaggatcctctttgtgaggcatcgaggaaggaacctgacattgagaagagtcaccaagcctcggagaagaggaagacgatacaataggtggaacagtcttccctggttcaggtagctgtgaattatcatgtccacaggatggtggcatcgcagtctacgaggggcctgagatggtgtcaccagagagccaaactgatgctcggaaagaaaacatccattcagatgtcgctgagacagatgaatgcaccaagactcagaangccgctctagcaggcacagagggagaaaattctgctgaagatctggtgtgccggcgtctgagatggacaaatgcaacgagatgcccaaggatgctccgacacttacaggagcaggtgca

SEQ ID NO: 26679 - DNA, 492 bp, Zea mays
  Clone ID: cC-zmle189101f04d1
cgacccacgcccccggagaaccaaccgaataaccgctccaaaccctcctgccgattctgctttttacaactccgaggctaacaggcatgggcacgggacttgctactgcacctgttccggcgcccctacttgggcccgtactcgccgcccttcgcgtggccactcgctggcgcatgcgctccacggtgctcaccactgaaggcaccgctgaacccacgcttcgcactatcctgaacactaagcagaactgcaacccgtacgacaaccacccctacacttaccgttaccacagcggccactacagaggagactcaaagagagaaactgagagcgtatatgctagcgggaccatggaaactaccaagtcaactacagagttacggaatgggcattactgtgggtcttaatacccatttgaagacccatgtgctgcggctcctcactgttcttatgactattgaaaaaagaggcgagcattaaggcttggagaat

SEQ ID NO: 26680 - DNA, 465 bp, Zea mays
  Clone ID: cC-zmle189101f05d1
cgacccacgcctccggcttattgacaacttcaacggactaccaattagggcttatttatatgttctagtaccaaaggcaatcaaggaaagcggccgggagacggtgtcggggttcttcacccgcagaggccaaggatttccgccactcatgcgtcacattaggcagctcaggaaggtgaagatatggttctacagggatgcagaacccaaatacctagcaagctatctcccgaaagcgattacaaaattcctcaggaatgacaacgttcatcgctccctgtcacttgacttccaggatggcccaagacaaacagaaatactgcaggcttgtgtggctgaagctagcggtaatctttactccctgaagctgtcgtccggcacaaatctgagcacgatccaactgtcggttattgccaccaacaagctgactggaatcacaaagctatgcctttcccgctggaaaac

SEQ ID NO: 26681 - DNA, 558 bp, Zea mays
  Clone ID: cC-zmle189101f06d1
cgcttacctttatcacccttgttcctccaacaatcatcagccctattacttcagttacctttggtgcatttattggcggcaaagtagtcagggcacaacaactacaacaacttgtgctagcaaaccttgctgcctactctcagcaacagcagtttcttccattcaaccaactagctgcattgaactctgcttcttatttgcaacaacaacaactaccattcagccagctatctgctgcctacccccagcaatttcttccattcaaccaactgacagcattgaactctcctgcttatttacagcagcaacaactactaccattcagccagctagctggtgtgagccctgctaccttcttgacacaaccacagttgttgccgttctaccagcacgctgcgcctaacgctggcaccctcttacaactgcaacaattgctgccattcaaccaacttgctttgacaaacccagcagcattctaccaacaacccatcattggtggtgccctcttttagatttcttatgagttatagttcaataataaacgttcttgtctgatgt

SEQ ID NO: 26682 - DNA, 386 bp, Zea mays
  Clone ID: cC-zmle189101f07d1
cgaccacgcctccgcccacgcgtccgctcattggaaccgtgggccaatgtttgtttatggttctcgcctttggtgcgttgattccgggggatcgcagtccgtcaagggtgctgccgtcggactcttcacctacatcgcgttcttcggtgccacctggcttccgctgccctggttgtacccggccgacatcaaccctctcaggacccgcgccaaagctaatgctctctccactacgagcaactggatctggcatttcttcatcgtcatgattacaccaatcctcatcgcctctatcaactggggcacctatctgttcttcgctgtgttgaatgcttgttttatccccattctctatttcttaatccccgagactgctggtcgttccc

SEQ ID NO: 26683 - DNA, 526 bp, Zea mays
  Clone ID: cC-zmle189101f08d1
cgacccacgcctccgcccacgcgtccgcccacgcgtccggtgaagacggccgccatttacgtgttacgacgccgtccaggtcgggtaccggggcgggcgcgaggacaagctcacccgcccggagctgggccacctgggcaaggccggcgccccgccgctgcgccacctgcaggagttccggctcaccgccgtcgacgccttcgagcccggccagcccctcgacttcgccgacctcttcaaggagggcgacctcatcgacgtctccggcaactccatcggcaaggggttccaaggtggcatcaagaggcacaacttcaagcgcgggctgatgacgcacggttccaagagccaccggcagctgggttccatcggagccgggacgacgccgggccgcgtgtacaaggggaagaagatgcccgggaggatgggaggaaccaagaccaagatcaggaagctcaagatcgtcaagatcgacaacaaccttcgggtgctcatgatcaagggggctgtgccagggaagcccggg

SEQ ID NO: 26684 - DNA, 515 bp, Zea mays
  Clone ID: cC-zmle189101f09d1
acgacccacgcctccgcccacgcgtccgaccgcacaacggcgaggatcttccctgctttcctttacgtcgagaacccagagttcaagagggagctggacaggatggttgacatcaaccagaacatcattgccgtcggagagtccgacgaaatccccctagtgaagaacctgaagaggattcctcttgtcgcctctctggtgtccgagatcatcgccgcctacctcatgccccccatcgagtctggctcggttgatttcgccgaatttgagccccggctcgtttactgattctgtacaaagatttatccttgagttattcaccctgaaagacaagctgctggtgctttctgccgaaggggccttggatgaatggtgaaaaccgctggatggttagaggatctacatcttcttgtgttcttctgtaaaatactgagacttgggccgcataaaaagcttggcaaatttcttgtgtgtggcatctccatgtaagtaacagtggactgcattagaagcga

SEQ ID NO: 26685 - DNA, 439 bp, Zea mays
  Clone ID: cC-zmle189101f10d1
cgaccacacgcctccggtgactacctgatgatcaagggatgctgtgtgggtccaaataagatgttggtgaccctccgccagtccctcctgaggcaggcttcccggctggcgctggaggagatcaagctcaagttcatcgacacatcgtccaaatttgggcatggtcgcttccagactaccgatgagaagcagaggttcttttggtaagctcaaagcgtaaggtgctgcggtgcaaccaccaggtccattttgcaaaaatcataaacctggaaaccttttgtttgtaccctgcctgacccacgtttaataccaggataatttggaaccttaaaaaatatataaaatattctttcttaaaaactaaaataaaaaaaaaggggggcggccgttttaaaggatcaaacttaccttccccgtgcttgcaaaaaaaaactttttt

SEQ ID NO: 26686 - DNA, 560 bp, Zea mays
  Clone ID: cC-zmle189101f11d1
cgaccacacgcctccgcactcaacagcaacagctaagcctctcccacaagatagcaatatggtttaggaggaggccaagaaggtggaggtggaggggggcaatgagcccgaggcggcggcgaaggaggacgtagccgatgacaaggccgtcatccccgcgaccgacccgccgccgccgccgccgccggccgacgactccaaggccctggccatcgtcgagaaagttgcagatgaacctgctcccgagaagcctgcccctgcgaagcaagggggctccaatgacagggatctcgctcttgcaagggtggaaacagagaagaggaactctttgatcaaagcttgggaagagaatgagaagacaaaagctgagaacaaggctgctaagaaagtatccgctattctttcatgggaaaacacaaagaaagcaaacatagaagctgaactgaagaagattgaagaacaactggaaaagaagaaggctgaatatgcagagaagatgaaaaacaagttgcaatgatacacaaggaagccgaagagaagcgagcgatggtggaggcaaa

SEQ ID NO: 26687 - DNA, 522 bp, Zea mays
  unsure at all n locations
  Clone ID: cC-zmle189101f12d1
cgacatcttttatacatttggtgaatccccctcccctctcatgctttttcactgatcatggggctactcagcatgatcctgtagatcaagcgcaaggagaaggagatgcgcatcctcatggttggcctggacaactcagggaagacaaccatcgttctcaagatcaatggggaggacaccagcgtcattagcccaacccttggattcaacatcaagaccatcaagtaccacaaatactctttgaacatatgggatgttggaggacagaagacaatcaggtcttactggagaaactactttgagcagactgatggattagtttgggttgttgatagttcatacataangaggcttgatgattgccgtgctgaactccacaatctcttgaaagaagagagactagttggagcttcattgttggtttttgcaaataagcaagacatacagggagctctaaaaccagatgaaattgcgaaggttctgaatctggaagtgatggacagaaacaggcactggaaaatt

SEQ ID NO: 26688 - DNA, 246 bp, Zea mays
  Clone ID: cC-zmle189101g04d1
acgaccacgcctccgcccacgcgtccgcgcaactaccggtagtgctgcggggatcaattttttagtaataaaaaatctatcaacgcggagggtgcgctgttgtttatagtccctgctgctaaccacccttgttgctggtgctgctggagaggcattgtacctgtccatgcatatatgatatatatatgttgtaacgttgtgaaagcaaacaatcttgggtaccaatgtttgttattctttcgctcg

SEQ ID NO: 26689 - DNA, 503 bp, Zea mays
  Clone ID: cC-zmle189101g05d1
cgcggacgcgtgggcggacgcgtgggcggacgcgtgggcggacgcgttttgcggggaggagagcgccggcggcggggggctgtttaagatggcccagggcttcctcaagtagatatattgtctggccaacgtatatacgtgtactcttgtagtgtctgttacgtaattagcttcaaaataatgttcccctcgcctttatttgctgtgcgcgcgcttgcttcaagtccctgtaataaccgagaacgttaattgtagcagtgtgttttttatatgattaaataagtactattgtataaggctagtgcagctgtgcaggttactctatattcttactctatatcactatttatagtctactcatcaataaatagattgcttgataatatacatcaagaaggacatcaccatagagttcataacaaatgcatagattgatgatttctgtgatacgaggtcacacagagtacaaataaaataaagtggttagtttgtaatcccaaaaa

SEQ ID NO: 26690 - DNA, 487 bp, Zea mays
  Clone ID: cC-zmle189101g06d1
cggacgggcgtcatcccgcccgcgggcacctacaactactgttccgacttctacacgctcttcgtcttcaacatggggctgagttgcttctccgagcaccgccgcctccaagactggtacaacccgggctccatgggcaagcagtactttcctcggcctggagaagttccttgcccggttccggcgacccgtcttaccccggcggcccctttttaaacccgctcggcttcggcaagaccgagaaggagatgaatgagctcaagctcaaggagatcaagaacggcaggctcgccatgctcgccatcctcggttacttcatccaggggctcgtcaccggcgtcggcccgttccagaacctgctcgaccacctcgccgaccccgtcaacaacaacgtgcttaccagcctcaagttccactagaccgtggtgcatcagcatacctgctgctgccgccgccgccgcagttgtttgctgtggaagctaaatca

SEQ ID NO: 26691 - DNA, 599 bp, Zea mays
  unsure at all n locations
  Clone ID: cC-zmle189101g07d1
cggtggtctgcncgtacgcgacacagccccgatccgaatcgtcctttttgcgagcctcgccgatcccccactccggtccgggggcttcaagatgcagatctttgtgaagaccctcaccggcaagactatcaccctcgaggtggagtcttctgacaccattgacaatgtcaaggctaacatccaggacaaggagggcatccctcctgaccagcagcgccttatcttcgccggcaagccacttgaggacggccgcacacttgctgactacaacatccagaaggagtcaacccttcatttggtgctgcgccttaagggaggcatgcacatctttgtcaagaccttgactggcaagacaatcacccttgaggtggagtcctcagacaccattgacaatgtcaaggctaagatccaggacaaggagggcatccctcctgaccagcagcggcttatcttcgccggcaagcagcttgaggacggacgcacacttgctgactacaacatccagaaggagtcaaccctccacttggtgctgcgccttaggggaggcatgcacatctttgtaagaccttgactgccagacaatcacccttgagtggagt

SEQ ID NO: 26692 - DNA, 179 bp, Zea mays
  unsure at all n locations
  Clone ID: cC-zmle189101g08d1
accacgccccgggacgcgtgggatgatatttggaaatctcctctatccattcctttttatctatatctgtaataatgcagtaggacgagcgcacattatcatgtgtggtatgaccaataatatatgcatgatcataataaagttttggttttaatgaatcacacncaaaaaatttttat

SEQ ID NO: 26693 - DNA, 584 bp, Zea mays
  Clone ID: cC-zmle189101g09d1
agcgtggcgaaggggtcaccaccaccagccttccatttccatttcagggcgtcgactttcgcggcgggcgccagcgtgcggctcgagctggacgagaaccccgaggccatcatctcgggggcgtggcccgggaactgctccctcctcagcttacgacgacctccgcgcctacctcgagtcgcaggagacggcggcccaggcagacgatcagcgcggcgtggcgctcctgagcgagaccatgtccacacccgtgctggtggccacagcagaccagaccctggaggacgtcgagtgccacttcgaggccgtgtcggggcttccggtcgtcgacagcggcctcagatgcgtcggggtgatcgtcaagaacgaccgggcaagagcctctcatgggtccaagacgaagatatcggacgtgatgacatctccagctatcacactattcggctgacaaaaaccgtgatggatgctgctggtctcatgctcaagaagaagatccacagattaccagtttggaaaccaggactgaaaagtaataggtataggtacccgcgcttgatgttcttcgcgtgttggaaggcatgttg

SEQ ID NO: 26694 - DNA, 528 bp, Zea mays
  Clone ID: cC-zmle189101g10d1
cgcgcgaccacgtccaagaagcaggccatgcacacgcggctgttcggcgttgagtggtggatgaagcgcaagaaactgccggggagctttcgcggccgggtgcgccagttcgagcgccagcggtgggccgccacgcgcggcgtcgacgagtgccacatcgtgcgcgacctccccgagggcctccgccgggacatcaagtaccacctctgcctcgacctcgtccgccaggtcccattcttccagcacatggacgacctcgtgctcgagaacatctgcgacagggtgaaatccctcatctttcccaagggagaaaccatcgtgagggagggcgacgtggtgcagcggatgctgttcatcgtgcggggccacctgcagtgcagccaggtgctgcggaacggcgcgacgagcagctgcacgctggggcctggcaacttcagcggcgacgagctgctgtcgtggtgcctgcgccgcccgttcctggaacgcctccgacgtcgacggcgacgctggtgaccctggagagcaccg

SEQ ID NO: 26695 - DNA, 276 bp, Zea mays; identical to SEQ ID NO: 26670
  Clone ID: cC-zmle189101g12d1

SEQ ID NO: 26696 - DNA, 593 bp, Zea mays
  Clone ID: cC-zmle189101h04d1
cgacccacgcccccgcccacgcgtccggacatgctgtcttaggagcttctgaatcttgtccttatctgatattaacgggacaccaggaggatgcgggatttgcgcttgccatgtgtccagcagaaccatatgtcctgtcaggaggaaaggacaatttgttgtcttgtggagcatccaagaccacatatctgcccttggggattcctcgtcttctcccggagcatctggcagcaagcagtctggcaaaattgcaaatgaaaaggagagtcctaaagttgatcctagaggtatattccatggccatgacagtactgttgaagatgttcagttctgcccttccagtgcgcaggagttttgtagtgtgggtgatgatgcttgtcttattctgtgggatgctcgaactggcactgacccagctgttaaggttgagaaagctcacagtggagatgttcattgtgttgattggaatccccttgatgttaactatatcttaactggttctgccgataactctgtccgaatgtgggatcgtcgcaatctgggttcggaggagctggttttccaatcacaatttgagggcataagctgctgtc

SEQ ID NO: 26697 - DNA, 601 bp, Zea mays
  Clone ID: cC-zmle189101h05d1
cgagaaagcccgcgcgggttcgtgtaccgcgagaactccacctccccgtgctactacgactgtcgctactggaccatgtggaagctgggcatgtgcggctgtaccgacgccacgcaggtgtacaaggagctgcaggaggccatcgccgcgtacccggacgccttccaccgcgtcatcggcttcgacaacgtcaggcagacgcagtgcgtcagcttcatcgcctacaagccccccggcagcgagtagagaccgtggctagatcgacccatggccatgcctctgcctgttgatcggatcaccttcttgcattggttcctctctctctctccctccttttttttccctttatctcatcatttcttttctcctgcatgcaatggttccttttgcttccaacaattctcctgctgatgtatccagcatggcatcatccatctacaattacgtacgtagtgcaacgactgtcgattcgttgcgtgaggaacatatatgtgaatgcaagctccggctaccatacatgtgtaatgtgtaatagatatatatacaaaactgccgaggcgccgacaatactttaataacttggccttttataaaaaaaata

SEQ ID NO: 26698 - DNA, 249 bp, Zea mays
  Clone ID: cC-zmle189101h06d1
gatctgcgctagatgctagtgttgtaacgcttttgattgttgatggatttcatatatgtactgtatttgtacatgaacagagcgtagtgtccattttcatagtgttcaaaaaaaaaaaaaaaaaaaaaaaaaaaaaaaaaaataaaaaatattataaataaaaaaaaaaataaaaaaaaaggggggccgataaaaaaaaactaactttactaacccgtgcatgcaactatataattatattatagagaa

SEQ ID NO: 26699 - DNA, 325 bp, Zea mays
  Clone ID: cC-zmle189101h07d1
cgcccacgcgtccgcccacgcgtccgcggacgcgtggggaccttcggttttcgtggaggcggcggcggtgggtacgggggtggtcgtggaggcggcggctacggcggtggcggtcgccgtgatggcggcggcggctacggcggtggcggcggctactggggcggcggcggctacggtggtggtggcggcggctacggcggtggcaaccgtggcggcggctacggcaactccgactggaactggaggaactgagcggtggggtccgcgcggccaagttatcctgtttgctgccgtgatgtttaccctaatccagagggtttatctt

SEQ ID NO: 26700 - DNA, 180 bp, Zea mays
  unsure at all n locations
  Clone ID: cC-zmle189101h09d1
cgagggtggccatggtggcgctgctgccggnaggcccgccaatcggctttttctttgaagattttcaacagtcgtgggtcgtgtgatgttgaacatgcagctgcatctcatatgtattctatagatattatttatgtgaaagatgctacagtacgctccccctgcgtttacattcagcgc

SEQ ID NO: 26701 - DNA, 293 bp, Zea mays
  unsure at all n locations
  Clone ID: cC-zmle189101h10d1
cgctcgccatcacataaaaccagngcaagcagaagcagcgcatttgcgtattagcaccatggccctctcctccacagggttctgcggcaaggcagtgaacgtgccgtcgtctctcttcggcgaggcccgcgtgacgatgcgcaagacggcggcgaaggctaagcctgctgcaagctccggcagcccgtggtacggccccgaccgcgtgctctacctgggcccgctgtccggcgcgcccccgagctacctgactggcgagtttccgggcgactacggcttggacaccgcggggc

SEQ ID NO: 26702 - DNA, 448 bp, Zea mays
  Clone ID: cC-zmle189101h11d1
cggttacccttctatggatgctcatttattgtccatgacagcaatatgtttatgagcaacaaaggagcaaaaagcgggtgtgggtcaatgttacaaaaaaaacaaaaaaaaaaaaaaaaaaaaaaaaaaaaaaaaaaaaaaaaaaaaataaaaataaaaaataatttaatttaaaaaaaaactaaaaataaaaataatatatataaaaaaaaaaaaaaataaaaaaaaaaaggctaacttttataaaatatcaaatttattaaaacgctcttactaataaaataatttttataatctgaataaaaaattaataaattgaccccctttattaaaaatttttataataaaaaaaatttccttaaccaaaagtaaatcctatttaataaaaaccccttttgccaaaagttaaaaaaaattaaaaagcttataaatattgcttttataaaaa

SEQ ID NO: 26703 - DNA, 276 bp, Zea mays; identical to SEQ ID NO: 26670
  Clone ID: cC-zmle189101h12d1

SEQ ID NO: 26704 - DNA, 324 bp, Zea mays
  unsure at all n locations
  Clone ID: cC-zmle189104a01a1
ctgattggtttttttttttttttacccttaaaactcccccactttttacttttttcctaaaaaaaaaaaccccattttttttttttcatcacacccctttttattttttttaaaacaaaatttttctttttttaaaaaatttaatttcttacacacggtttatttttcaaaaaaaccccacaatatttttttccccccccaaggaaaaaaaaaaatctacaaccccctctctgnnnnnccctaaaaccaaagctatcaaaaaaacacccctagctccccacccaaaacaccccataaaaaaacttttttacatcccccaccccc

SEQ ID NO: 26705 - DNA, 473 bp, Zea mays
  Clone ID: cC-zmle189104a01d1
acgcctgcagcgatcccgggctgctgctcttcgtctcgcctgtcttttcttgtttgcctccctgcctccacaagcagaaggcgtgtcaaggtcacggccatggcgccccaaaagaaggtgaaccgctacgacgagaactggtcgaagcagtggttcggcgcgggcatcttcgcggagggcagcgaggtggtgtccgtggacgtgttcaagaagctggagcggcgcaaggtgctgagcaccgtggagaaggccggcctgctgtccaaggccgaggagctgggcctgacgctctcctcgctggagaagctgggcctgctctccaaggccgaggacctgggcctgctcagcctcgtcgagaccgcagcggggacgtccccctccgttctcgcctacatctcgctgccgctcctcgtggccgccgtcgccgcggtggtcgttgtgcccgacgactccgtcgcgctcgtcgccctaca

SEQ ID NO: 26706 - DNA, 363 bp, Zea mays
  Clone ID: cC-zmle189104a02a1
ccggtaatgtcatttttttttgtgtgatttaaataaaaacaagtctggagccacccccttaccttacaggcaaaaaagcacaccacttttatttcaaagacaaaatatttatttatccaagttacaccaaaaggagcacaactgaagagcttaatagctggaatgacccaaaaatcccatcctagcgtccacagaactaaacatcaataccttgaccctaaactatcgtacctcaacctatttcacataatggaaggaatccatgatggcgctagccatataatcacacttagccagggacagcccagctaatgagatccgcccatccttggccatttaaatatgccatttattcccaatgtt

SEQ ID NO: 26707 - DNA, 443 bp, Zea mays
  Clone ID: cC-zmle189104a02d1
cggctaatggctagacacatcaagaacataacacagaagctctatttcagtttttctgccaaacataaaatcggagaggacggtgcttttattcataggaagattcacatgtcctactacaccagcttgaacaaagcacatagtgacagcatgacgcataaaagccatacttacatcaccaaagatgggcctatctccttagctaacctgtgccagtctaacattgatgatctagccgacgccatcatctattccatccataatgcgaaccatgcttacgtacgaacattaatggtcaacctattgatgatttacatccgaaaactctaggctgctattaatgggttcttgcaactatacatctcttccgacgtgctccatctgatgtaacctggataaataaatattttgtcgctgaactaaaactcctgtgcctttttacc

SEQ ID NO: 26708 - DNA, 433 bp, Zea mays
  Clone ID: cC-zmle189104a03a1
ttttacatgcatacgcaaacttttcccaacaagctgatggaagggtccaaccttagatagactgtgcatatggttgtgtaaagcattgttttgaactacacgcttacagaatagaatttgaaatagaatatgatagctgcttgagacaggcagacagccttatagataacaacaccagacgcacccatgacaatacccagctaatctattactatgttggctcatcgatccaacaccttttttttcgtcgtcgtcgtcgtaatcattttcacacgcacccacgcacgcacgccatcgttttattcatccggatccattgctttagttcagaagttggggcctgcggcgaggatctcgtcagtcaggctgctgtcgtccccgatcttgtagctggcgaacacctcgaagtttttcttgaagagcccgccgagcc

SEQ ID NO: 26709 - DNA, 572 bp, Zea mays
  Clone ID: cC-zmle189104a03d1
cgccccatgctcgccgagaagatgcagaagtacggcgccaccgtgttgctcgttaacaccggctggtcgggtggcgggtacggcgtgggcaagaggatcaggcttccctacaccagaaagatcatcgacgccatccactccggcgagctcctcaccgccaactaccagaagaccgaggtgtttggcctggagatccccactgagatcaacggcgtgccgtcggaaatcctcgacccgatcaacacctggacggacaaggccgcgtacaaggagaatctcctgaggctcggcgggctcttcaagaagaacttcgaggtgttcgccagctacaagatcggggacgacagcagcctgactgacgagatcctcgccgcaggccccaacttctgaactaaagcaatggatccggatgaataaaacgatggcgtgcgtgcgtggctgcgtgtgaagatgattacgacgacgacgacgaaaaaaaggtgttggatcgatgagccaacatagtaatagaatagctgcgtattgccatgggtgcgtctggtgttgttatctataaagctgtctgcctgtct

SEQ ID NO: 26710 - DNA, 467 bp, Zea mays
  unsure at all n locations
  Clone ID: cC-zmle189104a04a1
agcaggagtccgactctgtgcggtttacaaagaaaatatatagataggcccatgtccaatgagtatagtccatctaaactgctgacctgaaagagagggagagagagagagttacaggcgtatatgaaggtcactcgacgatcatttgttctgcaatgtgctgctgttcaacaccagataatagattggtaataaacaaagcgactcaagacgaatactacaaaacaaggcataatcttgattgtcgacgatgttgttgttgtgtcccacacgcanaaggtaaaatattcacagcagtcagctcatcatgcgctctttttccttttctcctcttcaatcttagccttaatgtgagagtacatagcaacaccagctatggcaatggacgtgccaattccagtttgtgtgctaattttggtgccaaaaacaacgattgagaagccaatgacaaacacacgctttaacac

SEQ ID NO: 26711 - DNA, 530 bp, Zea mays
  Clone ID: cC-zmle189104a04d1
actgcctcatcagctggagtgtcggtctccccaagcgagttcctatttatggcacgctcctgaagcttcgctttcgggtcgccctgtgccatggtattggtcacatcactagcaatgtgtccttcgctgctgttgcagtctcatttgcccacactatcaaagctctggagcccttcttcagcgcagctgctactcagtttatccttggacagcaagttcccttctctctgtggctttctcttgcccctgttgtcatcggtgtttcaatggcatcccttactgagctctcattcaactggactggcttcatcaatgccatgatatcaaacatctcattcacctacaggagcatttattccaagaaagccatgactgacatggatagcaccaacgtgtatgcttacatttcaataattgctctcattgtttgcattccgcctgcagtgatctttgaagggccccggcttatgcagcatggattcagtgatgccattgcaaaagtaggcttgacaaactttgttagtgaccta

SEQ ID NO: 26712 - DNA, 441 bp, Zea mays
  Clone ID: cC-zmle189104a05a1
ttttaataagatcaagcagaacatagtaatcataggggataggttctgagattcttactgcaaggatccaaaatacacctcatagttagccaacggtgggtgctacatgcaatgcaggcagcctccatatacagagcccccgtcttggacgactactgcgcatggatgccaagtttcgcatgctgttataggttacactagacatgataactgatggcacggatagaatatcaggagggcacacaacatatactccgtgccactaagttctctagctacttcatgagccgatcacgcttcggcgcttgctgtcgatggtcatcctgttgacctgaagacgacccgaccttgctgaaaaccctgccgccaaagagctcctttccgatcctagccttgaaggggaactgcctcttgaagcggttgcggaacaacgagccgccg

SEQ ID NO: 26713 - DNA, 548 bp, Zea mays
  Clone ID: cC-zmle189104a05d1
tacctggcaaccatatgggcaggcggtctttcatgtctatttcagtgttcccacttgtcttccggaacccggtgtccggatcagaatcgtgcaggatgcttgaggttagtaatgccgggcgagcgacaccaagtgatgacagccaggcttctcctctgtggcgtcgcagcttggcgagcccagagctcaagttccataacgcactgaacgaacttgggaagatggaggtttcacctgaacggaacacgagctcaagaagggaagggttcagatggagcaatgccagcagttatgattttggatacgatggagatgccattgacatgtcagatcatatcagtatcgagtcccagagatcacccacaagctcagtgaggttcctgaaatgtgggctctgcgagagattcctgtgccagaaatcaccctggacctcgaaccggattgttcgaaacgccgatatgccagtagcagcggttcttcattgccgacatgtcttccatgcggattgcttggaggagggcacttccaagacagaagtccatgaacca

SEQ ID NO: 26714 - DNA, 301 bp, Zea mays
  Clone ID: cC-zmle189104a06d1
cgcgtggggtaccattttgcagctcgagagctaatggtgtttgtattttattcagtgctatttacaaatactatgatgtttgccttattggcgtgtgatgatgccatttgccatgcttgtggtcgcagtggtcaatgttagtgcaaaatattgtatatatatttgacatccaccatatgaatcatgatgcttgtgcagtacagttgtgttggtgtttaaaaaaaaaaaaaaaaataaaaaaaaacaaacaaaaaaaaaaaaacaaaaaaaaaaaaaaaaaaaaaaaaatactaaaacaagg

SEQ ID NO: 26715 - DNA, 342 bp, Zea mays
  unsure at all n locations
  Clone ID: cC-zmle189104a07a1
actggcgctggggataattaactaaaaaacacccaccccccgcggtgtaattgtgtacataacctcaatgggatacacaaacatgccgccgcaaagcaaaacacgttgcaaatcccctttttttttaactccgtccctttttttttttccctttgggcccgcaaaaactaggcgttggaggcacgttagcgccaggtttttctcccatgcttacgcagccacagccgtccacaccttggatgctcacagctcgtccttgacgggctcggggggggctgcctttttggatgccggtggcccctgggtggtggtggtgngtggcagcccctgccgtctccttgc

SEQ ID NO: 26716 - DNA, 418 bp, Zea mays
  Clone ID: cC-zmle189104a08a1
tttttcttatttttttttattttttcttttttcttttctatgttttgttttatttttttctttttcttattttcttcccaaaaaaaaaaccaaaaatactcttaaccctccccacattaaaataaaataaaaactattccatttctcatttcttggctatgtaactacctgtttgctgttcaccataaaaacctctattgatattgcttaacgcaacttgatattcatcaaacccaccctaattaattacaaaatcatttccattgaaggaaaccacaccccatctatgacaagtattctccaccatccttttatcagcagaagagctaaatgtttctttacctatattccaaggggccacttggccattgctcccttggttatcacatcttacgatccttatagaatcattttgcca

SEQ ID NO: 26717 - DNA, 412 bp, Zea mays
  Clone ID: cC-zmle189104a09a1
ttattatattatgcactttcttatttctgggaagcgacagactttatcaaaaaaactttattattgaactataactcataagcaatctaaaagagggcaccaccaatgatgggttgttggtagaacgctgctgggtttgtcaaagcaagttgcttgaatggcagcaattgttgcaagtgtaagagggtgccaacgttaggcgcatcgtgcaggtagaacaacaacaattagcgatgggttaagaaggcatcaggactcacagcagctagctggctgaatggtattagttgttgctgctgtacataggcaggagagttcaatgctgctacttccttgaatggaaaaaattgctgggggtaggcagcaactctctggctgaataggattactagtttgttgttgcaaataagca

SEQ ID NO: 26718 - DNA, 410 bp, Zea mays
  Clone ID: cC-zmle189104a10a1
aaggtaataaatcacccactccatatggatcaaggttaagtgtgccgagtacgaacaagccggcagtcggcaaatggttcaccatgcacgtttcaaaacgagttgaatcttcaaaccacccaagtcttagcgtcaaaacttaaaacacagattcttacgatcacatacactgaccacagctaaatcacatgaacaggttgggcctcgaagccttgaacgtggtcttcagcttcctggtcggcggcctgaccttgcggtacacgagtgggaacttgatctcactgttgtgaaactgcttggtgttgtccctcttgcacagcttgaagtgtactgtggcggtcttgatgatctggatgcagggggacctcacgcggtggcgagaagccatctcattgtacatctgctctaca

SEQ ID NO: 26719 - DNA, 326 bp, Zea mays
  Clone ID: cC-zmle189104a12a1
cacaatgtgcgaaagggtgtataaaaaaaaatgataaacaggtgttcttgttttatacagggtgtttttttagagagagacaaagagcaagtgaatttgtaggaacaacccccacggaaaacgaacgcaagcctatttcctcattacaaggaacggaggcatacataggtctcatgtgtgagcactgagcaccgttggttccggatcatccttatgccttccaccatgggtcctccccggtcctaaagtcggtctccacccacggaacaaaaaggaccttgccgtcgtcaacttttgcgtgaaccagggccatcaacaaaggctcc

SEQ ID NO: 26720 - DNA, 443 bp, Zea mays
  unsure at all n locations
  Clone ID: cC-zmle189104b01a1
gcagctagcgaacagggcagagagacatcaccgcaataggacaacagcacaaattatcaatacattggactagagctcaatcgcttttagaaaacagtgtactaatcaggactgaaaacatggcataacgctctgaacttgagacgactaaccaaaaaaagtgtactcatcaggacacacatttcggtgcaagacaatccatgagaatgctctaagctacagcgctcttgcccttcttcctctgtagcttcttcatgtagaactcaagctctttaccctcaaggatgtacccatcagctcggccacactgtccagggcgggaagaaatgcatgccagcaaccgtccactgccaaattgctcctcaatgtgtgcgtcaagggtacgtccctccttgcgcttctcaagcttcctcgngacatggttgctctttttcgtttcctca

SEQ ID NO: 26721 - DNA, 504 bp, Zea mays
  Clone ID: cC-zmle189104b01d1
gcgcgggcggacaaggagcaggcggaggaggagttttgccatttcacaatgggtatctcgcgtgagtcgattgtcaagctcctagccaccggtggaaagcacaaggcctggaggaagaagcgaaagtatgagcttggtcgccagccagccaacaccaagttgtcaagcaataagacagtgaggagggtccgtgttcgtggaggtaatgtgaaatggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgcttggggacaagaggttgaggcaacagctgaggaaacgaaaaagagcaac

SEQ ID NO: 26722 - DNA, 341 bp, Zea mays
  Clone ID: cC-zmle189104b02a1
cgggttgtgttttcttcgccctaacggctgacaaaacaacaaatcaattaaaaaacataaaaaaaaaaaaacaatgcctaactaacccgaaagaacaccttcgcatataggcatgccaaaaaacacatgggcaatttaccattacccaaacaaaaggcgacaaaaagccaacccccttcacccatcaaaaactgccaaaccttttgacccccacaaaacacccaccctccttaaacccaacaaaaaaaaccccacaaccaaaacttaaaccacaaccgccgggaatcctcctttccctaaaaaagccaggaaataaccctatccttccacccccggacaaa

SEQ ID NO: 26723 - DNA, 461 bp, Zea mays
  Clone ID: cC-zmle189104b02d1
gcccacgcgtccgcaggattggtttaggtgcccttctttcaggttcccggtttgtttcagatggcatgcttcaagcagcagctgagtgcctggcatcatacatcacagacgacgaaattcgaaaaggaatcctcttcccttcggtctccagtattaggcacatcaccgcacgtgtcggcgcagcagtcgtccgtgccgctgttgctgaagacctggctgaggggtgctgtgatgtgggtcctagggagcttgggagtatgtcagagtcggaagcagtggactacgtcgctcggaagatgtggtaccctatttacagccctcttgtgagcgacaaataataaatccgaagatctcgatgcctgcgcagaagcagatgttccattgaaggaatgtatcggatttgatatttttcttaaccatctctaaattagctgctcatctagaaagcatttcggcaaaaa

SEQ ID NO: 26724 - DNA, 412 bp, Zea mays
  Clone ID: cC-zmle189104b03a1
agagccgggttttaaccctttaaccccacaccaccccccccaaaacacccaactttccctataaaaatccctaaaaaaacacaaaataaacatttcaaccttttaaaaataaaaaaaaattttatcccctaaaaaaaccacaaaaaattctaacctaaaacataaaacaaaaaaccactttttcctaataaataaccaaacaaaaataactaatggttctataactaaacgctttccatatcaaaaaacaaaccccccaaattccttaaaaaaaaaatccacccccctaaaaaaccccctttcaaaatctaaaacaataaaaatttccttttaaccaatcttacaaacaacaggtacttgctctttatacctctcccccaaaaaaattttcaaaaaacactcaaaccttatc

SEQ ID NO: 26725 - DNA, 364 bp, Zea mays
  Clone ID: cC-zmle189104b03d1
aaaaaaaaaaaaaaaaaaaaaaaaaaaaaaaaaaaaaaaaataaaaatttataaaaaaaaaaacaaaaaaaagaaacaatgtaaatcttaaaaaataatatctcctctaaacctcccctaaattacaattcacctaccccatatttttacaaccatcttatactataaaaaaccaccttgataaccccaacttatatccctttttttacacatcactcctattcacacaaccttccttttttatctcaaaagttacctcccccaatctcctcttcccaacatttttctcaccactaatatcctcaacccaaatcccccccttgtaaacactccattataactcctccatataatttttatctta

SEQ ID NO: 26726 - DNA, 400 bp, Zea mays
  Clone ID: cC-zmle189104b06a1
atattcttcttttgtgtttgttttttttttattttttttcatttttcctcaccctttaatttttttttttcccgccccccacccttcattcaaaaatatcataattgccaaaaaaccaccattaaccaaaaatttaaacaccaacacctatcaaaaaataaaaaaggccccaccccaaaaaacaaaatacaacttatttcaaacaaacaaactcattttttattacaaaaaaacccctatataaacagcggcaccccttattaaaaaaaccctaaaaaaatcttcaaaaaaaaaaccaatccttcccttaaaaggcgttttacataaaaaaaccaaacttctcaaaaaaaaagggctcaaaaatcctccccaaccttttatctggggaaacccctcccca

SEQ ID NO: 26727 - DNA, 465 bp, Zea mays
  Clone ID: cC-zmle189104b06d1
ccccaaactaatcagtctgtgtaagttttgctgcccttgttttgattataggctgtgcctattatgctatgggcccctgtaagggagagcacttgtatattattatcaatattcatttagggttcttgataaaaccgagtcactgtttatatggagttgtcacatccaaagatacggaaattgtaatctagcataatgtcagatttgtatctgtgtagtggagcattttatatcaattagtaactgttgtatatcaccatctgctgtaaaactcgattgttgacagttaagatagtctaatgaatagttcgtggccaaaaaaaaaaaactaaattaagccgatataaaccaaataacaaaaatagaaaacaaaaaaataaaattaaagacatgaaaatccctttcaccccagttaagtaggggggggcccgttttaaagattcaagccttctttcccctgccttt

SEQ ID NO: 26728 - DNA, 466 bp, Zea mays
  Clone ID: cC-zmle189104b08a1
gggtgggaataaagggtttaaattaatcttatttattaaccgggattgaattattaatgggggaaatggcttaataaccgtaacgaatgatcttaacctttaaattttatgccagcatgtgctaactctgctttgccatatagctaaaatgaggggcatgacaaattggttctccgttgttaccacaaacacttttttttattcttatcaagcttacttaactagaccttctaatcattactaaaatttgttttgaataaactattgctaactattattttaagggcccttaaagggagggggccctttttttgtgcaccggtggcacattccccccgcccggtcctggttttgaggagggattttacacaccaaaatattagggagatgatgtttgggaccaaggacactatttttttgggaaaatgaatgagggaacctgttggagtaagaaaaatcacttttt

SEQ ID NO: 26729 - DNA, 456 bp, Zea mays
  Clone ID: cC-zmle189104b09a1
atcgatgggtgcgtggcatccgatacaatttttttcaaaaagagtcatcatgatcgtaactctgtaatttcagatttgacacaattatttttatggtaccggagcacttcggtttgtgcaaattttcatacctatcgtagatatacacacaaaactcaatgagatttgagcagaccatggcccgtggaacaaatcaccaaaaacaaagcctaaatgaactatgaatattttattggccaactaacgtacaagccaccacgaagatctattttcagttgactccccgatccaagcattataaggagcactttccttggtgaatattttgtaggcatcgctgtagaccgctactacatttgatacaacagcaagaacaatcatgaagatcgccagaattttgtcccacttcttggcaataccttgtgaatcccttaaagtgatcgcagctgggaaaat

SEQ ID NO: 26730 - DNA, 451 bp, Zea mays
  Clone ID: cC-zmle189104b10a1
gatcagcgctacagcggcgtttactactgcggcggtggcatcgcgacgccggggtacggtccggcggtcccgtacgggatgtcgcaggtgaacatcgagggcaacgggtgcgggcgggcgctgccgccgcagccgaccgtgaaggtgtactgccgcgccaaccccaactacgccatgagcgtccgcgacgggaaggtggtgctggcgccggcgaaccccaaggacgagtaccagcactggatcaaggacatgcggtggagcacgagcatcaaggacgaggaaggttacccggcgttcgcgctggtgaacaaggcgaccggggaggccatcaagcactcgctggggcagtcccacccggtgcgcctggtgccctacaacccggactttttggacgagtcggtgctgtggacggagagccgcgacgtcggcaacggctttcgctgcgtccgca

SEQ ID NO: 26731 - DNA, 436 bp, Zea mays
  Clone ID: cC-zmle189104b11a1
ttttacttttcttttttttatattaaatcctaatttgcggtatcctgtttattttttattttatataaagctccttgtctttttgtatcaacacacaccaccatacgatagatgaagctagctcttattaccagccgatcgacctaatctaaggaggagagccccgaggtgaaaaagaacattccgttgatgattgaaacaaacctggccatcatttggtcttagcaacatgctgaataccattcccctcgtcgccggtgtagtgccaagcaacatctggagctccatcaacccggctcttgagccagggttccctaaccccaacgtgcaactgatgtgctgttttaaccaggtggccaaccctactacaagcattacacgatcctttattcttacccccgcaaacgctactcttggtctcttcacctccatgtta

SEQ ID NO: 26732 - DNA, 398 bp, Zea mays
  Clone ID: cC-zmle189104b12a1
aaagacacacatgcatctgggagcatcgatcaatccacgtacgtacaccctctccgatccgaaagacaatgaagttgcatagcatagccgttgagcttagttgccggggacgaagttggtggcgtaggcccatgcgttgttgttgactgggtcagcgatgtggtcagcgaggttctcgagcgggcccttgccggtgacgatggcctggacgaaaaagccgaacatggaaaacatggcgaggcggccgttcttgagctccttcaccttgagctcggcgaaggcctcggggtcgtcggccaggccgagggggtcgaagctgccgccagggtacagcgggtcgacgacctctccgagcggcccgccggcaatgcggtagccctcgacggcacccatgagca

SEQ ID NO: 26733 - DNA, 413 bp, Zea mays
  Clone ID: cC-zmle189104c01a1
aaaaataactcagtagttaggtagtagctttcaaggtatagatggaccatgagacgacaatatgcggatgcggtcagccagattattaccatgtggatgcatacataatactgctataaatggatggatggatggatccatattaaatgagatagatgcaactccgaaaatcaaatgggcggccggacggacaaaaaagcgaggaccccggtgtgcgcctgcctaggacggtagttgctcaacggccaccttctacatcttctggtgcgcccgggcctccatatagcagcagaggcagggccggttgaacacggagccgtgcgcgtgcgcgtgcacttgccccaccccgacggaggcgtgcgcgtttacagcaacgggcttgcgcgcgaagatcacggagttgatcacctccc

SEQ ID NO: 26734 - DNA, 495 bp, Zea mays
  Clone ID: cC-zmle189104c01d1
gcaaaagcaaccgtcgagcttgcaacgccttacgcctctttactctttattcatggtcgtcatgggcagggagcagtgacactattaggaggaggtgcaagggaaggtcgtccaagaagaagtgcaagtcgtccaagagacggtggtgccggtgccgtcggaggaggacaaggaggccgaggcggcgctggtgcacaagatctccagcctggccgccgccatcgcgaagctgccatccctgagcccgtcgccggaggtgaacgcgctcttcaccgagctcgtgacggcgtgcatcccgcgcagcagcgtggacgtggagcggctggtcccggagctgcaggagatgcgcggcgggctgatccgcctctgcgccgacgcggaggcgctgctggaggcgcactactccgacctgctggccttcttcgacaacccgctggagcacctgtcgctcttcctctacatcaacaactacttcctgctgagccagctggagca

SEQ ID NO: 26735 - DNA, 491 bp, Zea mays
  Clone ID: cC-zmle189104c02d1
gcgtccgcccacgcgtccggccatggcgtcgtccatgctctccgtttctcaccgtgccactccagcaggggggcgtggtgtcctagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaagctgaaggtggccatcaacgggttcggccgcatcgggcgcaacttcctgcggtgctggcacgggcgcggcgacgcctcgcccctcgacgtcatcgccatcaacgacaccggcggtgtcaagcaggcgtcccacctgctcaagtacgactccacgctcggcatcttcgacgccgacgtcaagcccgtcggcgacaacgccatctccgtcgacggcaaggtcatcaaggtcgtgtccgaccgcaaccccagcaacctgccgtggggcgag

SEQ ID NO: 26736 - DNA, 461 bp, Zea mays
  unsure at all n locations
  Clone ID: cC-zmle189104c03a1
caaaaaaaccaaacctcccaaaaaaccttttattaaacccaacttacccccccccccccaaccctaaatttaaaaagggatttccaaaaacccatggaaaaaaacccccccccgccccgaatttccttttttcctttggaaaaaaaaaacacaaaacatccccccctcacccccggaaaccccccccccaacttcagctgggaaaaaacccccaccccaaaaaaattctttttttccccccccaaccccaaaactcaanccctgtccctttttccccaacctggcccccccccttggccggacccccccccccgcctttttttccccttcctttttttttggccccttttttccttggggacacaaaacctttccccctcccccccgataatttttcttttatttttcaaataaccttctttttcccccccccccccttttgggccccccccctccccctt

SEQ ID NO: 26737 - DNA, 578 bp, Zea mays
  unsure at all n locations
  Clone ID: cC-zmle189104c03d1
cattattgccgtctcccttttgcgtgagcaaagattgagagcttgaagagcagncgccatgtctggantaggacaagatcgaggagaagctccacatggggggcgaccacaagaaggaggatgagcaccacaagaaggccgaggagcaccacaagaaggaggagggggagcaccacaagaaggacggcggggagcataaggaaggcatcgtggagaagatcaaggacaagatcaccggcgagcacggcgacaagtccggcgaccacaaggaaaagaaggacaagaaaaagaagaaggagaagaagaagcacggcgagggccacgaccacgacggcggccacagtagcagcagcagcgacagcgactgacatctggtgtcgcaggtgcaacacaagtatgcttgctggatggaggattcataccagctgatgctgatgtagtgtttcactggtgtcatgcatgcatgtatcgggctattataatcaaaaagaaaaaagaaataacagtcagggatggtttggttgccatgtgaacttgtacactcctacttaaattatggctgctgcacggtgctgcta

SEQ ID NO: 26738 - DNA, 480 bp, Zea mays
  Clone ID: cC-zmle189104c04a1
gaaccaaaaccaatacgtaagattctgcagctaggagttccaacaattcagcataacacgaatagcaaaacctgacaacgcttaacataaaacgtcataccaagtcctaaagttcattatttcaaatatcttggttgataatgcacctaataggatcctgcccccctcaagcatcatagctttggctgccaccaccatagccaccaccttcgtagccgccgccaccttcgtagccaccacctccatagccgccgccgccatagccaccaccaccaccgttcccagcaggtctctcattagccatgttgacacgtacctgccgcccatcaatttccttgccatccattgcagaaatagcttccttggcagcatcactgtcggagtagttcacaaagccaaagcctcttgacctcccagtctccctgtctgtgatcaccctcgcttcagtaacctctccaaagctgctaaatgcttctctta

SEQ ID NO: 26739 - DNA, 488 bp, Zea mays
  Clone ID: cC-zmle189104c04d1
acgtgaaactaagagaagcatttatcagctttggagatgttactgttttgagggtgatcacagacagggggactgtgaggtcattaggctttggctttgcgaactactccgacagtgatgctgccaaagaagctatttctgcaatggatggcaaggaaattgatgggcggcaggtacgtgtcaacatggctaatgagagacctgctgggaaccgtggtggtggtggctatggcggcggcggctatggaggtggtggctacggaggtggcggcggctacagaggtggtggctatggtggtggcagccaaagctatgatgcttgaggggggcaggatcctattaggtgcattatcaaccaagatatttgaaataatgaactttaggacttggtatgacgttttatgttaagcgttgtcaggttttgctattcgagttatgctgaattgttggaactcctagatgcaaaatttacctattggttttggttc

SEQ ID NO: 26740 - DNA, 411 bp, Zea mays
  Clone ID: cC-zmle189104c05a1
tttttctctttttttttttttttttttttttttttttgttttttttttttttttttttttcttttttcaccttatataaaatttttttttaattttccatttattactccactttgacggaaaaaaaaaaataaatttaaccccccccatgggctcaaaaaaaaaaaaaatctccaaattaaaaaaaaaaacaaaaaaaaacacccttttttaaaaaaaaaaaaaacacccctttttaaaattttgcaaaaccccccccccccttcaaaaaaaaatcctgcctactttttgacaaaaaaaaaaaaaatgcccccaaaccaaaaaaaaaccccccaaaaaaaaaacccttcatacaaaaaggaaaaaaaaattttaaagaccctggttactcaccaaaaaacccccccccac

SEQ ID NO: 26741 - DNA, 516 bp, Zea mays
  Clone ID: cC-zmle189104c05d1
cggtacgagggcgacaaggccacggccgccaccaccctttccgccctttccggcgacctccgcctcaagggctccgccaccgaggccgccttcaccaacggtccttccctgcgaggcctcaccctcaccctcgagaagcccggcgccttcctcgttgacctcaagccccacaaccaggatgtgcgctttcagttcatgaactccgcgctcgtgctcgacaagcgcgtcagcctcacctacactcactccactagcctcgccgcggcccccgccgccgcgccgccctcccgcaccgcgctcgactgcaccgtcactttcgaccccgccaacaaggtcagcctctcccactcgctaggctccggcggctgccgcctcaagtacacctacgcgcacggggtcgaccgcctcaccaccatcgagcccctcttcgacaccaacaagaacgcatgggagttcgccatcaccaggaagttcgccgggagggacgccgtcaaaggcacctaccaggcctccacc

SEQ ID NO: 26742 - DNA, 444 bp, Zea mays
  Clone ID: cC-zmle189104c06a1
ggaagaaaaattgtgtacggtttaatacgtattagatgcagaggtctaaatttaaaactcaaagcttgcatcctctattcattttcggaacacaacacgccctgagccgccgctgtcttgctgcccgctatgcaaacttcttctacacaaactgtgcaccatagatgccatattttaagtctgatgcttttcctttactgggaggggattttgaaatatttctattgggggcactttggggcgcattccaatcttatagccatagctggatttttcatcttttactcggcttccagcgacagcattccaatcttcttccagcgagaatgcagctacgaaccaatcgctcttatgacttgtatgctcttcaattaacaacacaagttccagatatttcggtcgctatgaccacttcttgcttgcttgacagatgctgcaaaatca

SEQ ID NO: 26743 - DNA, 378 bp, Zea mays
  unsure at all n locations
  Clone ID: cC-zmle189104c06d1
caaaggaccaaggaancgggagaaggaaccncagcagctttcgcgattaagacaaagagggcccnnccgggggnngcgggaaccatgacanagcgggccggcanaccgancaaaggcagcccncccgggccgcccaggaagcgcgcngaaanaaacagcnngcnncaacccancnagcaggaaanaanggaggagccangccccaacangcaagcanaccaacgccaagacgaacacgnngcgccnccanacnggaccacgaaaacnccagcaaccggcaagcccggnaagacaacagcacgggacacacgngcgagcacaaggcagaacaaggggaggacagangcaccccnncngagccgggagaccaaaggagaa

SEQ ID NO: 26744 - DNA, 501 bp, Zea mays
  unsure at all n locations
  Clone ID: cC-zmle189104c07a1
ttttgatctcttgaaaacaaatgtcaaaacaaaccagggtgggccacaactagaacagggaccgggcaattatgttacgaggcaatattcagacaaaacttcacttcagtgccgaggaattacaaaaaaaatcacttcagtgccaagggtggaacaaaacctaacacgaccataattatgacattgcagctagaccacccagagcccagaacagtaatacaaatgtaaacgaacgtttacttcttcttggcgtcaccagctttggtcttcttgacaccacggatcttcttggccctgttcttccgctccttcatttgcttgcgggacttctcaaccttagtagcaagaccattcctgatgaggcggtatttcggctcgaacttcttggcagcctcgaggttgtcgtagatgaggccgaaaccagtggactttcctcctccgaagtgggtgcggaacttgaagacanagatggtgttggggtcctttacctcgtacgccttg

SEQ ID NO: 26745 - DNA, 332 bp, Zea mays
  unsure at all n locations
  Clone ID: cC-zmle189104c08a1
atcctntatagcgacctcccttttttcttctcttttcttttttctacccacaaaacaaaagaaaaaagaaaggtttattttcctttaaacccctttaccaacccataaaaatcccttttctaacttattatcccatctgtacctaaacaacctaatcttttttatcctttctccctctatacctaacacaattataccaaaaaaaaaccctttttcttctaactacaacccaacatttatttttcccttacaaacaaaaaaaccccctacctaaacattcatatctttacacgccaacaaaacctcaccccactattttaccttttaataaa

SEQ ID NO: 26746 - DNA, 506 bp, Zea mays
  Clone ID: cC-zmle189104c10a1
ggctacagtacattccaattccgaatattgcatgaaatcagtacttgaataaacatcacataatacctgatgttatttgtacagcaaaaaaatttatagaatatgctaactgataatctgagatgtccacgaagagacaaggctgtaagcatcgaagtataaaggctatctacccgctctacacttttggcagaagatttgtatgtcttgcactttatccgctggcgacaatctcatgaatcttatcactgacttcagggtcatctgatctcacagctaatttcattgccacttcgttgggcccgctcagtccaaatgacaacctaactaggaccttcatgttgccaataaatacaccagatagaaggcaggtgtgcgatcttgcatttttcggtacaacctcagtgccctcacacggctgcattccaaggatattaatgacagcattgacagcctcagccaaactttctctaaccccgagtccatactcatcgacacgctcacta

SEQ ID NO: 26747 - DNA, 474 bp, Zea mays
  Clone ID: cC-zmle189104c11a1
ttttgactttatcctttaaaacacacactccaaacagtgaatagtgctgttaaaagacacacagtccacaatggcgatagttacttttccaagcaccatgttacatttggtctttcattcaagacactagcaacaactatgcggatgtgcagcatggatccccctagtagggcgaagctctcagaccaatgcaggatactgcttcgcctgcagtctaacgcgcctcttgtattctgtgggatcctggataaaaaggtgatatccgtctgtttgagcagggtcagcaggatttggctgatctagcaagtcctggatcccgactagaatctgcttaacagtaatagctggtctccaaccactgtcctcattaacaatcgaaaggcagactgttccataaggatacacatttgggtggaaaaaaccctgagggaacttgcacttgggaggcttgctaaggttattcttactaaaatg

SEQ ID NO: 26748 - DNA, 362 bp, Zea mays
  Clone ID: cC-zmle189104c12a1
aaaataatattttttttgttttttgttttttttttatttttttttcttttttttccccaaaaaaccccaaaactttcttttttcacaaagggatcccttagaacacatacccccaatccaaaaaaatccaaggttcaaacacccccctatttttgaaatctgaactaataccccataccaaaacacccactaaattatggtataaccctcttaacccttaaacccctttctgaaaacagagccaacaaagctgacccttttaaaaacccccaaaccttggacctgaactcaaaaaacccccaacctttcctacccacacccttatttttgccattttttaccccaaaaccaaccccccccct

SEQ ID NO: 26749 - DNA, 524 bp, Zea mays
  Clone ID: cC-zmle189104d01a1
cttcatactccagtcactgacaattagtgagggaattggcagtgccacagaaacagtcaagcgctattgcgctacgttacaatcacatcccagaccaagttaatagtgtgtgtgtgtgttttgccccagttgtatgttatatacagtattacttaaaataccaactcaaaggctggccgaacagacaagataaccagtgctagttttcagttactccttttctttgacaaataccagcgcagatgtcagataagtaacatgagcatcttggttccggcttggcgctgtcactatacctatcacgcatcgtcagcaagctctatggtatatacttctgccaagagggagcacaagggagcacgtgctgccatagctttagtcccattgatcattgagccgagcgcaggtcgacaatctcaaaccgcaagttgggattgaagtgcactttcgagcaggtttcatagattgggcttgcggtggttgtctctcggtgagtgtggaacccactttcgtcacactcccta

SEQ ID NO: 26750 - DNA, 593 bp, Zea mays
  Clone ID: cC-zmle189104d01d1
cgcctacggccactcgcctcgcctcgctgaaaccaatcgcctcttttctccctttccctctccctccaatgcttccgaccgatgtctcctgaagcggctcaactgctccagattttctcgaggctgaaattttggtgtccttgctcagccatgggtagtaggagatatgacattgatacgaggagatgtgggatccactcaagaccaaccaaatcaatgtatctggatgctcaacaaatcgtcagctgccaaactagagtgggagaccacgatgttggttcctgtgctgtgaagcatcacttcccgtctccaatcgtatcttggatagaagatctttccagctttggcaatgcttcttttaatcctgtctctgaatatgtggatgagcaagccagagcttcagtgggacagtcttcagcatcaagtaatttgcatgacatgcaaatatcagtgagattgacagccgaattcatggagcttgcaaaggagaatacaagcaataatctagagacttgtggaatccttggtgctttcattaaggatggaacttattttgtcacgatgttgattttaccaaagcaagaagaactgct

SEQ ID NO: 26751 - DNA, 365 bp, Zea mays
  Clone ID: cC-zmle189104d03a1
gcaaaacgtgtggggatgggtttcggctaattgccaaaagcatggcatgtacatccatatgcttctgtgcacacaacagcgtcattgatgtacatggcacaaagattattggattacaattcatgttcttttggggagaaaatctttatttgttgagggccaccgagaggccaacagagagtatgaaccacgccaataagaattatccaactagcttggttgggaactcatcttctggttcctttggaggatctggtgccaactccaatggatcaacttcaaatggccagacatatcgctcaggctgtccactttttgacaagctccaatcatataatcttccggacgcgtgggctgacgcgtgg

SEQ ID NO: 26752 - DNA, 374 bp, Zea mays
  unsure at all n locations
  Clone ID: cC-zmle189104d03d1
cgcgtccggaagattatatgattggagcttgtcaagaatttgacagtctgagcgatatgtctggccattggaagttggtccattggagttggcaccacatcctccaaaggaaccagaagatgagttcccaaccaagctcgttggctacttcttactggcgtggttcatactctctgttggcctctcggtggccctcaacaaatgaagattttctccccaaaagaacatgaattgtaatccaataatctctctgccatgtacatcaatgacgctgttgtgtgcacagaagcatatggatgtacatgccatgctcttggcaattagccgaaacatataacaacacgttctgcanaaaaaaaaaaaacaaaaaatta

SEQ ID NO: 26753 - DNA, 346 bp, Zea mays
  Clone ID: cC-zmle189104d04a1
aaaagtctcaaaggggggttttgttgcattgacacacatgtacaatacaatcgtacatatagtacgttttattcgacaagcagcctttgcatgcaataatagtacaacccccgatttaattaattggactaatgcatgctgaggatggatcaaatggaaatgctgttggggatgcccctcccggtgactcccggcttggaaaagggcttgagcagttcgtacggcacgatcccggcgccgaagcgttcttgaggtccaggttgttgttgcactcgtcgatgaacccctcgatctccttcatcctgccgccgaactttttgaacgccgccttcaccatgggctccgc

SEQ ID NO: 26754 - DNA, 373 bp, Zea mays
  Clone ID: cC-zmle189104d04d1
cggcggagcccatggtgaaggcggcgttcgagaagttcggcggttttatgatttagatcgaggggttcatcgacgggggcaagagcaacctggacctcaagaacgctgcggcgccgggatcgtgccgtacgagctgctcaagcccttctccaagccgggagtcaccgggaggggcatccccagcagcatctccatctgatccatcctcagcatgcattagtccaattaattaaatcgggggttgtactattattgcatgcagaggctgcttgtcgaataaaacgtactatatgtacgattgtattgtacatgtgtgtcaatgcaacaagaggcacgtttgagactttgtaaaataaaaataacaaaaaaaata

SEQ ID NO: 26755 - DNA, 410 bp, Zea mays
  Clone ID: cC-zmle189104d05a1
aaaaagaaacagatttgcccttttatattgattattgaaagaaaaacttgtttgtttgtttcaactttaaagttgactaataattgaaacccaatggaaacctttggccggtttatttggacgacctccccgaaacgggtgaatttcacccaaagtgattcattttggggtgaatcccaaaaccctgtggggggggaggagttacaaagtttttttacaatggaacgctttacttccactggttggcccaaatgtcagcgaggtcgacaaccctttgcgagtaaccccactctttgtcgtaccaggagatgacctttaccatttcgccccccatgaccatggggagggaggcgttcattgtggaggaaacctttgagcaccttaagttcacggacacaaaccggacccgt

SEQ ID NO: 26756 - DNA, 419 bp, Zea mays
  unsure at all n locations
  Clone ID: cC-zmle189104d05d1
gacttcaggggctccgacgncncctccactttcgacgtttccctcaccatggtcatggggggcgacatgttcaaggtcatctcctggtacgacaacgagtggggctactcgcagagggtcgtcgacctcgctgacatctgcgccaaccagtggaagtgaagcgttgcattgtaatagcactttgtaactcctcaccctccacagggctttgggattcaccccgaaatgactcactttcggtgaaattcacccgtttcggcgaggtcgtccgaatataccggccaaatgtttccattggatttcaattattagtcaactctagagttgaaacaaacatacaagttcttcattcaataatcaatatagaagtgcatatctgtttcctcttnaaaaaaaaaaaaaacaaaaaaagaaaattc

SEQ ID NO: 26757 - DNA, 448 bp, Zea mays
  Clone ID: cC-zmle189104d06a1
gggatgcaagtgaacgattccaaaccaacttattgataattaatactagaaagtagagagacatgaaagcatagaaaatacagggtccagaatgtaaccacagataatgataagtcaggtaggtacgacacccagcaaccccttgcacgctatagcaaaagccagctcaagccaggtgaatgtctcggtagcaatcctttggggatacacttcttttccgatttaagttgaaatacaggagggttccgtctccaaagccaaggaagttacttggggccaacattctttaacgcgcaaatctgctcctcccccatcgcagactggacagtcacaacaagatccttcccgctttcgaacccttccttaatctgggccacaagagtcttatcagttgggagtctaacatcatccttagggttgccatctgaaggaagaaggctcacaaatc

SEQ ID NO: 26758 - DNA, 554 bp, Zea mays
  unsure at all n locations
  Clone ID: cC-zmle189104d06d1
ccacccgtgtgtgctcctgcgcctccgcctgatccatccaagacatttgatcgttatgtcggactcggaggagcaccgcttcgagtggaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatctntgtgtgactgttcagtctgcgatggnggaggagcagatctgggcgttgaagatgttggccccagtaactttcctggcttggagac

SEQ ID NO: 26759 - DNA, 419 bp, Zea mays
  Clone ID: cC-zmle189104d07a1
cataagaaagcggtggtgtaattatactactataacccaatgaaatcactaaccacctgtttttaaaaccaccacgacagtcacaccaagctattactcgaagattggccataaagaaacggggcaaatataaagtctcaatgacaaactttttttaaagaggacccttcaaccaattttgaaatccatagtccttacttgcaacatcatcaactaaaaaaaaggctcccaggttgggcactaaagcataactgttattcaaaggatccttttgcacttcttacaccacccctgagggaacccctaacaccaattgcccaccaacaagacttttaacatatttttagcataaatctgcaaggatgaatgtctgcacgatttctgataaaagcaccatagacggccccaaaccatagcca

SEQ ID NO: 26760 - DNA, 507 bp, Zea mays
  Clone ID: cC-zmle189104d08a1
atcctctatagcgaccgcccttccttttttcttttttttttttttttttcttttttctttttttctccagccaagatttattttttctttccccccctttccccccctaacaatcctatctttcaatccaatttcctttgcaaacccccaaaaaaaaacccccatttcaaaccccccaaaaaaaaaaccccaatacccaaaaaacccacccaaaaaaaactaccccccctcaaaatttaaatcccacccatttttttaaaaaaaaaaaaacccccccaccccaaaattaaaaccccccaaaaaaaaaaaatttttttaaaaaaaaaatatcttcccctttcccaaaaaaaaacaccaaaccctcctacaaaaaacaagaaacccccaaaaaaaaaaccccctcaaaaaaaaaaattcgccccgaaaaaaaacatttatacctcccccccaacaaacaccccaaaacccctttttacaaaaccgaaacccccaaaatctttatccccc

SEQ ID NO: 26761 - DNA, 450 bp, Zea mays
  unsure at all n locations
  Clone ID: cC-zmle189104d09a1
tttttattttttttttttttttttttaagaaactagaggggggctttcttatttttgggaagccacaaacatcagcaaaaaaactttattattgaactataactcataagcaatctaaaagagggcaccaccaatgatgggttgttggtagaacgctgttgggtttgtcaaagcatgttggttgaatggcagcaattgttgcagttgtaagagggtgccaacgttaggcgcagcgtgcaggtagaacggcaacaactgttgctgtgtcaagaaggcagcagggctcacagcanctagctggctgaatggtagtagttgttgttgtacataagcaggagagttcaatgctgccagttggttgaatggaagaaattgctggtggtaggcagcagctagctggctgaatggtagtagttgttgttgttgcaaataagcagcagagttcaatgc

SEQ ID NO: 26762 - DNA, 437 bp, Zea mays
  Clone ID: cC-zmle189104d10a1
cactgagcatccgggattaggatagatctcccgacgtaacataaaatcgacatttaggatgttacatgtatttctaacttaaactttatacacatatcaagcgtcttatttcacgatcataaaactaatagtaaaaatagtgaatcagctcaccatatctcaatttgatttgatattcgcctgaatgatgacaggctgacggaggcgacatccggtaggagtagagtatagaggcgcggccaacaaggaagctgggtgagtgctggcagcacggcaactaggagacggcagcgcggttcgggtaaaaccgcacgagcactggacgagaaaaacgacgggctatacggcgctgtaaagttgagggcgagctccatgggaaaaaagactcggctggagctagcatggaggcgagaacgccatggagtccggggcacgga

SEQ ID NO: 26763 - DNA, 453 bp, Zea mays
  Clone ID: cC-zmle189104d11a1
tttctattttatttgtactagagataataattaattaggtagtgagattatgtatctaacaaatagccagctagctagtaactaatttgctaaaaaagctaatagttgatttattagttagattgtttattcaacttaattttagtgcatttggacagacacttttatcatagcgcgctggttaaagttctagtaaaaagtaaagcgccgtcgaaaccggcaaagcgaaaaatgcccgcccgcacctgcgtgcgtgtgctgtgtgggcatgggcagcgtcaccaaagcgaggctcctctcgtcccaagcgccggttaactccgtctcagcgcacgcggcacgcccctaatcttcattcccccgaaaccctagccggtccttggccttgtcccggtcgcgccgctcccgtcgcctctttcgcggaagctgtcctctgcgcgtcggcggcggtgg

SEQ ID NO: 26764 - DNA, 510 bp, Zea mays
  Clone ID: cC-zmle189104d12a1
ttttactttatttgttgcattaattgttgtacatgtgaggaaaacaggtagagatggatgcatcatccatcgacgggcggagtacatacagatcgagatgcatggaatggatagctagctttagttgactgtgatcttgccgaccattcctgctccttggtgcggctcgcagtagaagccgtaggtgcccggcacggtgagggtgacggagtaggtctcgcctggcgcgttgaggtactcctcctgcgagatcttggaggcgtcgacgccgctcggcacctcgtcttcgtcgaacacgacgttgtgcgggaagccggcgttgttcttgaaggtgatggtgtcgccggccttgacggtgaactggctgggctcgaagacgagcccgccgtcgcctgcgcccaacaacaccttctgggccatggcgccgccggcggcaagcaagacgctggcggcaacggccacggcggcggtggcagtggccttgcggagagaggcacgcacggtgaaaga

SEQ ID NO: 26765 - DNA, 428 bp, Zea mays
  Clone ID: cC-zmle189104e01a1
ttttattttcccaaatcagcctttgtattatacgtgaggaagaactaattccttacgtgaaaattttccatttctaactttgtaccgataaccaaacgttgaatgcaatacactccatcagtcgtggtaattatgatttggagtactagaatttactaactgtggttattataatttctgtaacaccacctattggccagaaggtgccttttctacaactgtggctccagagaggaatgccgtacagctactaataattttttggtacaggctaagactaatgctatcagaggaactcctcaagctaatgaggctgttgagttcatgagctaacttggtaacatgctcctccttcagcctatctgcattgcggctcagcagattgagccatgacatggaggagacgttgcatatcttgccctcatgga

SEQ ID NO: 26766 - DNA, 517 bp, Zea mays
  Clone ID: cC-zmle189104e01d1
aaccacccgtgcggccacgcgtccgcccacgcgtccgcccacgcgtctttccacgtttccgcccacgcgtccgatgttagtgaattgtaccatttcgatgagcgaagacaccttcggatggtacttgacgcttttaggcatgggaaggaacagctgttggatgatctatggcactacctgtgccgtcacagccgtgtcccgccctcccctgtcataatggaaagattctgcctaaaactgatgcagggagatacactggcggcgatctcctgcgtcagcagcttccatgagggcaagatatgcaacgtctcctccatgtcatggctcaatctgctgagccgcaatgcagataggctgaaggaggaacatgttaccaagttagctcatgaactcaacagcctcattagcttgaggagttcctctgatagcattagtcttagcctgtaccaaaaaattattagtagctgtacggcattccttctctggagccacagttgtagaaaaagcaccttttggc

SEQ ID NO: 26767 - DNA, 369 bp, Zea mays
  Clone ID: cC-zmle189104e02a1
gaagggataattgatgatgtattgaaaaacaaagttttgaaccatggagcagtttggaagttttacatgactggaaaaaaaagggagatgggattgtagcttttatgagcactgctactagtaatgttcacatagcatggctctgtaataatactgttgatcaccacatccaccagcagcaggcaatccggttgccaacgaggaggcagccttagacaagcacctgagctgcagctagcctagcaatcggaaccctgaaaggggagcaagaaacgtaatccagcccacccttcgcgaaaaaggccacagacgaaggctctccaccgtgttctccacaaatgcccacctttaagttaggcctatctttgc

SEQ ID NO: 26768 - DNA, 566 bp, Zea mays
  Clone ID: cC-zmle189104e02d1
gcccacgcgtccgggttcctcttgttggaacaccacttgaactgttgcatcaagtgactcttatccggcaagtgggtgagaaagtgttcgccaatgtgggcaagactatcgggtacaaagttggaacaatgattgacatccccagggcagctctggtggctgatgagatagcggagcaggctgaattcttctccttcggaacgaacgacctgacgcagatgacctttgggtacagcagggatgatgtgggaaagttcattcccgtctatcttgctcagggcatcctccaacatgaccccttcgaggtcctggaccagaggggagtgggcgagctggtgaagtttgctacagagaggggccgcaaagctaggcctaacttgaaggtgggcatttgtggagaacacggtggagagccttcgtctgtggccttcttcgcgaaggctgggctggattacgtttcttgctcccctttcaaggtccgattgctaggctagctgcacttcaggtgcttgtctgaggctgcctcctcgttggcaaccggattgcctgctgctgggtgatgtggt

SEQ ID NO: 26769 - DNA, 426 bp, Zea mays
  Clone ID: cC-zmle189104e03a1
ataaaaactttatttaaccattttttggtcgtgtttatttttacattaccatcattttctacaacgaaaaacaaaacgctttttttttcaactcaataaacttaccaattctataaattatcctagcctaaaatgcactgtcatattcccaaactaaaacactctgaaacgatccaaagcccttaccagctaaaaaacaatgttcctttcacataaaatatcaattttccttttcactacatattctaaatacccatcatcactagcatatactctgccttcctcttccctgatcggttccggccacgcgctttcaaacaccaccccacaaatttgaaaaactcctacatcagcacaactgggaatgccaatgacaccaccaagagccattttttaaaacttatgggaaacgatcccaaacacttt

SEQ ID NO: 26770 - DNA, 432 bp, Zea mays
  Clone ID: cC-zmle189104e03d1
cacccgtccgggcacgctccacgaccttctctacgactgcccattttaccgttttccctcacgcgccgacctcggggtcaagcgccgtcttcctatcgaggccggcgtccatcgcgacgaggaaatcaatgagcctcttgagccacgactcgccgcttgctagcctgacaaccccgcccgactcgggggtctttactcgcctatcatccgcctcgtcgccgcctagtacgaccctctacgtgactccgcccccttactgtgcctcgatcgctcccgtaacacgcacccagtctaccattacgagcttaaggaccgtggccgctgccctcatctacaactcgacgagacgcggttcgactttcctaccaggtcctacctcgaaagcaagacggaagagcctggccgagtcaaggatgtgcttcagcgactgct

SEQ ID NO: 26771 - DNA, 508 bp, Zea mays
  Clone ID: cC-zmle189104e04a1
cttcaaatcatagtattatagggggggtcgatcgtagtaacagcagcaggcagcagcagcacacgatgcaccaaaccatttacatgaatagcactcgtaccccccccaaggcttaattaacaacaattaatcgaatagcgtgttttgtccatagacgatgtaccaagccattctagtgcagaccataagccagaattcttctcacaagtcatagctgttagtagactttttcggttttcgtacagatccctacaagtcactgcatctcctccctcgtaccggactgtgtaaggataggaagccaccgttctagttgcggttcttggacttatcggctgcccttggagcgagtccaatcgcatctgagcctttcatgatcctgagcctgcggcaagagccggcgaacatcctacaattggagcgaaagacgatgtggcagtcccatggtacgtcgccgacaagcatccaatctccatccttgtcctcgtaagtcagaacatattcacca

SEQ ID NO: 26772 - DNA, 566 bp, Zea mays
  unsure at all n locations
  Clone ID: cC-zmle189104e04d1
gtgcgctcaccccttccgcctacccacgcaaacggcacacttatactaactgccacctctcacgtcccccaccgtctgggtcatgtcctgctgctccccatgtcgcctccactcgagctcgactacataggcctctcgccgccggcggcagccgccgccgctgaaaacgacgaactgaagggtactgagctccgcctcgggctgccagggtccgggtcgccggaccgccgtgtcgtggctgccaccgcgaccaccctggacctgctcccggccaagggcgccaagcgcgggttttctgacgaggcgcccccgccatcgcctgttgccactgccggaaagggaaagaaggtggcanaagaggagtacgacgagaagaaggtggcagcgaccccgcagccggccgccaaagcacaggtggtgggatggccaccagtctgcaactaccgcaagaacacgatgactaccacccagctggagggcagcaaggaggatggtgatgccaagcaaggtcaggggttcctgtacgtcaaggtcagcatggatggcgcgccgtacctcagaagatc

SEQ ID NO: 26773 - DNA, 409 bp, Zea mays
  Clone ID: cC-zmle189104e05a1
tctctttttttttttttttttgaaaataaaaaagcgagagcccaaatttgttttaacaagtaccttacatacaccattcctcctttgctctccaaagttttccatggtacatacaccttcccaaaatccattaggacggccggacacctaacagttaaacactcgaatcactcgagctgagcgtaccaaaccccctggatcttgacatccttgggcgccttggccccgaagtcggtgtctgacggctgcaccctctccaaaaccccgatgacctcccctgtctcccgttttctcttggtgacgctcaacgtgatgtttccggtagaagaggcggcgctcttgatgttctccttctggagctccttctcgtcacctctgccccttgcggttagcacgaaatctttttctt

SEQ ID NO: 26774 - DNA, 410 bp, Zea mays
  Clone ID: cC-zmle189104e05d1
cggaaaaaccaaaacgcatcaccgccgcgacgaccatttccattgctgcctcgctccaagccgcgggcgccctgatgcagcctcaagatcggcggccgggcgccctttgcctcgctgccgtcccgcccgtcgtcgcaactcgcctgcagggcgttcggcgtcgacgccggcgccgccaggatcacgtgctccctgcaggacgtcgccagcaggtgcgtcgacgccgccaagctcgccggcttcgcgctcgccacctcggcgctcctcgtctcgggcgcgagcgcggagggcacgcccaagaggctgacctacgacaagatccacagcaaaacgtacatggaggtgaacggcaccggcacggctaaccagcgcccgaccatcgactgcggcgtggagttcttccccttcaa

SEQ ID NO: 26775 - DNA, 395 bp, Zea mays
  Clone ID: cC-zmle189104e06a1
caagggcactagtaggggatgaatgtgcggcaaaatgtacatggaatggaaggcaacaacatctgtcctgccctgtcctgtgcatccatccatcaagaacagcggtgacaaacaaacaccattgatgattaattagatgaggaacaggaagcaagaaatcttcgggggggcagggcagggcactgtgtgggacggacggcgaccgcgcaaacggatcggggataacaaacaaaccaatgaatcagttgcgggagcactcggcgggaaagccctgcgggaagcgccagccgtcgtcgcattaattgtagtgcatgtagttctgcctggcccaggcgacggtgccccactcggcggcgtcgagctggcggctcatccagcggtcggtgccggcgggg

SEQ ID NO: 26776 - DNA, 521 bp, Zea mays
  Clone ID: cC-zmle189104e06d1
acgcgtccggctccatcatcactccactagcctttcagcttctggcctacagctagccgcctcggtcctggcatcccatcccatctcatctccgacaagcgaagcagagcactggcatgagcatggaccgcatggcgcggcgttccgtgtccttgctcctcgctctggctctcctggccgccgcggcgtcggcggactcgtggctgtacgagaagttcacgacggagggcaacgtgcgcgcggactacaacgcgcaggggcagcaggtgacgtctctgatcctgacgcagcagtccggcggcgccttcagctcgcggcagaagtacctgtacggggagttcagcatccagatgaggctgatcccgggcaactccgcgggcaccgtgacctccttctacctgtcgtcgggcgacgggcccgggcacgacgagatcgacatggagttcatgggcaacgccagcgggcagccccgtggtgctgaacacccacgtgtgggccaacggcgacggcaagaaggagca

SEQ ID NO: 26777 - DNA, 363 bp, Zea mays
  Clone ID: cC-zmle189104e07a1
tttttctcttttttttttttttttttttttttgggtttgttttttttttggaggcaatgtcaacctaccgctgaattaccaaatataaagacagtgggagcctttaaaactattttccaacataaaacgaggttaaagtccaagcaacaactacaattttcctttggttccacaactcaaaagtcaaaacaaaacaaactactttgatgtgataactgcccacacagctcaatcaaaaaggctgaaacccatgtaatcggcgtttttttccttttcctccaccttttttttttttttcacctcagctgaaggaacaactcccccaacaaaagggccattttttgccacaacccggacgcgtgg

SEQ ID NO: 26778 - DNA, 429 bp, Zea mays
  Clone ID: cC-zmle189104e08a1
ttttatttaaaatataatacatgttcgtccatggattgtgaaggaagccttccctattgatggccaatacaagttgtatggtcactctcaaccctctccatcattaaaattacagaagaactagttgatagctcatctcttgtctaggtaactacctggttgctgctcaccatggttgcctctagtgatattgcttaaggcaacttgttgttcatcaaatccatagtagtttgtgttgtaagcattgccagtgaaggaaagcacatcccagctatgagaagtattctgcaccatcgttggagctgcagaagagctagttgtttgttgacctctagtccaagtggccacttggttattgctcgcttggttagcacatctgaggttgtttatagaatcatgttgccaatcaaaatcataattgtttgtgtt

SEQ ID NO: 26779 - DNA, 402 bp, Zea mays
  Clone ID: cC-zmle189104e09a1
ctcaactgatactgggggggaatatgagcacaccaccttatctgcaacatgaggatgatgtctagactgagcaactagacaaggcattctgtcctctgcagtgcattgctacaaaaaggactgcttaaagcacttccaggaatccatccagccaaagctttgctacacatgattagcaaggcattgctctagggtgaccagctccatccacctaccgccttcctggccctgcaaacctcctcgccgtgccgaatatggcggccttggtcagcaatccaccgtcaaaggtgcaagccagggcgacggcgccaccgatcatgagaaccttgggtatgttgtttgtccagtgctttggcttctcaacctcggtggtcttgttgttgtcagtggatgaactggcct

SEQ ID NO: 26780 - DNA, 494 bp, Zea mays
  Clone ID: cC-zmle189104e10a1
attggtcgaccgctcgtgcatttgggtcatagatcaatagagaaacgttataatacagcccaaattgcttcagaacatacaatcgcccaatatgtccaaaacaggtgcggccaagggcgtaccgttttacaggatgcaacaaccaaagccttaagtttgggagtttgggacaagcgtcatcaaccaaggcaactgaacatgagcattggcataccatgggcataaaaatgaaacaatccagagacaattctcagggccagtgaattccaggctgtgatccatgtgataaagcacttgcaaacaatactcaggtaaacaatatgggacgacaaataatcagccaaaatcttcactcagccaatcatagaaggtatgttcccattctctaagcattcctggttgcgatctgagactcagcctctttcttcacgggctcttccttctctgacaagatgagtccgatgtggcacggggaggacatgtaaaggtttgat

SEQ ID NO: 26781 - DNA, 353 bp, Zea mays
  unsure at all n locations
  Clone ID: cC-zmle189104e11a1
tttttaattaatccagactccattggaacgggggaattgggaaggaaagaacagcatacgagtacacatggatggaatccatcgaccgatcagcacaagtcctgatccatccagctatatgaacagcggcaagaggaggaggaagaagaagaagaagaaacatctcaacgatcatctagtagccttaattattagttatcaatcatcgtcgtcgtcatcatcagctggtgaagaggaagcgggccgcctggtcgacggcgtcttcgagccaccgcctgggctcgtccatgagctcggggctgaggcgcaccatgaggacgcanaactccgtttcgctgagcgcgccgtccccg

SEQ ID NO: 26782 - DNA, 492 bp, Zea mays
  Clone ID: cC-zmle189104f01a1
tttttattatatatatagtatcaaatcatatcatggggggccaattaatatatggttacagcagatgcaatcggatcaaccaacatgcaggtagacacacgtacgtacatgagcacaaagactgacgccaaacatgcagagagagatagcaaactgaagaactctgtttctctctctctcacacacaccacacaatacctatgtatggcagccagctcggcctcgcttattattgttcaaccaccaccacaagctagatagataataatcatatccatggtcgtcgatcgatgtgatcagcagttgcaggggtcgcacttgcagttgccaccgcagctgcagccgtgggcggccttgccggactccgccgcggcctcgacgaactcgggcgcggccttcttctccggggccacgccgaagacgacggtggcctgcgcggcggtgctcgtctcctccaggtcagggtacttcttgccgcacttgcagcttgag

SEQ ID NO: 26783 - DNA, 520 bp, Zea mays
  Clone ID: cC-zmle189104f01d1
gtgcggcaactgcggatcaagctgcggctgcggctcaagtttcaagttttgcaagaagtaccctgacctggaggaggcgagcaccgtcgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgtgtggtgtgtgtgagagagagagaaacagagttcttcagtttgctatctctctctgcatgtttggcgtcagtctttgtgctcatgtacgtacgtgtgtctacctgcatgttggttgatccgattgcatctgctgtaaccatatattaattggtccacgatgatatgatttgatactatttatatact

SEQ ID NO: 26784 - DNA, 332 bp, Zea mays
  Clone ID: cC-zmle189104f02a1
ttttgtttaaggcataccagtgtcttctatgatgagtggaaactcgccttgattaatgtaaaaaaggacaagccctgatcatggtttcatgtcctcataaaaacaaggcttaattaaggcgatggtactctggtacaaataggcatgtgaaaaactgcatcggcagtttcccattacagatactctggttgacgaggcgccaccgtatttcacttcttttttcctgcttttgcatcaggcaccaaagacctgacacaaaggcgaggtttggtcgagatgagttcggctgggagaacagacaccccagccaccgaagatcccggacgcgtggg

SEQ ID NO: 26785 - DNA, 334 bp, Zea mays
  Clone ID: cC-zmle189104f02d1
cgcccacgcgtccgggatcttcggtggctggggtgttttttcttttagccgaactcatctcgaccaaacctcgccgttgtgttaggtctttggtgcctgatgcaaaagcaggaaaaaagaagtgaaatacggtggcgcctcgtcaaccagagtatctgtaatgggaaactgccgatgcagtttttcacatgcctatttgtaccagagtaccatcgccttaattaagccttgtttttatgaggacatgaaaccatgatcagggcttgtccttttttacattaatcaaggcgagtttttaataatcatagaagacactggtatgccttcgacaaaa

SEQ ID NO: 26786 - DNA, 368 bp, Zea mays
  Clone ID: cC-zmle189104f03a1
tctcttttttttttttttttttgctttttttttggttggttttttttttttttgcaacatgacaaccccattttattactttttattaaccaaccaaatacagtacaaagcaacaaaatagcattccaaccttttataaaaaaaaaaaaggggttggtttggttccacaaccattattattgtttgctgtctcgctcggacccatgccacttcttttcaattcataacaaaacagatcccccaaagggtcctactacacaaggatgccttcatcgcctatcaaaccccaccgattccgcaaagaaaaaatacttcactcaaaacaacaccgagtcgtgcgctggatcatatggatggtccttggatgg

SEQ ID NO: 26787 - DNA, 535 bp, Zea mays
  Clone ID: cC-zmle189104f03d1
cggcctatatcacagcatcagaaattcagaatcgatcctatctttttttgcgctgagctccatcagatgcaattcgctgcaggtgcaggaccgcgaacacgaggaggcaggggagcagcatccacaaccacaagccatggcggggaggactaacatccccactaacaactccgccctcatcgcaatcatcgccgacgaggacaccgtcactggcttcttgatggccggcgttggcaatgttgatctgcgcaagaaaaccaattacctcctcgtcgacaacaagacgacagttaaacaaatcgaggacgcgttcaaagaatttactgcaagggaggatattgctattgtgctcatcagtcagtatattgccaacatgataagatttctggtggatagctacaacaagccagtccctgctattctggagatcccatccaaggaccatccatatgatccagcgcacgactcggtgctgtctcgagtgaagtatctcttctctgcggaatcggtggcgtctgataggcgatgaaggcat

SEQ ID NO: 26788 - DNA, 459 bp, Zea mays
  unsure at all n locations
  Clone ID: cC-zmle189104f04a1
gcagcaccaaaaagcagcatgttttccttaagattaacttagaataaagcctgacgggggtaacagcatccatcgatccgcagtccatgctgtttgatgcatgggtctgctggagccgaggatgaacacagcactaacaactgacacagagcgaccttgcaatcaaaaacacagatgggcaacaacaaacacgagacgaacgaagataaaccctctggactagggtaaacatcacggcagcgaacaggataacttggccgcgcgggccccaccgctcagttcctccagttcccgtcggagttgccgtanccgccgccacggttgccaccgtcgtagccgccgccaccaccaccgtagccgccgccgccaccgtagccgccgtcaccgccgtaaccgccgccgccatcacggtgcccgccaccgtcgtagccggcgtcttcacgggcaccaccgtaccca

SEQ ID NO: 26789 - DNA, 536 bp, Zea mays
  Clone ID: cC-zmle189104f04d1
cggttggcttctcctccccctccggttcgggttcgggttcgtgattttctccggggttcggtttcgggggtgagcgcatcgatatggcggcgtcggatgttgagtaccgctgcttcgtcggcggcctcgcctgggccacggacgaccactccctccacaacgccttcagcacctacggcgaggtcctcgagtccaagatcatcctccatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggcggcggctactgcggtggcggcggctacggtggcggcggcggctacggtggtggtggcggcggctatggcggtggcaaccggggcggcggctacggcaactccgacggg

SEQ ID NO: 26790 - DNA, 344 bp, Zea mays
  Clone ID: cC-zmle189104f05a1
aaacccaaaattcagttctaaaagccttaacaacaacctcaaaacatacccgggcaaaccccaatcaaccagaggccccctggggttcacaaacccacccctaaaccgctaaattaaactgccagcgatccattataaactaaaaccccccctcaaatcaccccccttttattcaaatccaaaggaacccccccagggggagttcccaataacagagggagggctgcccatcaccccaaatcaaaaaaattttgtaaaccttccccaattcacccacctttcccaccttgaaagtaaacccctttcgcggccccaccttttgagtggccttaaacacattcatt

SEQ ID NO: 26791 - DNA, 594 bp, Zea mays
  Clone ID: cC-zmle189104f05d1
ccacccgtgcgcccacgcgtccggagaaggaaaaatatccccaaactttagctctcgatctcgatggcgaaccctcgggtcttgtgtggacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcgaccccttggctcgacggcaagcacgtcgtcttcggccaggtcgtcgagggcatggacgtcgtcaaggccatcgagaaggtgggcacccgcacggctccacctccaagtggtcaaggtcgctgactgcggacagctctcctagatctctctgatct

SEQ ID NO: 26792 - DNA, 513 bp, Zea mays
  unsure at all n locations
  Clone ID: cC-zmle189104f06a1
ttttgtttgagnaacaagaacatactgcagccggaacgtcatagatttacttgtttcagttgcatacagcatcagagtctaggaaaacgaacaaagggtcccaaattcaagcatcgacgaagtaccattgtaccaacaacagcctaagggctcaacatcgacaaatttattacgagaaagacaacattgactccagatgcaaaagaccacatgattccatacaggcagcagaatgtatcactccaagatagggtctatttaagcatcagcaaaccccagttcggagagcttgaggtgggcctctttgtagtcatcaaagaaagccttctcatccgcagcatatttctcgacaagagggcggaaaacagggtcgctcagcagggctttgtcacttgggagctgaagaaggccctccttatcaccactcagaagttccttgaagtaagagttgtcaaagaccaaagggtttgtagtccaggcccccttgaaaccagaccgctctttgtggcacct

SEQ ID NO: 26793 - DNA, 510 bp, Zea mays
  Clone ID: cC-zmle189104f06d1
cggcgtcgcgtcgcatcctacgatccaaagctctcttttttcgtttttcgcagccatggcgaacaacgggccgacgttgagcgccgagtacagcgaggctgtggacaaggccaggcgcaagctccgagccctcatcgccgagaagagctgcgccccgctcatgctccgcctcgcgtggcactccgcggggacgttcgacgtgtcgtcgaggaccggcggtccattcggcacgatgaagcatcagtcggaattggctcacggcgctaacgcggggctggacatcgcggtgcggctgctcgagcccatcaaggaggagttcccaatcctctcttacgccgatttctaccagctcgcgggagttgtggccgtggaggtcaccggtgggcctgagattcccttccaccccggtagggaggacaagcctcagcccccacctgagggccgccttcctgatgccactaagggttctgaccacctgaggcaagtttttggcaagcagatgggcttgag

SEQ ID NO: 26794 - DNA, 420 bp, Zea mays
  Clone ID: cC-zmle189104f07a1
cccgaacaacccacaggcgggaatccattatcatcaataccacaatataacaagtttgcaaatcttgcttcgtttacaggctcggcaacacggcaaccaaacctcataccaatagagcttaaatagcgcttcagctagtgtcatgcatagcgactaaatgatatgcttacaggaacttattaacaaacaccacggcgggagcttcatcgttgataattgaatttgcatctggctgaaggttcacggccctccacaggtcccttcaaaaggagaaccagcttcagtgagcccgctcccggaaaacctcgatgtccacctccgatgggtcggtcgcctggatttcgtagtggaacccgtcaagctcgtacttgatgcggtccttcgacggggagtacagcatcttagcacgtatgcgggatg

SEQ ID NO: 26795 - DNA, 202 bp, Zea mays
  Clone ID: cC-zmle189104f08a1
cggtcgatgaatttctttctgcgcttggcgaacgccgaggcgcgggagcgtcatgatggccttggccatggagtggtcgagcccgaacgcggagttcgggccgaccatgggcgacgccggcatgtgcagctgcgtgtccgccatggagctgtacgccggcatgtcgccggcctgcttgagcgacagcgcgtgcagctgggac

SEQ ID NO: 26796 - DNA, 495 bp, Zea mays
  Clone ID: cC-zmle189104f09a1
ttttctttaaataactttcttttattaataacgggcagtatgggcgggggtgcactgcactcccctcctgtttcccttgaaaagaaaactatacgtatcctgctattgcactgcagtagcgcagttgatcaatcgttttgggttttggccatatacagacttgagcatggcagtaaagagaagtctgaacttatttgctaacgaagctcagatagagagctgatgagtagcccattcgcccgcgtgatcactttgtgagctgctcctccttgctcgcttcctccagctccctgaggcccccaaccctctgctcaatctcctcgagcagctcctcccgcagcagctcctccctcgcagacgcctccaggtcctcttgcctgtcgtagtaccagtgcacggtcccgtcgccaccctggctcctgtacgtttcgctgtcgtagaagggatccttcatggacgcgaagaagcagactccccagacggtgaacatggcgt

SEQ ID NO: 26797 - DNA, 367 bp, Zea mays
  unsure at all n locations
  Clone ID: cC-zmle189104f10a1
gggtggggaagttgattcatattggaccaaaaaactgcccaaaaaagggaacacaacaatttttccttgccgattgaaccctggtacgggaagtaatttacattatgggacaaactggaaccagggcgcgcttacgtgcattcgaacacctaaatatccccaacggtggcccgggggcgggggcccctccacccccttacttgccgggcacaaagttgggggcataagcccattccttttttttaaccgggtcggcaagggggtctgnaaagtttttaagcgggcccttgccggggacaatggcctggacaaaaaaccccaacatggaaaacatggggaggcggccgttcttgaactcctttacctt

SEQ ID NO: 26798 - DNA, 509 bp, Zea mays
  Clone ID: cC-zmle189104f12a1
tttttagtttatatatagtatcaaatcatgtgatcggggaccaattaatatatggttacagcagatgcaatcggatcaaccaacatgcaggtagacacacgtacgtacatgagcacaaagactgacgccaaacatgcagagagagatagcaaactgaagaactctgtttctctctctctcacacacaccacacaatacctatgtatggcagccagctcggcctcgcttattattgttcaaccaccaccacaagctagatagataataatcatatccatggtcgtcgatcgatgtgatcagcagttgcaggggtcgcacttgcagttgccaccgcagctgcagccgtgggcggcctcgccggactccgccgcggcctcgacgaactcgggcgcggccttcttctccggggccacgccgaggacgacggtggcctgcgcggcggtgctcgtctcctccaggtcagggtactttttgccgcacttgcagcttgagccgcagccgcagcttga

SEQ ID NO: 26799 - DNA, 532 bp, Zea mays
  Clone ID: cC-zmle189104g01a1
ttttaataaacctctgaagattagttatggaacggtggtcagcaccaaatgcacttaacatatcacaagtgttgctaaaagtacatgatgataaattaaagtgtttcttataaactaacaaaaaaaggagggtgcagaactacaatttgtcaaactggcagagaatgtttcccgttccgaccatataaggtgcttccaccgtcgcctttgaagtagatttctatcctacactctgttgtatcccacatttttactgaacaagcggcggatgtagaggacctgcaacgcgctagcagccatgaaagccaggtactccgccatcgtatagaacatgacacgctttctggtgctctcattagtgtgtccgtgacgagcttcgcgtgcttttaggtacttctgctcggcggtgatggattctaatgcttccttcagctccgcgatttaacgttgatagggtccaagtgctcatctttcgccagattgtgctcattgggtatgtgcccacatggatgtagaaaaaacagtttcaagt

SEQ ID NO: 26800 - DNA, 577 bp, Zea mays
  Clone ID: cC-zmle189104g01d1
gatttgagtttaaagctccaagaggtggcatgtatattttctgtttccataacccatatggagcacgggaaactgtttctttctacatccatgttgggcacatacccaatgagcacaatctggcgaaagatgagcacttggaccctatcaacgttaaaatcgcggagctgaaggaagcattagaatccatcaccgccgagcagaagtacctaaaagcacgcgaagctcgtcaccgacacactaatgagagcaccagaaagcgtgtcatgttctatacgatggcggagtacctggctttcatggctgctagcgcgttgcaggtcctctacatccgccgcttgttcagtaaaaatgtgggatacaacagagtgtaggatagaaatctacttcaaaggcgacggtggaagcaccttatatggtcggaacgggaaacattctctgccagtttgacaaattgtaattctgcaccctccttttttgggtaagttataagaaacactttaatttatattcatgtacttttagcaacacttgtgatatgttaagtgcatttggtgctgaacattggtccataact

SEQ ID NO: 26801 - DNA, 473 bp, Zea mays
  Clone ID: cC-zmle189104g02a1
aatcagacctgaccctgtttatcggatggaccatgacaaaatatagcatcatcttaagaaggacctctggaacaaataaagcagcctccaacgtcttaaactgagaagacgatcgagccagttaataatgcaagaggttcatgatcggatgttgagatgattgaaacagaatgagcacaattacacatgaagatttaatttccctgcagtttggacatatctagggtcgacaagacaggtgatgatctcctccattcccatcagacgctgctgctagctgcttcaccacttccagaaaacgttggagccgcacttgaacttctccttcccctcgcactcaatctcgaggtcgtcgctgatgaaggggactttcttctgcttggcgaggtcctggcacccagtgaagttgtaggggaactggcagctgccgaactccacggtgtaggcgcgcgcaaaagttgcgccactggtgg

SEQ ID NO: 26802 - DNA, 542 bp, Zea mays
  Clone ID: cC-zmle189104g02d1
aacacccgtgcgaaacccgcacgacacgacaccaagtcgaggagctttagggcttctatcatggccggcgtgaactgcggcgtgggcgggctcaagcccgccgcggcagtgccgcaggccgccgccgcctcatcgccggcgaagcgggtgcagctggccgcgcccgagggccgccgcgccgctctgctcggcctggcggccgtcttcgccgtcacggccaccaccgggtcggccaaggccacgatcttcgatgagtacctcgagaagagcaaggccaacaaggagctgaacgacaagaagaggctggccaccagtggcgccaactttgcgcgcgcctacaccgtggagttcggcagctgccacttcccctacaacttcactgggtgccaggacctcgccaagcagaagaaagtccccttcatcagcgacgacctccagattgagtgcgaggggaaggagaagttcaagtgcggctccacgttttctggaagtggtgaagccactagcagcagcgtctgatgggaatggaggagatcatcacc

SEQ ID NO: 26803 - DNA, 313 bp, Zea mays
  Clone ID: cC-zmle189104g03a1
catgtagtgttaatttacgagcatgactgtatacagtatctgtctgtcatcttcccagtcttctcataaaaacatactcagaacagaaatgcggtgcaaattacaagaaccacaactgaggttcgaagaaggtcaggcatccatcagatctgatctttcagctttcaacacccatggtggagcctaagaactagtatcggcataagaaggccgtcaaaacttaagcagcaatggcggagcccccacgcgtccgcccacgcgtccgcccacgcgtcctcccacgcttccgcccacgcgttcgcggacgcgtggt

SEQ ID NO: 26804 - DNA, 335 bp, Zea mays
  Clone ID: cC-zmle189104g03d1
gggcgcggacacgtgaaacagacacatgggcggacgcatgttcagacttttgggcggacgcatgggggctcgaccattgctgcttattttttgacggccttcttatgcccatactacttcttaggctccaccatgggtgttgaaagctgaaagatcacatctgatggatgcctgaccttcttcgaacctcaattgtggttcttgtaatttgcaccgcatttctgttatgagtatgtttatatgagaagactgggaagatgacagacagatactgtatcacgtgatgctcgtaaattaacactacatgcgaaaaaaaaaaaaaaaaaacgaccagt

SEQ ID NO: 26805 - DNA, 289 bp, Zea mays
  Clone ID: cC-zmle189104g04a1
attattaaggggcgagatttcaataattgaagatgatcctttctgctactggagcttgttaacaatttccgttgccagatgcattccctacggagcaaagtactagtttggatagaaaccaagttatatccaagctgagctgagctaaacatctccatgtattttcagcatttaaaactaataacaacataagtgtaagctataattggcccctaggagtatgacagatcatcttttattattaaggagcaggacccacccctttccggacccctgggccgacgctttg

SEQ ID NO: 26806 - DNA, 290 bp, Zea mays
  Clone ID: cC-zmle189104g04d1
ccacccgtgcgcccacgcgtccgcggacgcgtgggtcctgctcctttataatatttagatgatctgtcatactcctaggggccaagtatagcttacacttatgttgttattagttttaaatgctgaaaatacatggagatgcttagctcagctcagcttggatataacttggtttctatccaaactagtactttgctccgtagggaatgcatctggcaacggaaattgttaacaagctccagtagcagaaaggatcatcttcaattattgtaatcctgctccttaatcat

SEQ ID NO: 26807 - DNA, 197 bp, Zea mays
  Clone ID: cC-zmle189104g06a1
ttttattttcacaaagctaacggtgtcattgagtccggtgatgttttccggcagactcatactaaaaactgaagtatatacacaggtttacaataacaccagccccatcatgctcaattatttacagtgacacgggcgattgctctaggcagacccaaaggtgttttaaccactcccgacacctgggtcgaccaccc

SEQ ID NO: 26808 - DNA, 167 bp, Zea mays
  Clone ID: cC-zmle189104g06d1
aaaacaccttcggctctgcctagagctttcgcccttgccactgtaaataaacgagcgggatgggtgtgctgctattgtaaacctgcgtatatacctccacctctagtatgctgctgccggattgcttcaatggcttcaatgacacccttagctttcaactgttaaaa

SEQ ID NO: 26809 - DNA, 444 bp, Zea mays
  Clone ID: cC-zmle189104g07a1
atcttcatcaggggggagaacttttatgagcgcaagctacacaaaggatagatgttggaacagacacaagagtagtagtagccagtagggtctcaaacaccatggacacaagaagagctcaaggaacgagaaggggtcggaggacgctacatttgcgaacgttagttgtgcaattgcaactgtaaccattggactgaagtggaaacgaacgcggccaaaaagaactcgaatttgacgggtctgtgctgtgcatcatatggacgctgtgaaattgaactgtggactgcgttccttttgtttcacaggatgccgtcgaccttccaattgtcgttgtcctcgtcccgagccttggaggtcgcgttggcgtctttttttgggaaccttggctcgtccattatacgcctgcgacggttgcggcgtccggcctcgcgcgccttgcgtttt

SEQ ID NO: 26810 - DNA, 379 bp, Zea mays
  Clone ID: cC-zmle189104g08a1
aaaaaaagtcgcagattggatcggtttttattgctagcgttccataaaaaatcctttgaggactcatattttctttttcagacatacgtactactttttattatgcgtggcacgtactacacgtaacgcaaatagaccaaatagagaagctattactactagcagccacccgaaatgaatactccacttgcacaaaaagagaccccgtgccccagcaatcatcgcttgacacggcagcaggaccgcgcgccacgagtggcgctctgctacctcgccctgtcgcccaaagaccggcggcgtccgcgtccgtccgtcacagcgtccgcgccgcggcaccatgctcggcagaggcgccggccccggccttgacgcaacggtc

SEQ ID NO: 26811 - DNA, 262 bp, Zea mays
  Clone ID: cC-zmle189104g10a1
gccgctaaagaacacagacgggggcgtgcattacatatttacatagcactccagctgaagccggagttcagagaccccatccgaccacagaaagtccagacaattcactgccctgaccctgtctgaactctgaaccccataccattatacagattcagctaacccgataccaccccccgaagaccctcctccgctccgcgagttcaacgaccggcgccgcaggctgcagcgtttcacaacggggatcatcgcaacccccaca

SEQ ID NO: 26812 - DNA, 385 bp, Zea mays
  Clone ID: cC-zmle189104g11a1
aatcggtattccatctattttttcaccaataaacaaacctaccccaaaaaaaccaaaaagataaaaacaaaatcttcgaccagccaaaacaaacaaagaaaaagcgcaatccatacaagggaaaaaccctttcccaaacaacaacccacctttacccaatctaaatcccaccttgaaaaattcaaccccggctttaatcacaatctctaaaacgttttcaaaaaattacccacaaacttaccccccatcgaaaaaaaactttacaaatcttcatcaagcgcaaaacaaaaacatttactctgaaaaaaaacttgcgcacttcatcattcctctcaaccaaaaaaaatacctcatccacagaaaaattgacaaaatttccaaaatc

SEQ ID NO: 26813 - DNA, 255 bp, Zea mays
  Clone ID: cC-zmle189104g12a1
ggaaaaaaaaagattggcgggatgttgagttaccacattagttgcctggcattcccagtgcatcaaacttgtaacacaaacttggcacgcaatgttttatttcagatcacattgaccggttcacaaccacggtacattagaaaacagggcacgaaggtagaaactcaaacaaatgccacataagttcaggcagacttaactctggtgtaacacacagagcgctaaattatgactcttcagccagagccaacagat

SEQ ID NO: 26814 - DNA, 312 bp, Zea mays
  Clone ID: cC-zmle189104h01a1
ctgttggattttattttaaattatttatttttccctttttttcctttttcaagaaaacccccaccttgtacaaaataaaattcaaaagatccccaaacacacactaattgacccaaaaaaaaccaaaatcaaaaaaccttttttacaaaaaaaactagaccccaaacaattaaattaccaaaaacaaaatccctaacacaaccattaaaaaaacccctttttttttcccccataaaaaccatcatcttctgtaaacaaacacaaacaaacccttttttacccaaaaaacccccaaaaactcctaaccctctt

SEQ ID NO: 26815 - DNA, 533 bp, Zea mays
  Clone ID: cC-zmle189104h01d1
gcggtttcgcgtccgcctgagcccgccgcaaggagaggtaagttttttagacatcttcgagaagctggggtggctcgtaaagctgctcctgccaagaagggtgatgccaagacccaggccttgaaggttgccaaggctgtgaagtctggggcagccaagaagaagaccaagaacatccgcacgtctgtgacatttcaccgccccacgaccctgaagaaggctagggaccccaagtacccacgaatcagcactaccggaaggaacaagctcgatcagtaccaaattctcaagtacccccttaccacagaatcagcgatgaagaagattgaagataacaacactctggtcttcattgatgacctcaaggcagacaagaagaagatcaaggctgccgtcaagaagatgtatgacatccaggcaaagaaggtcaacaccttgatcaagcctgatgggaagaaaaaggcttacctgaagctgactcccgactatgatgctcttgaagtggccaacaaaatcggaatcatttaaatgct

SEQ ID NO: 26816 - DNA, 455 bp, Zea mays
  Clone ID: cC-zmle189104h02a1
agatcaacactttattagtacaagctggcgggaccgtgcagcagccataatttaagtaggagtgtacaagatcacatggcaaacaaaccatccctgactgttatttcttttttctttttgattataatagcacgatacatgcatgcatgacaccagtgaaacactacatcagcatcagctggtatgaatcctccatccagcaagcatacttgtgttgcacctgtgctgcgacaccagatctcagtcgctgtcgctgctgctgctactgtggccgccgtcatggtcgtggccctcgccgtgcttcttcttctccttcttctttttcttgtccttcttttccttgtggtcgccggacttgtcgccgtgctcgccggtgatcttgtccttgatcttctccacgatgcctttcttatgctccccgccgtccttctggtggtgctccccctcctcctttc

SEQ ID NO: 26817 - DNA, 548 bp, Zea mays
  Clone ID: cC-zmle189104h02d1
ccacccgggcggacgcgtagcacagtccattattgccgtctcccttttgcgtgttcaaagaaagagagcgagaagaggagtcgcgatgtcttgcatcatccacaacatcgaggacaagctccacatggggggcgaccacaagaaggaggatgagcaccacaagaaggccgaggagcaccacaagaaggaggagggggagcaccacaagaaggacggcggggagcataaggaaggcatcgtggagaacatcaaggacaagatcaccggcgagcacggcgacaagtccggcgaccacaaggaaaagaaggacaagaaaaagaagaaggagaagaagaagcacggcgagggccacgaccacgacggcggccacagtagcagcagcagcgacagcgactgagatctggtgtcgcagcacaggtgcaacacaagtatgcttgctggatggaggattcataccagctgatgctgatgcagtgtttcactggtgtcatgcatgcatgtatcgtgctattataatcaaaaagaaaaaagaaataacagtcagggat

SEQ ID NO: 26818 - DNA, 443 bp, Zea mays
  Clone ID: cC-zmle189104h03a1
gaaaaccttgctcgatgctttagtattgcgatttccaaatagaagcaaattaactagcagtaaaactataggcctatttggtttgctgcataaatttccacactttgcctaactttttctgcctaaggttagttcttcaattcgaacgactaaccttaggcaaagtgtgtcacagttagccgtgaaccaaacatgcccatatatacatcattgttgcaaataatatcgccacaaaattacacatctcctcataaccacattactttcttattcttagcaaggatgccatggtaacttcactccccatccgcaaatatccaaggctgcaagcagcacctgttatttgaattaggacttatagactatacagagacaagcataagtatatagtatcaacttcttgaactattgacacctttaggtagaaggttggtacatggttg

SEQ ID NO: 26819 - DNA, 481 bp, Zea mays
  Clone ID: cC-zmle189104h03d1
cgggcactccagaagagcacaaccatgtaccaaccttttacctatttgtgtcaatagttcaagaagtggatactatgtacttatgcttgtctctgtatagtctatccgtcctaattcaaataacaggtgctgcttgcagccttggatatttgcggatgcggagtgaagttaccatggcatccttgctaagaataagaaagtaatgtggttatgaggagatgtgtaattttgtggcgatattatttgcaacaatgatgtatatatgggcatgtttggttcacggctaactgtgacacactttgcctaaggttagtcgttcgaattgaagaactaaccttaggcagaaaaagttaggcaaagtgtggaaatttatgcagcaaaccaaataggcctatagttttactgctagttaatttgcttctatttggaaatcggaatagtaaagcatcgagcaaggttttcaaaactttacctatctctt

SEQ ID NO: 26820 - DNA, 437 bp, Zea mays
  unsure at all n locations
  Clone ID: cC-zmle189104h04d1
ccaccacccttttcaacctttccggccacctccgcctcaagggctccgntgtcgatttctacttcaccaaccccccttccctcctaggccacaccctcaccctttataagccctacaccttcctcgttgacctcaagccccacaaccagcatgtgcgctttcacttcatgaacaccacgctcgttctctacaagctcttcaaccttacctacactcactccactagcctcaccgcagaccccacctccacacctcccttccgcaccgctctcaactgcaccgtcactttcgacccctccaacaaggtcagcctctcccactctctaaactcccgcggctgcctcctcaattacacctactctcacggtgtccaccgccttaccaccatagaacccctcttttacaccaacaaaaacccatgggagtacgccatcacc

SEQ ID NO: 26821 - DNA, 295 bp, Zea mays
  Clone ID: cC-zmle189104h05a1
tttttctcttttccaaataagcatacataatgggcaagctgaattcatgtgtatatacaaactttaatacaattccgaaatgcttgtatcatggattcatattttccataatcatgccctactggctcatccgtagtataaagctgtatgccacaaaaccgaatcagttcacgacaacagttgcggggccggtacctacggatcctttactttggcggcgactccatcttgtgccttgtttggggcggtacccttgagggtttgcgccggtgcaaccaccgccgtttgaaacttg

SEQ ID NO: 26822 - DNA, 377 bp, Zea mays
  Clone ID: cC-zmle189104h06a1
caagacatgacgacctcgttatgctggagtgttaccaccgttcgatgtagtaaaatgaccaactatcactaactcctacagctcaaatacaggatattcatacataacacttctctgacaacaatcgaagctcaaatacggtatattcagacataacacttgtctgacataacacttagctggattccaatgctgcgcatgcatgtgtaacatgcatttagagctctcccagcctcttggcgcactctacgctgcagtccagcgactcctacactccatacttgaatctgaaccccaagcacttcagcttgctgatgttgggctgaatcctgaccccttctccggtcacctgagtcaactgtatcttgaggacgggg

SEQ ID NO: 26823 - DNA, 518 bp, Zea mays
  Clone ID: cC-zmle189104h06d1
gggcggtggagcacatggaggacctctgccaggcactcgtctttttcatggagcaggaatccatgaggggccgcgtcctctgtgccaccgggtaccccaacatgcccgacatcgacgaccactttagccgaaaacaacccgacctcaagatacagctgactcatgcgaccggagaaggggtcaggattcatcccaacaccagcaagctggaggacttggggttcatattcaagtatggagtggaagacacgctggactgcagcgtacagtgcgccaagaggctgagagagctctagatgcatgctacacatgcatgcgcagcattggaatccagcgaagggatatgtcagaaaagtgttatgtgatgaataaaccgaactttgaacttcaaaaagttgtcaaaaaagtgttatgtctgaaaataccggatttgagcagtaggaacttaggatagttcgtaactttactacaatcaaccgtgggaaataatggggggagacaagtccccatagccttgt

SEQ ID NO: 26824 - DNA, 427 bp, Zea mays
  Clone ID: cC-zmle189104h08a1
ttttattttttttttttagtcaattaagcagctgccagaaataaattttacatgtgcaaacgggcgctagtaacagtgcatgcattccaaaccaggtcctttgagcaatctgagtaactgtagttacagagtacaatacatccaaagcacactatccttgaattacagagctcaaaccacctgaacttgttattgtggacttttttcatctcatcgctggttctccctcctgcgtgcgtagcgggtcctgtcattgtacctaggcctgtctgcagccctctgtggcacgggctcgacccttctctgcctctcaggaggcctctgaacaatctcaccgttgacaagcagttcagctccgtagtccttgtactcagggtcaacatacgaattcggtagcacaaagagaacaccagggaacccctcgagc

SEQ ID NO: 26825 - DNA, 233 bp, Zea mays
  unsure at all n locations
  Clone ID: cC-zmle189104h09a1
ataaaaaacatgggttttatttgtaccaccagtaaaataacggtttttaaaaaacatgccctttgaaaacacccgaaaaaccaaaccttaaaagatatcctttccccaatggaaaaagacatccccctgaaacaaaactggaaaaacacaacttggtcccaaacacatccacaaaataccaacttttgattttttaaantgtgaactaaaaaatggccccccttaaaaacccc

SEQ ID NO: 26826 - DNA, 239 bp, Zea mays
  Clone ID: cC-zmle189104h10a1
aaaaaaaaccaatccttcaccataaaatattgggctcaaaaaacccggattaaaatacaggcaggctcaaaaacttgcccgcagccggccgttaaaaaaaagtgggggcctgatcctttgttaacggcggacaggaattaacgggccacaattaggcctaacgaaccccaggcaaggactttataccagtttaaatgcccacggcgcacttttgctttgaccaggcccaaaaactcttt

SEQ ID NO: 26827 - DNA, 384 bp, Zea mays
  Clone ID: cC-zmle189104h11a1
aatgctaaaactatcaaacggggatgagttgggcgctttccgaagaataaaaattatccaacactagtactctcatatcatatgattgcaggcacatcttgtttccatatgatcgtataattttggtcttctatcttgcaacacccggggccaccggctaatcaccgtcgacgtgagcacacgagtgatctcagatttgggtgaacgacggagaggactgcctcaggcctcagccgcaccgtggtttcttgattgattgtctgaataccccttaccagtctcgggcacttaggggctattacagtcactggccatttcggccccaaggacctgtccaaaaagtagaaaaacgcagcaacatatattacgctacttgccttggaa

SEQ ID NO: 26828 - DNA, 238 bp, Zea mays
  Clone ID: cC-zmle189104h12a1
cttatttcttttttttttttttttcttatttctcatttttgagtatcatggacactattaaaacgacctaccccacaacccctaccaataatactatcaattcctccaacaatcctttttatccacttccatcataagatgacatagacgcctaagcagttcttctcctcatcaacttcatcctgtccatcgccatttctaaactgtcatccctaatccctatccactaagttaacac

SEQ ID NO: 26829 - DNA, 234 bp, Zea mays
  Clone ID: cC-zmle189105b11d1
ccgtccgggagaatggagtggcttctcgatcatgctcttgatcccttttttctctctcgtctcaaacaattctcctcagaggagagggatttatataagtcggctctcacagtgatatctgaacgactttcttaggacgatatcgctggcctaatacaaattctccatgcacttgactttcataatttaggcgtaattacctttcgttgaacttatactatgtttaaaaagatt

SEQ ID NO: 26830 - DNA, 103 bp, Zea mays
  Clone ID: cC-zmle189105d10d1
cccacacggccgggcggacgttaggttaaggattgactttgcggcattcccatctatttctattctatttaggcgaactaccagtgtggtcttatcaacacaa

SEQ ID NO: 26831 - DNA, 250 bp, Zea mays
  Clone ID: cC-zmle189105e10d1
cacgcgtacgcccacacttcctcccacgcgctcgcccacgcttcctttttcttcttagcccatcacacacaaacaaagggcaggggctcacaactctgcctttcctcctatatattccaaatagacttcagagtcattacaattcacctaatttcctcgcccaacacaacaaaaacatctctctactcatcaccctaatccaaacaactactcgtgttaaaaaaaaatactatgacccctctaaaattat

SEQ ID NO: 26832 - DNA, 327 bp, Zea mays
  Clone ID: cC-zmle189105e11d1
ccacgcgtacgccaagcttttgctttcctgtacatataccttcgcctttgtcataacatgcacgaaacctccatcaacagtggggggagcgtactaccacattgtccttaatacctcggcaactgtttactactactaggctttcccaatcctatgaaaaagattatcccactccccaagcttccgtactatgcttgtattacgtgctccatatgatctgatgccaatattttgttatcctccaatagatgcatcattcaatctgcatctaatctatattaactattgtatctaccgatcttttcagacggatcctaaaaactaact

SEQ ID NO: 26833 - DNA, 367 bp, Zea mays
  Clone ID: cC-zmle189105e12d1
gggcgacccacgcgggcggttctcatggttgaccaagatgagctctagaccgttatccttcatatcggtgggctggtgctgatatggaagtgggcttatcagagatcaaatgccatgttgttcttagtggacactgagaaattccttacaatattgcatttttataaatgtttttattatgtgaaggttcttacggcttactaatacgatgacattttcatgattatccttatgatatacagtgtcatccattccattttttctgttcatcaccaaatcaaacaatcactatgcaacccaatgtactatctcttccaattacatatcttataaatactgtgctttgttatcttttgtgatggaatat

SEQ ID NO: 26834 - DNA, 268 bp, Zea mays
  Clone ID: cC-zmle189105f11d1
ccacgcggcgacgatttcagccacgcacgtatcactttgtcttagcttaatcagaataacaccatttactggtcggggcagcccaggctctccttttcagtcgacatctgctgggccgtcccgtgcaatcagtcgtctttatgtacgtatctaggaatgcgcccttcttctttagggccatcttcaacccttcatccaagcatggtgccgacaggcagttgtggttttcgtccaagcagttcctctcctaccttgatgtcacgctttc

SEQ ID NO: 26835 - DNA, 229 bp, Zea mays
  Clone ID: cC-zmle189106a03a1
aacttaaaatctcataaatcaaaacctaagggagggtgttttttattctacagggtacccattcacgatatacacctacccctaccctttagggatactcatctttgtttatttatataagcatataaccaatcctattcattctttatctttatactcttgttatttacaaattatactcttgcaaaacaatgtattcccccaagtacttaaccttaatatacaccat

SEQ ID NO: 26836 - DNA, 61 bp, Zea mays
  Clone ID: cC-zmle189106b02a1
gcacgcccacgtcacctaggatcctctacagcggccgccctcccctttttttttttttttt

SEQ ID NO: 26837 - DNA, 303 bp, Zea mays
  Clone ID: cC-zmle189106b04a1
ttttgtgaagttgcaaaactaaaatttttatttctgggtgggggagacatgacaactgtttctcctgttaagaaggacctaagcctttctaacactgtctctttttgcgctgtcactgagctctttttcagttttactgaacctccaacttaactcacactcagcgtaacatcttattcgcgttactcttccaagaactcctcatggaaagcccttaagcggttgatcaccgcggtgatcttttcttcctgcggcaggatcgtgcatttgatgtgccatgttccaggaacttgaccaaattca

SEQ ID NO: 26838 - DNA, 338 bp, Zea mays
  Clone ID: cC-zmle189106b06a1
tttttaataataagtccggttttattatatatatagggtcgggtcatatcatcgtggaccaattaatatatggttacagcacatgcaatctgatcaaccaacatgcatttttacacacttacttactttatcacaaatactgaccccaaacatgcagagagagatttcaaactgaagaactctgtttttctctctttcacacacaccacacaatacctttgtattgcagtcagcttggcctctcttattattgttcaaccaccaccacaagttatatatataataatcatatccatggtcgccgatcgatgttatcatcaattgcatgttatctcact

SEQ ID NO: 26839 - DNA, 52 bp, Zea mays
  Clone ID: cC-zmle189106c02a1
acaaaccataaggttcaacttttcggggaggggacctgaattcataataaca

SEQ ID NO: 26840 - DNA, 395 bp, Zea mays
  Clone ID: cC-zmle189106c04a1
attctaaggcacagcttcctgactagggggggtaagttcacagacgccttggtcggatttattctcaggcacaacattccgaggaactgattcaagtttcacggacgcctcggtctaatttggcacaacttccgcgtggagtttatttaagttcacagaggtcttcttgagagcacacacaaaaaaaaatcgatcacttaacccaacaaacatagcatctcacaacccgagtcttcctttttccatttttcggcttatctggatttccttcgacatataattaatcccgtggccaaaattgtgctgctagcctgggatttttttcaacgaaagcgaaatcttcatgcggttgacggtgactttgcccacttattcactaacctttttcaattagt

SEQ ID NO: 26841 - DNA, 117 bp, Zea mays
  Clone ID: cC-zmle189106c05a1
attttattcatgtatctgagaaaataaatatcttttgggacaggtgtctactcactcattgccaaacctcaaacaacacattaacactcctaagatgtccaacttttgttctataca

SEQ ID NO: 26842 - DNA, 384 bp, Zea mays
  Clone ID: cC-zmle189106c06a1
ttttattcgctcaaaacatcacgggaacatgtacatggtctgggatgatctggcaatgaacacaatagttcatgacttacaacatgtcatgcttccgaatttcatgctcttctctctaatcttagggaatttacactttttactccaacaagaccacaacttattattaatctgtcgcaagcttttgttcttcggttctcataatccctaattctttctagcagtttaaatctacaggttctacacttctactccatgaccaataccacaactagtttataaaatttactgttgcgcactgactggttaaatttacaacaatcttctgagcttcataacacatgcttatggagcgccccccccctctttttatatattatatat

SEQ ID NO: 26843 - DNA, 382 bp, Zea mays
  Clone ID: cC-zmle189106c10a1
ctcccccctttttttttttttttggaaaaccccaacaaaacccctcttataaaaatcccccaatttttatataccccccccctttaaaattgttttacctcaaaaagccctaaaccctcccctaaattgagttccccctaacccaaaccccccaaaaaaaatttccccaaccggtcaaaaaattccccccccaaaccctaggcttaaatttcccggcccccaaaaatgtaattttcaacacccaccaaaatatccccccccccttttcccccccgaaaattcccaccctccccctgaaggaaacccccttttcccataatgaagcctataaaacccttgccaaaaaaattacaaaacctcttcccttttaaaaattttttcc

SEQ ID NO: 26844 - DNA, 348 bp, Zea mays
  Clone ID: cC-zmle189106c10d1
gcccggataatttggatggtgatgacaatgactatgatggggaccatttgtatctgagcctagcgtttaggcggggaaggatgggacccgttagggagatttttttttggttgtttgacttagctggaactcaacttagggaactgtttagtgccttatgaagtcaaccaacttgaaaggagactgctatatcataatctcggtatatctatcaacgcagtttgacctgtgattccaaaaaaaaaaaaaaaaaaaaaaaaaataactaataccaaaaaaaaaaatttaaaaataaaaaaaaaaaaattaaaatttttaaaaaaaaaaaaaaaaaaaaaaaaatggggg

SEQ ID NO: 26845 - DNA, 429 bp, Zea mays
  Clone ID: cC-zmle189106c11a1
acagtgggaaggggggcgttgggggttaattggtttacaagccaaaggcttcttttcacggagagacggctttaagattttttttacaaataactccctaaaacactttaagagcccccacattaaacaccattgtacattacgcttctactgcacagttttcaacatcactgggcaacattagaattaggcatggtaacaccctgttcaacagacatataaacatttttatgcttccgcgtgcatgactacaattactggcaggagctattgctcggcagggcagatatcttccaagcttttgcccaagaactcaatgatatcagaggtgacagtcgatctcttgttcttcttaaaagcatgtgacgcagctttccggagtagaagggaggcaactattcacccaagggtcataggattaactctttt

SEQ ID NO: 26846 - DNA, 390 bp, Zea mays
  Clone ID: cC-zmle189106d01a1
aaagcaaaacgttggggaggggatttttaaattattgaaacaaaatgatcacaattacacatgaagatttaatttccctgcaatttggacatatctagggtcgacaagacaggtgatgatttccttcattcccatcatacgctgctgttatcttcttcaccactttcaaaaaactttggaacctaacttgaacttttccttccccttgtactcaatcttgaggtcttcttttatgaaggggacttttttcttcttggcaaggtcctggcacccaatgaagttgtatgggaactgtcattctcctaactccactgtgtatgccctcgcaaaatttgcgccacttggtggccatcctttttttgtttttcagctccttgttggcctttcttt

SEQ ID NO: 26847 - DNA, 491 bp, Zea mays
  unsure at all n locations
  Clone ID: cC-zmle189106d01d1
cgacgcgacaccaantcnaggagctcgagggcaccatttatggccttttgtgaactccagcgtcgtcgtgctcaagccgtccgcggcagtgccgcangccgccgccgcctcatcgccggcgaagcgggtgcagctggccgcgcccgagggccgccgcgccgctctgctcggcctggcggccgtcttcgccgtcacggccaccaccgggtcggccaaggccaccatcttcgatgagtacctcgagaagagcaaggccaacaaggagctgaacgacaagaagaggctggccaccagtggcgccaactttgcgcgcgcctacaccgtggagttcggcagctgccagttcccctacaacttcactgggtgccaggacctcgccaagcagaagaaagtccccttcatcagcgacgacctctacattgagtgcgaggggaaggagaagttcaagtgcggcttccacgttttctggaagtggtgaagcagctagcagc

SEQ ID NO: 26848 - DNA, 381 bp, Zea mays
  Clone ID: cC-zmle189106d02a1
ttttctctggaacagattgcgcttaattgacatcgggacaggaatctagcacccaaacaccctactgataatgccagcccatgaaatgtattaaaaatcttaattacctactcgccccttttactcacttggttgacaatttcctgtgcctttgtcaggctctccaccatctgttggcaatccttccgcctcctgactgtgtagtcggactccttcagcagctcgtcaagctcgtcggtcttgtacatgttggtgagcagctcgctctgcatgttctccctcgaccacgagacgaggttcagcatgatggccttgggaaccatatcaatcattgtgcggcggacaatgttgaagtatgatgtgataagcagtttgatgact

SEQ ID NO: 26849 - DNA, 476 bp, Zea mays
  Clone ID: cC-zmle189106d04a1
ttttagtatatatatagtatcaaatcatatcatcggggaccgattaatatatggttacagcagatgcaatcggatcaaccaacatgcaggtagacacacgtacgtacatgagcacaaagactgacgccaaacatgcagagagagatagcaaactgaagaactctgtttttctctctctcacacacaccacacaatacctatgtatggcagccagctcggcctcgcttattattgttcaaccaccaccacaagctagatagataataatcatatccatggtcgtcgatcgatgtgatcagcagttgcaggggtcgcacttgcagttgccaccgcagctgcagccgtgggcggtctcgtcggactccgccgtggtctcgactaacttgggcgcggccttctttttcggggccactgccgaggacgacggtggcctgcgcggcggggcttgtctactccaggtaagggtactttttgtc

SEQ ID NO: 26850 - DNA, 359 bp, Zea mays
  Clone ID: cC-zmle189106d05a1
catcaatcaggccattcggggcgggttgattagcaaactacaggcgttacataaaaataatatgtccaactatgtcattcaaacagcatttcaacagacattgtactccaaatgtgcgtaataccgaatcattccaaacattcaagtccccctttatatcgaaaccttcactctagcaaatcccacaaacagaattttaaaaggtccccacctttgcctgggtagcattttttattgttgctcaaaaaaggatccattccccctttgcgaggtcttatcagcttccttattcccatcttggcgacagcataaccagagattccttccatgctttaagggccccccccctcccaattgcc

SEQ ID NO: 26851 - DNA, 471 bp, Zea mays
  Clone ID: cC-zmle189106d05d1
cgcccgctccgctgggccaccagctttgaccgccgcctcccttccccttcgtttctgctcctccccaccccactccccgggaggagctgctttggcggcggcggctgttatgtcctaccccacatttgcgagcggcggtggcaccgttcttaggcataggcaagatgttcgggcgcgcgcctaagaagagcgacaactccaagttctacgagatcctcggggtgcccaagtcggcgttccaggacgatctcaagaaggcctaccgcaaggctgttatcaagaaccaccctgacaagggcggtgaccccgagaagttcaaggagctcgcacaagcctatgatgtgttgagtgatccagagaaacttgagatttatgatcagtatggtgaatatgcccttaaggaaggaatgggcggcggacgatcccatgttgatccatttgacatcttttcatcattttgtggaccctttt

SEQ ID NO: 26852 - DNA, 451 bp, Zea mays
  Clone ID: cC-zmle189106d06a1
ttctttttttttttgagacaacatttgtattatgagcggtggaaaaataatgttatacaacaaattaaaacataggtttcaaagcaatcctttttacacctatatgtaggaaagttcacgttcaagtatttttggattaattctgaaggcttaggtggcttccagtcatattactcatcagtcaaaactcatcaggatgtttgtcaatacccgttaaaatctttcccaatacgatactactaaacaaattttttaaggcttggcttgggggaatttaaactacatcactgctttacaactcatcatcatggaccatagtaaccaaaaccctatttttctgtcttacaatacaaaaaatgatcaaacttcctacatcaacgttaatatattttttttcttcccggacacttacctattttaaactatataattttgccccatatccatctgg

SEQ ID NO: 26853 - DNA, 522 bp, Zea mays
  unsure at all n locations
  Clone ID: cC-zmle189106d06d1
cccacccgcccgggaggacgatagatgattgatggtctggctgagttgtagtttttttttgcacccagctggactgtggccacgtgggtgtagtttaacataggttagtgtccgggaagaaaaaagatatattaacgttgatctaggagtttgatcattttttgtattgtaagacagaaatatagggttttggttactttggtccatgttgctgtgttgtaaagcagtgatgtagtttagattcccccaagccatgccttgagagatttgtttagtagtatcgtcttgggaaaacttttgccgggtattgacaacatcctgctgagttctgactgctgagtactatgactggaaaccacctaagcctttagaattaatccaaatatacttggacttgcacttttctacatatanggcgaatatggtttgctttgaaacctatgttttaatttgttgtattacattattttttgcaatgcttataatacacatgttgtcttaaaaaaaatatatatttatttt

SEQ ID NO: 26854 - DNA, 454 bp, Zea mays
  Clone ID: cC-zmle189106d07d1
gcccgcccacgcgtccgcggacgcgtgggggccgcaaagctaggcctatacttgaaggtgggcatttgtggagaacacgggggggagcctttctctgtggccttcttcgcgaaggctgggctggattacgtttcttgcttccctttcagggttccgattgctaggctagctgcagctcaggtgcttgtctgaggctgcctcctcattggcaaccggattgcctgctgctggtggatgtggtgatcaacagtattattacagagccatgctatgtgaacattactagtagcagtgctcataaaagctacaatcccatgtcctttttttccccagtcatgtaaaactttcaaactgctccatggttcaaaactctgttcttcaatacatcatcaattatcgattaaaaaaaacacaatttttttcctttttttatatttctaatcatttcttatag

SEQ ID NO: 26855 - DNA, 254 bp, Zea mays
  Clone ID: cC-zmle189106d08a1
ccggaaacccccacaaacccaccattattcctactttccgatggccccttttttaacactaaccaaaaccaattttttaacccttcccaaaaaaacaaaccatgacaccaattatttatgaaaaaactccaatcccaaaaaaacctgggccccacaacaaaaaatgtctttttccccccgctttagccttaaaatttaaaaaccccatttgcttaatctggggaaaaaacctttaccaagggcgaaacatgggt

SEQ ID NO: 26856 - DNA, 453 bp, Zea mays
  Clone ID: cC-zmle189106d09a1
ttttactgaatagaatttgaaatagaatatgatagcggcttgggagaggcagacagccttatagataacaacaccagacgcacccatgacaatacccagctaatctattactatgttggctcatcgatccaacacctttttttcgtcgtcgtcgtcgtaatcatcttcacacgcacgcacgcacacacaccatcgttttattcatccggatccattgctttagttcagaagttggggcctgcggcgaggatctcgtcagtcaggctgctgtcgtccccgatcttgtagctggcgaacacctcgaagttcttcttgaagagcccgccgagcctcaggagattctccttgtacgcggccttgtccgtccaggtgttgatcgggtcgaggatttccgacggcacgccgttgatctcagtggggatctccaggccaaacacctcggtcttctggtag

SEQ ID NO: 26857 - DNA, 457 bp, Zea mays
  Clone ID: cC-zmle189106d09d1
cggtaccagaagaccgaggtgtttggcctggagatccccactgttattatacggcgtgccgtcggaaatcctcgagcgcggggaacacctggacggacaaggccgcgtacaaggagaatctcctgaggctcggcgggctcttcaagaagaacttcgaggtgttcgccagctacaagatcggggacgacagcagcctgactgacgagatcctcgccgcaggccccaacttctgaactaaagcaatggatccggatgaataaaacgatggtgtgtgtgcgtgcgtgcgtgtgaagatgattacgacgacgacgacgaaaaaaaggtgttggatcgatgagccaacatagtaatagattagctgggtattgtcatgggtgcgtctggcgttggtatctataaggctgtctgcctgtcccaagcagctatcatattctatttcaaattctattctgtaaaa

SEQ ID NO: 26858 - DNA, 432 bp, Zea mays
  Clone ID: cC-zmle189106d10a1
gaggcttaatttggggagggccccaatagggggaatgtgcaaaaatggccttaacaacgacatgcccattttaaaccacaaaaacccttatttttaaacatgaacagtttggaagttttacataccttaaaaaataaatggaactgtaccttttatgaaccctgttactaatacttttcaaaaaacatatggctttttcataggagtattattaatcaccaaatgccccaacagcaggcttccaacgaggagggagccccttaaacaaacacctgaactgtagtttgcctaaccatcgggacccttaaaggggagcaaaaaacctaatccaccccatttttggcgaaaaaagcaacccaagaaggctttccaccatgttttcacaaatgcccacctttaaattaggcctagctttgcggcccctttttttaa

SEQ ID NO: 26859 - DNA, 203 bp, Zea mays
  Clone ID: cC-zmle189106d12a1
cttaaacccccaaacactttttttttatttcttacccaaaaaacttggtaaaacaacaattacatttccatttttttttttacaaacaaaaacaatttccccttaaaccccttttatcccccctaaactaaaatacttttgtttgttcgtttgccccaatttcttttaaaaaaaaaaaattacccccccccatccttttttat

SEQ ID NO: 26860 - DNA, 226 bp, Zea mays
  Clone ID: cC-zmle189106e01d1
aaaacgccaccaacgcggggaacctcgagcttttctaccttcgctccaccaacaactcatatccccagaccatacttatattgtggcaatgcaagaactacaatgattacactgatatcgcctcttcccccctactttactccttctagcctacttcctggaacttccaccgttcttgcctcctccagcaacttcataccctcacattcctttacatctccacaca

SEQ ID NO: 26861 - DNA, 429 bp, Zea mays
  Clone ID: cC-zmle189106e02a1
caggcaatcaggcctgggagagactcctgcgttcttttttatttgtcacggtttatttcaaaaaagaaccatcggaccacatatatttgatgaacgaaggtattttattttaacatccaaattggagtgtattcgactatcggcctcgtgccatctttcgcctctttctttcctgctcgcgtttttcttcttcctcaatcaagcgaagttgttcttcatcctcctgcctaacaatcctcgcgctccttttcttttccatttctatagaagcaaaatcggtttccatgtcactgacattttcatcttctgcctgcatatttactatgaacatacccaaacattttttttatcattgctaaagggatttcatcatcctcatcaaatcttttttttgccactagctttctttttgcatgaacatcactaatt

SEQ ID NO: 26862 - DNA, 320 bp, Zea mays
  Clone ID: cC-zmle189106e03a1
accaaaataaagaggaaagtgcctataccaattttggttcaaaccgaccatattaaatattagaactgtaattttgtactggtttttttaattagtgcaaagggagatggattttccttttggtttattaccaagcacataatttaacatatgaataacccttacaagactaccagcaacagttgcagaattctaaacccttcaaattttaaacttttcttgtttctagccagtctaaccacttctactcccaaaatcatttcttccccctttcattacagtaacttttaaaacggaggcaggattctctgccacatctt

SEQ ID NO: 26863 - DNA, 490 bp, Zea mays
  Clone ID: cC-zmle189106e03d1
cgaaaggtaaggcggaggagcaagaggcggttttccgcttttaaccagcagggcgcagccggggattcctgttctgacagcttccagacgcacgactcggacatcgacaacaatgcctttggtgtgcagaacggcttcggtaacatggtgcacgggcaggccatgaccatgaggaacggcattggcagcgtggcgaggacggtgaaggaggatagctattggttcacggacctgaatctagatgatctgcaggcgccctacaacgtgacccatgtgttgaatccgaacccggtccagacgatgaatctggcggctgggcaaggccatggctacttgcagtctatgagctcgccgtcgacgaagatgtggcagacgatcctgcctccgttctgagagttgctgtgatggaagggggaagagatgatcttgggcgtaggagtggttagactggctaggaacagcaggtttaaaatttggagggtttgaattc

SEQ ID NO: 26864 - DNA, 333 bp, Zea mays
  Clone ID: cC-zmle189106e04a1
ttttctttaggatttaacttaaaataaagccggactgtggtaacatcacccatcgatccgcattccatgcttgttgatgcatgggtctgctggaccctatgatgaacacattacttacttctgtcacagagcgaccttcaatcaaaaacacatatgggcaacaacaaactcgagacgaactattataaacactttggactagggtaaacaacacggtagctaacaggataacttggccgtgcgggccccaccgttcatttcctccatttcccgtctgagttgccgtatccgtcgccactgttgccacctccttttccgtcgtcaccaccaccg

SEQ ID NO: 26865 - DNA, 350 bp, Zea mays
  Clone ID: cC-zmle189106e04d1
gggacgcgtgggtgggttggcttctcctccccctccgtatctgtttcgggttcgtgaggttctccgggggtgggtttcgtgggtgagcgtatctcagatatccgccacggatgttgagtaccgctgcttcgtcggcggcctcgtctgggccacggacgaccactccctccacaacgccttcagcacctacggcgaggtcctcgagtccaacatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggccc

SEQ ID NO: 26866 - DNA, 297 bp, Zea mays
  Clone ID: cC-zmle189106e06a1
aatatgaacccacaacacttacaggggggctttttttcattcaaaaacaaaaccaacatctatgattaaatccaatattatatctttactttaaactggtacccccaattccttgcaactcatttcccgaaattagaaaaaaactgcttactttttaataacaacacatactagctctgtcttgtcatacattcttttgaaacgaaaccattccccccctatggaatccattctccttttcataacctttaaaactttttatggtccttaaactaaccccgggctaaaatttcccta

SEQ ID NO: 26867 - DNA, 385 bp, Zea mays
  unsure at all n locations
  Clone ID: cC-zmle189106e07a1
atgttatacaagacttcttcatcgagtttcttgaagtacaacagaccacttccattccttcctcctacaccaaaagccatgtttcccacgtacgacgactgcccaactgcagaagaaacaggaacacaaggcacgttaatcttttcactgttcgttatcaataaacaagagagagttgttcaacagccgctagccatggatcgggccttgcctcgccagcagcgatgtgcaagcacaggtgcagcagctagtagtagccgatgtccttgtcgtcgacgacaaggtctccgttgatgagctcgcggtaggccgcgacgggccagatgaaccccctggggaggaggcgtgtggcaagctcnacgtcgatgatgatctccctcatggc

SEQ ID NO: 26868 - DNA, 309 bp, Zea mays
  unsure at all n locations
  Clone ID: cC-zmle189106e08a1
aaccgagaacttcattggggttgcataggcatagttaaattacagcagggaagacccaactacatcatgatttgaccgataacccaaactacagaacccggcacatctctacaccttctagccagacagtgatgacagaaacggcgactactacttccacctccaccgggacgacgcctaggccctctccccacggatacggcgggcgagctggatgtccttgggcatgatggtgacgcgcttggcgtgaatggcgcanaggttggtgtcctcgaagagcccgaccaggtaggcctccggacgcgtggg

SEQ ID NO: 26869 - DNA, 395 bp, Zea mays
  Clone ID: cC-zmle189106e10a1
aaaaagggccaaaaacaaaatccttttccccccttaaaagaaaaaaaaatttttttttaattgccccccctaaaatgggcccccaaaaaaaaaaaccccccaaaaatccacccggtccattttaggggggcccaaaaaaaaaataaaccccaaaattttttcccccaaccccgaaaacaggtccttttaaaatttaacccccccccttgttcccccccgaaattcccacaccctccccccaggccacccaacttttcctaaagggaggcctaataaaaccttggaaaaaaaagggaaaaaccttttccctgtgaaaaatttttttccctccaaaatccccacaaaaaacaagccgaaaaaaaaaaaattaaaacccctgggccccaaaagggggc

SEQ ID NO: 26870 - DNA, 501 bp, Zea mays
  Clone ID: cC-zmle189106e11a1
gtaagcttcaatcctctagaacggccgcccttccttttttccccctttttccccctctcctccctctcggtaaaaactgtttttttaaaacccctacatccctcatccccccccattcaaaaaaaaaaaaacaatcccacaaccccctcttctgaaaaaaaccccccaaaaaaaaaaaaaaaaaaattaaaaaaaaaaaaaaaaaaatttttttttaaaaaaaaaatccccaaccccaaccacaaaaaccaaaattttaaaaaaaaaaaaaaaaattcctcccccccccccccttttaaaacaaaaacaaaaaaaaaaccccccacccaacccccaaaaaaaaaaagaaaaacccaacaaaaacccccccccttttcacccccaaaaaaaccaacccctaccaaaaaacaaacaacttccaaaaaaaaaaaaacccaaaaaaaacccccccaaaaaaaaaaaaaaaaaaccccccctctaaaaaaaaatttatcccccctc

SEQ ID NO: 26871 - DNA, 110 bp, Zea mays
  Clone ID: cC-zmle189106e12a1
ctttatcttttttttttttttttttttttaaaaattgttttttttaatacttattccccccctaaccccataattaatatttaaattttaaaaaatataaaatcatattt

SEQ ID NO: 26872 - DNA, 209 bp, Zea mays
  Clone ID: cC-zmle189106f02a1
aacaagcttgttctttttcattaatattttttatctctaatatcactatcccaaaactatttcattttcttacactttcttttcaaattctttaataacatacaacttttactttacccccctttttttaacctttcacaccattttgctctaactatatacaattcatttttcccatttctatcccttttttttaacaatcaaatctc

SEQ ID NO: 26873 - DNA, 422 bp, Zea mays
  Clone ID: cC-zmle189106f03a1
cctcccctccctttctttctctccttctaaaccaaaaaaaaaccccctcccctcacattttctccaactctattccccttccttttaaaaactcaccttctcccccccatcacttttttaactccttccctaccttttaaaaaaattcccatctctcttcttctttattaacccctctcttcttattctctcctaactctctttctttaaaaaaaatctctactccccccccatctccctcctctctctatctcttttttcaccttaatcctcctctcaaccaaccccctttctccctacattcccccactttcccacccctttattggttctaaataatctttctacccccccccccctctattaaaacccccaacactctttcttcctcccctttttttcccaaacccccccccataata

SEQ ID NO: 26874 - DNA, 546 bp, Zea mays
  Clone ID: cC-zmle189106f03d1
gtccgctcccggtgaccatccgactcctggaccctcttctccacgatttccttccagaagggaacatgggggacatttgagagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggagcaagctgaattcttctccttcggaacgaacgacctgacgcagatgacctttgggtacaacaaggatgatgtgggaaagttcattcccgtctatttt

SEQ ID NO: 26875 - DNA, 95 bp, Zea mays
  Clone ID: cC-zmle189106f04a1
tttccttgtattacccgtctattaccgctttcccccgtaacatcacgctgggcatggtgcgcccgtccgcggtctcactgaccatttttgtcggt

SEQ ID NO: 26876 - DNA, 322 bp, Zea mays
  Clone ID: cC-zmle189106f04d1
gcgggtgactgtgatgacaggcggcgcgccgccggcgccttatgtgttgttccggatggaggagctcgggttgcgggtgattcactcatacgggctgacttagacctacaggccaacgacggtgtgcacgtggcggcccgagtgggacgcgctgccggcggcggagcgcgcggccatcaaggtccggcaggggctccaccacctggggctggaggtggacgtgaaggacccggccacgatggccagcgtgcccgcggacgggcgcaccatgggcgaggtgatgttccgcgggaacacggtgatgggcgggtactacaaggac

SEQ ID NO: 26877 - DNA, 151 bp, Zea mays
  Clone ID: cC-zmle189106f05a1
gggtggagaggaacaacatgatctatttttccaatgtatccaatatggattcattgatatcactactttctctataatcttttataaatattccacttttattttccggccggttatgctaatgatgttttttataatttatttaaaaacc

SEQ ID NO: 26878 - DNA, 294 bp, Zea mays
  Clone ID: cC-zmle189106f05d1
gcccacgcgtccgacctgatcatggtgacgacgacgactctgttgctgatcgcggggcggttcgggcttgcgcgggtcgcgaaccgcaaggcgacggcggcgctcaaactggaggcgcgcgaactccggcctgcagacgggtgacccctgccggttcaccctcgccgacacgctggccttcgggggccgtgggcacattcttagccgtcggatcctgctttggcttaaaaaccaccgcccccttgaccaaaacattggttagaaccctacgtcgcccgtggttagaataaactt

SEQ ID NO: 26879 - DNA, 494 bp, Zea mays
  Clone ID: cC-zmle189106f06d1
ccctcccgagttctcaaccaaccttctccttcggtctttttttaccaccccggtccccgatttacccagggcgcacgccttctccctctcatctccccgctcactcccgtccccatcccacgcgatggccttcctcctcgccggcgccgtctccgtcgcagcgcctgcgtcgtggcctttcccggtcgccaccgtcgccccgccccgcctcgccctccgcccaggcctcccgccgacgtggcgcgcagttcgagccctcccgcgttcccgtggcgccgtcgaggtgtgccaggcccagggcggccaggacactgcaatccaagttcctgatgtgagcaaatccacatggcaatcacttgtcgtggagagcgagcttcccgtccttgttgagttctgggcttcatggtgcggaccgtgtaagatgatagacctcatcgttggcaagctctcaaaggagtaccaaggaaagctgaaatgttacaagctaaacactg

SEQ ID NO: 26880 - DNA, 449 bp, Zea mays
  Clone ID: cC-zmle189106f07d1
aaaacttacaatcttatatagataaaatttatactccatacatctatatataaaaaattatttacataaacaataaattcttattacatattaacatctaaagataaattcagttaataatatatttatattcttcttatttacattaataataaaacaaaaactatattatttattaataacatgtgcttttactaacaattgatattcttaataataaattatttttccttcaatataatcagactgataattaacaaaaacctattacactacttttaacaacacaacttattttcatttcaatcatatacttatatacaaatctacctctatttataattaaaaactattttaatttaaacacttatataaagactattattaattattacaaaaccttacatttaataatttttgcgcaacttaaaactttttttttttttaat

SEQ ID NO: 26881 - DNA, 287 bp, Zea mays
  Clone ID: cC-zmle189106f09a1
ccccggaaaatcccgacccttccctaaaggccacccacctttcccaaaaggaaccccaaaaaaacccccccaaaaaaaaagccaaaaccctttcctggaaaaaatggtaatcccttccaaaatccaaacaaaaaacaacccgaaaaaaaaaaatgaaaaccccggggccccaaaagcgggcaccaccccacaaaaattgctttgcccaacccgcccctttccaagggaaaaaaccttgccccccactttaataaaaaaatcccccaacccccgggaaaaagctgttt

SEQ ID NO: 26882 - DNA, 478 bp, Zea mays
  Clone ID: cC-zmle189106f10a1
caaatggaaagcggaagcctgtaccggcagttcggtgactgcatacaactcatatatatatataacatacgtctctttcgtcgaataatctgtatattattctctatggaaagaaccctcgcgcccgtgctgtacgtttcgtcgtggaaagaaccctggcctcatgcttcgtacaccttgcactcgtcggtctcggggttgtccttgcagaagtcctccagagggtcgccgttgccggccgccgccgcgccgggccacttggccgccaccaggtgcgccagatcaaccacgcgttggctgtacccccactcgttgtcgtaccaggcgacgaccttgaccatgtcgtcgcccatgaccatgctgagcgacgcgtcgatggtgcaggacacgtcggagcacctgaagtcgacggacacgagcggcacgtcgcagacctccaggatgccctgcagcgggccggcggcggccttgcggaacg

SEQ ID NO: 26883 - DNA, 506 bp, Zea mays
  Clone ID: cC-zmle189106f10d1
cccacccggccgcccacgcgtccgcccacgcgtccgcccacgcgtccgcttactttccgacctatgtcgtcggcgtcaacgggggggactacgaccacagcgtcgccgacatcatcagcaacgcgtcctgcacgaccaactgcctcgcgctcttcgtcaagatcttggacgaggagttcggaatcgtgaaggggaccatgacgacgacgcactcgtacaccggcgaccagaggctgctggacgcgtcccaccgcgacctccggcgggcccgcgcggcggcgctgaacatcgtgccgacgagcacgggcgccgccaaggccgtggcgctggtgctgccgcagctcaaggggaagctgaacggcatcgcgctgcgggtgccgaccccgaacgtgtctcgcgtggacctggtgatcaacaccgtgaagactggcatcacggccgacgacgtgaacgcggcgttccccaaggccgccgccggcccgctgtagggcatcttggaggtctgc

SEQ ID NO: 26884 - DNA, 322 bp, Zea mays
  Clone ID: cC-zmle189106f12a1
gtggaaaacaccccaaaccaaaacccatataaacacttgttaggtccccacacagaaggggggctgaaacaaaaaaaaactcactgacaaagggggaaaacgtccctactgggcatgtatgtatatatgtaaaaacaggcaaactgtaaaaaaaaaaaaaccccgccccggttttggggctaaacggttaatccggggggatggccacccccatggccaaaaaaaaaaccgcggcaagggcaaaaaaaaaaaatgccttaacaaaaaaggaggcccctctggtctggaagtttccaaactcaaaaaagcgcccccccttggc

SEQ ID NO: 26885 - DNA, 481 bp, Zea mays
  Clone ID: cC-zmle189106f12d1
cggcactgccctcccagctggtttggtttggtttcgttttttttttggttgggatttcacaggcaccgcgggcgcgcctttgatcgatatggccgactggcgcctcctggtggtggtggaggtgctgttcgtgcttgttgttcctggcctgctgatgcagctgtcggccaagggcggacgcttcgtggagtttggtaacttccagaccagtggcgccttcatctttgtccacgccatcatcttcttcgcccttgccgacgtctttcttattgccatcggggtgcacatcaccacggactagccgtctagcctcataaccgggaccgggatctttgttcggtacagtctgcctgtatatacatatatacatacatgctcagtacgtacgctttaccactctttcagtgagtatctctttgtatcagcacccctgctgcgtgcttacctatcaagtgtttatatgggctctggtctgggctgt

SEQ ID NO: 26886 - DNA, 68 bp, Zea mays
  Clone ID: cC-zmle189106g01a1
agcttttatcctctatagcgtccaccctttttttcttttttttttttacccctataaacattcttttt

SEQ ID NO: 26887 - DNA, 448 bp, Zea mays
  Clone ID: cC-zmle189106g01d1
cccacgcggccggatccacccatccctcgcagctccaaagcattgttagcaaagttttcctgcaactgcaacaagccgtgacgcttgtacatcggccggcactcgatcggcagcacatcaaagatggcggcggaggagggggagaaggcgaagagcggcggcggcgggcagcagatgacggtggtgcgggggctggacgtggcgcggtacatggggcggtggtacgagatcgcgtcgttcccgtccttcttccagccgcgggacggccgcgacacgcgcgccacctaccggctgctggaggacggcgccacggtgcacgtgctcaacgagacctggagcaagggcaagcgcgactacatcgaaggcacggcctacaaggccgaccccggcagcgacgaggccaagctcaaggtcaagttttaccttccgcccttcctccccatcgtcc

SEQ ID NO: 26888 - DNA, 101 bp, Zea mays
  unsure at all n locations
  Clone ID: cC-zmle189106g02a1
tgacttngcatgcacccctcacgtaagcttgcatcctctagaacggccacccttcaatttcttattttttcctttttcccatttcctttgagtaggtttat

SEQ ID NO: 26889 - DNA, 285 bp, Zea mays
  Clone ID: cC-zmle189106g03a1
attcaaaaaccatatgcaaaattgtggtggcgtgggcctcttattgtaccaagtatatacataattgtcctcttcttaaacaatatacattatgttttcattttaaactgttattatgtaccccttttgttacaaacttgttatggttacacatgtttttttgtagttctacaaatctacaacatcttccttccattccatataaaagataaatcatttagatgttaaagaattactattttcttacttgaacatttttgtttctaaacattggtctccttcatt

SEQ ID NO: 26890 - DNA, 562 bp, Zea mays
  Clone ID: cC-zmle189106g03d1
cggtcaaatttcaagttacctgctgacccatccactccgattattatgattggtcctggaacagggctggctccgtttagaggtttcttgcaggaaaggttagcactgaaacaatctggagcagaactgggcacttcaatccttttctttggatgcaggaaccgtaatatggactacatatatgaagatgagctgcaaactttccttgaggagggggcgctttctgagctaattgttgcattctctcgggaagggccaacgaaagaatatgtgcagcataagatggtggagaaggccacagaaatttggaacatcatctcacatggtggttacttatatgtatgcggtgatgccaagggaatggctagagacgtacacaggatgcttcatacagtagtccaagagcagggatctttggatagctccaaaaccgagagctacgtaaagagcctgcagatggaaggcaggtacctccgtgatgtatggtgacatatcacccccattcagccatagctctagcgtgtggagtaaagctggctttgcgtgtacgacatgcctaatg

SEQ ID NO: 26891 - DNA, 356 bp, Zea mays
  Clone ID: cC-zmle189106g04a1
aaacaagcacttgaataaatgtgggtgcggaaaaattcaacaagctgccgtttgagtatagtcccagacaacatacaaagttttaagccgaaaaacaatattcaacacaagcttgaaacttttactgactgccaattactggaacattgcctgctaagcagtcaactactgttgttgcccaggaaagccttgcattggagggcgcggtggggttgctccgggagtgaagttaggcggcggtggaatcattgtccgtaaaccatttgccactcttgctggaggtggcggaggttgaacatccccaataggtggtggaggaatcctagggggcattcccatatgttcaagagggggcc

SEQ ID NO: 26892 - DNA, 597 bp, Zea mays
  Clone ID: cC-zmle189106g04d1
cgacccacccggccgcggacgcgtgggtacgcgaccagtgaggtgcggttggtcattcagcggcgagccaaaccgagcgtacgcggatggatcgcgagtggggctccaagcccggcagcggcggtgccgcctccgcccagaatgaggctattgaccggcgggagcgtctccgccgcctggccctcgagaccatcgacctcgccaaggatccctatttcatgcgcaaccacctcggcagctatgagtgcaagctgtgcctgacgctgcacaacaacgaggggaactacctagcccacacgcaagggaagaggcaccagaccaacctcgccaagcgcgcctcccgagaggccaaggatgcgcccgcacagccccagcccaacaagcgcaagcttgccccccgcaagtctgttaagattggcagacccgggtataaagtaaccaaacaatatgatcctgagacgaagcaacactcgtttctctttgagattggttaccctgaaattgaagataattgcaagccaaagcaccgtttcatgtcatcatatgaacagaagtccaaagttgggataagaggtatcaatacctaccttttgctgc

SEQ ID NO: 26893 - DNA, 77 bp, Zea mays
  Clone ID: cC-zmle189106g06a1
aacaggagaggatggatcttatatgcgaatggccaagtttaaatttacacccattacctccaccatgtttacattta

SEQ ID NO: 26894 - DNA, 533 bp, Zea mays
  Clone ID: cC-zmle189106g06d1
gggcagcacactcagctatccagcaaaagagatcgagattcattagtcatggccaccgtcagcgccgccggggggaccaccatcgttgcccgcgccgcgatcgccaggcccaatgctctagggctgcctgcgctgagggcgaggagcgagagggtgcggtgcagctacgccaaggacgcggccccagtcagcaccaagggcgcaggcgcgtcgctgctcgccgcagcgggcgcggtgaccgcgtcggcggggcccgcgctggcgctcgtggacgagcgcatgtccacggagggcaccgggctgagcctcgggctcagcaacaacctgctggggtggatcctcctgggggtcttcggcctcatctgggccctctacaccatctacacctctgacctcgacgaggacgaggagtccggtggcctctcgctctagatccaccctctcctgttaatgatctgaatgtaaacatggtggcggtcatcggtgtaaatttaaacatggctatttgcatctagaatccatcctcttctgtt

SEQ ID NO: 26895 - DNA, 255 bp, Zea mays
  Clone ID: cC-zmle189106g07d1
ccgcccacgcgtccgaaaaaaaaaaaaaaaaaaaaaaaaattataataaaaaaaaaaaaaaaaaaaaaaaaaaagaaagaggtctttttttttttaacgatccaaccttacctacccttgcattcaacgatataatttcttttatagtgttaccaaaattaattttattgtccgtctttttacaacttatggattgttaaaactttgtcttttccaaacttaattccttttgagataatctccctttctccagtt

SEQ ID NO: 26896 - DNA, 360 bp, Zea mays
  Clone ID: cC-zmle189106g08a1
ccctcccttttatcccttttccaacccaccaccacaaaccgcaaaaactgctgtattacaaaccaaacacccccaaaaccaccaccaagcgccacccaaccaatgacagcatgcacaaagaagccaccccaagcacctgaaaaaaacccccaaaaaaaaacagccccaccaagcccaaaacaaccaaccctgggaaaaagcacctgacaaacaaaaagacccaaacccaaaacacaaggaaaaaaacagacacacccccggaacaaaaaaaggaccaacagacacaaaacaactcaaacaaaacaaccccaaaactgtaaacaaaaaaacataacaagaaatatgacccaaaaaaaacaa

SEQ ID NO: 26897 - DNA, 519 bp, Zea mays
  Clone ID: cC-zmle189106g09a1
ttttattaaaggaccagttattaaagtgttgtcggggcctcggcagttttgtatatatatctattacacattacacatgtatggtagccggagcttgcattcacatatatgttcctcacccaacgaatcgacagtcgttgcactacgtacgtaattgtagatggatgatgccatgctggatacatcagcaggagaattgttggaagcaaaaggaaccattgcatgcaggagaaaagaaatgatgagataaagggaaaaaaaggagggagagagagagaggaaccaatgcaagaaggtgatccgatcaacaggcagaggcatggccatgggttcgatctagccacggtctctactcgctgccggggggcttgtaggcgatgaagctgacgcactgcgtctgcctgacgttgtcgaagccgatgacgcggtggaaggcgtccgggtacgcggcgatggcctcctgcagctccttgtacacctgcgtggcgtccgtgcaaccgaacatgggcagcttccaca

SEQ ID NO: 26898 - DNA, 389 bp, Zea mays
  Clone ID: cC-zmle189106g11a1
ttttgtttttttttttttttttttttttgttttttgggtgggaaaccatatacatgcctacctgcaattttattagataaaatagtgacagaacaattgattaagcaaacgactgcaagatcagaaatagagacatatacacacgtacggggccgtctttatttgatatatagatttgtatacgtaacagtcgacagactttgaaggggatgacacttcacgaaggggcttattggaaagttgaaataagaagacaaacgacaagttcacaaataaccaatcccttgacgacagtcgtctggccctcgtttcttcacgtacttgcttataattaatcaaatgacatccagggaaagcgcattacgagcaggcaccggccaacggccttc

SEQ ID NO: 26899 - DNA, 496 bp, Zea mays
  Clone ID: cC-zmle189106g12d1
gccgcacgttgctgacttcgttcatggacctgatggccttttgttcgtagatcttcctgatcccactatcagcggggtggaggaaagtgctaccgacttcttggttgataaggtctcgcgatttcctggagaggtcttctgtgctccgcctttgggtcctctgacaaacatagcattggccatcaagaaggatccctcattcgtgaaaaacgttaagaagatcgctgtgctgggtggagcgttctttgcggctggaaatgccactccttccgctgaatcaaatatccacagtgatccggaggcagccgacatggctttcacttctggggcggacatctacgtcgttggcctcaacattacaacgcaagttagcttcacagataaacgatctcctggagctaagaaacctctcagggaagtacgcacagcttctatgttaatgtatgcagttctacttggactggcacacctcagcttatggtgctcctgtgatttt

SEQ ID NO: 26900 - DNA, 370 bp, Zea mays
  Clone ID: cC-zmle189106h01a1
acgacgaaatgcatttcacattttacgggggcattgatgaccaccgtacaaacacattatcacatgaaataatttactgttcattatccaaactttattcgatatgaagctaacaatccaaagttcccatcatgatctcatattacaaactcgtttttactgactaacaaacgacacattacacattatggccaactacatttatatgataaaccacgggaagcacagattaaactagtggcagggaaggtggtggaatatcttacatgccacgccccatggtttgttccatgggcggcattatgacaaatactgagtgcccatttgtgaatccagggtggtgaacccttgcggtgtatatcgctaccct

SEQ ID NO: 26901 - DNA, 573 bp, Zea mays
  Clone ID: cC-zmle189106h01d1
ccttccctgcctcgcgttaggtagcctgctttttacccgttttatctccctccggttctcgccgggggcgccgtcgccaacaaccacgaggagtcgagccccctcatcccagctgcggttgccgcccccgcggacgagaagcccccgcaggctccggcgccggaggccgccaattactatgccgacggggtcccggtcgtgatgggcgagcccgtgtcggcccacgccttcggcggcgtcccgcgggagagctggaactccgggatcctctcctgcctcggccgcaacgacgagttctgcagcagcgacgtcgaagtgtgtcttcttggaacggtagcaccatgtgtgctctatggtagcaatgttgagaggcttgctgctggacaaggcacattttgcaaacagctgtttgccttacactgggctgtatttgcttgggaactctctctttgggtggaactgccttgccacatgggtttcttattccactcgtactgctattcgacaacgcttcaatcttgagggtagctttgaggctttcaccaggccatgtgggtgctgcggccatctggt

SEQ ID NO: 26902 - DNA, 348 bp, Zea mays
  Clone ID: cC-zmle189106h03d1
gggccaacgtcttcttacgatggctcctacattttcacggctttatgaacaggctcctcgccggcgagctcttcctcaccaagctcgacatacagcgcgccatccctctcgtccccaagaccgaggctgatatccataatagcgcccacaatctcttcaaagacattgaaattgtcatatctgatgtggacatggcgatcgtttctgacgtcatgctcgtctatcttcctgctacaactattgctttacagccgccactgccaaaaaacactcgagctattgccaactttttctataactggcctgataatactttccaaattgctatggctggaacgtcattctcac

SEQ ID NO: 26903 - DNA, 511 bp, Zea mays
  Clone ID: cC-zmle189106h05d1
ccacgcgtccgcatcgattgaccactgccatcagccttattttaatgcctcctgaagggtaaggaacgcattccacgggagctgatatctatcttcaacgacaaagagcttgagcttctgattagtggtcttccagatattgacttggacgatttgaaaacaaatacagaatattctggctacagcatagcctctccagtcgtccagtggttctgggaaatcgttcaggggttcagcaaggaagacaaagctcggttcctccagttcgtcactggcacttcaaaggtaccgttggaaggttttagtgaacttcaagggatctctgggccacagaggtttcagatacacaaggcatacggcagcacgaaccatctgcctttagctcatacttgctttaaccaactagacttgcctgagtaacacgtccaaagagcagctccaggagaggttactgttggcaatccccgaagcaaatgaagggtttcggatttggctaatcagtcatgctcgt

SEQ ID NO: 26904 - DNA, 545 bp, Zea mays
  Clone ID: cC-zmle189106h06a1
atgagacaacatttgtattatgacgattggaaaaataatgttatacaacaaattaaaacataggtttcaaagcaatccattttacacctatttgtaggaaagtgcaagttcaattttttttggattaaatttaaaagcttaggcttctttctataattgttcttaacctctctatactttctaagattttattcaaatcccatttcaatttctctctattatctttcttattatcacattctttctcatttttatttgattatttatattcatctatcttctcttatatttttcgtatctacttccattttcatataatattatttttcttatttattataatttttattcactttatcttcttttttttctttttattattttttacttattcttcttctcttcctaattatttctaatatttattaatatctttctttttcttcttttctttttatataatactacatttctctttatcactcaattatttatatcattttttaattttcttaatattcatttacttttattttatcatttat

SEQ ID NO: 26905 - DNA, 168 bp, Zea mays
  unsure at all n locations
  Clone ID: cC-zmle189106h07a1
cctctagagcggcacgcccttccttttttttttccttttttttttggggaagaaaaaaaagtgcaaacttttgtncgggtttctgtcgagccaaactgctgctgtgtgtgcggtcagcccttcacccttcacttcttcaatcgactatatcacctggcgcagcacgta

SEQ ID NO: 26906 - DNA, 547 bp, Zea mays
  Clone ID: cC-zmle189106h09a1
ccctctttttccccttcattaataaaacgtaaaaaattgtctttaattaaaccttatttcccccaaaaccccaacaatatttaaaataatccaactccaaaacaaaaaaaccgccaacaaataaaaaacacaaaaaaaacaaaaccacactaaacaaaaaaacaaacaacataaaaaaaacaccaaaaacacaaaaaacaacaaaaaaaaaaaaaaaaaaaaccacaaaaaaaaaaaccaaaaacaaaaacaaaaacaaaacatccaaaacaaataaaaaaaaaaaaaaacccccccacccaaaataaaaataaacccccacacaaaaaaaaaaaacaaaaaaaaaaacaaacccccaacaaaaaaatacaattaaaaaaataaaaaaaacataccctccataaataaaaaaaacatcatcacaaacaccaccaaaaaaaattccaacaaaaattcaacccacaccaaaattcccaccaaacacaaaaacacccaatacccaaaaaacatcccaaaaaaaaagacaaaaaaatctcaaaccccctcc

SEQ ID NO: 26907 - DNA, 74 bp, Zea mays
  Clone ID: cC-zmle189106h09d1
gtccgaaaaaaaaaaaaaaaaaaaaaaaaaaaaaaaaaaaaattttatataaaaaaaaaaaaaaaaaaaaataa

SEQ ID NO: 26908 - DNA, 533 bp, Zea mays
  Clone ID: cC-zmle189106h10d1
gggcgacccacgcggccgcatcggcaagcccgaggcctacgtgatggttgttctcatggtttcggtgcctatggcatttggaggtacggaggagccagcagcttacggtgagctggtttccatcggaggcctgaaccctgatgtgaacaagaagcttagtgctggcatcgcttctatcctggagtcaaagctgtctgttcccaagtcacgcttctacctcaagttctatgactcgaagcgctcggacttcggttggaacggctccaccttctagacttgaggtctgcagctgaaataaaagaaattcgtggaatcatggtacctaatgcccatggctattgcctattaaggacaatggcataagaatgtgtcttaattcggtgctgaactgagaaacagtaacttgttgtcgtgggaactggaagtgggggtgcttgccgtgtcagagtgcttgctttctaccttacatagcatgcctgtgctatcttggtattgggtattgcttgatatcaggctatattatcatttacgga

SEQ ID NO: 26909 - DNA, 462 bp, Zea mays
  Clone ID: cC-zmle189106h11a1
ttttttttttttttttttttttttttttttttttttgttttttttaaatttttttatcctaataattttttttttttatatttttattattttaaattaaaaaaaaccaaaacaaaaattttaaaaaaacacaaaaaaaaaaaaaaaaaaaaaacctaaaaaaaaaaaaaaaattttaaaaaaaaaaaaaaaaaaaaaaaaaaccctcactttaaaaaaaaaaaaaaaccccatcaaaaaaaaaaaaaaaaaaaaaaaaatatttaaaaaaactaaaaaaaaaaaaaactgataggtaagggaacaaaaaaaaaaacaaaattttttaaaaaaaagtagcccaaaaaaaaaaaaataaaaaaccaccaaaaaacaactttaatatttaaaccccctcaaaaaaaaataaaacaaagggaaaattttcatttccacaaaataaaaaaacacattttgggttat

SEQ ID NO: 26910 - DNA, 499 bp, Zea mays
  Clone ID: cC-zmle189108a02a1
ttcttttttcagacaaaaagaacatgccgcttattcgggctgtcaagaacagtccaatccaaatacacatgccccggggactacaatttgccctcatttacagactttaactctcacagccgacaaaactcgacaggaaagacttctattcttacaaaccccactcctttccgaggcagaaaagaattttcctacagacatcccataaaacctactacggccatggaaccctactactaacaagtataactgactaaaaaacccagataagaaaacaagggatctgtactgctgtaataaaacctactacggccgtggaaccctaacctaactgaacagtagctcaaggaccagctcttccaacatatcatctttaatcattctctcaatgtcccttcttttcttctcctcgaccagatgcaggaaccttttggcatccatcccgaaaaatcagataatacaaaacctgtagggacatgaaatgattgcaggaagtgca

SEQ ID NO: 26911 - DNA, 466 bp, Zea mays
  unsure at all n locations
  Clone ID: cC-zmle189108a02d1
tgcggcacgcgtacgatggaaaccaacaagcaacattttaattttgtatccagnagcaacaatagagcagcggtggcggtcaagatattttccctccttatgctccttcgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgtttcaacaatcgccagccctatctttggtgcagtcattggtacaaaccattagggcgcaacagttgcagcaactcgtgctacctctgatcaaccaagtagctttgggcaacctttcttcctactcttatgaacaacaacttctttcattcaaccaactgtctacactgaaccct

SEQ ID NO: 26912 - DNA, 425 bp, Zea mays
  Clone ID: cC-zmle189108a03d1
gggggggacacgtgaattcttgaaaaaggggccattatatcgttcatactactactcctacaataggaagctgcagcgggtttatatcaatccatgttactgcactaccaaattatcatgaaatgactttttaaccggcgttgcgtctgatggtgaagaggaagatgccttgattgacatggacatatgactgaccgtgttctgctagctacctgatgtgcgtataatatataacatgtatgctcattcctggtagggaactttcaatatgacgcacttttaccgtttcctgtaaaaaccatggcacggtttagctttgtctttatatgccgatatgaaatttgttggtgggaaactttcaatcccctaggcttgaactgccattgtaattctgtactctttcgtatgctatacctgcaatgaat

SEQ ID NO: 26913 - DNA, 437 bp, Zea mays
  Clone ID: cC-zmle189108a04a1
atactttgcaagcaaagaacaaatcaacatatatggcggacttaactagaagggcgcgcacaaaccaagaatcctctaagcctggcatcagaagtccagataagcacgaaattctgatatgtacaactagtgttgctggtttgacaagtaacgaaggcaccaagggaagttgcgtgtcatggcccgacacgcaattgactgctccaccacaccactacctttgtgttctcctctctctttcttctcgtttatatagagattgtttttttgcaagctgcgatttggatcattactagtggatatgaatactggggcaaccctgtccgatagaccaacgccgcaatcctcagcttcaatcgatccatgcttggccctgcaatccttagctccaatcgatctacggagcgggtgttccgacggttattgggacatgccgt

SEQ ID NO: 26914 - DNA, 196 bp, Zea mays
  Clone ID: cC-zmle189108a04d1
aaaaacaaaaaaggcaccaaaacacaacccattaccataaaaaaaaaaccacaaccaaaaacggcgccactgttaaaaaaaaaaaaaccaaaaacacccaacccaaaaaaaaaaaaataccaccaacacaaaaacacaacaaacaacaccaaaaaaaaacatacataaaaaacataaaccaatcaaaacacaaaaa

SEQ ID NO: 26915 - DNA, 200 bp, Zea mays
  Clone ID: cC-zmle189108a05a1
aacaccaaactcccccccttgaaatccttaacaaaaaccaattcacaccatcaccaacaaaacatggggggaaaacaaaacaatccatgaacaatctgccaactagctatttacacttgccaatttccaatgtcactcatgccctcctcattacctaatcactcttttatctttttacgactctggcaaaccacctcccc

SEQ ID NO: 26916 - DNA, 299 bp, Zea mays
  Clone ID: cC-zmle189108a06a1
ggaaaaaataaaaaaaaccgcgcttttaaaccatcaaatttcatctccctccatatttcacaagctgcgggtatttcaacactccatttgcaagctgctttgataatttcattaccttcacgagcaaaaacccccccttctttaccagcttgtacacaggcttttaaagccacaccattagctgctgcaccaggtgcctttccccaaggatgtcctaaagttcctccaccaaattgtaataccgaatcatttccaaagatttcggtcaaagctttcatatgccaaacatgaataccccc

SEQ ID NO: 26917 - DNA, 257 bp, Zea mays
  Clone ID: cC-zmle189108a06d1
cgggcggcacacgtccggcgacattggatgtgaaagtttgtatttgctatatcgcgctgagaaaagatggcggaaatggtttattaacaatactgtctttgccaactaacatctgagcaagtaccaacactgaagaacaaggatctgtttcgagtgtaccatagacaagctgtgctgtaatattttccttcacaacgattgcgtggttaaagtgattgagtcaaataaaaaaaaaacaaaaaaacaaaatcaataaa

SEQ ID NO: 26918 - DNA, 75 bp, Zea mays
  Clone ID: cC-zmle189108a07d1
ggacgcgtggggtgcctgtgttactggatgattttaattagagttgcagcaataaaattggctttgccaccggtt

SEQ ID NO: 26919 - DNA, 396 bp, Zea mays
  Clone ID: cC-zmle189108a08d1
attccaaccaaatcatcacccgtgtgtctatatgagttcacgcccatggcgagcaccggcattgggtcagtcaccattcggttcatgctggcccccggcgtgcccactgccagtagctgcatctgtcttgtcagcttctcctcggcgcccaaccgacttggcaggaggcttgtggtcctggccgattatgagtccccggcagagccggcgcccactgcggaatgggatggcgccgtggccaccaagcccaatgccgagaatccttcgtctatcggacccaataggggctccaaggtgaacatcctgatgctgcagttctacttgtacaacgggatctgtaacctcttcaccgtcatcaggatcctaatacccgttaccctgtggatggtgcggtat

SEQ ID NO: 26920 - DNA, 180 bp, Zea mays
  Clone ID: cC-zmle189108a09a1
gcgggcgcccaaaaccggttttatccccaccaaacaacattatcaaaacaaacgaaaaaaaacataaaaaagggacaaattaccccaaaaaccccaacacccccaaaaaagcctgaaaaaacaacttaccgaaaaaaaccaccaaccaacaaacacggccacaaaaaaaaaaaaccccca

SEQ ID NO: 26921 - DNA, 413 bp, Zea mays
  Clone ID: cC-zmle189108b01d1
gcggcgggagggatttgctgttatgttcagccttggtcacacaaagggggacttgtatattgtaattgactccgacgaccaagactacgatgactccgacgacgaagagtacgcaatcgaggaggaggaagaggaagaggaggcggcgaaggatgaggagaagaagtagaactgtttggccaggtttctgcagtctcatctgtattggcagatgcgcgttttcttagaaatcaaatgttctctttgtaacatctgcgactttttataaaggctggagggtatgggatgagagtcagaacctatcacttgtgtttctgaacttttaagaccaggaaaacgggagctggaatttaccgggtgggtgaaaatggatgacatgaatttggaaaatcttcccgtgaaaaaataaatat

SEQ ID NO: 26922 - DNA, 477 bp, Zea mays
  Clone ID: cC-zmle189108b02d1
gaaggccagcaccgggtacggctcccccgaggatatccatactcaggtcgactaccagcacggcaggggggcggggggcgtgaagaccgactcctaccccggcctcgagaccgacgccgtggccaccggcaacgtgctggagagctccacccccgaggtggacgggaagcattactacagcatcaccgtgctgaccaggacagcggacggcgacgagggcggcaagcaccaactcatcaccgccaccgactccgacggcaagctctacatctgcaaggcgcaagccggcgacaagcggtggttcaagggcgccaggaagggcgtcaagaaggccgccgcctccttcagagtcgcgtgaccgacgtaaactattgtttctttgatgcttttcatcagggatgcacatgcacgcaccgtgtgtacgtagagagctaggcatggcctgggctcgccatgcttgttgtgtgtttcttttga

SEQ ID NO: 26923 - DNA, 377 bp, Zea mays
  Clone ID: cC-zmle189108b03d1
cggcgaaaacagactgagtggcggcatcaaggacttattgtctttacccaacttactcatctttaaaacagcgcgttgggtaaaaattgtgaatcgtattctacactcttacttactaaataaatcgttttaatttttaaaaaaaccataacaacccatatcacaatattgaggacaacaacaaaaatacaacaaaaaaaaccatataaacatcaaaaaacaaaaaaattcaacaaacaaaacaaaaaaaaaaatggtctgccctttaaaagaacccatttacactccccctcctattacaaaaaaaacctttttttaccctccccaaattaaaaccattcgcccccttttataaaacctctctacttgaaaaaccc

SEQ ID NO: 26924 - DNA, 357 bp, Zea mays
  Clone ID: cC-zmle189108b04a1
catacctaagcttcgcatcctctatatttttctaccaaaatactctgtatattaaaattactgttggattataaaacacatgtcaaattataccaccaccccaccatcacccaaattacaatatactgtaattaataaaagaagaacttctttaatttgcatcccggctggggcgtgcggcgtacgtgaaacgtgattagtctaaggtggccttgccggtgaacttgacgtcaatggggttgaccttcttgccgatgctgcggaagttctggccgacgccctccctgccggggttgaccttctccgggtagacgccgtccttggggtggaggtactgcacctccccgttggggaaaa

SEQ ID NO: 26925 - DNA, 272 bp, Zea mays
  unsure at all n locations
  Clone ID: cC-zmle189108b05d1
ttttcccccccccccttttcacccacagggggaggggtaaatttaaaaccccggaccaccccaaccacaagtaagagatgagatgatcttggaaacaggagaatgtgacgagactgcgttcacgcaaactcatactacaccatgatacnaaacctctttttgtgattttttgagacaaaccaagtatttgaagcaattatgatgttatagaattgcgatgcaacacataatgaacatacttgttatggagatatatcttataataatactac

SEQ ID NO: 26926 - DNA, 337 bp, Zea mays
  unsure at all n locations
  Clone ID: cC-zmle189108b06d1
aacccggcaaaaaaaaaaaaaaaaaaaaaaataaaaatttaaaaaaaaaaaaaaaaaacaaacccggaaaaggtaaaaaaaaaaaaacccncccccccccacccaaattaaccaacccaaacacccaaaaaaaaaccaccatcaaaaccaacaacaaacaccaatcaacaaacaaaacatacacaacaacaaaaaattccaaaaccctaaaaacccccaaaccaaacaaccaaaacaacaaccaccaacacccaccctccccaaatctaaaaaaaaaaataaacaaaaccccaaccacaacaaaaacaaaacctcaaaaccaaataaacccaccccc

SEQ ID NO: 26927 - DNA, 420 bp, Zea mays
  Clone ID: cC-zmle189108b07a1
tttttcccaaataattcgttgttaattgataccgataaattaaaaacaaattgtcgcgtttacctccttcacgtacatgacccacacatcaataatcttaactaagaattttacagggtcatatcaaaaatggaatccccaccgttgaatctgggatccccaaccggaagcgatacagcattgccaaaggaattcacccaatcctggcgaacagcgctgcctgattcacaacgatataccttcttttgtggaatgctgatcgagccaggatatgatatcatcgaaaacttggaatattgtctggtccggttcaccttccaagatagcgtgatacgcacctttgtagaggcacagcttcttgtcttggctcttggctttctcatacagagccttactaaccgtcgggtcattaaccatatt

SEQ ID NO: 26928 - DNA, 362 bp, Zea mays
  unsure at all n locations
  Clone ID: cC-zmle189108b08a1
ttttaaagcaagcaattattttatatgattattgggattattaaataacacggcggatttatcccgtgaccctagccancccagcatgcagcttcacagcctcatttcacaactactacaaatcaatcacacggtagctagcgcggagcccttgagccggccggccccactcatttcacctctaagacctcgtccaaggcgtacttgttggtggacacgccggcgtatttcaccttgttgaaccgcacaaccaccgggtagcgggtgttgggatcctgatcgacggtgacgacgttgccgatccctttgtaccattaggactcccttctaaagatctttaccttggcgcccctcttgggccc

SEQ ID NO: 26929 - DNA, 289 bp, Zea mays
  Clone ID: cC-zmle189108b08d1
tgttaaagatgggctggcatcattgcactgtcagggtgatcaagagaagaaggaagacaagtcggacgggggttattactagaagaactgatgtccccactcttcatgcttccatgctcacaaagaaattgatcattggtctgcattggctgcgcttactctcttggctatgaaatttgcttatcctcatgtaacagtgctttgcttataacttaatgccgagggaatttgtattgtgactgcaacaatcttctcgtcataaatgttcaagtgatttcgtgtttcaagc

SEQ ID NO: 26930 - DNA, 418 bp, Zea mays
  unsure at all n locations
  Clone ID: cC-zmle189108b09d1
cggccgggactatcttgttggggacgctcctccaggaatttctgttgagcacatctcgatcgtgcaatacctgaagccttaggaatcgatggcgcgataatcctcaccactccgcagcaggtctctctgattgatgtgaggaaggagaaaaacnactgcaagaaggtttttttttctgtcctaggtgtcgaggagaacatgagtggcctgaggcagccgctttcagacctcagattcatcaagtcagatgaggcgggcaagacagatgcgacagaatgggccctgaactacatcaaggagaaagcccctgagcttctgtcggtcatggcctgcattgatgtatttgatagcagcaaggtacgctcctacaagatgtgccatgaaatgggggttcctttccttggtaacgtgcccatgg

SEQ ID NO: 26931 - DNA, 299 bp, Zea mays
  Clone ID: cC-zmle189108b10a1
accggccgccctaaacatggatttttttcccccccccccacctttctttccaacaacgaaaaaaaataacaaaaaggccaaaaatacccaacacaccgatcaaccccaactgctaaatataaaaactttccacctacaacacaccttcatacattgtggaacaagaccccggcatcacactcaaaccctgaaccccgcttccatcaactggtcaaacccgaacaccccaaaaaacccgaccatctatgactccccagatcacaacataggcaacaacatccaccctcacaaggggtcca

SEQ ID NO: 26932 - DNA, 239 bp, Zea mays
  Clone ID: cC-zmle189108b12a1
atatttctccccacgaccgttataataacaaaccttaaaatttaagaaaattggcttttttcacccttcaacctatatataccatatatgcatggacacgtacaattcctcttcaccatcaccatcaacaagggtggttagcagcattgactataaacaacataataccctcctcttttatagattttccgacccctgggccgactcttttttctaccctgtaattccttaccggttcc

SEQ ID NO: 26933 - DNA, 461 bp, Zea mays
  Clone ID: cC-zmle189108c01a1
tctctctcttcatggtattctatagcacatgctgcagagttgatgtttcatgaatatatagctacaaaaaaaaaaggttacacctgcatagttgctgcagctaactgtacaatttacataacccctgaagtgagggaagggcgaagcaactttccaagatctttggggttgctatgtggagttgtcctttgaagccgctggtgtggaggtactatcagaattccttgcctctgacttttcggttgaataagacgacagtattgtgacccagacaagctccacacagtcgacccatagaagtctttgctcaacaggaaccacaccatatgtaactaagtgcgcaaaaggccacaacttccatccagcagtaaacatgggccagaatgtggacttgagctccttgtaaatagtggtaggtgattccaaccgaaggaaacccaagaccacaaagtagatactgt

SEQ ID NO: 26934 - DNA, 436 bp, Zea mays
  unsure at all n locations
  Clone ID: cC-zmle189108c01d1
ccgcggccgagagaagtgagggtgtcaggcttgcagaggctttatagataaatgtcatcaactggagaccatcctgggcgcgtatgcctatgcgatgatagaagaccgtgccaaacgattttccagggatgaacgaggagaattttgttctgatgatgaacgagnccaggagnngctggatatggtgaaggaggttttgccagcccctccgaaagcagaggtggagacagcagaggcagaggcggtggaggcagaggccgacgtagaggcaatgcaagagagaatgtggcgtaagataacatatttgagggccagattgcattagacactagtgctaagtgctggcaggaaacttagaacactcacgtcggctgttagttctggaagctttccccctaatgcttccgttgaatattaacgtattcatctcaatcca

SEQ ID NO: 26935 - DNA, 447 bp, Zea mays
  Clone ID: cC-zmle189108c02d1
gtccgcgttcctcttgcagttgattgggaatttgccttatgagttgctcctgacatcaacactagctgcggggctgttgtcatattccgctgagctctgccctgtgacctacccaaaagagaattaactccaagattgatgaggtcacaaataaatgatggcccattttaagggacatttaactctttctagcttttggactgaaaccgatcgatgcaatgtagacacagaagaggtgcatgattttgcaaagaagatttttaggaatatttcaactgttcgccactgccatgatgacctcaatcatccattcttcattttgctcacaaagattatatagttggtcataacatgtcgttacagctgacttgtttatgtaaaacaagtttaagactatgatttgtctttcttggtccaataaaaaaaaaaaaaaaaaagggctgtcgt

SEQ ID NO: 26936 - DNA, 383 bp, Zea mays
  Clone ID: cC-zmle189108c03a1
ttctccttttttttattaatccttaaaaaactggaaagagagcgttttatttttggttggccacatacctcctccaaaaaactttattattgaattacaactaaaaaacaatctaaaagagggcaccaccaatgatgcgttgttggtaggaggctgctggctttgtcaaagcaagttggacaaagggcaacaattgatggacaactaagaaggttgcggaggtagacgaaaactgtttgtataaaggaatcaaccgttgctgtgtcaaaaacgaaacactgcttgctccaactaagaagctaaatgggaggagcatttgctactacaaataagcaccggggttcaatgcggccaattgggtaaatggaagaagttttccttgc

SEQ ID NO: 26937 - DNA, 548 bp, Zea mays
  Clone ID: cC-zmle189108c03d1
cgtccgggacaaggagggcattccaccggaccagcagttcctgattattgctggcaagcagctggaggatgggggtacgctcgccttctacaacatccagaaggagagcaccctccacctggtgctccgcttgcgaggtggtatgcacatctttgtgaagaccttgactggcaagaccataaccctggaggttgagagctccgacaccatcgacaacgtgaaggcgaagatccaggacaaagagggcatccccccagaccagcagcgtctgatcttcgccggcaagcagctggaggatggccgcaccctagcagactacaacatccataaggagagcactctccacctggtgctccgccttcgcggtggtcagtaagccatggttcatttaagctgctgctgtacctgggtatctgcgtcgtctggtgccctctggtgtacctctatatggatgtcgtcgtctaataaacatctgcggtttgtgtgtcatgaatcgtggctgtggcttcgtttggttaatggacctgttgtgtcctctgtgtgtcccc

SEQ ID NO: 26938 - DNA, 487 bp, Zea mays
  unsure at all n locations
  Clone ID: cC-zmle189108c04d1
cgggcgggcaaagtgttaaagtacctttctcttctctgttaccgtattccgngctcgtactgtgactgatgggacacgcttcgattcaagcaacattacttcactacaactcatgtttagcaaatttgaatacgatggaatactcaacccaacatttactgaaggtccgcttgagcttcctttttcgagtattagagcatacatcaatgagccgatcactccaaggttcgttcatgtgagttctgcgggagttacaagacctgaaagaccggggttagatttaagcaagcagccacctgctgttcgattgaacaaagagcttggctccattttaacttttaagttgaagggagaggatttaattcgggaaagcggtattccgtacactattgtaaggccatgtgcattaactgaggaaccagctggagccgatctcatgtttgaccagtgggacaacattacaggaaagatatcaagggaagaagtt

SEQ ID NO: 26939 - DNA, 406 bp, Zea mays
  unsure at all n locations
  Clone ID: cC-zmle189108c05a1
atattgcagnggaaataaattttttattgcaaaggcattatttataacaatacgtctacattatacaattatcggagtgattacaaaagagagtgattcaaaagaattataatttaaaatgaataaaatatttatagtttttaaaatacatgctagcttaattgacaatcctcaataaagaagctaaagatgtgatatacttatataaaaaggccgagcccaccggcacttagcaccatccacactatccacaacagaacaaacttataacctgggataacactaggttagtgttgttagacgatgaccacttggcgaccagccttgtgtgttggcactggttcaatctgtccatccttaagtttggtcattagcattcaccttgcgaagaaaccaatacttaaca

SEQ ID NO: 26940 - DNA, 505 bp, Zea mays
  Clone ID: cC-zmle189108c05d1
ccacgcgtccgtcgctctactacgtcgcgttttgcatcctctgcttcctcgtcgtgccctgggtgttcgtggagctgtccaggctacgcgccgtcggcaccttccaaccggatttcttcgtctttgggaccaattcactctgcgcctttgcgctcaaccttgctgtgttcctgctagtgggcaagacctcggcgttgaccatgaacgtcgcgggagtagtcaaggattggctgttgattgcattctcgtggtccgtgatccgggacaccgtcaccccgatcaacctgttcggatatgggatcgcgtttttaggggtggcctactacaatcatgtcaagctgcaggcgctcaaggctaaggaggcccagaagaaagccgcacaggctgatgaggaggttggatcgctcttgcaggagcgcgatggacactgtgatcataagagccgacaatcaggcttagactgtcagatctgatcctggcctttccatattggggatctgatgca

SEQ ID NO: 26941 - DNA, 425 bp, Zea mays
  unsure at all n locations
  Clone ID: cC-zmle189108c06a1
cttgtaaaatttaaaaaaaaantgccccttttcccttctttctcaaaaaaacccccctaaaaaccaacccattttatantctcttttcttttttccacaaaccaaacccccccccttaaaattcttccttccttcaaaactatctttttacccccaactaaaaaaaaatctaacttttccccttctctttttttttttttttttccatacccaattaaacctttgaaaaaacccccaacccgaacaagccttcttttaccataaataaacattaaaaaccccttccccaaaaatttccccaaaatgtcaaaaaaactcacccctttttttacccctaaatttcttacccttaccttcatcctttccaacttttcctttatcgatcccattttaaaactcttcctaaatatcattcaaaacttttt

SEQ ID NO: 26942 - DNA, 506 bp, Zea mays
  unsure at all n locations
  Clone ID: cC-zmle189108c06d1
gggacggcgcgcccgacaacttccactccggtttgactttgtcaggaacggcagccctgccaagaagcgggtgtagaaagatcacgcatcggtgccgcacgaccaccagngctccatcctgttttttgttgccgtgaacgngncgcnncanaaccnnaagagctaccccttcgncaaggaagggctggccggcgggacgctcaagctggttggcgcccactacgacttcgtcaaagggcagttcgtcacatgggagcctccccaggacgccatcgagcgcttgacgagcgggttccagcagttcaaggtcaatgtctatgacaagaagccggagcttttcgggcctctcaagaccggccaggcccccaagtacatggcgctcgcttgctccgactcccgtgtgtgcccatcggtgaccctgggcctgcagcccggcgaggccttcacccgtcgcaacatagccgccatggtcccaggctacgacaagaccaagtacaccgcatcgg

SEQ ID NO: 26943 - DNA, 233 bp, Zea mays
  unsure at all n locations
  Clone ID: cC-zmle189108c07a1
aacaccaaacttttatttttttcagggnaatttttaaaaataatgccctgttttcctaacacttctcacccaccactaacttacctttaacatgaccaaaaactctctaccaatacattatagagcaccattcctctttctctaatccctcctattctactattatcatcctattttctacacataaacacactacccttcaattatccttcactaagcacaacatcctactt

SEQ ID NO: 26944 - DNA, 406 bp, Zea mays
  unsure at all n locations
  Clone ID: cC-zmle189108c07d1
ccacgcgaacgcgcacgcgaccgggaagcagttccatgttcggctgcaccgacgccacncacganggggggnggcggcaggaggccatcgccgcggacccggaccccaaccaccgcgncatnggttggtacacccccaggcacacgcagngcgnnagctacatcgccaacaagccccccggcagcgagtagagaccgtggctagaacgacccagggccatgcctctgcccgacgaacggaacaccaacaagcagaggaaccgcactctctctcccaccatcgctaacccttgaacgcagcacatctattctcctgcatgcaacggaacccaaagctaccaacaaagcgcctgccgacgcaaccagcatggcagcatccatcaacaaggaccgacgaagtgcaacga

SEQ ID NO: 26945 - DNA, 361 bp, Zea mays
  unsure at all n locations
  Clone ID: cC-zmle189108c08a1
atttttcccctcttccttatatttttaaaaagggaaaacataaaaaaaaactgccccttttcccctnccctctcaaatccccattacaatatttttatttcactgaatcacccattcttttgttttggcaactttttttgaaccaaatcccaatatcccaacccaaacttcacatttccccccctttttaaaaaacctcattcactagcattgcgtcttatacaaccttatgatgccgtctccccaaccgacattcccaaatcagatcttccttccttcccaaaagataaaatgattccccctcttttactttaattgtccccctacccttccctcaagtttttttaaaaccaccttcttt

SEQ ID NO: 26946 - DNA, 302 bp, Zea mays
  unsure at all n locations
  Clone ID: cC-zmle189108c10a1
gcggccgcccttttcttgttttttttcaaccccccccctttttttttttccccgggancctttatctcctaatgcctcgttttaccccctcatcccctcttttacccccctctttatctaaaaactaaaaccctttcaccccaatctcatttcttatcaaaaacacttaaaaaaacctacttaataccaaccaaaaaacttcccttcaaaaatattaaaccccccccattccccccccgcataaatattccaaaaaacccctcctccttaaaaaaaaaacctaaaccccatatttggccccc

SEQ ID NO: 26947 - DNA, 303 bp, Zea mays
  unsure at all n locations
  Clone ID: cC-zmle189108c12a1
aaaaaaaaaaaaaaagggcccccngccccccacaaacgcaanaccccccccaacgacaaaccacccagcgcccccccaacaacganaaaaaagaaaacacgggcaaggcaacaaagcaaggggcaacacaacacccgngggcacacagacnccggacaacccacaacgagggggcgaaaacacccccggcaaaacccgcaccgccgggccaaacccaaaccgcgccaacggggccngaccaacccacacgcccgaaacaccccccacccgggaggccaacaaaaaacaggcaccacaaaaccc

SEQ ID NO: 26948 - DNA, 469 bp, Zea mays
  unsure at all n locations
  Clone ID: cC-zmle189108d01a1
ttctctttgttgcccacacaggatttcatctcactgggaatgtagagtaaaaaaatattacagtcgctgttcacaaatgtagcccgagtaataaacagtgcggctataataaagtataaaaaacgaagtaaagtgttgctgtttgctccttaagctgcgagagcactgaggaacttctctctatggtattgttcttaatatattttcagctctctaatcatctggccaacgaatagatgctatcaggaataatgcaaatacatttgcgtgcgcgcacaaaccgtagaaatagtcacaaggaaccaaggaaatgaggcaatcttaggacgagcagcaagacgtcttctggttgacgggttgcccgcggatctgcacggtcgctggccttgcgttggccgcggctggtntggctggccatcctatccttgatggatgcagccatagccatgaaggcctgctcacgttgatg

SEQ ID NO: 26949 - DNA, 642 bp, Zea mays
  unsure at all n locations
  Clone ID: cC-zmle189108d01d1
aaaaaaaaaaggacactcaacaaaaaaatttataaataatcaacacaaaaaaaaaaatttcgtgaaaatgtttattttaaaaaaaaataaccccaaaaccccaaaaatatatataataaaaaaaanaacacatttttaattcttttttaacaaaaaananaaancaccaaccataaaaaaaaaattaattaaaaattaaataaatattaataaaaaaataaaatataataaatattaataatcataaaatataataaatattaattaaaaaaatataaattaattattaattaaataaatataacctataaatatataaaaaaattaataatattaaatactattaaaaaaattcttaaaataatactaatatattatataataaaaatatatattaataaacaataattataataaaaaaaaatatactaatcacaaattatatcaatacatttattaaaaaaaaataatttattattatatatcaaataataactaactattaataactattaataaaaaattttaacaatacaaaatatataatattaatataaataaataaatatataaactaactttaacataaaaatataaaattactaaacatcctcataacaaaataaatcaaataaaaatata

SEQ ID NO: 26950 - DNA, 535 bp, Zea mays
  unsure at all n locations
  Clone ID: cC-zmle189108d02d1
ccccgcgagcggtatcttccatattgttagagtttttggatctttttggttatgcaaagtcaatcaagaaggctttggggcngggtacaactcttttttcatgtaagagaagcctcctgccatcaaagaaacggaaagcagatgacgctgttgtctcagacagggacaaatttgctaaaactgtggttactcaggcagccacgggaactgatccaaatgcttccaatcctcctgtttggcctgcaacttctgaagcatctgggcaacaatggggagcttcttatgcacagcaggctgcatatcctgcatatggaacttacgactacagccatcaaatgccccagcctgctcctcaagcagctgcctatggtgcttatcctccaacatactctgcacaggcttatacacaacaaagctacccacagcctgcagcaatttcagcagcaccagtaccagcacctacagcgccgtcagcttatcctcaacaacctgcggcagctcaaccttattatggcacaacctactactgataagt

SEQ ID NO: 26951 - DNA, 317 bp, Zea mays
  unsure at all n locations
  Clone ID: cC-zmle189108d04a1
aaaaaaaaaatgaaaaatcgccccatcatgctantcaagacggttcnnggaaacaccaaagcggccgccctatatttgatttttttcntcactnaaacctttttttaacccaacgaaaaaaataataaaaacgcaaaattaccccttacactggacaaccccaaaactctagttcccaattaacaagaataccactctgtccgactacatcaacaggtaccccacagcgacaacagtaaaacccatttgcagaaaacactccacaaacggcccgaacctagacccccacaaatcaaacgcacaagccaccaaacaca

SEQ ID NO: 26952 - DNA, 169 bp, Zea mays
  unsure at all n locations
  Clone ID: cC-zmle189108d05a1
ttttacccctacaactccttttttaatacccggnnaaaaataaaaaacatgggccatctaccccttatttcccctataccccccatttcaccctcttttacacaccacccaacctctaaataatccttccttctttcacaatacccactttctaatgtcatacaattct

SEQ ID NO: 26953 - DNA, 295 bp, Zea mays
  Clone ID: cC-zmle189108d06a1
gatttttcctcccaccccctttttttttctcaacgaaatttttatttctaatgaaaaatttcccccaatcccccaatcccccccaccaatatatttataaaataaccaaaccccccacatacctattaaccttcccattccaccaacccctaaaaaaaaaacacccccccttttcccaaataaaaaaaaacccccaccccaccccttctttctccccaaaaaaaaaaaaccttcaatacaaacccccttaactaaccttccctaaaaaaaaataaatcgccatacccacaacctt

SEQ ID NO: 26954 - DNA, 424 bp, Zea mays
  unsure at all n locations
  Clone ID: cC-zmle189108d06d1
cgggcggccacgcgaccggggtaacatagatggaaaatttaaatttatggcgcgcactatcgatgaaaacagggggatttgtccaagccaacctagagcatccgccngaccaacatgaaaatgccagngtttttttctcctctcggcgaaacagncannggacngnnacagaatgatcaaactgagacctatgctaaacaagagctgaaggaaacacctgaagattctactgcgtgcagacaaccggaactcttctcgaattgcttcaagcttgctaataggtatatgaagcagacaagctttcatttcaaagcaaaaccagctggacagcaccaggtcacaagcaggttggatgcatcattatctaaactagctgggcatctcactttaaaggaagaagctcatcctttccagataactggag

SEQ ID NO: 26955 - DNA, 376 bp, Zea mays
  unsure at all n locations
  Clone ID: cC-zmle189108d07d1
cgggcgggcacgcgtacnggacgcctctctctcaacatttaaattatgaaaccccaggagccagccaaccgggggtttgtgagatgagaaggcgaaggaccccaacaccctggcaaaagcctacgaggagcactaaatagacccctttcgacaccaaccgngcggcgctggaggggctgaatcaggagaccaccatgctcaccttcgagggccaaaaaggccagggcccaaccgccaatgccggcaagcacggaactcatcccaaacaggcctgcgagcaccagaacgacaccgaagacagccagccgacggcgacccaaggaggcatgcacagcatacgacaccggggccatgcgcaccggccccgaggagcacc

SEQ ID NO: 26956 - DNA, 285 bp, Zea mays
  unsure at all n locations
  Clone ID: cC-zmle189108d08a1
atttataaaaagtgngacttctccccttccattgctcaatatacaaacaaccggccattctttcactcccaaatactataccccaccttcatacatcattctccatttgtccattttcataaaacaaatgcactcaacccttgtgacaaccaaagcattttaaaaacggacatagactttttttttcctctcaggacaccttcagatgttctctctctcctgctgcacacgtacccccatgctcatacaacaaccttacatgcctgacgcgtggttctacccttt

SEQ ID NO: 26957 - DNA, 443 bp, Zea mays
  unsure at all n locations
  Clone ID: cC-zmle189108d10a1
agcggcgccctttttgtttttttaacaggaaagatgtatcttanatccggagccatttaaaaaattgcccgttaccgccccatcttacatccccaacattaacaggagagggtggatcttatccagaggccaccggactcctcgtcctcgtcgaggtcacaggtgtaaatggtgtacagggaccatattaggccaaaaacccccaggaggatccaccccaacaggttgttgctgagcccgaggctcagccccgtgccctccgtggacatgcgctcgtacacaagcgccagcgcgggccccgccgactcggacaccgtgcccgctgctgcgagcatcgacacgcctgcacccttggtgctgactggggccacttacttgtcgtaactgtaccgaaccctatcgctccttgcccttagcgcaagcagccctataacatttggcct

SEQ ID NO: 26958 - DNA, 381 bp, Zea mays
  Clone ID: cC-zmle189108d11a1
acgattgggggaactccgagcggccgccagttatgacattttttctgcaaccagggacttttttaaactattgttatatttaaaaacaaaaggccgattttacacccactctaggctacccccccgaacctgccttcttgcgcgccacgcgctctggcccgtccgtccgtcccccaccacgtgcactctcctgccccgccggactcagacaatcagaggtggtgcctgtcatgggcccgccccgcccagcctacctaaccgaccgactggcatggcctgtgcgtggcgtttctccttgcgcgcgcgctcacgtacgtacgtactaccgaaacaccacaccgtcgcttttcctccttggcttcttcttcttattcttcttct

SEQ ID NO: 26959 - DNA, 322 bp, Zea mays
  Clone ID: cC-zmle189108e01a1
ctctcttttttttattttctttttttttttatggttggtggttaattaattatccgtcccaaccccccccaataagggctaaaaaaataaaatataaaatataaacaacccacaaaatatcaccagcggggggaggggaaaacggcatttcaacgcgggggagaaaggaaaaataaaaaaaacccgtaggcaaagccccagtacagaaaaaaccaacccaccggtttttaaaaaagagcacaaaaaaaaaatggcgaggggcgcgtgaaaaacaaaataaaaaaaggcaaaaagggggggggggggggggagaactttgttc

SEQ ID NO: 26960 - DNA, 456 bp, Zea mays
  Clone ID: cC-zmle189108e02d1
gggcgggggcgaccgtactcacaaaccttcgttgctacctgcgcatcttcaattcggtgagtcgcgctctttcgcacttgtttagcatttacttccaacctgtcccaaaaaccgacgaattatgtactgcgttttctcccgatttcctccctgaaaaaatcatcgaattttgaactatgttggtagcgcgcttgggctcagatcgcgtcttgggctccagaagcggtgattggagtcagatctgagagctgcaaggtctagaggttttaaagcgcacttggtttgggggcggtgattctcgggtgatggatctgtcgcggtttgttgtgttatacagaatctcgggtgcgtcgaattttgctagctttctgatttgcgacctaccagtactgaaaatcggttttggatgcggttgggaatccagaatgccccattccaaattgccaactgttttct

SEQ ID NO: 26961 - DNA, 365 bp, Zea mays
  unsure at all n locations
  Clone ID: cC-zmle189108e03d1
aggggctgagtcttcccgcaagcaatttaggtgttcgaccttgctgactacaacntgggaggtggagattttcactgtgctccccctccgggtggcatgccatctttgtgagacattgactgcaagaccataccttggagtggagcgttgacacaatcgataatgtcaaagccaatatccagacaaggagggcattccacggaccacatcgcctgtctttgtgcaagcgctgaggatggtcgtccctcccgactacaacatccaaaggagagcaccctcacctgtgctcccttgcaggtggatgcagatcttcttaaaccttgactgtaagaccataacctggagttgagagctctgacaccatc

SEQ ID NO: 26962 - DNA, 126 bp, Zea mays
  Clone ID: cC-zmle189108e04a1
ttttaccaccacctccccaacaccccaattacaatatactttaattaataaaataataacttctttaattttcatcccgactagaacgtgctgcaaacataaaacgtaattaaactaatgtggcct

SEQ ID NO: 26963 - DNA, 473 bp, Zea mays
  unsure at all n locations
  Clone ID: cC-zmle189108e04d1
ggaatagggaattttacgtcgtcgctcttccatgtctatcatacagagancctctacctccgccttcggcattgtttgattcttattcctattcatctcaaacctttagcaaaccaaccacctacccttagaagtcttcatcctcatcagcctatcctcaatatggaactccacatacagccaccccggccgcaccttcgtccacttatgacaaccaggtctgtcctatctgtcttgtgaaccccaaagacatggcgtttggctgtggacaccagacctgctgtgactgcggacagagtctctagtcgcgtccaatctgtcgcactcccatcaccacaagaataaagctatactagcaagtgttggctttcgatcattgccaatgggtggtatactggagccaccctgcctcacactggaggatcgcgacggcatgtcccataacccactgaacacccgttcgtaaatcgatt

SEQ ID NO: 26964 - DNA, 352 bp, Zea mays
  Clone ID: cC-zmle189108e05a1
acgatacacccatacgtagagcttggatcctctagattttccgcccttttttttttatcttttttttttttgtaatattttaaaaaaattcgacaacttgacccaaatttatattttcacccccaaaaattcatcggtcgtaatattaatctaagcaatatctccctaacaagtatgtacattatttgttgcatcgcaattttttcacatcatacttgctttatatacttggtttgtctaatataatgctggccccgggccaaataatggtgtcgtttaattctgccttcacccaatcaccccaccgttttccttttccaaaaagcaacgcaaatcacgcatttttttcttt

SEQ ID NO: 26965 - DNA, 315 bp, Zea mays
  Clone ID: cC-zmle189108e06a1
cttcatcctctagatttgccgccctttttttctttcttttttcccccgcaaaataaataaaaaatgcccgttttaccccctttccccttttccccccccagggcacacccctgggtccccccggaaattccctacccaatcccctccggccatccaacttcccctattatcaacaaaataaccccttttacaaaccttggcaaaaacttttaaactcgtaaaaattgtaacctctcacaattccccaccacataccaccctaaacctcaaagctcaaaacctggggccccctatgggcaaacaaactcaccaaaa

SEQ ID NO: 26966 - DNA, 499 bp, Zea mays
  Clone ID: cC-zmle189108e06d1
accttttaacttaccattatatctttttaattcctatcgaattccttcctatggcgtgggtatagttaaatgcctataggatacaacgtacacagggtgtacacattatatatgaatgaaacatattcattaactgaagcatactcctttttttatttaatgaggtgatattaattaaatatctttttttttagatttttgcaaaggtttcatttacgcctaatccatatggagtagaccctgtcgttgtgagaattgttaattcatgagttgtagggagggacttatgtcaccacaaacagaaactaaagcaagtgttggatttaaagctggtgttaatgattataaattgacttactacaccccggagtacgagaccaaggatactgagatcttggcagcatgccgagtaactgctcagcttggggttccgtctgaagaagcaggagctgcagtaggtggggaatcttatagctggacatggacaacttggtggact

SEQ ID NO: 26967 - DNA, 392 bp, Zea mays
  Clone ID: cC-zmle189108e07a1
cttgcgatcctctagattttccgccctttttttttcttcttttttttttttgtaaaattttattaaaaagggaaagtttaacccaaaaaccccggaacccccccccaatccttaccatcttaccatattttcattttatttacaccttttactatttactttcatatttttttcctttattacattgataaacccttacaatctcacacatcataccaacctttaaccttaaatcttaaaccttacatccctattaacctacctaacttacattccttcctttaccctcattgccccatttcccactttaaaacctgtcaatccctttgaccttattaaataatcaatcctccaacatatttccaatactaaattccccccatgtttccctt

SEQ ID NO: 26968 - DNA, 53 bp, Zea mays
  Clone ID: cC-zmle189108e07d1
aaagaaaaaaaacaaaaaaatataaatttttaaaaaaaaaaaaaaaaacaaca

SEQ ID NO: 26969 - DNA, 140 bp, Zea mays
  Clone ID: cC-zmle189108e08a1
cgcaacacccctacgtgagcttgcatcctctatatcttccgccctttttttttcttcttttttaaaatggataaaatttttatttattgtcttttttacccccaaatttcccctttatcccccccttttattactaaaaa

SEQ ID NO: 26970 - DNA, 454 bp, Zea mays
  Clone ID: cC-zmle189108e09a1
aaacacccaacgtgagcttggatcctctagttttgccgccctttttttttatcttttttttttttggaaaaaaataaaaacacccgctggttattcacgaacaaaaacttacacccccaacacaagcactaatacagattcagtgtgtaacgccgaaacatatatatatattggtaacgagaactctggcatctgtcatttcatctcatttctcactaccagattccccagcaggccaacattattttctcactcggccttgatcagcttcttcaccatgtttctaaaagccggcgcactggcactgcatttttgatcagcaaagcatgacctccctttctcagccgccttgcacagctgcggatccatgggcaccttaccaaggaaaggaacccccattttatggcacatcttcttggcgcctcccttgctgctatcaaatacctcactgcag

SEQ ID NO: 26971 - DNA, 364 bp, Zea mays
  Clone ID: cC-zmle189108e10a1
actaagcttcatcctctagttttgccgcccttttttttttttttttctttaatgcaaaattttataaataatgcccttttttcccccattatcccttctacccccctttccatttttttcttctttttttcttaacaccaaaaccataacctctcaactcatctatcatcaactttttcttacttattcatcccccactcacccaccccatcttctgtgttcacccaccttttcccccccccccccattcttttaattccttctctctttgcccccccatcctttttttccccacccccttcgacaattcctaatcaaaatctttcctcttccccccaaaattttttatcctctcacttttccc

SEQ ID NO: 26972 - DNA, 464 bp, Zea mays
  Clone ID: cC-zmle189108e11a1
tacgtgggcttgcatcctctagatcttccgcccttttttttttttttttttttttttgtaaaaatttataaaaattgccctttttaacccaaaaaaccattaaaacctttttttaaaccggatcccaggtgacatgcattctttagcccgcttgtccctctggtttctttaacaatacatggccctgccaaaaccacatttttttttttttttttaccctggtcgtggtccaactaacaacaaaagaaatccactaaattttattttatctgcccgccgtcttccttttcatcacttcacttgtaaaaaacccacatccccattcccctttaaaaaaggattcccaaaactttccaccatcccccaatcatttactcttacaccttttggaccctactaatttctactatctctttacccaatccatccccttcaatccaaaaaacctcccaaaaatggtatgt

SEQ ID NO: 26973 - DNA, 468 bp, Zea mays
  Clone ID: cC-zmle189108e12a1
cccctagcgaagcttggatcctctagtttttccgcccttttttttttttatttccgatcgccgaaaaatttaaaaaaaagtgtccattcttaccatcttcaccactaattaccaccatatcagaactacggaaatacaactgattccacatatttttcgcaaatcagcgatgagctgtgctgtaactttattgttaaattcggctcctattcctttttaacatatgcgaagactactggaggagctccttttaaatgccattaagctccatcttttgcagccatctcaaacgccctcatgaatacatttggaggcttgccaccactgagttgatatttatcattgatcacaaaatgtggtcccccggatatgccagatgaatacttcttgagttcttcctgaacctcatcgactcctttggtagggtcttgaaacatattttctgccccttttatgcccacctttttt

SEQ ID NO: 26974 - DNA, 564 bp, Zea mays
  unsure at all n locations
  Clone ID: cC-zmle189108f01a1
ccttattttttatttattttttttattttttgttgttgtggttattaagaaaattaaaagacccccccccaataattataaaaataaaccccccaagaaaacggaagccgaaaaaagggaaaacaaaaaaggaaggggaaaaaaaaaaaaaaaaaaaaaccatggggagggggggaaaaaaaaaacaacaaaaaaaaagggaacccacaacagacacgaaacgaaaaaaaaaaaaaggccaccccaaaaaaaaacctagaaaaaaaaaaaaaagagtctggagcgaaataaggaaggggggggggggggggggaccccaaaaaaaaaagaaaaaaggtgagcgaccaaaaaagacaaacaatgggaccgaggcatgcgggggagaaaaacagtaaacttccccccgcacaaatacaggaaccttggggaggcaacacggaaaaaaaaaaaaaaaaaccgtgntgggcatgaaaagaaccaggaaagcaaattacggtcaaaaagaccacgcaggagaaagaaacctccaaaacattgcgaaaagaaaaaaacggcaaggggcct

SEQ ID NO: 26975 - DNA, 440 bp, Zea mays
  Clone ID: cC-zmle189108f01d1
gaccggagaccatgtacagcgacaacgactagactcagagcctttatgttttatcgactccttctgggagcaagtccgggaagggtgccctctatctgccgataacgaccaacctcatagggggtcgccacacgagaacggatggagcaaagtggggaacatcggtgatcttacagaacagaggggcctgctgtcatcaacaaatcaccgcgactcagggaatgggctggagtgtatcttaattaatatacgggagactgggattatcggaaataagcgtcgcctgcagctgttggtatttttccttttggccaaaaaatgatatgccgtgatatcaaccactcgctcgacctatatgcgcgggaggggcagagctccatctgagctctgaatgccacagccacctgcttgtgtcaatctatgatgatggctagcttggc

SEQ ID NO: 26976 - DNA, 411 bp, Zea mays
  Clone ID: cC-zmle189108f02d1
cggggacgcgtgggcagcactccgcgctagctgaggacgtgatcatgtttgtcagaggtgcgacgtacgacgacgacgacgggggcgccacacatggcatgccagctctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtcggcgaaccgcaaggcgacagcggggctgaagctggaggcgccgcgactccgcctgcagacgggtgaccccgccgggttcaccctcgccgacacgctg

SEQ ID NO: 26977 - DNA, 500 bp, Zea mays
  unsure at all n locations
  Clone ID: cC-zmle189108f03d1
cgcaaaccctacctggcccgccgccgccgccgcagcagccttgccgttcaaattggacccctctcaggtggtnggcgtcggggtccgcgtgacgggaggcgaggccggcgcggcgtcgtcgctggcccccaagatcggcccgctcggtctctccccgaagaagatcggtgaggacatcgccaaggagaccgccaaggactggaagggcctccgcgtcaccgtcaagctcaccgtgcagaaccggcaggccaaggtctccgtcgtcccctccgccgcggcgctcgtcatcaaggcgctcaaggaacccgagagggacaggaagaaggtcaagaacatcaagcacagcggcaacatcagcctcgacgacgtcatcgagatcgccaagaccatgcggaacaggtccatggccaaggagttggccgggaccgtcaaggagatcctgnggacctgcgtcagcgtccggtgcaccgtcgatgggaaggaccccaaggacttgcagc

SEQ ID NO: 26978 - DNA, 497 bp, Zea mays
  Clone ID: cC-zmle189108f04d1
cgggacgcgtgggcgtcctcttgcgattcgctcgctcgttcctattttctcttccaagaagcgcagcgcccagggccagggtcacgcaagcctccgccgccacccgccacctgctggccgccgcctgggcgccggcggcgaagccgcggcagctgagctcgcagctcgcgctgccgtcgtcgtcctcccgcgggccggccccgctccgcgcgtccaccgaggaggcggaggaggcgcctaaggggttcgtggccccgcagctggaccccagcacgccgtccccgatcttcggcggcagcacgggcgggctgctccgcaaggcgcacgtggaggagttctacgtcatcacgtggacgtcccccaaggagcatgtgttcgagatgcccaccggcggtgccgccatcatgcgggagggccccaacctcttgaagctggcgcgcaaggagcaatgcctggcgctcggcaccaggttgcgctccaagtacaagatcacctac

SEQ ID NO: 26979 - DNA, 185 bp, Zea mays
  Clone ID: cC-zmle189108f05a1
gcttcatccttaaagtctccgcccttttttttatctttttttttttgaaaatataaaaaaaattgaccttttaaccctcaatccctacatccccccatatcaaacaaaactcattttttattcaatcctccatataccacctccttataaaatctcaattccttcaaaatcaatatatccccctt

SEQ ID NO: 26980 - DNA, 723 bp, Zea mays
  Clone ID: cC-zmle189108f05d1
aaaaaaaaaaaaaaaaaaaaaaaaaaaaaaaaaaaaataataattttttttaaaaaaaaaaaaaaaaaaataaccgccattttttaaattttattacccatattctcccatcctcattattattttatattattattttttattatttttttactttttttcttatttaatttatattttttttatattttattttttttatttaataaatttttatttttttttttattttcatatttttttatatttatttaatcttttttattttttattttatttcttctatatattcttattttattttatttatatattatttttttaattaaaatttttatttttatttatttttttttttatatctattatacattttttttatctattttttatatactttttatctttttttttttatattattttttatattaattttttttttatctattttattttatatcttattttttattctttttattacttatttttattatttatttatttttatttatttatttatattatattttcatatttcttacttatttttttttatttctattatcttcttttttcttctttcttataatttaatattttattttcttttatatttataaatcttattctactttcattttcttctctttattttttattttatttttatatatattttttttatattatattttttatttcatttatttattattt

SEQ ID NO: 26981 - DNA, 120 bp, Zea mays
  Clone ID: cC-zmle189108f06a1
tttgccgccctttttttttttttttttttttttttgtggaaattaaaccaatttgcttgcttcaactctcgttacaaacatcccctaacacaggcaccccacgcgtccgcggacgcgtgg

SEQ ID NO: 26982 - DNA, 70 bp, Zea mays
  Clone ID: cC-zmle189108f06d1
aaaaaaaaaaaaaaaaaaaaaaaaaaaaaaaaaaaaaaaaaaaaattataaaaaaaaaaaaaaaaaaaaa

SEQ ID NO: 26983 - DNA, 437 bp, Zea mays
  Clone ID: cC-zmle189108f07a1
cttggatcctctagatttgccgccctttttttttatatttgcatgagtggggtgttatcacaaacaattgttccatttacaaatttatgtgcatgtacccaatcacaagaaaaacgaatacatcgattttagagcaagagagattattgagtccacggtgaatgaagcatgcaataaattacatgatgattgtggagattaagccattacaagattgatgttgtgacgctagcagctaacgtagcagctaggcagcagcctcacttcacaactacaaatcacacaggagcatggggtccttgagcagactggcctcactcatttcacctcgaggatctcgtccaaggcatagttgttggtagacacgccggcgtaattcaccttgttgaaccgcaccaccaccgggtaacgggtgttaggatcctgatcgaccgtga

SEQ ID NO: 26984 - DNA, 372 bp, Zea mays
  unsure at all n locations
  Clone ID: cC-zmle189108f07d1
caatatctattgctctttcaccgggattgcctacaaggataaaccacgtttgctaacagctctggagatgctgagatctacacatgagatacaaaggcgtgtagaagaggtttctttgccctcgattcattttggacggtgaggctgatatggttactgaccctgcggttagtaatgctctgtatgagaaagccaagagccattacaagaagctggtgcctctacaaaggtgcgtatcactctatcttggaaggtgaaccggaccagacaatatgccaacntctcgatgatatcatatgcgtgctcgancagcatttcacagtggagggtatatccggtgtgaatcaggcagcgctgttctccaggattggg

SEQ ID NO: 26985 - DNA, 485 bp, Zea mays
  Clone ID: cC-zmle189108f08d1
cggtcggcgcccaaccggcttggcaggaggctcgtggcccttgcctttttcgaggccgccgcagctgaggcggggggggggttgggtgccgtggccaccaagcccaaggcctataagccgacgtcgatcgggcccaagaggggcgccaaggtgaagatccttaggagggagtcctactggtacaacgggatcggcaacgtcgtcaccgtcgatcaggatcccaacacccgctacccggtggttgtgcggttcaacaaggtgaactacgccggcgtgtccaccaacaactacgccttggacgaggtcttagaggtgaaatgagtggggccggccggcttaagggcttcgcgctagctaccgtgtgattgatttgtagtagttgtgaaatgaggctgtgaagctgcatgctgtgttgcttgcgtcacacatccatcctatgtgttatagcataatccacataatcatatcatgtaatttgcttgctt

SEQ ID NO: 26986 - DNA, 544 bp, Zea mays
  Clone ID: cC-zmle189108f09a1
cacccctacgtgagcttggatcctctagttttgccgccctttttttttttttttcgcggggcaggacacatttaaaaaaactggtccattatcacccactgcccagaatgcacatcacaccatatcacaataaacacagccgaactgtaacatatggttaacagtaaaaaactttagggcttgtttggatactcctatatacaccttaatccatgtgtattgaggcacattggagtgtaaaatactttaatttacgcctcaatccacctcaatatacatcgattgagattatattcaccttaatccatgtgtattgaggcagattgtagtgtaaaacagtttaatatacgcctcaattcacctcaatatacatggattgagatgaatactataattttcaaactaagcattatggggaaagctttcataactaacagccgacctgagtgttttaacgtttcctttgagcacttagcactagtgtctaatgcaaaatggcccttaaatatgttaacttaacccacattcactttttgcatttcct

SEQ ID NO: 26987 - DNA, 437 bp, Zea mays
  unsure at all n locations
  Clone ID: cC-zmle189108f10a1
cacccctacgtaagcttgcatcctctagttttgccgccctttttttttttttttttttttttttgaaaaattttataaaatttgcgggatttacccccaanttatacataaacctcatttccatccctttatcctattaagaattaaatacactcttatttgacttttacaaaatggttgaacatcaaattttaagccaaattatctacaccttacattccaattcctttaaaaatgacaagatccaaacctccttaaattacaagttcacattttaaaaccaacccccgtttttcttttattacctctttcattctcctttcacaaagccaaaccccaaaaataaagccttactttggttccttcctacattcaactcctatcatttttccaaactttcaaattaaacaaaattccctttcttcaaacaaaaagct

SEQ ID NO: 26988 - DNA, 315 bp, Zea mays
  unsure at all n locations
  Clone ID: cC-zmle189108f11a1
ttctatcctctattcttccgccctttttttttcttcttttaaaaatagggcaaaacatttacaaaaaatgtcgtgttttccctctcttcacctatataccccctccacnaaaccaaccattcaaccattcattctttacttccatcatcccttttcattttttctttcacgttcctcatgaccctcaatctctccccatccatcctctatctttatttccggcatgaccttttttcaaaaccatttcttcccccatagcatcaccatctctttcattgtcaccccctttttctccttcagtaatacttttacaaa

SEQ ID NO: 26989 - DNA, 362 bp, Zea mays
  Clone ID: cC-zmle189108g02a1
ctcttttttttttttttttttttggaggcatgaacgctggattatgtcgattatgttcatattcatggttaacaacgctacctcgtctacagtagattatgctattgcatgaaaacaatggcaactcctagcgacaaaaatgctgattgtacaaatctcatatttgttctcaagtgatcatctcgtcgctagcattcgtctaaaggcgagctaaacaatggcagtacagaggaaccacacacatgcgaaaaggtagattaacaggctcatcggatcaccatccacgactactctacttatcagtagtagggttgtgccataataaaggttgagctgccgcacgttgttgaggataagctgac

SEQ ID NO: 26990 - DNA, 364 bp, Zea mays
  Clone ID: cC-zmle189108g03d1
caacaagcaaaataaaaagagcaaaccaaaaccaacaatatatttataatggcgaccaaaatatttttaatgggaattgttcatattaaataaccataaccccccaaccccacaatatttactcaattctaacaaactcctatatcattatccttttccccaataccattcatcaaacaaaacttcaatatgtaaaaacccatctcttcaaccatatcatcaacaacaagcaatagcacaaaacaacatacctttaatacccttttttcatcaatcactatccctatctatttaacaatcatttaaacacaaccatatttcacatcaacattaataactactgctaccttgtatcaaccaaata

SEQ ID NO: 26991 - DNA, 435 bp, Zea mays
  unsure at all n locations
  Clone ID: cC-zmle189108g04a1
cttggatcctgatttctgncccctttttttttttttttatgtaggcttatttaaatacgacgcttaatgtccgcagcaaacaaatcccaccggatgcaacggaacaggagtccagaatccaaagaaattatccagcaaagaggcgtgactaatgactatcaccccttaaatatcgtctgtagaagtaactgagtgctctcgctatcagatgctgacgtttatacctgccacacaacaaattctagccgattgtccggaacagtatcagcatatgttgtgatgatcaccagcatggtgtgatgaccaccacaaagcgatcgtttcataccacatgacaactattggctgcaaactacattaacgagccggaaacgaaatgctcaagaccccacgcgttctgcacgcgttcgcccacgcgttcgcccacgctttcgc

SEQ ID NO: 26992 - DNA, 256 bp, Zea mays
  Clone ID: cC-zmle189108g06a1
cccctacgtgagcttgcatcctctatttctgccgccctttttttttatcttttttttcaatgtaaaaattataaaaaaaatgccttttttccccctctctccccttttcccccctctcttttcttttttttttctcctttcttcccttccttccccccaataaaccccccttaccccccccccccaaataccattccccccccccttcccccccctctatcccccctcccaattttacaaatatcttttttttttt

SEQ ID NO: 26993 - DNA, 475 bp, Zea mays
  Clone ID: cC-zmle189108g07a1
cttgatcctgtagttttgcccccttttttttttcttttagtccaggataacttaaataacacggcgtcatttcaacagaggagatacaaaggccatgagagtagcggcgacagtcggtattcatcgtctcaacatgaagcccttaacaaattcgttcatcacaagagttttcggctgtcttttagccatagttcaggcggaacatgtcattctgcacgaagaaggacccagctgccggcagcaaatggaatgcctgagagaacttgatggggtgctcctcggggccggtgcggatggaaccggagacgaagaccagcatgcctccctggggccccgacggctggcagtcgacggtgaccatctggtgctcgcaagcctggaagggaagagatccgagcttgccggcaatggcggatgggccctggaacttttggcccttctaggtgagcatggaggtctcctgatacagccccac

SEQ ID NO: 26994 - DNA, 423 bp, Zea mays
  Clone ID: cC-zmle189108g08a1
atatttttttttttcggtaaacaataaaagatgcggtcttttataacagacttttgaaccatgccccactttggaagttttacatgactggaaaaaaaagggagatgggattgtatcttttatgagcactgctactagtaatgttcacatagcatggctctgtaataatactgttgatcaccacattcaccagcattaggcaatccggttgccaacgaggaggcagcctcagacaagcacctgagctgcagctagcctagcaatcggaaccctgaaaggggagcaagaaactttatccagcccagcctttgcgaataatgccacagacgaaggctcttcaccgtgttcttcacaaatgcccacctttaagttaggcctagcttttcggcccctttttgttgcaaactttaccagcttcgccca

SEQ ID NO: 26995 - DNA, 420 bp, Zea mays
  Clone ID: cC-zmle189108g09a1
acgtgagcttgcatcctctaaattttccgccctttttttttatcttttttttttattgagaatattaaaaacataatcctttgtttatccaaaaaatcaccttcaacacttcagtaccacacttgtaccaaaaaaaaatttatacaagaccaatattcatctagagaaacttgcccacaagtccacaacttcaatcttcaatggcgaccttatgctgcttcgcgcgttgcctctccaacaatgccacaagaaatcaagtcaggcccctgcaattaaggccacgacgctgtccatgagcagcttgtccttctcccactcctgcttctggaggaaaaaaacatgctcctctccttctgactccagccaccccacgttcccggtccactccccttccgccactgttttatattacccccccgt

SEQ ID NO: 26996 - DNA, 560 bp, Zea mays
  unsure at all n locations
  Clone ID: cC-zmle189108h01d1
cccacgcgtccgcggacacgtggatgctgggcaagagtgttttagtataatcactagcagctactaccgcgtggctctggtgacattattgaatatgacgggacataccaacaaagcttcaataatgtgaagcaanggttttctctatttaccgcaangcaagggagaatgttaacaagctccttgtagggaacaagagtgaccttactgccaacaaagttgtggcaactgagacagcaaaggcgtgtgctgatgagatgggcatgccattcatggagacgagtgccaaaaacgccatcaacgtggagcaggccttcatggctatggctgcatccatcaaggataggatggccagccaaccatccgcggtcaacgcaaggccagcgaccgtgcagatccgcgggcaacccgtcaaccagaagacgtcttgctgctcgtcctaagattgcctcatttccttggttccttgtgactatttctacggcttgtgcgcgcacgccaatgtatttgcaataatttctgagagcatctattcgttggcagatgattagagagctgaa

SEQ ID NO: 26997 - DNA, 328 bp, Zea mays
  Clone ID: cC-zmle189108h02a1
ctctcttttttttttttgggtacaacacagagggcagcggcaggttcattaaaccaacgaagccacaaccacgattcatgacacacaaaccacagatgtttattagacgacgacatccatatagaggtacaccagagggcaccagacgacgcagatacccaggtacagcagcagcttaaatgaaccatggcttactgaccaccgcggaggcggagcaccaggtggagagtgctctccttctggatgttgtagtctgctagggtgcggccatcctccagctgcttgccggcgaagatcagacgctgctggtctggggggatgccctctt

SEQ ID NO: 26998 - DNA, 451 bp, Zea mays
  unsure at all n locations
  Clone ID: cC-zmle189108h02d1
catcgatcaacagacatacataccnttcttcaactatatgacgtttatacaaggggaaacctgaaaaaatcggggagttgtggagatacaccagcgagcgccccaatcacacggctactagagaccggatgatcaaggagaacgtcacggtggacaacagcagctgcatccgctccatcgccttcatctacatcggagccgacggcaaaccgtacaaggaggggccatggggtttctgccatgctggcaccgagtacaagattgatctgagcaggttataccagagcttgacggatatctccgagaccacgggcccagtctacaacattgacaatctggtcaggtctctcaacatctgcaccaacaaacgctcttacggaccgtactgcagggactagggcaccccgatccttgtcaaggtgatgaacaaacgccacgtcgctggcttctt

SEQ ID NO: 26999 - DNA, 507 bp, Zea mays
  unsure at all n locations
  Clone ID: cC-zmle189108h03d1
cacgcgtncggagaaagctactgctaccatgaaatagactatctatacgagcgctaacacccagggggctcgttcatacacaaagcaactatcctccctcccgggtctgcccttggaatggtcacacaactcccctcacaggatgagacttttattagcaagaaacaactccttgcacgtcttgatgtttgcatgggtgggagggttgctgaagagctgatatttggggaagacaatgttacaactggggcgagaaatgaccttcacactgcaacagagcttgcccagtacatggtatcaaactgtgggatgagtgatgctatcggtcctgtgcatgtgaaagagcgaccaattgtagagatgcaatcaaggatagatgctgaggtacttctccatagaccactcagatatactgataacattttggctgtactatttcatttttgctatacatttaggtgagcaaatagtacctcattgttgaatgctccttccgttctcaaatgt

SEQ ID NO: 27000 - DNA, 517 bp, Zea mays
  Clone ID: cC-zmle189108h04a1
tttttagattacgggaagctcattatatatcgggaataaccaccaaattaacattctgcagcaatacatttttagtccctaatctactagcagaacaaataaatctaggcaatgggcaagtgaggtagtagtaaggcatggctgcctttctgtagaacaaagtgtctaaaataacaaggcaaagctctccaccaagcaggtgcatatttcctaaacgttaatacctctgattttctctccagacacaaagttaagaagtgcaagaaaccgtcatccacctccttgaaagcaaccgtagaccaaactctagtctttgcaccttgcatcagatccccaatatgggaaggccaggatcagatctgacagtctaagcctgattgtcgctcttatgatcaccgtgtccatcgcgctcctgcaagagcgatccaacctcctcatcagcctgtgcggctttttttgggcctccttaccttgagcgcctgcagcttgacatgattgtagtaggccacccctaaaa

SEQ ID NO: 27001 - DNA, 268 bp, Zea mays
  Clone ID: cC-zmle189108h04d1
cacgcgtccgagggaagtaactcgtgcgtacggaggttagtgttatgcagatgagggcgtccaaattccggcgttgtggagatatacctgcacctgcactccaccgttgaccccgtggggaaccagctgatgtagaccgaccgagtggtcatccctatacatgggaccaagagcatctgtactgtacagtgtaaaacagagagatgggggtaatatagaggataccgattgggtcaaaataaaaaataatattttagagaaaaatatt

SEQ ID NO: 27002 - DNA, 314 bp, Zea mays
  unsure at all n locations
  Clone ID: cC-zmle189108h05a1
tttttggtagaaagtgatattgcttattacattgacattgtgcgattgatccggtatatatatgtagatgcagaaaacagatatatagtactcgacgcattcacattgctcgggtgcatatcggtaggtacgtagtagtatagtatagtatatatatttatgatgatgcaggagtcggcgggccggtagaattgccgtagccctagtttttcactttttccatgtgaggaactctcctgagacaaagtcgtagtgggcgccgatcagcttgagggtcccatttgcaagcccttccttgacgaangggtaggtct

SEQ ID NO: 27003 - DNA, 303 bp, Zea mays
  unsure at all n locations
  Clone ID: cC-zmle189108h05d1
ccgcttcctaacatgcaacagggacaacaagaacaaggagaacgctgcggaccaggncggcgaacgccgctaccagcaacgaggactaaacaaacagcctccccgagaatgactgccgatactccatctatgatatctactttgtcactgcagaagaagtccaaaagagcatgatcttctatatcctaaggtccccatgctacgccaaggtgaagacccacatgccttatgcatgctcaaaccaaaaattcaagagtgggctcaatggcattcaagtggaactgcaagctactgatgcaagtg

SEQ ID NO: 27004 - DNA, 450 bp, Zea mays
  Clone ID: cC-zmle189108h06a1
ctcttttttttttttgtttttttttatataatttgttttttttttttttttcctttttttcccccctttttttttttttttttttttttttttccccttttcctaaaaaaaaaaaatttttcccccccccccccttttttttttttttttcttacccccctcccctttttttccacccccatctttaattcaaaatttttttcccccccccaaaaaaaccaaatttttcccccccaaccccatttttatatgtattaacccctcttttttccccaaaaaaaaaattttttgaaaaaaaaaaaacccttttcttttccaaaaaaaaaaaatttttcaataaaggaaaaaaaagttttgttaaaaaaaaaaaaccccctcttccaagtttttccccctccacaaacaaaaattttccctctttttttattatcacccattttttttttcttt

SEQ ID NO: 27005 - DNA, 231 bp, Zea mays
  unsure at all n locations
  Clone ID: cC-zmle189108h06d1
caaaaacgaacaacacggggaaatggtcaaaataaaccactgagaccaccccaaccaccaccgaaaagggcccnnngtggatcttctacccccaaannnnnaannnaaagaanaacaacgaaagaacctacaccaccaacaaacaacacggaaactaaacacaacaacaaagctatgcaaccacacaaccttaaccatcggaaaaggcgaacaaacaaggaaagatcgaaa

SEQ ID NO: 27006 - DNA, 345 bp, Zea mays
  Clone ID: cC-zmle189108h07a1
atcttttttttgttaggatgaattgcacaggccttgcatagtttgattcatccactgatgaccacacatgcgtctgtgcttagtttacatcgaccgcttacagcaggcagccattgacattgattgatgagcacacatcgatcatgagcatacgccggctggtgcaactactacacgcctaccatctgaacaagtagagtacagagaagaccacactgttcactcgacggacggacgaacgaatggatggatctgatggtagtacacatgtacggcgttgctcagtcagttagttgccggggacgaagttcgtggcgtatgcccaggcgttgttggcgacggggt

SEQ ID NO: 27007 - DNA, 129 bp, Zea mays
  Clone ID: cC-zmle189108h08a1
cttgcatcctgtaatcttccaccctttttttttatctttttctaaaacggaaaaaatttatcaaatggggctgtttctctaacttacacataatatcccttcattataaaaatgagtatataccctttc

SEQ ID NO: 27008 - DNA, 398 bp, Zea mays
  Clone ID: cC-zmle189108h09a1
gggaagaaataacaaagggcttaccatttcattcattccattattactgattgagagacatgaaacgacggaaatgcaatccaaggcagatggatggatggatggagatgactacggaaagaaagggttcactcggatctggcggcgtatcgttccacctttgggtcgttgaggttgatgccgaccatggcctccccgagccccgtgctgacgtcggccaagatggtggggtcgctgtagtgggtgactgcctggacaatggcgcgggcgcggcgcgcggggtcgccgctcttgaagatgcccgagccgacgaagacgccgtcgcatccgagctgcatcatgagcgcggcgttggcgggcgtggcgacaccccccgcggcgaactgcacgacggggag

SEQ ID NO: 27009 - DNA, 367 bp, Zea mays
  Clone ID: cC-zmle189108h11a1
ttttgaacacaacagttcttccttgccgattgtgccctgttacggtaagtaatttacatcatgctacaaactggaaccagtgcgcgctcacgtgcatccgaacacctagatatccgcagcggtggccggtgggcggtggcgcctccaccccctcacttgccgggcacaaagttggtggcataggcccatgcgttgttgttgacggggtcggcgaggtggtcggcgaggttctcgagcgggcccttgccggtgacgatggcctggacgaagaacccgaacatggagaacatggcgaggcggccgttcttgagctccttcaccttgagctccgcgaaggcctcaaggtcgtcggcgaggccgagcgggt

SEQ ID NO: 27010 - DNA, 92 bp, Zea mays
  Clone ID: cC-zmle189108h12a1
ccaccctacccccctatatttttcccacccgaaaaaaaaaaaaaaaactgaaaatttaacccccaaacccccacaatccccaaaaaaattat

SEQ ID NO: 27011 - DNA, 397 bp, Zea mays
  unsure at all n locations
  Clone ID: cC-zmle189109a01a1
ggatcctatacactagaccgccctcccttttttttttttttatctttttttgggaactcaattccaattttacgagggtgtacatatacacattgttcatttttttacattgctggtcacatttgcagtttgaattgcaaaaccatattgccagcattattgccacaactcatatgccatgatctcatcgaatgaccgaaattgataacaagaactatcccattttaacaacaaaatccccctttcgctggtggcacggaacatcaacgaacgcaccaccacccttggagcaaccactgatgcataaagcaaccccatctctaatacaggtccttcttcttgtgggtgtggatgacgcantctgccttggggtaggagattcaggtgaagaagtacc

SEQ ID NO: 27012 - DNA, 523 bp, Zea mays
  Clone ID: cC-zmle189109a01d1
cgggggagccacccaacctgctcctccgccccgcgcttcgcctgttttctttcgtccgccgcgccccgtaccgtgtggatagaggaacaggaagagcagtaacccatccacccatccatcggggatcaccaggggtcaggggagcaagatgtcgactgccaccgccccaagattgcccgctcccagatccggggcaagctatcactatcagacgaccgcggctccggcggccaacaccctctccttcgccggccacgcgaggcaggcggcccgcgcgtccgggccacggctgtccagcaggttcgtggcgtccgcggcggccgtgctgcacaaggtgaagctggtcgggccggacgggacggatcacgagttcgaggcccccgacgacacctacatcctcgaggcggccgagaccgccggggtggagctgcccttctactgccgcgccgggtcctgctccacctgcgccgggaggatgtcggccggcgaggtcgaccagtcggaggggttcttccttgacgac

SEQ ID NO: 27013 - DNA, 334 bp, Zea mays
  Clone ID: cC-zmle189109a02a1
ggaacgcgatagaccacaacgtgtgtgtggttattacacaaccggacatacaatacaaggaatacctttcgttgaacaaggaactaattcaatagcagcagcaacacctttagttgccacaataacccattagcccattccgagttccttattcaaattctaaagaacgccctttatttaaaaaaaaccatcatcaaagctggtcaccgaccacttgccatccttacccctttttgcctgctatccaaactgggtgaatgggtcatatccatagacctcctcttggttcgagtggatgaaggttaactcattctccagaaactttacaaattcc

SEQ ID NO: 27014 - DNA, 270 bp, Zea mays
  Clone ID: cC-zmle189109a04a1
ttttgagttttcttgctatcagatgctgacgtttatacgggcggacaacaaattctagccgattgtccggaacagtatcagcatatgttgtgatgatcaccagcatggtgtgatgaccaccacaaagcgatcgtttcataccacatgacaactattggctgcaaactacattaacgagccggaaacgaaatgctcaagacaggacagccattacattcgacgctctcaacacaatgtaggccgtgccatccgcgcccggacgcgtgggtt

SEQ ID NO: 27015 - DNA, 259 bp, Zea mays
  Clone ID: cC-zmle189109a04d1
cgggcgcggatggcacggcctacattgtgttgagagcgtcggatgttatttctgtcctgtcttgagcatttcgttggcgggtcgttaatgtagtttgcagccaatacttgtcatgtggtatgaaacgatcgctttgtggtggtcatcacaccatgctggtgatcatcacaacatatgctgatactgttccggacaatcggctagaatttgttgtgtggcaggtataaacgtcagcatctgatagcgagagcactcaaaa

SEQ ID NO: 27016 - DNA, 299 bp, Zea mays
  Clone ID: cC-zmle189109a05a1
ttttagtattactttgaagttttattcaggtcacgagctgagttggggtaattcgtacaggagctgagtgcgtgcacgtaccatagccaagtaccatgaccctgcacaaccagtcaaccacagacatacataaggcacgcaagcaagcacaaacgggcgtggatgcctgccgccgggcggattaattagccctggcgaggaagctctccctgcgctcgtggacctcgccggagcaggtggtgatgttctctttgaccctggtctcacgcaccactaaaccctggcccccgcggtgacca

SEQ ID NO: 27017 - DNA, 440 bp, Zea mays
  Clone ID: cC-zmle189109a06a1
aactatctctcttataagatttagggtaagatacaaatatattacatatataaatatataaacttaattagttttgtctaaattataattattaaaatggaattcaattccaacgaaacaaacgggcccttacaggaatcagaagacatactgtacatgtgccccaggaggctcaactaggcccttttattacgggagaccttgtgcatcatcctcgccctttcattacccagctggaagctactgatagtctgaagtttgtaatcacacatgacaggcccttgctttcgcataagctgattgtcaggaatacttgcaaagctgcaatggtcttctcagaattccaaaagggcatgactatcaacatccttcatcacacatgctgtcttctcagaattccaaaagggcatgactatcaacatcatgcacagaacaaaaca

SEQ ID NO: 27018 - DNA, 564 bp, Zea mays
  Clone ID: cC-zmle189109a06d1
cgcgaaatgcagaccaagcagctggaagattactacaagaagcattttattattgtggaactgaagacatctgctggcccggtggagacatggcaggggctcgtagccgccctgcacctccagcatctggactcgcccccgacaccgcacaaactcaccgcgtaaatatcattattaattttgctacctccgagtagagagtctaaaggatcagaattccgatcctgcctgcagcatatctaatatccctatgtttgtgggttctggctcgagagagtcagtcggctgtcttttgctttgttttgttattgttatagataaaggtaagcgattttgcagacacgcttattgtatggttgtaaccgagagttgtggacttgccttggcttgcgagtgtactcgcttatatgctcctttgtgatgatgctttgcacctgtggtatcttcagttgctccattgtggtgttgtccaccatatgttctgttctgtgcatgatgttgatagtcatgcccttttggaattctgagaagacagcatgtgtgatgaaggaatgtgatagtcat

SEQ ID NO: 27019 - DNA, 378 bp, Zea mays
  Clone ID: cC-zmle189109a07a1
ctgggcttcaaccacctatatttttttatgtgccccaggcccaaacgcatgggttaaacatctttttggcaccccccctataaactaaaaaggggactaaatccccataatacaaaagcttaattttttaagcttacttaaacacttaaaactgcataaaacttcttaaacaataaaacaaacattgggagacgggagtaccccttcccggacccaacccatctaaatgctttggggctttaacaggctcttcctaaatttccaactaaaaaagaaaaatgtgcagcccctccttatttttagaattagggggggtcccccccaccaccccggcggaaaatagcattcccaaaattttttttttaaaaacctccagga

SEQ ID NO: 27020 - DNA, 508 bp, Zea mays
  unsure at all n locations
  Clone ID: cC-zmle189109a07d1
tgcggcaccgggcgctctagtgcgaacgctgtgcttgggcctgcactgcacttgtcgcgcgcggcctgcgactgcgagccggggaatccaagaagccgggccggccggagtgtccatcgttgtttccgccggttgcgagatcggagccagcaaggacaggtcgtcgtgggactagccatgctgcacgccgaggagaagaaggggaaggtgaagagagggtggctggcggtgcgcgtcggggcggcggaggccgacagcggctcccagcggttcgtcatccccatcgcgcacctgtaccacccgctgttccgacgcctgctggaggccgcgcgcgacgcctacggctacgactactccgcgggcccgctgcgcctgccctgctccgccgacgagttcctccgcctgcgcgcgctggtcgagcgggagacgccgccgcacgcggngccagcgcccgcgtcctcgcaccgcgtgcacgaaggcggacactactctaccctctacccgtgca

SEQ ID NO: 27021 - DNA, 386 bp, Zea mays
  Clone ID: cC-zmle189109a08d1
cgcacgcctcccgagccccacgcgcaggggtccacaataatgagcgcctcccgcctctcctgatcctcgttgagacgcttccgaggacgacgcccgatgtacccggtggtgacgggcacacccacgctgcacctgccggctacgtcgcggatggacaagaccacgagccacctgctgcacggccccgactgggccgtctacctcgaaatctgcgacaccctcaacgccaaccgctggcaaaccaacgatatagtaaaagctgttaataagccattgcaacataacgatccaaaagataaattctttacttttacgttatttgagacaatcatgaaaaactgtgctcaatatgttcattctgaaggtgttgatcaccatattttaca

SEQ ID NO: 27022 - DNA, 129 bp, Zea mays
  Clone ID: cC-zmle189109a09d1
aaaaaaaaaaaaaaaaaaaaaaaaaaaaaaaacaaaacaatttttattttaaaaaaaaaaaaaaaacaaacacacgcaagctacaaaaaaacaaaacccaaaaaaaccccaccccaactcctcccccca

SEQ ID NO: 27023 - DNA, 563 bp, Zea mays
  Clone ID: cC-zmle189109a10d1
gggccagtaggcgattacaagggtggaagaaacatctagccttattatttcaggctacagcctaacccctctaatggatggcagcagtggtagccaggacaagaaattcagagacaatgatcgccctgaagcaaaagctaatagcaccgcacagcatcttgttgacttcacggaagcagaggaagatcttgtttccagaatgcacaggcttgtggggaacaggtgggagattatagcaggaagaatcccaggaaggacagcagaagaggtagagatgttctggtccaaaaaataccaggaaagatgaaaccgaggccttagatttatatagatgatatatgcaagcatgtgctgataaataatgttaaactgggcctacgatgttaccggtttttcagcctgtgcacatcttgttatgacatgatgctcattttgcaaaagcacagtaagaaaatttacagaacgtcagaaaatatcaatcatgttttagaagatgtgtaacagtatagtatgccttaagaaaagatgaattttgcctcttgcacttacttgtgtaccggcag

SEQ ID NO: 27024 - DNA, 401 bp, Zea mays
  unsure at all n locations
  Clone ID: cC-zmle189109a11d1
ataggagaaaatgaactggcagcgtataaggtaaaatgcccatccttatagtagtgatatttatatatctgggggccggtctggatgtgacggcattaagggtaccttgtccctttcttgacatcaccagaatccgcctgcagtcttgtgctcggtggctgatctcaaggctttgtgatgttattacagtaatgtacacggtgtaacagagtttcttcatactgggagaatgcttgcttgggtcttcaaacggttgtgttgttgtacaacgggnaaggggcagcgtcngcagcccgttcctgggccagagcgcttagttcctgaggcaccagtgcagcccggcggggacgccctacttttcgccacattaccaagcgctgcaacaacaccgctgccaccac

SEQ ID NO: 27025 - DNA, 202 bp, Zea mays
  Clone ID: cC-zmle189109a12a1
aaaaccaaaaaaacaaactaccccattaaaaatccaaaacgttcaatctccgtttttgaaattaatgaaaccaaaaaagccccattcccccagaaaatttttttcccccgccccttgaaaattttttgggaaaaaaaaaaaagggataaccccccccattcccataaaacccctgggctaacttccttaccccttacaaaaa

SEQ ID NO: 27026 - DNA, 491 bp, Zea mays
  Clone ID: cC-zmle189109a12d1
acgcgtactcttacgcgtgggagccctcacgacacgacattattttaggagctcgagagggcaccaataagagcgtgcgtgaactccagcgtcgtcgggctcaaacccgccgtggcagtgccgcaggccgtcgccgtctcatcgccggcgaagcgggtgcagctggccgcgcccgaaggccgacgcgccgctctgctcggcctggcggccgtcttcgccgtcacggccaccaccgggtcggccaaggccaccatcttctatgagtacctcgagaagagcaaggccaacaaggagcttaacgacaagaagaggctggccaccagtggagccaactttgcgcgcgcctacaccgtgtagttcggcagctgccaattcccctacaacttcactgggtgccaagacctcgccaagcagaaaaaagtccccttcatcagcgacgacctcgagattgactgccaggggaaggagaaatttaagtgcggctccaacgt

SEQ ID NO: 27027 - DNA, 363 bp, Zea mays
  Clone ID: cC-zmle189109b01a1
aatataaagagactaattgcaatgggatgggtgggatacaaccaacaatatccaactctcgacaaattcactgatcaagaaaacacactcaggcagcacagcacacgccttgcttgtgggtgccagctgccgacaacttcaaatttgtgctcaatctcaagctactgcacagttcttcagcatgttaatcaattccgatggacgaagatgcgcaatggcacagcatttttttttctcaattgccagacaaatcatgaatggaacctacgaattcgactgacctactcaacagtatttctgtcaaacgcctaatcaacctgcaaacagcagctgaccacaagctggaggcagttctttgcaatg

SEQ ID NO: 27028 - DNA, 381 bp, Zea mays
  Clone ID: cC-zmle189109b02a1
agggcagaacatctgttgccggacgggctatcgttttcactggggaaattaatctatctgaatgcaatgtatgtgggtcgagtgtagcaaagattgcacacagatgatacacgtacgttacaactgacactacactacaggacacaacattttactatccagccgtgcgtttaattccaagctccatggatttccaacacaagtatacaaaaggctggcctctttgtatagcagagccacaagaccatccagatgaacatatattggcctgctctaccattctagtctctacctgggggcgggtgaagttgaccattttccagctccagcagctgcacgcttgcctgactggccatcgcctgtgccttggctagctgcgcg

SEQ ID NO: 27029 - DNA, 315 bp, Zea mays
  unsure at all n locations
  Clone ID: cC-zmle189109b03a1
aaataacggatgcaaattcatcggagtcgaaaattcgtagttatctttatactattaaaaaggaaataaatagaagaataaattaaaaaaaaggaaaaacatctttcttggtcttatccccaccgcatcctaatctctacctctgcattcctgcgttgatttttttttccaaatcccgtcgcttgatatttctgagaccggaacgcgcagaggcctgtcttctaccttcgncgctatcctctgcgccgctcatcggagattttttctgctcgcgctggccaggatattgcctgaagtcacgaccttatcttcccc

SEQ ID NO: 27030 - DNA, 618 bp, Zea mays
  Clone ID: cC-zmle189109b03d1
acgcgtccgagctcacgcaacgttttaccgtgtccagcgctttgctcacacaaaccgacggtgggcacaacagctgagttgaagctgagcgcgtgcagggagaactccagagcagcagccgcggcatccatggaagagagcacggcacgcaggaaaaacactaaaacagcagccgcgacgagatggacaggggcgcggctgggctgaacgcagagaaactcgaggagagagagaagctgctgcagcaagctctagggagcggacgcgccatgcctggagctgggagcttcggtcggctggaaggggaagcgcgacgcgcggcactgggaaaaactgagccggccgaccggacctgggaccaggtggcttcggccatgagcgagcaggacagagcgccgtgagatggagctaggcagtggagagctcggctagactccagatcaggggcgcggttggagaagagcaagaccgagcggacgggacgcagctcgattggagaagaccgcgcgtagggagcttcagctgggctcggcagagaaagctgggaaggtcgcgatggagagcgagcagagggcttggtgcgccgcgagctgcaaacaaggcgaccgaacaggacgc

SEQ ID NO: 27031 - DNA, 414 bp, Zea mays
  Clone ID: cC-zmle189109b04a1
gctaggatcctctacagcggccgcccttcatctataactattccttttttttggtcaacccaagatttctctaggggtcggaagatagcgtaccactctatgcatatactaaatcgcattagagcttcacctaattatcgcgatcgctgactccctagcctaagctctattgtctaacacttacacacaccattcgaggcagtatagacaagattaacacctgcaaaaacctaatgagagagcttactgacactaattgccataatctcactggcccctatatacaacgaaaacacgacaagcccacttcattaatcaactactcaacccccagagaaaacccaaaaagcgcacgcactctactgaggatttactttttatcactgccacaagttccagcagattatgcttcaa

SEQ ID NO: 27032 - DNA, 362 bp, Zea mays
  Clone ID: cC-zmle189109b05a1
gcatctgaaaaattatacagtgtggggattggttcaaagattcagttagacatgcacagggaagggcaattccttgaggtagatgctctacccgcgcaaattggtcgacacatacacatggtctccacaggatttaacgagtgcctattatccacttgattactatatagtactctcaatacagtagcttcagcgtcccaatcgggcattcagataacatatcgcgctaaatacagctcagggcaggactcaggagggcactggagccccacagtcaaacagcacatggcctagagctcatgttctgccccctctcactctcgtctaagggcaggctatgaacaaagctcggaggcaacagc

SEQ ID NO: 27033 - DNA, 237 bp, Zea mays
  Clone ID: cC-zmle189109b07a1
ggagggaacagtatgggtagcgttattccatctgcccatttaactgttacaccgcagtttaatcgagcaatttttgaactacaccataattggaactgtaaaagcaaatcctatgatggcaccataggaaaaactggtcacttttcaagcgctataggattatacatagccaataagtttcggcctaggcaaaaaattggcaaaacgtgccctattagacaatagcataacctgatt

SEQ ID NO: 27034 - DNA, 543 bp, Zea mays
  Clone ID: cC-zmle189109b07d1
ttttaattgatcttccacctaatactgactttttttttcttaagtctgcgcttcacaagtgcaacgtggggggaaagcctgctgttgctactcgtgtcgtggacagcatgactgacaacctcagacctactcgcgcagaggcaactgatgtggcaaatgcagttcttgacgggagtgacgccattctccttggtgctgagactctccgtggtttatatccagtggagactatttcaacagtgggcagaatttgtgctgaggctgagaaggtattcaaccaagatttatactacaagcggactgtgaagtatgtgggagaacctatgacccacttggagtctattgcttcttcagcagtgcgagctgcactcaaagttaaagcatcagtcatcatttgcttcacctcttctggacgagctgcaaggctcattgctaagtacaagcccagcatgcctgctttgtctgttgtcattcctcgtctaaagacaaaccaacttgagtggagtttaacaggtgcttttgaggcaagacaatcactcatag

SEQ ID NO: 27035 - DNA, 271 bp, Zea mays
  Clone ID: cC-zmle189109b08a1
aagcgaagggaaggccatgcttgcaacaatggatacatcacatccagcagaaaaaactggaaagcaaaggaaccatggccggggaaaaaaaaaaaaaaaggaaaaaggaaaaaaaaaaccaaccaggcaaagggttcggggacccctaaacaaaacccaacaacaaaaacaacccatggcactagctagctactagctcacccaggagctatagttatccggcggggggcggccggcgggccctttctaatcctttcccgggggcttttag

SEQ ID NO: 27036 - DNA, 478 bp, Zea mays
  unsure at all n locations
  Clone ID: cC-zmle189109b08d1
gtcggcttctgtaccgcagaactccacctcccctgtttctttacggccgctactggaccatgtgggagcggcccatgttcggctgcaacgacgccacccacgtgtacaaggagctgcaggaggccatcaaatcctacccggacgccttccaccgcgtcatcggcttcgacaacatcaagcagacgcagtgcgtcagcttcatcgcctacaagcccccgggcagcgactagaccgcgcccgccggccgccccccgccggctagctatagctcctgcgtgagctagtagctagctagtgccatgcgtcgtctctgtcgttcggttttgcttcggggtcaccgtaccctttgcttgcttggtttcttctttcctttttccttttttttttcttttccccggccatggttcctttgctttccagttttctctgctggatgtgatgtatccattgttgcaagcatggccttgcattggcttnc

SEQ ID NO: 27037 - DNA, 382 bp, Zea mays
  Clone ID: cC-zmle189109b09a1
atattacagacccactttgttcgtaagtttccttaatgactactacaagcgatcgaccccaccaaggccacaacttttacactggtttatgatacaataatactggtacatgggtacaaaaaaatgcacaacccccgcagcttcatgtatattacaagccggcagagcttatgcatatgaagctgcacatgcatgcttatgtatatgtttgggttatatatggatgtatatataacttgaccgcacgtgtacatatatgatgtatataggttagtgacgatacattatatatatacacgggagtagcagtacatatgcagatgatgatcgatcagtaagtacgcgccctaatatagttattaccggcactggaagctggagg

SEQ ID NO: 27038 - DNA, 455 bp, Zea mays
  Clone ID: cC-zmle189109b09d1
aagctacctagagctagctacctcccaccacccgcaccatttcctttaacagccaccgcattattgcaccgggtcgggctgctgttcgcggccacgacgctagtcgtcttcgtcccgcagctcgcggcgccagctgccccctgcccctactgccctacgccgacgccgccccctccgtcaccgcccccgcccccggtggtgaacccgccaccgtcacacacgccgtgccctcctcctacctactccccgtccacgcccacgggcacttgccccgtggacacactaaatcttctggcgcgcgtggacaccctgaacggactctctcacgcccttgtctggacccacgccaaccacacctgctgcccgctgctgtcccgcgtggtccacctccacgccgagctctgcctttgctccaccatcaaggccaacgcgctcagccacagactcgtgctccc

SEQ ID NO: 27039 - DNA, 301 bp, Zea mays
  Clone ID: cC-zmle189109b10a1
attcgggcgggcttattcccttgtatggatcacaggcaagagacaggaaaaaaaacaatctgtagttctgtacattatatgtatagctctctgtgaacctgtaaattaatgcgagtgtatgatctactaccatcttctaggcaaggtcaatctgacagctaccaactactgtacttccctgcgctgcctcgctccgtccaacggtcagccggtggtcgtcgccgggttcgggtaaaggtcggtccagcatccgtccttcgccacggcctttttccacctcctgttgaacagctgcagctcg

SEQ ID NO: 27040 - DNA, 547 bp, Zea mays
  unsure at all n locations
  Clone ID: cC-zmle189109b10d1
ggcgctcgaccggcggtcgcagatccaccaccggcttattgtttgcgccgcgcggagcgggggcgtgcgccgggggtactacaagacgagcgggcacggccggtgctacggcaacagcactggaccgccgtgcgcggcgtgggtggagatgatggtgcccgtgttctcgcgcgcggcgtggtgttgcgcgtggcacatgatccagaacgacctcatctacgcctggggcatggactacaagctcggctactgcgcgcagggcgaccggagccgcaacgtcggggtcgtcgacagtcagtacgtgctccaccggggcatccctacactcggcgacggcggcaaggcgacagcgacngctgccgcgtcggcagaccggttagcggtcatgcagccgtcctacaccgagctgcagctgttcaacaggacgtggaagaaagccgtggcggatgacggatgcttgaccgacccttacccgaacccggcgacgaccaccggctgaccgttggacggagcgaggcatcgcagggaagtacagtctttggttgct

SEQ ID NO: 27041 - DNA, 642 bp, Zea mays
  Clone ID: cC-zmle189109b11a1
ctacatcctctagagcaggccgccctttcttttttttttttttttttttttttttttttttttttttttttttaagataagttttattttcctttccttttcccccccccccttaatatcttttccaataaccaacccttaaccctcctttttccccaaaaacaaaaaatttcttggcaataatcccccccccgtccccgtccccaaaaaaaaaaacccccccttatggccaaactcaaaaaacccaaattccccccccaaaattctaaaaaaaaaacccaaaaaaaaaaccccgaggggggattcccccccaaaaacccccaaaaaaaaaaacacccctaaaaaaaccccccccccaaaaaaaaaacccccccaaggggggggggccccccctccaaaaatttttaaatatttccccaaacccccctttataaaaaccccccccccaaaaaaacaccctaaaacccccaaccaaatcatacccccttaataaaaacccaccccccccccccccttttccccacaaaaatcccacccccccccccctaaaaaacccaccttccccttataaaaacccttaaaaaacctcggaaaaaaaaccccaaaccccccccaaaaaaaaaacccccccccccccccccc

SEQ ID NO: 27042 - DNA, 419 bp, Zea mays
  Clone ID: cC-zmle189109b11d1
ggtcgagccactatcaaggcgacgcacatgatgaagcacttcttgtatttcgctgaggagcgtggtattccaatggaggggctgtgtaaatgataaaaacaattccaaaccaataccccccccccctttgtagcattctttctcctgtcgctgtaattttcttaaggtcttcatttttctgctgtatctatgggatgaatcccgcctcacggtttcttttttgcatctctcttctgagattctgtgtgtgagaattgagtccatgagatctgaccctatatgcttgctcttcacttctgtacactgctactggtggaaattcacaccaaagaatgaacagatttagcgcgatttaaaaaaaaaacaaattaatccaaataaccatactccatctgctaaatgtaaaaacttcttctaaa

SEQ ID NO: 27043 - DNA, 509 bp, Zea mays
  Clone ID: cC-zmle189109b12d1
cacagccagaagatcaccttccctggtgaagctgatgaatttctttataccgtcactggagacattgtatgcggggttcagcagaaggaccactccaagttcaaaagaaagggtgaagatctcttttatgagcacaccctgtctctgaccgaagctctatgtgggttccaatttgttcttacacacctggacaacaggcagcttctgatcaaatcaaaccccggcgaagttgttaaacctgaccaattcaaggcgataaatgacgaggggatgcctatttaccagaggcccttcatgaaggggaagctctacattcatttcacggtggagttccccgactcgctggcaccagagcagtgcaaggctctcgagtcggtacttccgccaaagccttcgtccaagctgacagacatggagatagatgaatgcgaggagacaaccatgcatgatgtgaacaacatcgaggaagagatgcgcaggaagcaggctcatgctgcttcagaggcgta

SEQ ID NO: 27044 - DNA, 391 bp, Zea mays
  Clone ID: cC-zmle189109c01a1
agtaagcacaagtcatctcattacccaagggaggggtaggttaatgttggactacaactcggatcctagagatggatcggagaatgcacaaggaacagaacaacatacgtcccctataacagtttcatgggcaacaccacaattgtctgcatttagccagaaacgccgaacatttcatcccatggcgtacttctgggtccagctgcgggctgtcgcctcatacttaggcccatccgtctcgtacatgtgagcaatctcagggacaagagggtcgtctgggttgggatcagtaagcagggagcagatagaaagcaaaaccttagagattgtcaaagcagggctccactgcttcttaagaatgtcaagacatatgcttccattactattgatg

SEQ ID NO: 27045 - DNA, 410 bp, Zea mays
  Clone ID: cC-zmle189109c01d1
tccccatgctgctcatcttctatcctccgcgcccccgatccacatccagatacgagggcttttcatggcatccaaacgtatcctcaatgaataaaatgactttcaaaaagaccctccaacataattcagtgcatgtcctgctggtgatgatatgttacactggcagacaaccattatgactcctcctgatagtccatatgctggacgtgttttcttggtgaacattcatataccgccagactaccccttcaagcctccaaaagtatctcttaacaccaacgtcttccatccaaaacatcaatattcaatgtaagcatatgtgttgacattcttaacgaccaatgcagccccgctttcacaatttctaaggccttgctttctatatgctccccgctttctgttcccaaccc

SEQ ID NO: 27046 - DNA, 374 bp, Zea mays
  unsure at all n locations
  Clone ID: cC-zmle189109c02a1
ttttaatctttaattgatgatgtattgaagaacagagttgggagagcatggagcagtttggaagttttacatgactggaaaaaaaaagggagatgggattgtagcttttatgagcactgctactagtaatgttcacatagcatggctctgtaataatactgttgatcaccacatccaccagcagcaggcaatccggttgccaacgaggaggcagcctcagacaagcacctgagctgcagctagcctagcaatcggaacccttaaaggggagcaagaaacgtaatccagcccatccttcncnaaaaaggccacagacgaaggctcttcaccgtgttctccacaaatgcccaccttcaagttaggcctagctttgc

SEQ ID NO: 27047 - DNA, 523 bp, Zea mays
  Clone ID: cC-zmle189109c02d1
cgtccggacgcagatgacctttgggtacagcagggatgatgtgggaaagttcatttccgtctatcttgctcagggcatcctccaggatgaccccttcgaggtcctggaccagaggggagtgggcgagctggtgaagtttgctacagagaggggccgcaaagctaggcctaacttgaaggtgggcatttgtggagaacacggtggagagccttcgtctgtggccttcttcgcgaaggctgggctggattacgtttcttgctcccctttcagggttccgattgctaggctagctgcagctcacgtgcttgtctgaggctgcctcctcgttggcaaccggattgcctgctgctggtggatgtggtgatcaacagtattattacagagccatgctatgtgaacattactagtagcagtgctcataaaagctacaatcccatctcccttttttttccagtcatgtaaaactttcaaactgctccatggtttaaaactctggttctcaatacatcatcaattatcgaat

SEQ ID NO: 27048 - DNA, 387 bp, Zea mays
  Clone ID: cC-zmle189109c03a1
gtacaaaaccataccataattcaaagggtggggtcgaacatgcaaatactatgctcccacggcaatggacaaacaaaacgaacatgcaggctttaaagtccacagataggtaacttgttgggaagatgcaggataagacagattgataaaatactattgcgtctcaatacaaagttcagcgacacaactaatcaaaacttaactaggtctcaaaggccgcttcactgcgtcactccgagccacttggagaagttctcaaactcggggtagtcactgtccgagatcatggtcttgtaccacgccttgccggcagccttgaccttggcagtctcctccgaggtaagcttggtcgctcttggaatcaagcttttcctttcgggccttgac

SEQ ID NO: 27049 - DNA, 311 bp, Zea mays
  Clone ID: cC-zmle189109c04a1
ggaaaaaggcaagaggtggattaaatagttggatttgattgattgggaatcaagaatcaacagttcaaaacacaaaactacatacattttatgaggtaatatccgaccgatatgtatgtacaccaatccaaattgcaaatacaacactgtaaaacaaagacatgaccaccatgtatgagaaaaggtaatggctgcctgactttttgattattttgttttcgggattatggacgccacccccttcaaattcaagggcttgaagaacgttaaaccgaacactcctggagatgggcgaaaatttaaaatttact

SEQ ID NO: 27050 - DNA, 496 bp, Zea mays
  unsure at all n locations
  Clone ID: cC-zmle189109c04d1
gtccggcgagatcatggatcggaatcctgatcttgcccatgtgctcaattacctaagtgtcctccgccaaaccctcgaaggtgcgaggaaccctgaaatcatgagagagatgatgcggaacacagacagagctatgagcaacattgagtcctctcctgaaggttntaatatgctccgtcgcatgtatgaaactgtccaggagccatttctaaatgcaacaacaatgagcggggaagggaacacagcctcaaacccatttgcagctcttctcggcaaccaggggtctaaccaacctggtcaaggtcaacctgcaacatatactccaactataggttcggagtcgacaactggaaccccagctccaaatactaatccacttccaaatccctggagcaccaatgctgggagtgcacaaggagcaacacggtccagtggcaacacaagaactggtgcttctggtcatgttggaggtactggtgccactggtggattggga

SEQ ID NO: 27051 - DNA, 435 bp, Zea mays
  unsure at all n locations
  Clone ID: cC-zmle189109c05a1
ttttccttttccataaaacattatccatggaacatcatagaggtgggagtaacggtaaacggtcatccacatanagcaaaattaaagctcgtcttgacaaacacagaacagcaacaccacccagagagggctagcttcataatggccaccggccaagagccggcaaatgccacgcagacgagacgcctacagcctccttcccctcctaccgccctttctgcgagtgctgtcagtggggaccggggtaacgtcctcaatgcgtccgattttcatcccggaacgagcaagcgccctgagggcaaactgggcaccaggtccaggggtcttggtcttgttgcctccggnggcgcgaagcttaatgtgcagtgcagtaatgccaagctccttgcagcgctgtgcgacgtcttgagcagcaagcatagcagcgtaaggtga

SEQ ID NO: 27052 - DNA, 433 bp, Zea mays
  unsure at all n locations
  Clone ID: cC-zmle189109c06a1
attgtgcaaggcacagatgatctttatgtgagcgccaagagcttttggaacaagtgatagcaggagaggtacgagtacgactggctgcacacagcacacggcacagtgttcgtcccaaaattaagctccagctcattggcacatttgacagagcgagcccattcacaccgggccacggacgtgcatggatcgagagaagagcgacacatagacatagaccatgactacggaccactagtatatcctagggagtgttgccgatacatagagtgagaggactgaggagtaaacaagtgcgcactctctgatcgatggancatgaatcacacttggatgtggtcgagctcgtcgtcttcgaccgcgacggactggctctgcaggcggcggagcttgaaagaggagagcttctgcgacatgtccttgtggctgggcg

SEQ ID NO: 27053 - DNA, 518 bp, Zea mays
  Clone ID: cC-zmle189109c07a1
aaagttagtttttattaaaaaaaattttacaatcctcacccctacaattaataaaaacttaacaacaaccacaaaacaaatccaaaaaaccctaatacctaaggtccaatttataaacaacaccacataccaaaaaaaaaaaaaaaaacacaaacaaaattcccaacacaaaaaatcgcccaccattaacaaaaccaaaaaaaaaaaacacctcccctttatcacaacaaaaaaaaaaagattacttattttcttcataaaaggcaaaatatctggcccaaccccaaccccttaaaaaaaaaacaatccttaatccaaaaataatatgaaaaaaagtctcccaaaacaaaaaaacccaccatataaaacaaccccaacaaaatacaacaaacttcatcctcatatcaccctcaaaaaaaccccacaacctttattcacaaccccacacctccaaaattttgcctttttgaaccacaaacacactacccaagcctcttttgttaacacccccccccccc

SEQ ID NO: 27054 - DNA, 540 bp, Zea mays
  Clone ID: cC-zmle189109c07d1
ggggttgcagtaccagggtgagtgggtgacaatgggctctaaattttacttctaaaatttaagaatccgatcggggggtggcaggttatatttatatttattattgaactaaaattaatttagggctctaacaaattgtggagaaacattttgaatcgtgatccattatcacccctaccagtaccacatacatacctcccgttgtggtgtttaaccctacgtgcagaccttgtcaccttattttggatcgattccctgttgtatgtggcttgtgctaaaacaagaaacacttgcaactttactagaaattatggtcagactctctttctctgtgttcgtttgattgttgctctggctgtctcctgctaaccaattttgtgggaaattcaacctttgaagcatcaatgtggtgaataatttctcaaaccctcagtatgttttccctaatgctggataaggcgctctcaaaaagcgaggctgtggtcagcgccttcgcctccatgacgccgatgctcatcggctccgtcgtactggactcca

SEQ ID NO: 27055 - DNA, 354 bp, Zea mays
  Clone ID: cC-zmle189109c08a1
ttttactctttaatattttcagcctttgcatggttacaagagtcaggttaaactcttttgatactgcaaacagaacagtagtgacattcgcactacatatccatgaacaagtttgctacacaacacagatactgcctcccagctcacggacagataaatttctggttttagctcagtgaattcaggccagcccaccgcttgtcgctgtcctgattatctggaacaaggatgatccaatgaccacaaaaatgaagaatccaagaactataggtccaacagggtagtcattgctctttttcaccgtggtctcaggcacagaacccctctttgtgatgttcttctggaactttgcac

SEQ ID NO: 27056 - DNA, 412 bp, Zea mays
  Clone ID: cC-zmle189109c08d1
agatcagctccggcggcacgcggatatgactacttcaaggcttttttctgacaggaagagtgcaaagttccagaggagcatcacaaagaggggttctgtgcctgagaccacggtgaaaaagagcaatgactaccctgttggacctatagttcttggattcttcatttttgtggtcattgcatcatccttgttccagataatcaggacagcgacaagcggtgggctggcctgaattcactgagctaaaaccagaaatttatctgtccgtgagctgggaggcagtatctgtgttgtgtagcaaacttgttcatggatatgtagtgcgaatgtcactactgttctgtttgcagtatcaaaagagtttaaactgatgttgtaaccatgcaaaggctgaaaattttaaagagtaaaa

SEQ ID NO: 27057 - DNA, 267 bp, Zea mays
  unsure at all n locations
  Clone ID: cC-zmle189109c09a1
gggggaacttgaggnnaacacacacaacaaaacacaaaccttcncccgctttttcccggagagcttttctttttaaaccccggggaaaccccgcacacatatgaggggggtggggggcgccacagaaaaatactatatggggggcaacacctttttgaaaagggggaaactgtgccccatatgtgggggccccccgcgcacccggatgtgtataagagagactttcttgtgtcccccaaaaacaggggggggtccctttttttgggg

SEQ ID NO: 27058 - DNA, 451 bp, Zea mays
  Clone ID: cC-zmle189109c09d1
gggaactgtgaacagaggaagcgaggtcattgctgcaggcatgattgtgttacgactggactgccttttgtggctcggacgcgacagccaccgagctctcagtcatcgaaagcgtcttcaagctgagagaagggcagcccactgcgattgtggaggacatgaggaagtctctgatagacagttacgtgtaactggggggccagcagatgtgggtcagagtttgcctttgctaaaagatgtattgcaagctatagtcgaattatcagtagcacaacataaccctctgatatgttcgtggtttatccgtggtttctgaattgtagacttctgcgttgaagctcgtgctactgtttgttttccattgtttgttcacaccaacagctaaaaaaaaaaaaaaaaaaaaaaataaataaaaattaataaaaataaaaaaaaaaaaaagggggcgccc

SEQ ID NO: 27059 - DNA, 216 bp, Zea mays
  Clone ID: cC-zmle189109c10a1
gagggggggataaaaatgaatcccttttgcattgcaactagcttttgttccacgatccatccatcacacgtgcgaggctgcgagcgagacaaatccaatcgttaacccacaccccctacccggggaatatacatagaagcctttgtttccttcctccttcttttaaggaaaccccaccccaaaaccccaaaacttagaaccaccattggaaaactt

SEQ ID NO: 27060 - DNA, 342 bp, Zea mays
  Clone ID: cC-zmle189109c10d1
gctccgcccctctccgtccaccacattttctgtgaccataccacaccgtgggggtatactcccctcacacccagcgtatgaatgaccggcgtcctgaaacgcggggcgccgatcacggtcaccggggcctccatccccagcgcactaacgcggcagcgggcccgttcaccattgctgtctgcgcacccaagccgaacctactccagacccccgtgactggcaagactctggaaggcatagactgtctacgggccgtccatcgcctatggctgtctccatgcgttcatacgaggcccatgtgatgggtcatcccaatccttatcccaagagcactggtgacct

SEQ ID NO: 27061 - DNA, 307 bp, Zea mays
  Clone ID: cC-zmle189109c11a1
acctccccaactctttgtacaaccaccttaatttctacccacccaccccaaaccaaccaccattccctaaaacaaaaacaaaaaacccccccccacacacaaaaaaaacccctcaaaaaaaaaaaccaaaaaaaccccaaaatacccaaaaaaaaaaaaaactctaacacaaaaaaaaaaacaccccattcccaacaagagaaaaaaaccaaaacaaacccttttcttaaacaaaccctaagaaaaaaaaaaaaccttcaaaaaaacccccacaaaaaaacaccaaccccccgaaaaaaccccaaaa

SEQ ID NO: 27062 - DNA, 340 bp, Zea mays
  Clone ID: cC-zmle189109c11d1
ccgaaaaaaaaaaaaaaaaaaaaaaaaaaaaaaaaaaaaaaaaaaatttatatttataaaaaaaaaaaaaaaaaaaaaaaaagaaaagagtcaatctaaaaaaaccaacccaaccccaccaaccctttcattcttatttcactccccctttttattttctcccaccctatttccaatccccctctccctcctttttccaccctcttttccctgtaaaaaccccttccctttccccacccttattcctctttccaacccatccccctttacccccctttttcccccctataataaaaattgcccttttccccaattccccttcccaaacaattagccaacc

SEQ ID NO: 27063 - DNA, 582 bp, Zea mays
  unsure at all n locations
  Clone ID: cC-zmle189109c12d1
cggggacgcgtggggtgccaagctgcctgacgggatggataagatttaatttcctgcggtcattgtcatgcgctgctgccaggaagagctctgccaacgtcgtggaagagctcagcaagcaccataacttgagacaactggaactgtattactatgctactgaaacgcctgggaatgagaagcaaatcaagttccccgctgatgggctccagactgtgaaacaactgtgcatccggtgcacatcaccatcggtgacatttgagccccgtgtactgccaaaggtccaagcacttgtcctgagattcgagaaaggccgtgctgatgacacgattggcgtgtctggcttagagcatctgtcgagcctcaagcatttggtacttgagtttgagcagcatgatgcgggtgccatggcgacagttactgcaatgaggatggctgctgaggggctccatctagatcatcaatatataactctaaaggtggatgggaaaaagtactgaggctatcttcagcaaaggcgtgtatataaacgtagaaagcactgtttacaatatatattacacggnttacaaagtagatatg

SEQ ID NO: 27064 - DNA, 505 bp, Zea mays
  Clone ID: cC-zmle189109d01a1
gaaaggaagatggcgatagatgtggggctggacctaaattcttcttgtcctgattattacagactcatagtacttatactaccctgggacgcagcccacactcatttggcccactcgcctaaagctagaactcatttggcacactctggcccatgaacacgcttgttcggacaacgcatacaactggacgcgtcttttcttctcctgcgtcttcagtatcagtagcttcactcaccggactgctaacaagctcgtccaggccaccaacctcctccagctcctttggtcccaggaagagcccatacgggacgccgccgaacttgtccatgtggtgtatcttgtgcgaggcagccactcggcggaagtagggcacgtcggcgatggggccgaccggaaagcggcggtggaccaggccgtcgtggacgaacatgtaggccatgcctgacagcgtaatccccaggcccgcgccgaagcagaggccgggcacgatgccgcggtggaagaa

SEQ ID NO: 27065 - DNA, 434 bp, Zea mays
  unsure at all n locations
  Clone ID: cC-zmle189109d01d1
cacacgtccgctcgcctacggcttcttccaccgcggcatcgtgcccggcctcttcttttgcgcgggcctggggattacgctgtgcggcgtggcctacatgttcgtccacgacggcctggtccaccgccgctttccggtcggccccatcgccgacgtgccctacttccgccgagtggctgcctcgcacaagatacaccacatggacaagttcggcggcgtcccgtatgggctcttcctgggaccaaaggagctggaggaggttggtggcctggacgagcttgttagcagtccggtgagtgaagctactgatactgaagacgcangagaagaaaagacgcgtccagttgtatgcgttgtccgaacaacgtgttcatgggccagagtgtgccaaatgagttctagctttaggcgagtgggccaaatgagtgtgggct

SEQ ID NO: 27066 - DNA, 454 bp, Zea mays
  Clone ID: cC-zmle189109d02a1
ttttacccttacttattttatttcattcctcaacatagggggcgtgttattaaagcaagaagatgctagaagtaaacagattccagcccttaatccgagtccagactccagacacacatatgaaaagctcttatgccagagttgtatgatcttgcgcaccatataaggaaccactactgttcatcatgatgctgaagaagttaccgtcccaatcgtctggtcaaatatttcgatccagtaaccatcaggatctttgatgaaagcgatgcctttgatttttccatcatcaggtttcttcacaaactcaaccccaagacgttcaaagcgttcacatgccttgtggacatcatccacagttactcctatatgaccaaaaccacgagggtctgagttcccattatggtaacctttgaattcagggtcattttccgtgccccagttgtgggtgagctca

SEQ ID NO: 27067 - DNA, 419 bp, Zea mays
  Clone ID: cC-zmle189109d03a1
cattaaaaccaaaactttggtagggtcatgcatatattatgggccataccacacatgataatgggtgtcgtcttactgcattattacagatatagatagagagggatggatagaggagatttcccaaatatcatgaatcagtagtagggcggaatggcagcggaaaccccacaggaggtggtgcggtagctgggcagctggtactggtagagtccacccatggccggcatgttctgggccatcatcatggccatggggttgagaccctgagctgccaacagctgctgctgctgctgcatcagagctggctcgtacaggctgctgctggcggcagcggcacgctcaagctgcatcatcatctgcagctgctgcgcgacggactgcacgtccatcacccacgcgtccgcggacgcgtgggt

SEQ ID NO: 27068 - DNA, 418 bp, Zea mays
  Clone ID: cC-zmle189109d03d1
cacccgtccgcggacgcgtgggtgatggacgtgcagtccgtcgcgcagcagctttagtttatgatgcagcttgagcgtgccgctgccgccagcagcagcctgtacgagccagctctgatgcagcagcagcagcagctgttggcagctcagggtctcaaccccatggccatgatgatggcccagaacatgccggccatgggtggactctaccagtaccagctgcccagctaccgcaccacctcctgtggcgtctccgctgccattccgccctactactgattcatgatatttgggaaatctcctctatccatccctctctatctatatctgtaataatgcagtaagacgacacacattatcatgtgtggtatgaccaataatatatgcatgatcataataaagttttggttttaatgaa

SEQ ID NO: 27069 - DNA, 448 bp, Zea mays
  Clone ID: cC-zmle189109d04a1
ttttattcatatgttgtcgattaaaaagcgtatacagcgggggagaacgttgctacatccaaatagcgtgtagcatgcctagcaagccaaacatattaccttacagcaagcatcccattgccgcttcacacatctttgctgccttcgatacataaacagcacaaatggattactagcagggattatagttctacaatatatggaatcacgattatcaccgctgaccagagtctactccttcgaggcgtggactgcggacacggtagagaccatggaatcgacgccgcacttgttgcgaacgttggaacccctgcatatcttgtagtatccgttctccccccagttctcgccccacgagttcttgatgaacccagaaagcttgtccttcaggcgaatgggggcgaaaccagaagcaccatatccaacaaggagaacaccatgggcaaag

SEQ ID NO: 27070 - DNA, 260 bp, Zea mays
  unsure at all n locations
  Clone ID: cC-zmle189109d06a1
ttttaaagttttttctattttgtttggtatttgtcacgggggcaagaaacataatacgtttctgaaccaaanaattggtaccctactgtgttgccagtcacttacagacgaacaacaggagattaaagataacatgtaaccagttgtattacttttcttacattccataccaagcgtcacttacagttggactactcatgcagatgacgggcaagcaggctgacaaagacgaaggccacatcctggtaacgttctctcgt

SEQ ID NO: 27071 - DNA, 243 bp, Zea mays
  Clone ID: cC-zmle189109d06d1
ggacgcgtgggcggacgcgtgggccctcacctctctttcctatttagtcttccccaaaggtcttgcacccttgggcttgattggtcaccgtgaatgatgcaatatggaaaatgtattttgatgaattgctcccgttattcactgttgatggtgatgatggcagctatgcacaaacagttgcactggacttagcgtgtctgcaagttctatcacaaagaattcatattggtaaatatgttgctg

SEQ ID NO: 27072 - DNA, 400 bp, Zea mays
  unsure at all n locations
  Clone ID: cC-zmle189109d07a1
atattaattaatcattacaaatcattttttttatttttctattcttattattacaaaaaaaaaaaaatgccaatattatccacttgtactaaaaaacaaaatttaatattaataaacaaaaaaaaacaaaaacataccccaaacacactctgcctattttttttttccccccaaaaaaaacaaaaagccaaaaaacagaacctcattatatccttttaatataaaaaaaaaattaatataagccaactaaccaaattttttcattctttcggnaataccccccaattttatgtttagagaaaaaaacaaatcctacaaattctcctcttaaaaaaaaaaatctccccattccaggttttttttttttttggaaaaattctttgaaaattttttttttccc

SEQ ID NO: 27073 - DNA, 393 bp, Zea mays
  Clone ID: cC-zmle189109d07d1
gcgggaatcgccagattggggaaaagacgcttgccgtatactttacagcatgagctttgagctttgggggggaacacgctgcttacgctcttcatgtccttgccgtcaaattgtcgaagccaaccctcgaggtccaccgtccacggcttggcgttggcgtggatctttcgtctggatgttctgggaggggagcagagacgctcgtgcctattcatggctgaagatgatgcacctggacgctaatccggcggcaggtcgaggacgaggctgagaggcaggttcatccaccgcgggacacgaaggttgctctcactgatccgagccggccgacaagacaagcagtgaagcacaactgcacaagcaaagcggtcaggaagtgaagtggatgttgag

SEQ ID NO: 27074 - DNA, 249 bp, Zea mays
  unsure at all n locations
  Clone ID: cC-zmle189109d08a1
aaaaaagggaggggggctttagtatatatagagtatcaaatcatatcatcgnggaccaattaatatatgggtacagcagatgcaatcggatcaaccaacatgcaggtggacacacgtacgttcatgagcacaaagactggcgccaaacatgccgagagagattgcaaactggagaactctgtttttttttttttcacacacaccacacaatacctatgtatggcagccagctcggcctcgcttattatt

SEQ ID NO: 27075 - DNA, 599 bp, Zea mays
  Clone ID: cC-zmle189109d08d1
cggggacgcgtgggtgattcttgaagagatcgagcttcttttgcatttacattgtcgaggatgtcttgcaactgcgcacaggctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagctagtggtggtggttgaacaataataagcgaggccgagctggctgccatacataggtattgagtggtgtgtgtgagagagagagaaacagagttcttcaccttgctatctctctctgcatgcttggcgtcagtctttgtgctcatgtacgtacgtttgtctacctgcatgttggatgatccgattgcatctgctgtaaccatatattaattggtccacgatgatatgatttgatactatatatatactaaaacccgacttcttatt

SEQ ID NO: 27076 - DNA, 276 bp, Zea mays
  Clone ID: cC-zmle189109d09a1
agcatgcatttttttttggtactgagtacgttaaggaatagtacagaaattaaggaacctatgcacagtatggcacaaatatacgcaaatacttctaaacgtgtttttgcaaggaatcctgaagaaacaacagagtttggatttgacaggattcttcagtatggcttttgcccggagaacatgataaatgacctctgaacattgctgctgtagttgacaaggccacaggatttgcacaagtcttctagctctccttcagtaaaatagttgtagctg

SEQ ID NO: 27077 - DNA, 490 bp, Zea mays
  Clone ID: cC-zmle189109d09d1
cgcgtccgcggacgcgtgggcgccacgccataccgctgtcttcctctcgcaatccaagcaagcagccccgcgatgggggtcgctgtgctgcgagtgcgagccatggagctactggcacgacccgcagcggcagcgtcgtcctcctgcgcgcgaccctcgctacagctccccgccccgggcacatcccgtccccgtcggcccgggttccctactctccgcgcagctgcggcggcagcggcggcgatcgccgcggagccgcaatcgaacgagcagcagaatatcattatggaaactgaggtgtttgcctgccctgtctgctacgagccattgatgagaaaagggccaccaggcataaacttgccagcaatttataggtcgggattcaagtgttcaaagtgcaacaagtcatttaccagcaaagacatctttctggacctcactgtaactgcagggacaaaagaatatagcgaacagaagcccgctagaactg

SEQ ID NO: 27078 - DNA, 199 bp, Zea mays
  Clone ID: cC-zmle189109d10a1
aaaaagggatccaacgctttgaaaccatcaaatttgatctccttccatatttcacaagctggggcttattcaacactccatttgcaagccgctttgataatttcattaccttcacaaacaaaaaccccccctttcttacaaacttgtacacaagcttttaaaaccacaccattaacttttggaccaagtgcattttccc

SEQ ID NO: 27079 - DNA, 527 bp, Zea mays
  Clone ID: cC-zmle189109d10d1
ggggacgcgtgggcggacgcgtgggcggacgcgtgggccctgtttttgttagaattcttaattcatgagttgtagggatgtacttatgtcaccacaaacagaaactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccacatcaatatatctgttatgtagcttatccattagacctatttgaagaaggttctgttactaacatgtttacttccattgtgggtaacgtatttggtttcaaagccttacgcgctctacgtttggaggatctacgaattccccctgcttattcaaaaactt

SEQ ID NO: 27080 - DNA, 241 bp, Zea mays
  Clone ID: cC-zmle189109d11a1
aagatggggtttttttaacttcccggcgggaaaccaaaaccctggtcattttttttttggttcggtttaaagggggggcacccaaagcgaacaaccggggccccccccctaattcaaagggggaacgggcccttacccggggaccaaacccaacgggaaccccattcttttaataaaaaaaaaaacccggccacaaaccaggatgggcccacacaattttttctttaaccggcgccccccc

SEQ ID NO: 27081 - DNA, 298 bp, Zea mays
  unsure at all n locations
  Clone ID: cC-zmle189109d11d1
ttttctcttttttttccccttattttattattttttctgttttttaaattaaaaaaaccgccccccccccccacaaaaaacaaatcctcnccatcctcacatcaaacatcccaatccataccataaaaaaaaaccaacccacacttcaacattctccacaacacacaaccaaaaaaaaaaccccaatcacctcctcccaacttaatctacccaaacaatagaattacaccctcccaacatataattcactaaaaagcctaccaaaacccaacataaaaacattttttaataacaatat

SEQ ID NO: 27082 - DNA, 510 bp, Zea mays
  Clone ID: cC-zmle189109d12d1
ggggggttctcctccccctccggttcggcttcgggttcgtgattttcttcggggttcgggttcgtgggtgagcggatcgagatggcttcgtcggatgttgagtaccgctgcttcgtcggcggcctcgcctgggccacggacgaccactccctccacaacgccttcagcacctacggcgaggtcctcgagtccaacatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggccgtgggtacggtggtggccgtggaggcggcggctactgcggtggccggcgccgtgatggcggtggcggctaccgcggtggcggcggctaccgtggcggcggcggctaccgtggtggtggcggcggctaccgccgtggcaaccgtggc

SEQ ID NO: 27083 - DNA, 286 bp, Zea mays
  Clone ID: cC-zmle189109e01a1
atgtaaatatacttttttttttggattgattttatacaaccaacaatatccaactctccacaaattcactgatcaaaaaaacacactcaggcagaacagcacacgccttgcttgaggatgccaactgcctacaacttcaaatttgtgctcaatctcaagctactgcacacttcttcagcatgtaaatcaattcctatggacgaaaatgcacaatggcacaacaattttttttctcaattgccaaacaaatcatgaatggaacctacgaattcaactgacctactca

SEQ ID NO: 27084 - DNA, 357 bp, Zea mays
  Clone ID: cC-zmle189109e01d1
tccgcccacgcgtccgaaataaaaaaaaaaaaaaaaaaaaaatttttatattaaaaaaaaaaaaaaaaaaaaaaaaaaatgtatattttaaaataaataaaatctttcttaccttaatccctccttccatatccggtccctccccactttattagcccctctttttctctccccttaattttccttttctcttgccttttttttttcaactccctttttttgtttttccttgccctttcttatcttttttgcctttgaaacccccttcctttcccccctttttttctttttgaataggcccccccttttctcccttttctttctttgcaaattccccccttcccaatctcccccccc

SEQ ID NO: 27085 - DNA, 342 bp, Zea mays
  Clone ID: cC-zmle189109e03a1
tttttcggttaacaaagcatgtaaccaaagaagaggtagggcagactaataacatattctcaagcaacagcagagtatggtaagggcacaaaaaataattcatatagtgattatagctctgctagtagactaaaaagtcaggccagaggatacaactcaaacaaaaaccttggaaggtgatcttgcgttcacatggagatgaagcgagagctgttttgccccacaggtgaggtttaaatcgtgctggcctgagccttgttgaggatgacaccttcatacttgacctggaaccacttcatggagtcctccttggtcaccctatgctgaatcccaacacgggac

SEQ ID NO: 27086 - DNA, 557 bp, Zea mays
  Clone ID: cC-zmle189109e04d1
gtgcgaaggagagtacgtggaggagcagccatggcttcatcggttgtttccgcggcgagcacattcctgggcacggcggtggcggacccggcgccacagaacgggcgcatcgtggcccggttcgggttcgggttgggcggcaaggcgaagcctgctccgaagaaggtggcgaagacatcgacctcctctgaccggccgctgtggttccccggcgccgtggcgcccgactatctggacggctcgctggtcggcgactacgggttcgacccgttcggtctcgggaagcccgtggagtacctgcagttcgagttggactcgctggaccagaacctggccaagaatgaggccggcggcatcatcggcacccggttcgagtcctccgaagtcaagtccaccccgttgcagccctacagcgaggtgttcggccttcagcggttccgcgagtgcgagctcatccacggccgctgggccatgctcgccaccctcggcgccctcttcgtcgagtggctcaccggcgtcacctggcaggacggccgcaaggtggagctggtggacgg

SEQ ID NO: 27087 - DNA, 332 bp, Zea mays
  Clone ID: cC-zmle189109e05a1
attcagggccacaaccacattaaaaaccaaacccatgaacaaaaaactttatcaactcaccatgaactacacatccacatgttctcctcctttttcaactaaaaactattatccactctcaatactaaaaaaaaactctccatacaaggaaaatcttcgttctcatccttaataacaaataacaaaatcgcgctaaaaacatttcacgccaggaataactaagacacttttttcccacaatcaaacaacacatggcctagaaaaaaggtgttgacccctttcaatctcctttaatgttatgctattaacaaaactccacaggcaacaaaatt

SEQ ID NO: 27088 - DNA, 462 bp, Zea mays
  Clone ID: cC-zmle189109e05d1
tgcgggaagttcttccgttggatttcaccactaactgtggtaatatctttttctactgctgggataccgcaggggaagagaagtttggtggcctcagggatggatactatatccatggccagtgtgcgatcatcatgtttgatgtaacttcaaggcttacttacaagaatgttcctacgtggcatagggacctgtgcagggtctgtgaaaacatccccattgtcctctgcggtaataaggttgatgtgaagaacaggcaggtcaaagccaagcaggttactttccacaggaagaagaatctgcagtactatgaaatttctgccaagagcaactacaactttgagaaagctttcctgtaccttgcaaggaagctggctggtgatccgaaccttcacttctgtgaagctgttgctcttaagcctccggaagttaccatcgacatggctatgcagcagcagcatg

SEQ ID NO: 27089 - DNA, 104 bp, Zea mays
  Clone ID: cC-zmle189109e06a1
gagtaaggttctatttatatcactttacccgcccaaaaaaataattacccttttgtaatttccaacacttacaatcctacaacaggagaaccaatataacaaaa

SEQ ID NO: 27090 - DNA, 470 bp, Zea mays
  unsure at all n locations
  Clone ID: cC-zmle189109e06d1
tgcgagcaggacaagacgctggccacctacgggatcaacgccttttgttctcacctcggctgcgtcgtgccgtggaacggcgccgagaacaagttcatctgcccatgccacggatcccagtacaacaaccagggcaaggtggtccgtggaccggcgcctctgtcgctggccctggttcacgccgacgtcgacgacggcaaggtcctcttcgtcccgtgggtggagaccgacttcaggaccggcgaggacccgtggtggaaggcatgaggatgatccgaaaccagcggtgctcagtgctcacacatgagacctacgtatgcctccgttccttgtgatgaggaaatatgcttgcgttcgttctccgtgggcgttgttcctacaaattcacttgctttctgtctctctctctatatacacactgtataaaacaagaacagctgnttatcatctcttcttatataaccttttga

SEQ ID NO: 27091 - DNA, 334 bp, Zea mays
  Clone ID: cC-zmle189109e07a1
ttttgtacatcacgaacaccatttttattccttcggggggggcacacagcggcacgctcttatttccggcgtttccaccatcagatggtctctgcgccccagcaccgggcgcatggctcacgcatgcctttggcaatatacacatagaccacgcagtagaataaaaaaagagaaaggaaaaccttgccgaacttaacatcattgtccaagaaaacacggcctatttcgtcatcatcattgttccgagttattggatttcaaaggcggacttcactgactggcggcatcggaggggagtcgtcgctgcacacgccgtcctagtagcctccctgga

SEQ ID NO: 27092 - DNA, 585 bp, Zea mays
  unsure at all n locations
  Clone ID: cC-zmle189109e07d1
ggggggggttttaatgtataaagggaatagtgctgatggatcttttttttggtgcaccacagaggatagcgtcgatgagtctgtcaaatctatgactcagcacaacgtgggagctttggtggttgtcaaacctggacagaatacatcaatcgctggcattgtcactgagagagattatctccggaaaatcatagtgcagggaaggtcttccaagtcaactaaggttggcgacatcatgactgaagagaacaaactgatcacagtgaatcccgacaccaaggtcctgcaggcaatgcacctcatgacagaaaaccgcgtcagacacatcccggtgatcgacggcacggggatgctggggatggtctccatcggcgacgtcgtgcgcgcggtggtggccgagcacagggaggagctgaaccggctcaatgactacatccagggaggctactaggacggcgtgtgcagcgacgaccccctacgatcccgcaatcagtgaagtccgcctttgaaatccaataacttcgaacaatgatgatgacgaaatngccgtgttttcttggacatgatttaatttcgcaaagtttt

SEQ ID NO: 27093 - DNA, 258 bp, Zea mays
  Clone ID: cC-zmle189109e08a1
ttttgtattacgcaagaacagtgtgtgctatatatggaggagtcaatcatccatcccaattaccaatcgagttccagctgaacttacacactgcctgatgtaatcccgtatgccagccacctagactacaccctgcttctcggatcagggataggaaagaaacgcctgcagggggggcagatctaatgctcaaattggatacgatacacaggaggtcgttgcgggaatcgccagcaccctgaagcgagaaaagacaat

SEQ ID NO: 27094 - DNA, 552 bp, Zea mays
  unsure at all n locations
  Clone ID: cC-zmle189109e08d1
gtgcgattgactgtgataatatcagtgcacgttgcatgcttactatttttaccttgtttgccacaaagacagagggatcgctgttacgcatgttaaagggttcacctgatgtttacttaagtggtccaataaagaagtatataacagacaggggtggtaggtttcacttaaggtggggatgcagagaggttctctatgagaaatcacctgatggagagacctatgttaagggccttctactcaccaaggctacaagtagagagataatcaaagctgatgcatacgtcgcagcctgtgatgttccgggtatcaaaagattacttccatcanaatggagggaatgggaaatgtttgacaatatctacaagttagatggtgtccctgttgtcactgtccagctccgctacaacggatgggtcactgaacttcaagatttggagaaatcaagacaactgcaaagggcggntgggttggataaccttttgtacacggcggatgcagacttttcctgtttttcggaccttgctctctcatctnctgctgattactaca

SEQ ID NO: 27095 - DNA, 283 bp, Zea mays
  unsure at all n locations
  Clone ID: cC-zmle189109e09a1
aagcatccattacatagaccgccctcccttttttttttttttatatttttttnnnnatatnacaaaccccctttgttggtttttttttttaattactactacaatccatctaaccccccaaacccaaaaatttaaaaccgtttcatgattcttttatactcgttcattgatacaaaaaaaatgcaaaacccctttttctaccatttatatcacaaccccccccaactaaaacatataaaactacacatccatgcctatgtaaataaaaaaaatatatatagat

SEQ ID NO: 27096 - DNA, 537 bp, Zea mays
  Clone ID: cC-zmle189109e09d1
ggcggaagcaagcaagcagcgagtacatacatactaggcagccttgcttccatggcgcccaccgtgatgatgggctcggcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccacgtgtacaaggagctgcaggaggccatcaaatcctacccggacgcctttcaccgcgtcatcggcttcgacaacatcaagcagacgcagtgcgtcagcttcatc

SEQ ID NO: 27097 - DNA, 386 bp, Zea mays
  unsure at all n locations
  Clone ID: cC-zmle189109e10d1
ctataccaacggtcncacatccaccaccgccttttttctctcgccacacgcaaccccctcttccgccagcgttactacaaaaccagcacacacaacccatactacatcaacagcacggaacccccctgcgcagcgctcgacaacatcatgttacccctattctcgcacacgacgatctctttcccataatcacaagacctcataacgacctcatctacacacttatacattgactacaaccatcaactaccgcgcgaaaagctacacatatcctcaacccaaaaaataccagaaaacaagaacaccctccaccagatcatatattactcacatatacaagcatgatccgacaaataatgctaaaccgtgcctacaacgttaaccgt

SEQ ID NO: 27098 - DNA, 258 bp, Zea mays
  Clone ID: cC-zmle189109e11a1
gggggggggtttacggattttaaccggaaacctttttgggaaaacaaaacaaacaaatttttttcgaaaagattcgaactggttaaaaaacccaaaatgcatttttttggattggggttttttattaactaatggaaaaaacagttaattcgccataatttttttttagggaaaaaaaaaaaaaagggcccctgggccccgaatgattatttggcttatgaactttttaagaacaataccaaaggggttaaaaagagg

SEQ ID NO: 27099 - DNA, 601 bp, Zea mays
  Clone ID: cC-zmle189109e11d1
cgagcaactcgtttacacgtgcgccaatgcttttcaagggttctttttatgcaatgaacataattgacctgggtggggatcaatgtcttacttcatggattcgaaagaatagaagaacagtagcctgacaatgacaaacagctggttcagtccgattcaggtgccaattaaggtgcttactcaaatagaactcctattgatttgctagttgataaggtaaatatccagcccactcaatgctaggcgtaatgaggataagggcctacaaaaaacttcttttcgttctatgaactttaaggcgtatgaagtctcatagtaaactcttgcagcggaacgatagagactccatttcacttaggttgatttaatttaggccggaggcagacctaagtcaaggtaatcctcctttgaaacactttggtattgttcctagatagatcataagacaaataatcaatcagagcacagggagccatcttattatctttccctaaagaaaaactatggcgaattaactgatctttacattagttgatgaaagagcccaatgcagaaaaatgcatgtttggtctttgaaacagttcgaatcatttcgataata

SEQ ID NO: 27100 - DNA, 364 bp, Zea mays
  Clone ID: cC-zmle189109e12d1
atcctcctatcaaatccttctcaatttcttaccatttattttttcgatagcacccatcgcgtactgtggggtgctgaatcagaatcccgcctaggccaaccccctgactgacaagctcgtgactgctctcacgctgactaatcccaaggccttatagctcctcccattggaccactccccccttatctacacccgcatggccatcatggtgaactccatatctactacatccctggagacctacaagatcttcatcttcaatgtgctgaaccatttagcaccccgtcattgttatttcgatcaatgtcacttccatcatgaactcatttatctacgtcgttttcctcatactaaccgccgagtc

SEQ ID NO: 27101 - DNA, 266 bp, Zea mays
  Clone ID: cC-zmle189109f01a1
ggatagatcacaaggggtaggattattaccaaccggtacatacaatacaaggaatacctttgtatgaacaaggaactatgtcagtagcagcagcaacacctgtaggtgccacataaacggttaaacctcaaccgagttccttttttagattttcaagagcggcctttattttagaaagaccatcatcaaagctgataggcgacgtggtgcaatccttagcgcttttagccggctgaccaaactggaggggtgggtcatattcagag

SEQ ID NO: 27102 - DNA, 91 bp, Zea mays
  Clone ID: cC-zmle189109f02a1
ctgtccgtcggctttgttttcacacgccggtcgctgtacatatggcagggcaaaaacaccgcggacgaataactcctaactgactaaaaga

SEQ ID NO: 27103 - DNA, 362 bp, Zea mays
  Clone ID: cC-zmle189109f02d1
acttctatataacttatattatattttttttttttcctaagtaaaaattaactcaacttcccattacatttcctctccactatacttcatctcaaaacaataaaccacataccaatttttaccataaaccttcccatcccctacttaaaacattccttaaaaaccaacacccaactaaaaatacctaccctactacaaacaaatttaattccacaagaactactaccacatacccaaacaatacctttaaaaaaaacctcaaagattcactaatttataatcacaaaacatccttcctcaattcctttattcataaaaataacctcaaatataaatctacaccaattacgataaccctttta

SEQ ID NO: 27104 - DNA, 352 bp, Zea mays
  Clone ID: cC-zmle189109f03a1
acatcgaccgccctccctttttttttttattttttctattaacacaatctaacccttttaccggtcagcaacttatacatatcctacaacccaccaaacatcaataaattttttaataaattaccacatctccataaacaccaccacaaatcttatccccccctccacctaacatctatctattcataactacattaactagctcttaaacaaaaccctcaaaacaagacatccatcacatacgacgctatcaacacaattttacccttgccattctcccctcaacccgttattcaaccctttaattcctcacccttacctgcaatcgtaccaactttccctatatatattc

SEQ ID NO: 27105 - DNA, 272 bp, Zea mays
  Clone ID: cC-zmle189109f04a1
acaccagaaaacatcttcttgttttggacggcacacggggagcacgaagagacgacgccaacgcgacgacagacgcacacgacaagcgcggccacgcacgcacaggcatggccacggatgccaaccacacaaacgaccgccgccggaaagcctacagcagcggacgactaagaaaaacaacatgggacacactaagttgacgaatttgcctacttgtacttgatggcagctctagcgatggcactgcagtaagccttcgtcggacgcgtggg

SEQ ID NO: 27106 - DNA, 142 bp, Zea mays
  Clone ID: cC-zmle189109f05a1
tttttgattaaatcgctctccctgctggtcacttggtcaggagatggcagagaaagtctatatttcattccaccaaatttcacagtggtcaaaagcgttatagtgaagagatgacaaacacctgcgttcttgtttcatgcag

SEQ ID NO: 27107 - DNA, 270 bp, Zea mays
  Clone ID: cC-zmle189109f06a1
aaaaggatctggagacaattttagggcgagggataataacataaaaactattttttcgcactgcatccgctacagttgagtgcatacactatacaaaatacatatgtgagcaatatgacctatacccggcaaaaagttactttccctacctagacccctagagccctagactacagacacgactagcgagcgagtgatgtcgacacaacagattcttacgaatctttcaaataatgtcagcgtgcacgtaatccaccaatacaaaaattt

SEQ ID NO: 27108 - DNA, 423 bp, Zea mays
  Clone ID: cC-zmle189109f06d1
cgtgcgctatggttatgatacgttgatggagaacgtctctgatccttcttatatagaatttgctcaccacaaggttggctgacgaagagatagagccaggcctttgacattcaggatggaatcaagtggtgcctggggttactcaggagcaaattctggtaatcctcgcattactgcaacttttgaggccccttgttatgcattaaacaaaatagagatagacacaaagttacccatttttggcgaccagaaatgggtcatatggatttgctctttcaacattccatggccccaggaagactccgtctatggtctggagcgctcgaaactttttccagttcacaatgccaggaaaagcattgtggcagcttgttcctcgatggtatgaacattggacttcaaatttggtctatgatggcgata

SEQ ID NO: 27109 - DNA, 387 bp, Zea mays
  unsure at all n locations
  Clone ID: cC-zmle189109f07d1
acccctccaaaaccccaacgtgnctgttaaaatttaataaacacactccacccaaccacaacataactgacaacctcacacctacttacccanaaacaacttattcttcaaatccctccctttaccncaattactccattctcctttatactcaaactctccntccattatatccagtgtacactatttcaacattacgcataaattctacttaatcttaaaacttatccaaccaatacttatactacaatctgacttttaaataattcctataacctatgacccacttggaatctatttcttcttcaacatttctagcttcactcaaaattaacgcatcagacatcattttctttacctttttttaccaacttcaattctcattac

SEQ ID NO: 27110 - DNA, 267 bp, Zea mays
  Clone ID: cC-zmle189109f08a1
attattttttatatattttattccactattttattttttcaatcgaatgatttttttttatttactcctccacatacaaacaatgacccaaaaaaaccatgaatacaccagaaccacggacacgaacacaaaaaaaaaatccaacaacaacagcaaaactcactcaatcaatagagaacttaccccccgaatcaaacctaaccacccaaactatccccttacgttcataggctttaatttcttcacgctcttcatccacatccctgc

SEQ ID NO: 27111 - DNA, 337 bp, Zea mays
  Clone ID: cC-zmle189109f09a1
tattttttttttctctttttttttttttttcctatgggttggtttttttaattttttactttaactttaatcctatatatctattttatcaattctcaacctactttacaacaaacaacccccaaaacagagtcaccaacaaaaccacaatctgactgaatttatttaataacacccaaccatatcagccccatgcctatcaaactgcacaagcatccttatgaaaatcttatactcaaaacactgcctctataaaaccttacccatctcagccacaaaaaaattatttattttaggaactaaacactccgagcagacagaaaaaaaaacctaaaaa

SEQ ID NO: 27112 - DNA, 431 bp, Zea mays
  Clone ID: cC-zmle189109f09d1
ccacccgtccgcccacccattcccccactcgtccacccacgcgtccttttttttttataaatacaaacaaacccctataatgaatagctaaaataaaaaacaaaaacaaaaaattcacaaacaataatcaccctaaacaaaactattactccgcacagcatcttgttaacttcgccccccccttttaagatctccttttcacaatccccacccttgtggggaactactttttttattattcccctaaaaatcccttcattgccccctttttacctacagatgttctggtacaccctattcctccccacattaaaccccttccttacatttctctttttcatatattcaagcatttgctaataaacccccttaaactcctcctcccacctttcccccttttcaacctgaacacatcccccccctacatcatg

SEQ ID NO: 27113 - DNA, 203 bp, Zea mays
  Clone ID: cC-zmle189109f10a1
ccttccctatttcaataatacattcaatttaaaatttacacttacacccatggtcacactggcccccacggaaaccagaaacaataccttactaatacaccaaaaaaaactacaataccaaggcttcattacaataatacaacacaatacattcttacgacaagtcaaaaccccccacattttccacccaaacaaaagcacct

SEQ ID NO: 27114 - DNA, 552 bp, Zea mays
  Clone ID: cC-zmle189109f10d1
cgggcagcctagcaattagctcatcgactccagattggagtactttatcaccatgaaggtgctgatcgttgcgctgggtctcctggcgctcgctgcgagcgccccctccagtacaagcggcggctgtggctgccagacaccaccgtttcatctaccgcctccgttctatatgccgcctccgttctatctgccgccgcagcagcagccgcagccatggcaataccccactcaaccaccgcagctaagcccgtgccagcagttcggatcctgcggcgtcggcagcgtcggcagcccgttcctgggccagtgcgtcaagttcctgaggcaccactgcagcccggcggcgacgccctacggctcgccacagtgccaggcgctgcagcagcagtgctgccaccagatcacgcaggtggagccgctgcaccggtaccaggcgacatacggtgtggtcctgcagtccttcctgcagcagcagccgcagggcgagctcgcggcgctgatggcggcccaggtagcgcagcagctgacggcgatgtgcggcctgcagctgca

SEQ ID NO: 27115 - DNA, 256 bp, Zea mays
  Clone ID: cC-zmle189109f11a1
aacgatgatgaactggattccagtgacagtttttttcaccaaccttgcaaatattttccaagtatcaactgggaaccgacaagcagcggaaaagcaggggaggggggcaaaaaggctttaatttaagatcacatgatggaccgacagccattacgagacaagtctcaacaaaacaagacccaggccccagcacagctaatgacacacctacgccaatatgaacagggcagataagttgaacgccggtaaccattac

SEQ ID NO: 27116 - DNA, 545 bp, Zea mays
  Clone ID: cC-zmle189109f11d1
cggactagttctacatcacgatgctctgtacaagggatactttatttccgccgagcttgatcccagtaatgggaggggcggcagaatattgaggtcacaaaaaagaaactggctgaacaacgagtcccaccagaagagcagatcacacatgcaggccaagctcaaggaccacatccaatatttacaagtggtggtgttcctttcaatctgtttccaccaggtagttctccagatcaagaattcttcgctggctggtcgtccgatgttggtgcaccaccaccaggacattcgataagtatacatctgaatgatatttttggccaaacaaatgtcaatgctagcggtcaacgatcaagtcaaacagggaattcaaataaccatactccatctgcttctttctcaactggtgctgctgatcctactccctttgccttctcgggctcaggaaatgaatgaacgcaggcacgccaagcttctaatggacttgaaggggaacatggtgaaccaggcatacacaaggatgatgacgtccatataaatttggc

SEQ ID NO: 27117 - DNA, 383 bp, Zea mays
  Clone ID: cC-zmle189109f12d1
cccgtacacggagcagtgtacgctcgagcggagggcttttctttgcgctggcggagttccgggcgagggggagcgaggtcgtgggcaacatcgacaggcggaacacggaccctgcgctgaagaaccggacggggcatgtggaggtgccctatacgctgctcaagccgacggcacagcccggactggtgctccgtggcatacccaacagcatcaccgtttgagcaacatagcgccgtcggcagctgtcagctgtgtacagtacaaaataataaggtggtcgagtttggcgctatctccaccacataaacgtgaaaatgttttcctttgaattatatggacatgcatggcctcaatccgtaagcctggccccactttccgctttt

SEQ ID NO: 27118 - DNA, 178 bp, Zea mays
  Clone ID: cC-zmle189109g02a1
ccatcgaacgcataccatcaatcgagagatttttatatatggactactctacataaaaacaataaacccacgacgttatcacgattaccccacttatacccacactaactaatcattttcacatcagcaatcattttatctttctcactatataatcaacaactactactcacaatca

SEQ ID NO: 27119 - DNA, 364 bp, Zea mays
  unsure at all n locations
  Clone ID: cC-zmle189109g03a1
aggaaaaaaaaagggatggttgaggatttggtaagaaactaataatgagcacaagctattacaattcaggatgaatttcatgtttatttcaaccaatacacaataagaaacaaacaagcaacaatatgtcgatattcatataaaggggtgcattaggccttagcctacactaccttgcaaaaggatgtgaaatggtgcccgaggtgtaaaagtagcctgagcttgcatccaagaaaaaagttggttttgcagcagcnggttgagaactagtatcatcatcattgagcattaccatgacatctgacattgtagggccggtccattggattctgttgaaggcaccacaagccaatgttaacacatt

SEQ ID NO: 27120 - DNA, 186 bp, Zea mays
  Clone ID: cC-zmle189109g04a1
aagagcgccttccccccccccaaaaaacccaacctacaccaccaaaagcaccccctttccctaaaacacaacccaaccgaccttgatacacaaacagccaaaatgcataccaacagaaaatagcatccacttcaccccccccaaaaaaaaaaaacccgagccctcaaactctaacccccggcggcc

SEQ ID NO: 27121 - DNA, 238 bp, Zea mays
  Clone ID: cC-zmle189109g05a1
gggagtgtgaagactagcatcaggactaaaatattattgaatcagggacacacgttcggcattcaccaaaacaccatacctggcccatgggtcatattataaatatcatggcttcctggaatgggaatggatcggagtacctgcttaaccataatcagctcacacttttactttcggaggggcgggggcttcccgggggaacgccgggcaaataattaaaagctgcaatttttaacca

SEQ ID NO: 27122 - DNA, 125 bp, Zea mays
  Clone ID: cC-zmle189109g06a1
gggggaaaaaaaaaaaactccaccgttattaaataccatagcgtcaactgattcggcctggagggagtaccacgaattattacattttcttcgatgtcccattgcacgcttagatttgccaaaag

SEQ ID NO: 27123 - DNA, 310 bp, Zea mays
  Clone ID: cC-zmle189109g07d1
gcaaaacaaccatctctaaattttattttaaaaaagaaaaaacccaacacgaggtcagcattttttaaatatatttattcattaactaaaattaatttaaccctctaacaaaattttacacaaacattttgaattcggatccattatcacccctaccattaccacatacatacctcccgatgtggtgtttaaccctacgtgcataccttgtcaccttattttgcatccattccctgttgtatgtggcttgtgctaaaacaaaaaacacttgcaactttactagaaattatggtcagactctctttctctg

SEQ ID NO: 27124 - DNA, 346 bp, Zea mays
  unsure at all n locations
  Clone ID: cC-zmle189109g08a1
tttttgcctgccaacaagttccttttcaagtcgtggcagggtgcctggaataccaggagcagtaacctgttttcatatgtacacccaatcctggaatagctgtgctgatttactggtatactaaatggaccaaaaaggtagtttaagcctttaaggaaatgtcactctgcaatcctcacggctttcttccttaaccaatggttaagtgagttgatagggatttttatcattccctgtggtctcctagtaaattctttggatatttgctctaaattacttctagatttagtcngngcttttcgtttttgatgaaacgggagggcagcttccaggttcaatcaaaact

SEQ ID NO: 27125 - DNA, 486 bp, Zea mays
  unsure at all n locations
  Clone ID: cC-zmle189109g08d1
tgcgggcactaaggagaatgcagcgagttgggatgagacttattgtttttgcatatactgttgctattaaggcggggggggaaaacaaagatttgaagttagcactgcacttatttgaagaaatgaaaacacaccaactgaagcccaatttggtgacgtacaaaactctcctgacagcacgcatcaattatggatcactacaggaggtccaacagtgtttagcgatatatcaggagatgaggaaagcagggtttcaggcaaatgattattatctcaaggaattaatagtggaatggtgtgaaggagttctgtctagtcgcagtgataatcaagatttttacaatttggatctacaacctgagaggaaagaatcgttcaacctgtttcttgagaaaagtcctaacagtcttgcaaaaagatactgatcagaaccaaattgtcgatgttcgtggcctttcaaaggttgaagctcgaattggcgntctc

SEQ ID NO: 27126 - DNA, 149 bp, Zea mays
  Clone ID: cC-zmle189109g09d1
tcaaatataccaatatcatccacaacataccatttatttaacttatcctccttctcaatttaactaccattaaataaactccccagcataaacttccattacaccaacactcattaaatttaaaatcaacaatatttaccacaaaacat

SEQ ID NO: 27127 - DNA, 280 bp, Zea mays
  Clone ID: cC-zmle189109g10a1
caccacagggaaaaatgggacccaaactgtcaaacaaaacattttatacaaatccccggggggttttgttagttccaaatttccgaattccagtcacttcacccacaggagggaggaaaaaaaagcttatttcaccactcatttaacaaaacacgggggcaagcctatccccaaaagtccatgtgtggaggaaaaaaccttaaccttgcagggctacaccaagggcccaaacaaaataacacccaaaggtggcaaaaccttagttgcaacaacaacagca

SEQ ID NO: 27128 - DNA, 375 bp, Zea mays
  Clone ID: cC-zmle189109g10d1
ggttcctcatgcacaaggaacttgactaccttgttggagctgttttcaacccaaagaagccatttgccgctggtggtggtggttccaaggtctcaagtaacattggcgtcattgagtcgttgctggcgaaggtcgatatcctcatccttggtggtggtatcatctacacattttacaaggcacaaggatattctgttggaaaatctctcgtggaagaggataaacttgagctcgcaacttctcttattgagaaggcgaaggcaaagggcgtttctcttttgcttcccactgatattgcagtagcggacaagtttgcagcttatgcttaaagcaagattgtccctgccactgctatccctgatgactgaatgggtc

SEQ ID NO: 27129 - DNA, 69 bp, Zea mays
  Clone ID: cC-zmle189109g11d1
aaaaaaaaaaaaaaaaaaaacaaaaaaaaaaaaaaaaaaatttttttttaaaaacaacaacaacaaaaa

SEQ ID NO: 27130 - DNA, 256 bp, Zea mays
  Clone ID: cC-zmle189109h01a1
ttttacagaaaaatgctttaatgctcaaaaaataagagagagccatataagttaatgcatacatgaccaaagaactacaagcccacctcatgctttgtaacattccaagaactaaggggccttacataatctgggcccgaataaaaaaggtttattccaaagggcttgttttcacttcttaaacaatgaagggtttaacttactttgggcctaagttctaaaaaaggcgtacgactttttaaagaactttttgcca

SEQ ID NO: 27131 - DNA, 394 bp, Zea mays
  Clone ID: cC-zmle189109h01d1
ggggggaaccacccgtgcgggctatggcagtggcttccttcgtcgccgcttcgcaccaccacttcagtcacctggccgccggcgtccccttctgcgcgcgagtaggcaggagcttaggccgcagtggcgtcaccatctacatgagagcccagaagaagcgcaatagtgaatctgggagcagtagcggaggtggggacgtgcgggccagcagcgggcggcgagtgtggcgtcgtcggaaactgaccaaagaggatgacatgttgcgttacaagttggatcgtatcccttttctagaggagaaggtgagaaaagtaagggagaatgggaagatcatatgcctggacattaatcagctgatgttatctcaagagaataaatttgcattcaccatgga

SEQ ID NO: 27132 - DNA, 432 bp, Zea mays
  Clone ID: cC-zmle189109h02a1
ttttaacattatatgacacattttgtatataaatgagtcagggtattatatgttctcgttgcaacgcaagggtactcatatagtcttgaaataagttccaaaaatattacgatcaaccatatcgatcaaggatttgaaccagttgacactaaagaaacccaagcaactgacccttcaaagaggattcctgacgcccactcagataaccgatgggtcattctattagacttgcatcaaagaggattccctgaaatccatgttataaacattttttggcattccaaggtcttatacaacggctcaacatgtccagcacccttcacagtggcaaatgttaggccgctcgcataactccttgtgaatccagcaacttggcctccaacgtaccatggtcgccaatcatcaacgatgtcaagttgaggtatctaatca

SEQ ID NO: 27133 - DNA, 447 bp, Zea mays
  Clone ID: cC-zmle189109h03a1
ccatccactagaccgccctcccttttttttttttttttttatatttttttttttttttttttaaaaaggcaagattttttttaaaaaacctgacccaacacaccccaaatcaaaaatcaacaattcaaaacacaaaacttcatacattctatgaagtaatatcccacctatatttatttccaccaatccaaatttcaaatacaaccctgtaaaacaaaaacatcaccaccctttataaaaaaaattaatggctccctaactttttaattattttgttttcaagattaataaccccacccccttcaaattcaaagcctttaaaaaccttaaacccaacactcctgcaaatgccccacattttaaaaattactgcccgtgtgtggctcgctccttttaactacttcccacaatttccccaaaagaccctccaccccaccaattacattc

SEQ ID NO: 27134 - DNA, 317 bp, Zea mays
  Clone ID: cC-zmle189109h04a1
aaattcccattctcccttccacttttaaaaacccctcttcctacaccgtcctgcggcgcccacaaaaacccacatctttaaaaaaaaaacaaatcaccccccttcaaaaaccacccagacgaaactcctcccccccccttaaaaaaaaaccaaaaaaaatccacccccgaccctaaaaacctgaaaaaaaaaattaattcgtccgtttttcataccaaaacaaaaaaccccccccaaaaaaaaaccacccccagccccggcggtcgtggattaattcccccccctttaactcccacaaaaacaaccccccccccccc

SEQ ID NO: 27135 - DNA, 201 bp, Zea mays
  Clone ID: cC-zmle189109h05a1
atgggggggccatcggttcgaaaccatcaaattggatctccttgcatctttcacaagctgcggctggttcagcactccgtttgcacgctgctttgataatttcattaccttcacgagcaagatcgagcccttcgttacgagctggtacacaggcttctaaagccacacgattagctgctgcaccaggtgcatttccccgag

SEQ ID NO: 27136 - DNA, 288 bp, Zea mays
  Clone ID: cC-zmle189109h05d1
gtgcggcgtattacaattcggtggaggaactttaggacatcctttttgtttatgcacctggcgcaccagctaatcgggggggtttagaagcctgtgtacaaactcataacaaagggcgcgatcttgctcgcgaaggtaatgaaattatcaaagcacctcgcaaatggagtgctgaactagccgcagcttgctaaatatggaacgacatcaaatttgatggtttcaaagctatggataccatataaaatgaatcaagaggcgcaaaccgtacctatctctgaaagcagg

SEQ ID NO: 27137 - DNA, 237 bp, Zea mays
  Clone ID: cC-zmle189109h06a1
ccgccctccctttttttttttttttttttttttttttttttttttaaacacttgcggacagaattaatataaatagttgccttgatcaacaaacaccaaaacacttgcaatgtcgctgcacttcttaaccgtagaacaatccacaaaacaccaaaacatgctcccaaatcatcctgctacaaaacttggtccagcaaggtaacaaacaaacttttcacaattagatgattttcacaa

SEQ ID NO: 27138 - DNA, 264 bp, Zea mays
  Clone ID: cC-zmle189109h07a1
aacaccatggtaaacaagtccatccagggggctgggatattaattaattattacaaaacagcatgcagattgtacgatgcttattattacaatatgtataatatgccaagattttccacttggacttgacaacaagagtgaatataaagaggcaggaaattacatatgcatagggaaaacagacgctgccagttcggcatttccatccaaaactgacaaaacgccaccatccggaagctgattattgcggtgcactctgcaggt

SEQ ID NO: 27139 - DNA, 459 bp, Zea mays
  Clone ID: cC-zmle189109h07d1
tgcgggacctcctgcgccaggtgttcacgttcgggctctcccttttttatgctggacatccggcaggagtcggggcggcgcaccgacgtgatcgacgccatcaccacgcacctcggcatcgggtcgtaccgcgagtggtccgaggacaagaggcaggagtggctgctgtcggagctgcgaggcaagcgcccgctgctgcccccggaccttccccagaccgacgagatcgccgacgtcatcggcgcgttccacgtcctcgcggagctcccgcccgacagcttcggcccctacatcatctccatggcgacggccccctcggacgtgctcgccgtagagctcctgcagcgcgagtgcggcgtgcgccagccgctgcccgtggtgccgctgttcgagaggctggccgacctgcagtcggcgcccgcgtccgtggagcgcctctacttcgtggactggtacatg

SEQ ID NO: 27140 - DNA, 245 bp, Zea mays
  Clone ID: cC-zmle189109h08a1
tcctctagagggcccccctttttttttttttttttttttttttaacaccatggtaaacaagtcgagccagtgggctgggatattaattaattattacaaaacaccatgcagattgcacgatgcttattattacaatatgtataatatgccaagattttccacttggacttgacaacaagagtgaatataaagaggcaggaaattacatatgcatagggaaaacagacactgccactttggcattt

SEQ ID NO: 27141 - DNA, 435 bp, Zea mays
  Clone ID: cC-zmle189109h09d1
gggacgcgtgggccgacgcgtggacggacgcgtgggtatctgcttcttgttccatagtttttcttgcatggtacgtctcaccgatgaataaaatgtatgtatcagactaaaaaaaaaaaaaaaaaaaaacatcgacataattataagaacaaaccatactaaatctaccaatcccaagcacaatctcctaccataccaaccggattccctactatccgcgcaaatctagaaaaacaattccaccacataaacgaatcctgaatccaacttaatggacattatcctaattgccactacgccgacggtcaacaactgtataaaactagccaacaatgacatatagcccgcctaccataaacctaacatccacctaaaaaacctcatttaacactcaatataacaccgagggctccatgagattgacatcatttccgg

SEQ ID NO: 27142 - DNA, 565 bp, Zea mays
  unsure at all n locations
  Clone ID: cC-zmle189109h10d1
gcgagcagcagaggcagcgacacgatcgcgagcgcacgcacttaatttcgttgtcggaagctcaagttagaggggcgccagtgactgatcgatggcggcccangctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctacggcgaggtgatcaacggccgctacgccatgctaggcgcggtgggcgccatcgccccggagatcttcggcaagatgggcatcatccccccggagaccgcgctccgtggttcaagacgggcgtcatcccgcccgcgggcacctacaactactgggccgacttctacaccttttcgtttcaacatggcgctatgggcttgc

SEQ ID NO: 27143 - DNA, 491 bp, Zea mays
  Clone ID: cC-zmle189109h11d1
cggctgcggaagaagtttctaacgggctacatcccaccactttacttatgtcggcagcggcgcgagtgctgcggaggggggtgaccttcgtgacgggcaacgccaagaagctggaggaggtccgcgccatcctcgggtcttccgtcccattccagtcgctcaagctcgacctgcctgaactgcaaggggagccagagtacatatccaaagagaaagcacgaatcgctgcatctcaggtgaatgggcctgtactggtggaggacacctgcctatgttttaatgcgctcaaaggcctaccaggaccctacataaagtggtttcttgagaagattgggcatgaaggtttaaataatctgttaaaagcttatgaagataaatcagcgtttgctatgtgcatcttctttcttgctcttggacctggagaggaaccaatcacatttgttggcaaaactgcgggaaagatcgtgcctgctagaggcccctatgatttt

SEQ ID NO: 27144 - DNA, 451 bp, Zea mays
  Clone ID: cC-zmle189109h12d1
cggcacgcgtccgaaacgtcctcaacggtggctcgcacgtctttttccgccgctttccaagattcagggctgtccttgtgaggcccctaccttctaccaggccatgcgccagggagccgaagtctaccagaagctcaaggcccttgccaagaagacctacggacagtccgctggaaacgtctttgacgagggtggtgttgcccctgacatccagaccgccgaggaggccctcgacctcatcaccaaggccattgaggaggccggctacactggcaagatcaacatcggcatcgatgtcgcatcaagtgaattctacaaggccgacgaaaagaagtgcgaccttgacttcaacaacccagacagcgacaagagcaagtggattacatccgaacaacttatcgacatgtacaagtccctgcccgaaaagtaccccattgtcaacatcgatgac

SEQ ID NO: 27145 - DNA, 103 bp, Zea mays
  Clone ID: cC-zmle189110a01a1
agtatcttctctcttttccacaagcgaaggggccaccatgagaatgctgcctgcctgcaaaactagcttttcacccccaacgaaaaaagaatctaactattcg

SEQ ID NO: 27146 - DNA, 108 bp, Zea mays
  Clone ID: cC-zmle189110a01d1
gtgcgcgaatagttagattcttttttcgttgggggtgaaaagctagtttttcatgcaggcagcattctcatggtggtggtgtcgggtgtggaaaagagagaagatcct

SEQ ID NO: 27147 - DNA, 355 bp, Zea mays
  Clone ID: cC-zmle189110a02a1
ataccctagatctcatacacattggcgagctttaccaataaaaagcatactgatttccaacataagccctaacactagttatatgaagggcttaaatattcacttcatcatgggatgctcttttaattgaatacactgtcccactttccgcctacatgtattttaagtgtgccatattatcacatgaagacccttcattgatacttacttaaccattaaattggtgaccaaaaaacaaatttatacaaaattctttctcttaaaacatcatacattacctgacttgaatagtgagtgtgataactttcattaatcgaacatcattaaccgaaaacattccaataaggaaaacttt

SEQ ID NO: 27148 - DNA, 360 bp, Zea mays
  Clone ID: cC-zmle189110a03a1
aaaaatctaaaagtgggctttcttatttctgggaagccacaaacatcaaacaaaaaactttattattgaactataactcataagaaatctaaaagagggcaccaccaatgatgggttcttggtaaaatgctgctggctttgtcaaaacaagttggttgaatggcaacaattgttgcacttgtaaaagggtgccatcgttaggcccaacgtgctggtaaaaccgaaacaactgttgttgtgtcaaaaaagtatcacggctcacaccacctaactggctgaatggtactagttgttccttctttaaataagcaggaaagttcaatgctttcaattggatgaattgaagaaattgctgggggt

SEQ ID NO: 27149 - DNA, 420 bp, Zea mays
  Clone ID: cC-zmle189110a03d1
cccgtccgcggacgcgtgggcggacgcgtgggcggacgcgtggggtgaaaatttcaattcttcaaccctacaggatccaacaggcgatcgcagctggcatcttacctttatcacccttgttcctccaacaatcatcagccctattacagcagttacctttggtgcatttattgccacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctatctgctgcctacccccagcaatttcttccattcaaccaactgacagcattgaactctcctgcttatttacagcagcaacaactactaccatttc

SEQ ID NO: 27150 - DNA, 209 bp, Zea mays
  Clone ID: cC-zmle189110a04a1
tttttatttctcatatttttcattattaaaaacacaaaaaaagacgttctttttgaagggactttaaaagcctcccccctatccatctatcataccaataaacatcatcaaaactttaacatcgaacaccacccatgctcgcttgcaattaaaatgatcacggaatacacaaagctcttctactgaatagcatttaattccactctttt

SEQ ID NO: 27151 - DNA, 217 bp, Zea mays
  Clone ID: cC-zmle189110a04d1
gtcgacacacccgtccgcccacgcgtgcgattacacgtatgcttactcattgatctaaatttcatttttttaaccctacaagatccaaccgtgaagctcttatgcatttttacatttataaaccttcttactccaacaattataataccctcttacagcacataacactttgatgcatttacaaccatacaacacaaactcacatcaactacaacaa

SEQ ID NO: 27152 - DNA, 339 bp, Zea mays
  unsure at all n locations
  Clone ID: cC-zmle189110a05a1
tttttcttttaatattttatcattattatcaaggaacccatctgtagggatacctgtgcagatgttatgctgaaacatctctcgatcaaccaaccaactgcaacatcgcggaacacagaacacaagaggtaccactgttacaatcacacgtagtgaagcgcaacacagatagacagctgccttatcatcctctaggtaatggagacgggtgaccagtctcatttctttccacttttcttcagacccgagcctccaatcgcgcccttttgtgccttggccttgagctccttcagngctttttcctcgtctttcttcttctgcagatatgcaagatccgtc

SEQ ID NO: 27153 - DNA, 473 bp, Zea mays
  Clone ID: cC-zmle189110a05d1
gtccgtgctctcgcggctctcgccagccagtctagggtttcggtccctttgtgcttatccgcccccgccggccatgtcggagcggggagggaaggccaagccgctgaaggcgcccaaggccgacaagaaggagtacgacgagacggatcttgcatatctgcagaagaagaaagacgaggaaaaagcactgaaggagctcaaggccaaggcacaaaagggcgcgattggaggctcgggtctgaagaaaagtggaaagaaatgagactggtcacccgtctccattacctagaggatgataaggcagctgtctatctgtgttgcgcttcactacgtgtgattgtaacagtggtacctcttgtgttctgtgttccgcgatgttgcagtttggttgcttgatcgaaagatgtttcagcctcccatctgctagctatgatacagatggtttcctgataataatgatgacatattctgtg

SEQ ID NO: 27154 - DNA, 379 bp, Zea mays
  Clone ID: cC-zmle189110a06a1
ttttggtttaagatgttttgcatgtttcatttgctgcgtccgacgttattattggcaagattcaccaacaatccccaagccaagacttgccgcggctttgctcgcccagcttattgcactgttcgcactactccactagatacatatagtaataacatcggaagagctagctactggaaccgatgcgaccgcaccaaaccatttctcgtcgtccatggcaacatccggcaccaccagcccttcttcttcctcatgttcttgtccctccaacggctcaagtcaaggtcgggcgcgcgcctcaaactaagtctcaactctcaagacgatgactaacctgtaaccttgcacgccatgcgtaaggccaaagttggtctctata

SEQ ID NO: 27155 - DNA, 548 bp, Zea mays
  unsure at all n locations
  Clone ID: cC-zmle189110a06d1
gtccgcgatccgaaaacaccattcttcacttcccctcggtacttgccattaactaagtcggataagtgcaggattaaaggcgcgatcatttcacacggctgcttcttgcgtgagtgtgccatcgagcactctattgttggtgttcgctcacgcctaaactctggatgcgagctcaagaataccatgatgatgggtgcggatttgtatgagaccgaagacgagatctcaaggctactggcagagggcaaggtgcccattggcgtaggggagaacacgaagataagcaactgcatcatcgacatgaatgccagggttggaaggaacgtctccataacaaacaaagagggcgtccaagaagccgaccggccggacgaaggatactacatccggtctgggatcgtgngtagtcctgaagaacgcaaccatcaaggacggcaccgtcatatagagaccaactttggccttacgcatggcgtgcaagggtacaggttagtcatcgtcttgagagttgagacttagtttgaggcgcgcgcccgaccttgactgag

SEQ ID NO: 27156 - DNA, 280 bp, Zea mays
  Clone ID: cC-zmle189110a07a1
ccacacaatgaaaaaaaagggagcttttggtaacattacaaaccatatcctcttcaggcccatggttcgcgtacaaatctgtaaaagcaaacattaccagataactggctgctaagcctgaattcagctgcatcaagtaaacagctcaggaatcatcaaataaactgccacataaacacacagaacattaaatcgtttcatataaggacactttcacttgaaaatagaaactcaaatgtgtcacaaaaaatttctcagtctagttgttgatggctttctt

SEQ ID NO: 27157 - DNA, 489 bp, Zea mays
  Clone ID: cC-zmle189110a07d1
aacctaagaaaatcagtgctggtgactcaagccccagagtctaatctccattccttttacaacagagtgcagggtcgtccaaaagaaacaccccgatcaattgtcagaatcatcagaagatgagcttgctggtagaagaacaaagcatcaaactgattcacctgatgattctcgttgaaaacagcattccccgactagaattgaaaatgatgagtcttattcaaagggtggtagaaacagtgagcatgtcatgagaggtttgcgtgatgattctgatgatgctattgatacaaagaaatatttgtctaaagtcaatgaggactcccaatcggacgatggaagtcctttgaaaaaaactaagaaaaaaacagatggtaataggcacattgattctggtagttcagggtctgaagagcctgacaaacatagaacccactcggagaagcgaaggcacaagaaaactcataagcataagaaacagtatgatga

SEQ ID NO: 27158 - DNA, 152 bp, Zea mays
  unsure at all n locations
  Clone ID: cC-zmle189110a08a1
cancacccgngcactaaaacatcacaagaccttttgttacatttttttaaccctgagctcccactcatcccctaccagnctgtctctttaatttttgccattttatacatttaattcattcacgaattcatccaaaaaaaaaaaaccttttt

SEQ ID NO: 27159 - DNA, 371 bp, Zea mays
  Clone ID: cC-zmle189110a08d1
acgcgtccgtttttttttttttttttttttttttaatgaattttatcactgattattgttacatgacgaaagtggggcatccatggaggctagattatagacagacaccctgattttacacgacgaatcgcaagaagcgcatgcattggatatccttagccggagagggcgctggtgttgtaaacgaggagggcgccgccgccgaggatcccagcgagggtgacggcccagatcagaagcccagtggttccaccgacgtagacgtcgccggtgggagaccagtcatcctcgttgtagattgggctgtatccgtcgacgttcgcgccgtacttgtcgacgaactggtacacgcccttgcccttgcccttttt

SEQ ID NO: 27160 - DNA, 272 bp, Zea mays
  unsure at all n locations
  Clone ID: cC-zmle189110a09a1
ctcaaaaatttttaatggatattctacgtctttnaaacgctaatttgaaaattttttttttctaccttccactccaaaaactcccttaaatttttcccatcatatgcatacactttgtttcatcacaaccaccttacttaaattttattttccaacacctagaatattcactaaataattttgtgccaaaagaaacaaaaattaaatgactctattaaaattaaaataaaaaacgaaaggagctcccccccttcttggccaattttttccca

SEQ ID NO: 27161 - DNA, 525 bp, Zea mays
  Clone ID: cC-zmle189110a09d1
gggacggcgatggaggggacggcttttatttgacggtggagcgtcgtacgtggagaaggggtcgcgactgaccgatggggccggtctgccagtgagggaaagcgcgcgagtgagaggggctggcgggtggggttggcgtgtcagcgagagcgggtgaggggagtgcgcgggcggcttcgtgcgcgagcaggccggctaatgggccgagggaggggaatgcgcaggcgcgcgggaggggaggcggtcgcaacatgggccagaattggcccagcagggggggagctcctttccttttttctttttattttctataactcatttcatttttgtttctttttgcacaaaattatttagtggatattctaggtgttggaaaataaaatctaagtgaggtgcttgtgatcaaacaaagtgtatgcatatgatgggaaaaatctaagggagttttttgagtagatggaaaaagaggggaggggtagattatggttttaaaacacctataatattccctaaataattttgtgc

SEQ ID NO: 27162 - DNA, 307 bp, Zea mays
  Clone ID: cC-zmle189110a10a1
aaacagaaatatgtgttaattttttcccgctattaccccaattgaactaaatgaagggcaaatgtaaaattaatatgatttagtctttttaaccatatcttgagaaactagagactaaatcactttagtctctgttttaatcctactgtttgacaatttaggaactaaataaaactaaaattgagggactcttaaaccaaacgaggccttaaagtaattttgattggcccaaacggcggtcttttcccttgaaggaacgcaacgctttcaagtacttaaccttcccaaagtcaggccacattttggc

SEQ ID NO: 27163 - DNA, 360 bp, Zea mays
  Clone ID: cC-zmle189110a10d1
acgcgtccgcggacgcgtgggcgcgagaacttgagccgccctaaggccgaggtcgactacatgatgggcttggccgaggggctgataggcgacaacatcgacaagctctcgaggtcgtcgtcgtcggctaataaaaacctgcagtgatcttgcatagcacagtgccacagtataccgcttgaatttttttttacatgttctgcttccgcgttcaggcaggggatccgactgcaggtgatcggcgacgccgcgaagatgccagcctctctgcggagcgcagcggcgcaggccgacgaggccacgaggcaaaactcgcagctgcacgtgatgctggccatctgctacagcgggcgatgggac

SEQ ID NO: 27164 - DNA, 372 bp, Zea mays
  Clone ID: cC-zmle189110a11a1
ttttacatccagaagttcactttgcgaattctctcacaccatacgtacacgctgacaagatttttacgagatagcccatcctggagcccggagaggcctgggtacccctacattgtcttatggatagtatgtatagaaaattaaagggacagtatttccaaagcgcatgcagttgtcttcctcaggattgcgtagggctggctgtcacacaacaaaaccatttcttcgtgcttggctttgcagcataagattccaccctctcagtcctggtgtccttggaaggtgactcagtgtcttgtccgttcccacccttcttctcatctctggctttgttgaatatgacagtgaatccgtctgcagcccacgcgtccg

SEQ ID NO: 27165 - DNA, 444 bp, Zea mays
  Clone ID: cC-zmle189110a12a1
aaaccttactacaaaagccagaggtaaaaccattgttaaactggaacactttgatagatagaactccctaagcacataacacaccgcctgagacactttgggcacacacttagtttgtacagtacctaactgacaccaaccacaatcagagcttagacctaaagcaacccatctcatgcggaggccttccgtgccttcttggaggcaggggacttcacggtcttcggcttggccttggccttggcggcgggggacttcttcggcttcgccacgaccttcttctcgggcactttgcgcttggtcccagcagcagcggccttctttggcttggcagccgctgccttctttgacttggcggcggcggccttggccggcttgggggcggtggtcttggcagcggcggcctttgccggcttagccttggtcttgggggatgccttcttg

SEQ ID NO: 27166 - DNA, 440 bp, Zea mays
  Clone ID: cC-zmle189110a12d1
cgtccgggcacgcgtccgatctccctctccgaaatcaaggtagcgtacaccgctgcagtttctagagccctctctgccactggcgatcccactagtcacaatgcctgccctcgccaagcccgcctcccgcaccgccaagcccgccgcggctccgaagccgaagcctgccgccgccaagccgaaggcggccaccgctggtgcctcccacccgccttacttcgagatgatcaaggaggctatcacggcgctcaaggagaggaccggctccagctcgcaagcgatcgccaagtatgtgggggacaagcacggcgcgtctctgccggccaacttcaagaagatgctttccatccagctccgtgggtccgcagccaagggcaagctcgtgaaggtcaaggccttcgtacaagctctcggacgccgccaagaaggcatcccccaag

SEQ ID NO: 27167 - DNA, 380 bp, Zea mays
  Clone ID: cC-zmle189110b01a1
agacacttgaatactgaaacgtacgggtcgaagttaaaaagtcacgcatgtttgacacctgagacttcataacatttcggagaaaagagccacttgatctttacaacgcaaatttatatatattaccacgggtacaacgtgcatctccgttaaagcatacacaggacagaggaaacatagtagtggaatctccaagcacaaagctacgtctagctcgtagatcagagaaaaaaagggtagctatggcaataaacacaggaactgaacacaatatatggtggtgctgagaagctccagacttcaatcaccatgtaaagcatttgacggggcctgactttattggtagtacctacgccggtattcgatcacaggatcgagat

SEQ ID NO: 27168 - DNA, 385 bp, Zea mays
  Clone ID: cC-zmle189110b01d1
atctcgatcctgtgatcgaataccggcgtaggtactaccaataaatgtcttgccccgtcaaatgctttacatggggagtggagtctggagcttctcagcaccaccatatattgtgttcagttcctgtgtttattgccatagctaccctttttttctctgatctacgagctagacgtagctttgtgcttggagattccactactatgtttcctctgtcctgtgtatgctttaacggagatgcacgttgtacccgtggtaatatatataaatttgcgttgtaaagatcaagtggctcttttctccgaaatgttatgaagtctcaggtgtcaaacatgcgtgactttttaactttgaactgtacgtttcagtattcaagtgtcttgac

SEQ ID NO: 27169 - DNA, 484 bp, Zea mays
  Clone ID: cC-zmle189110b02a1
ttttagctttattcaatagtacttatttaatcatataaaaaacgcactgctacaattaacgttctcggttattacagggacttgaagcaagcgcgcgcacagcaaataaaggcgaggggaacattattttgaagctaattacgtaacagacactacaagagtacacgtatatacgttggccagacaatatatctacttgaggaagccctgggccatcttaaacagcccaccgccgccggcgctctactacccgccgccctgctgcttccctcccaccagctgctcggcgcccttcatgacgtcgccgaggccgaagcccttcgacgacttgctgccttcctccgcggccggcgcaggcaccgccgccggctccttgggcgcctccggcgccggtggcttgggcgccgcgtcgtcgcctggtgccgccgcaggctgctcctgctcggtggcgtgtcccgcgctgaactccttgaggtacccctcg

SEQ ID NO: 27170 - DNA, 471 bp, Zea mays
  Clone ID: cC-zmle189110b02d1
cccgtccggggtacctcaaggagctcctgcacgcggcgtccgtgtacggtattctctacgacaagccggccgggcagtacgtggagagggccgaggggtacctcaaggagttcagcgcgggacacgccaccgagcaggagcagcctgcggcggcaccaggcgacgacgcggcgcccaagccaccggcgccggaggcgcccaaggagccggcggcggtgcctgcgccggccgcggaggaaggcagcaagtcgtcggagggcttcggcctcggcgacgtcatgaagggcgccgagcagctggtgggagggaagcagcagggcggcggtgaggagagcgccagcggcggtgggctgtttaagatggcccaaggctttctcaagtagatatattgtctggccaacgtatataacgtgtactcttgtagtgtctgtttacgtaattagctttaaaataatggttcccctcgccttt

SEQ ID NO: 27171 - DNA, 320 bp, Zea mays
  Clone ID: cC-zmle189110b03a1
caacaacaaaccttgtcccccaaaatcgttcattttcccaacgcctttcaacctcttaattacatcaacttccactgtacatccgactttccccattcaataccaccaacgcctaggttcgccagaacactgacctttaaactaaaaaagccccctcccctctcaaaaattttttattctctcaaaaagccaccaccgaatcctacaccgctttcacctgaaccgcaacacaccttccctctctttcacctttaaccatacccgtgcgaggaccacaacatgctgctacacccacttctttgcctttagcaactccacat

SEQ ID NO: 27172 - DNA, 611 bp, Zea mays
  unsure at all n locations
  Clone ID: cC-zmle189110b03d1
gtccgggatgtcttccttcaacgagaggcctatcatcttttcactgtcttacctaacctcgcattctgaatgcactgcgtgacgagcatatacatggagtcagggccgttcaatctttgccagtggcagtccatttgccctcgtggagtacgaaggaaagacttttgtgcctgggcagtcgaacaatgcctacattttccctggactcggcctcggtcttgtgatctatggagccgtccgtgtccacgaggacatgcttctcgccgcatcgaaagcgctagctgatcaggccacacaggacaacttcgagaagggctccatcttcccacccttcaccagcatcagaaagatctctgcgcacatcgctgcagccgtggctgcaaaagcctacgagctcggtctggcgacccgtctgcctccccccagcgacctggtgaaatatgcagagaactgcatgtacacttccgtgtaccggaactaccggagttggtgnggcgatcaactttgcaggtataaaaaatctatcaacgcggatgggactctggtgtttataaaccctggtggtaccacccttgttgcttgtgctgctggagagcattgacctgtcatgc

SEQ ID NO: 27173 - DNA, 327 bp, Zea mays
  unsure at all n locations
  Clone ID: cC-zmle189110b04a1
atcctctagagcggccaccctttccttccttttttttcttcttttttttttttttttttttttttttttttttcgagttgttttggtaaatttttaaaaacaaaaaccccccggcaccccctaaaaaaaaaaaaccccccccatatttccccaaccccactcccaaaaaaaaatgaaaaagtaaaccctttccccccatttccgcaactcctaccaccttaaaattttttaaaaccccccttctttgtatcaaaaaacactataattcttttttttaaaaaaaacccttgcccccccctttaccgttttnaggtgaaaaaaacccat

SEQ ID NO: 27174 - DNA, 451 bp, Zea mays
  Clone ID: cC-zmle189110b04d1
cctatgtcgtctttgtcaacgagggcgactacgaccacagcgtggccgacatcatcagcaacgcgtcctgcacgaccaactgcctcgcgccattcgtcaagatcttggacgaggagttcggaatcgtgaaggggaccatgacgacgacgcactcgtacaccggcgaccagaggctgctggacgcgtcccaccgcgacctccggcgggcccgcgcggcggcgctgaacatcgtgccgacgagcacgggcgccgccaaggccgtggcgctggtgctgccgcagctcaaggggaagctgaacggcatcgcgctgcgggtgccgaccccgaacgtgtccgtggtggacctggtgatcaacaccgtgaagactggcatcacggccgacgacgtgaacgcggcgttccgcaaggccgccgccggcccgctgcaaggcatcctgaagtctgcgacgtg

SEQ ID NO: 27175 - DNA, 162 bp, Zea mays
  Clone ID: cC-zmle189110b05a1
atcccattatttttttttttgtgtgtaaatgagaaccttaaccactcgttttcccagctttcaaacaactccactacaaacaccaattttcctaaacctaaaccaatctacctaacatttattctacttgggaacacctgctcctcacaaaaccctaacact

SEQ ID NO: 27176 - DNA, 541 bp, Zea mays
  Clone ID: cC-zmle189110b05d1
cgacccacccgtccgcggacgcgtggggaagctacagctgcaacacacaaatacgtatttttttgctcggagcagatagagcacacagcgagtgggttagtggcaagagcgtcagtgacctgtgagaacccaaccgacggagtgaacgatcatggcggcgtctctgctaagcccgtacaccggaggcagcggcttgggcggtagggttcacgccaggagcggcggacaccgccgttcagctgcggcggtgaagcggttgctgttgaggctgtggcgctcttggagaatacgcgcggcgcggccgaggcgaaccgcggtgaggttcgggtactacccgcatagctactcccagaacttctacgacggctctgctttctacgaccaccactgcttgtagttgtagctgtagctgtgcttatgtttgcttatgatatgccggagactattatgtacaggatggcttacgtcttgtttgagactaacagtgattgagaggatcaaaatcacttgctattcaaaattgaatagtaactaattttgg

SEQ ID NO: 27177 - DNA, 187 bp, Zea mays
  Clone ID: cC-zmle189110b06a1
gcaaacaaagaccttggtgattcttttttcgtctcgtttcatagcgggaccaaacaaagggaacaacaggggtaccaacacctaatccaaaggttgaacggacactaacacggtgacagaagcgaacggtaacaccattctattgatagataagataactcggccgaagccaggatgggcccacaca

SEQ ID NO: 27178 - DNA, 442 bp, Zea mays
  Clone ID: cC-zmle189110b06d1
cggggctggcttctcctccccctcttaccaagtcctcctcgggtttgtgttccttagggttttgtggaggggcgagggcgggggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggctgtggctactgcggcggtcgcggcggcggcggctatggtggcgggcgccgtgacggcggttattgctggccgtggcggctacggccgtc

SEQ ID NO: 27179 - DNA, 311 bp, Zea mays
  Clone ID: cC-zmle189110b07a1
catctcaattcttaaccgatttattattggcataatgggtccccaataattctagcctcgttccggcaaaatttgtagatataaacaacaatacaaagagtttgagttggcgctcaccggcctccactctaaactatatacgggacgacgattcccatcccatcccatgtttattccatttcattcatcccaactaattcccttatcaggtctttctgctccgctctgggtatatatataaatcataatgccgaacgtcccttgtagtatcatctggacgatggccgggaccgggaccaccacctgatcct

SEQ ID NO: 27180 - DNA, 595 bp, Zea mays
  Clone ID: cC-zmle189110b07d1
acccacccgtccgcggacgcgtgggcttttgctcctcccaacgggtactacgggccttcttccggttactgtgatggccactgttgtgaccgccatcattacggtagagcatcacatccagatgagactcagttgcattcttctcaactcgcatatgatatgtacaacccatcagtaggcatctaccatcctggaagcacccatgagcacgagcacgagacagtatatgtagaaccgtctagttcctctccagacacaggtggtgacggttgttttgagatggaggaggaagtagggaagaggttttaccccatggtcccagttccccatgtccccaaaattaatggagaaatcccatcaattgatgaagccactatggaccatgaaaggctgacagaaaggttgaggctgtatgagctgggtgaaaacaaggtgaaaggagatggcaactggtcagttccgagcactatcagatcagctttaccaaagtccggatcaccatgaatttgtgaggtcgcagataattaaccagcttataactaaccgtgacgcctatgatggatacgttcccatggcatatgatgattacttggag

SEQ ID NO: 27181 - DNA, 386 bp, Zea mays
  Clone ID: cC-zmle189110b08a1
ttttgcttggaacaattatgtttgccactggtctaaaagagaaagaaaaatgtgctacatattatgccggcgtccgcgtgtcaccgcgcgatgagcgagcctatggcgccggcgatgagcgcggtgggatcgccgagcaccgcggagatgacgacctgcgcggcgaacccggcgatctcgcagcagcgcttggccttgcccttgtgcctgccccagtacgagtacctccctcccccgctggcgtggctgctcttcgccgcgcccctgatcatcgccggcacccagtacccgccgctgccgggcaccaccacgtgggccgccatcccctggtcgcctttgtggcgcccgacggcgtgccagctctcgacgagcatgtccatgacgca

SEQ ID NO: 27182 - DNA, 618 bp, Zea mays
  Clone ID: cC-zmle189110b08d1
ggggcaagtccgtgagcgggatgaactactacgcctgcctctctttcatgtcgctggtgatcctcctccccttcgggcgggccatggagggacccaagctctgggcggcgggctggcagcaagcagtcgccgagatcggccccaacttcgtctggtgggtggctgcgcagagcgtgttctaccacctgtacaaccaggtgtcgtacatgtcgctggacgagatctcgccgctcacgttctccatcggcaacaccatgaagaggatctccgtcatcgtcgcctccatcatcatcttccagacgcccgtccagcccatcaacgcgctcggagccgccatcgccatcctcggaaccttcatctactcccaggcaaagcagtaacgccttgcattaattggcgtctagatggcctgccctcatcagttcaccgcgcgatcagctcggtgctcgaagatgacagcttatgacctttgagaatgtctactaagaatcgccctttgtataatactactacgacctctcttttttgtattttctttcctaagactagcttccagtgttactgggctcatttcgtggtgtttctattatgactaagattagagagagaatgagagat

SEQ ID NO: 27183 - DNA, 269 bp, Zea mays
  Clone ID: cC-zmle189110b09a1
atacaaaccatgtgtgtatctttttgtaacatcaaagcctacataacttacaaatctatctactgatccatttacccacaaaaattaaaatcaccttaagcaaaagttttttttaaaaaaaaaaaatctgccgattactacaactctaccaaaaacccaacggacacaggaacggctgcattccacggcccccgaaagctcttggtcccaccgctgtccattttccagcttttatttgcgggcggcgcaaccccctttaaatttgggtt

SEQ ID NO: 27184 - DNA, 478 bp, Zea mays
  unsure at all n locations
  Clone ID: cC-zmle189110b09d1
gggcgtgatggacgcgtccacggtggcgcagatgatggctccgttgtgctgcgtcgccgacatcatcaacggcacgtccgccatgggcggcggcagcgcctcggcctcggcggcgcacgcgcgcggccggaacctcttcacctacttcccggcgtccccgtcgtggccgcgctccaggaagagcctgacgtacgcggtcacgcagacctcgctgacctccatcgaccgcgcgacgctgagccaggtgttggcgcgggccttcgcgcggtggtcggcggccacgacgctcagcttcacggagacggcgtcggagcgagacgcggacatcaccatcggcttctacgcggnggaccaccgcgacngcgaagcgttcgacgggccgctgggcacgctggcgcacgccttttcgccgacggacgggcgctttcacctggacgncgccgaagcgtgggacgccagcggcgacgttgcgcgcgcg

SEQ ID NO: 27185 - DNA, 486 bp, Zea mays
  Clone ID: cC-zmle189110b10a1
ttttccgtcctgcattctgattgagatagcacacattactggaagtatacattgttcttttgcaaggaaatatatggtaggttcacacaaccacaactcaaactgatgcgacgaaatatatggtagcacacattcctgtaactgtacattattcgtacttccaacaagactgggcccttcattgttcttctccatacattatttatttactagaagaggctgttcacaaagggacatcgacaatgttcctgagggcatctgcagggagagggccataccaatcgcatcatcattgttgctttcaagtattttttagctctgcttctttggcgtatcagcgtacttccaggtggtatgtgcatatgaggtgaattgtctcccaccagccacatcttcttcccgtatctggctgcccatttctttcagatcttcgtctgtcagtttcaccttcaaggagtcaatgttggaatctagattcttgatttt

SEQ ID NO: 27186 - DNA, 392 bp, Zea mays
  Clone ID: cC-zmle189110b10d1
cgcgtgcgcacgcgtccggaagaaacgtcttgccctccactccaacatcgacacgactactcgtccgactagaaccggacttttcaatccatcgttcgcagttcagttcacacttcacaggcgagcgcgaccatggatacccaagcacgtccggttccccgcgtcaagctcggcacccagggattcgaggtgtccaagctggggttcgggtgcatggggctgacgggcgcatacaactccccgctggacgacgaggccggcatcgccgtcatcgcgcacgctttcagccgcggagtcaccttgttcgacacctccgacgtatacgggcccctcaccaacgaaatcctcctcggcaaggcgctgaagcagctgccgcgggagcaggtgcaggt

SEQ ID NO: 27187 - DNA, 313 bp, Zea mays
  unsure at all n locations
  Clone ID: cC-zmle189110b11a1
agaaacattggaaaattttaaacccgtacaccccccnnccccatttttttaaaccaacaataaaaaaatttctcaaaagccaacttccattcaatttaatgcaactcccatacaggaattaattcaaacaagcaatacaaaaacttttctgaaccatacaaggcatcattttttataaagtaaattgttctcaaccatttccttgcccaaaaaattacttgtaaaatcattccaccaacaaattattgcaacttcctttcaattttccataagtttaaacctaaacttttccacaatccccataacataacta

SEQ ID NO: 27188 - DNA, 278 bp, Zea mays
  unsure at all n locations
  Clone ID: cC-zmle189110b11d1
ccacgcttccactcatcccatctccatccatctccatccccacacacgcctccttgtacaccagccgggttagtttcatccccacacacctctcctccacctccatttacnttagcacctccgcctccttcccgcatgctccttttgatctcgacaaggtttgcgcgttgtatgcaaaaccgcctagcaccactctagccctcccccctcctcctgctagtcacttcaacccactagcgtgtctatccatcgactttctgtcataaaaagccactctc

SEQ ID NO: 27189 - DNA, 354 bp, Zea mays
  Clone ID: cC-zmle189110b12a1
gaaaaaagcaagcaattacatgatgtaattttggggattattctattacacataccatcgatgttgtgaccctagccaacacaacatgcagcttcacagcctcatttcacaactactacaaatcaatcacacggtagctagcgcggagcccttgaaccggcccgccccactcatttcacctctgaaacctcgtccaaggcgtacttgttggtggacacgccggcgtatttcaccttgttgaaccgcacaaccaccgggtagcgggtgttgggatcctgatcgacggtgacaacgttgccgatcccgttgtaccagtaggactccctcctaaagatcttcaccttggcgcccctc

SEQ ID NO: 27190 - DNA, 484 bp, Zea mays
  Clone ID: cC-zmle189110b12d1
acccacccgtgcggggacgcgtggtccggcttggcaggaggctcgtggcccgggcctacaacgaggccgccgcagctgaggcggcgggaggggagggtgccgtggccaccaagcccaaggccgagaagccgccgccgatcgggcccaagaggggcgccaaggtgaagatccttaggagggagtcctactggtacaacgggatcggcaacgtcgtcaccgtcgatcaggatcccaacacccgctacccggtggttgtgcggttcaacaaggtgaactacgccggcgtgtccaccaacaactacgccttggacgaggtctcagaggtgaaatgagtggggccggccggctcaagggctccgcgctagctaccgtgtgattgatttgtagtagttgtgaaatgaggctgtgaagctgcatgctgtgctggctagcgtcacaacatcgatcctatgtgtaatagcataatccacataatcatatcatg

SEQ ID NO: 27191 - DNA, 442 bp, Zea mays
  Clone ID: cC-zmle189110c01a1
acaaaaccacatagacgaacttacgacatgtacaaaaccttcagatttgagccaaccgacatcaactatgacaaaactacatagaccaccttaccacatataacaaagccttcagattgcacccgtcgattgagctattatagataaccaatgataactatgtctcggcaagtgtactttccaacaggaacataaaataaaactgcaatccaggctcagtaaatctcaaagcagatgttgcaagggacacggtaagttctacaaacatagaacaaaattaacagaattacatccaaggccaccatggctttagcgcaacctcctggcctcccgctcaaactcgagcagggtgaggatgtcaccctcacgaacaaggcccttgacgttcctcatgatagacggttctggtcatccaaaaacttcactctgacctgggtcacct

SEQ ID NO: 27192 - DNA, 360 bp, Zea mays
  Clone ID: cC-zmle189110c02a1
aaaaactggaaatgtaactttttatttttgggtggccccatacatcatccaaaaaactttattattgaattacatctaataagccatctaaaaaagggcccccccaattatttttttttggtaggaggcttcttggtttgtcaaaacaagttggacaaagggcaacaattgttttacttttaaaaaggttgcggggttaaccccaaactgcttgtaaaaccgcaacaactttttttttttcaaaaaagaagcaccgcttgctttaactaactggctaaatggtagtaatatttgctgctgcaaaaaaacaacggggttcaatgcggcccatttgttaaatggaaaaaatttttttttttt

SEQ ID NO: 27193 - DNA, 506 bp, Zea mays
  Clone ID: cC-zmle189110c02d1
cacccgtccggaccaacaagcaacatagaaagtggaatccagtagcaacaatagtgcaacaatggagaccaagatattttccctgatgatgctcgttgttcttacaacatgtgttgataacacaacaattcttcattgatgataacaagctattatagctctcctttttccacaatacctatcattaattatagctgcatgataagaaaacccacctcttccaccatatatgctacaacaagcaatcgcaggcagcatcacaccattatcgtccttgtggcgacaacaatcagcagtactatctttgcagccatcattgctacacaccatgacggcacaacagctgcaacaactgctgcttcctatcaacaaccaagttgctgtggaaaacctttcttactactctcagcaacaacaatttctatcataccaacaactgactacactgaacgctgctgattatttgcagcaactactattaccatttaagctggttactgctgact

SEQ ID NO: 27194 - DNA, 321 bp, Zea mays
  Clone ID: cC-zmle189110c03a1
ggccccatcgagggaggaattgtacattgatttaccatgtgcaatacagtttccggtctcaataaaatcaatactagtttgttgttacaggcagcaggctggacatgcatgaatcatgaccgatgcaacgcttcaggttcctttacaacacgcatgcatttagctttccacaacaaacaactggcggcggcggcagcaggtattcttatgcaccaaccttctaatggaacttgaggctggtgagcaccttttttttgaccgggtccgcaaggtggtcgagcaggtttttgaaccggccaaccccggtgaccagccccttga

SEQ ID NO: 27195 - DNA, 382 bp, Zea mays
  Clone ID: cC-zmle189110c03d1
gtccggctcaaggagatcaagaacggcaggctcgccatgctcgccatcttcggttacttcatccaggggctcgtcaccggcgtgggcccgttccagaacctgctcgaccacctcgccgaccccgtcaacaacaacgtgctcaccagcctcaagttccactagaacgttggtgcatcagcatacctgctgccgccgccgccagttgtttgctgtggaaagctagatgcatgcgtgttgtaaaggaacctgaagcgttgcatcggtcatgattcatgcatgtccagcctgctgcctgtaacaacaaactagtattgatcttattgagaccggaaactgtattgcacatggtaaatcaatgtacaattcctccctagatgcggac

SEQ ID NO: 27196 - DNA, 339 bp, Zea mays
  Clone ID: cC-zmle189110c04a1
ggaaaaataaaaaaacttcattcccctttaaccaaataaactaaaaaaataccttttatacaacttgcggttttacacacaccataaatttttagtcaaaccattttctattaaaatcaacatttttgcaaacaccgttactttaacaaaattttttttctaaaacttttacaacccaccaaatgattgccattcctttccataaaactgctttttggtataacaatgctacagtggttttccacccatccaacaaaaaaaacttttggcaaaagttattaacccaatgaagccaattttagccaaatactttcttttaacaaatttttcataccttcc

SEQ ID NO: 27197 - DNA, 471 bp, Zea mays
  Clone ID: cC-zmle189110c04d1
gaccacaagcacagaagaaaagatcatgtagattaaacatgaattttaactgctggaatacgactgtacaaacgagggaaggtgcagtgcagggccattgggtttagcaaaccatggaagtttgatgagaacactgggaggtatggaaaatttgctcacaggaagtattctgctcatattggcttcattgcgttcatcacttttgcccgaagttttctttgttggattggtggaataccactgtagcattgctataccacaaagcagtttcatggaaaggaatcgcaatcatctggtcgcttgtagaagtcttaggaaaaagatcttgttgaagtagccgtgtttgcaaaaatgttgatcttgatagcaaatggtttgactacaaatctatggtgtgtgtaaaaccgcaagttgtatgatagctatttttttagtttacttagttatatgataatgtagttttgtttttgt

SEQ ID NO: 27198 - DNA, 238 bp, Zea mays
  unsure at all n locations
  Clone ID: cC-zmle189110c06a1
cttgtatcctctacaccctccgccctacatactttttcactcctatacccagccaacacacgctctcaatcggttcatttgtcattttttaatcctgcacacccaaacaaccgcccctaanaaccatcattactccacttttacccacacaaactcataatgttcatccatcatcaccaacattcctaacttaatcatttctaactcactcaccaaatcttcaataaacacccacctt

SEQ ID NO: 27199 - DNA, 410 bp, Zea mays
  Clone ID: cC-zmle189110c06d1
cccggccggcttcggccgccacggcggcggcgtccagcagcttttctttaaggagaagttcgaggaggtcgacggggggtcacgcgccggcgccaaccaccaccaccaccatggtcaccacggcggccacggcttcgtggtgcgcgagaccagggtcgaagaggacatcaacacctgcaccggcgaggtccacgagcgcagggagagcttcctcgccagggctaactgagccgcccggcggccggcatccacgcccgttcgtgcttgcctgcgtgccttatgtatgtctgtggttgactggttgtgcagggtcatcgtacttggctatcgtacgtgcacgcactcagctcctgtacgaattacgacaataagctcgtgacctgaataaaacttcttcgtaatactaaaaa

SEQ ID NO: 27200 - DNA, 342 bp, Zea mays
  Clone ID: cC-zmle189110c07a1
ggcccacacctttgacctttggcctccactacctcggcctgctcctgcgcgtcggcgaaccgcttaacaatgctgctctccctcttcctctttcccccgtcgcaccccgcggagccggagtcgaattcctcaagctcgaagtcctccatccggaacgccggccgccacgggggctcgtcgtcgcgcgcccgcttcctccccggtgccgcgccgccggtgctgaccatgcccctcatggcgcggatgttgtccagcagcgcgtagaacctctccacctgctcgtcgtcgtcctcgctgccgctcgccctcacgccggcgacggattcgggcgacgacagctgc

SEQ ID NO: 27201 - DNA, 231 bp, Zea mays
  unsure at all n locations
  Clone ID: cC-zmle189110c08a1
gtgtacgcagnctccaaacattattaacgggagagtgtggatcttaaatgcaaatagccatgtctaactttacaccgatgaccaccaccatgtttacattcagatcattaacaggagaggaggtggatctagagcgagaggccaccggactcctcgtcctcgtcgaggtcagaggtgtagatggtgtaaaaggaccagatgaggccgaagacccccaagaggatccacccc

SEQ ID NO: 27202 - DNA, 534 bp, Zea mays
  Clone ID: cC-zmle189110c08d1
ccccgtcccagcctcccagccgtcccggctccccgcgaccctttccttcggcagtccggcgcgggggctcctgggcggtgccggtgagccgaacgaggatcccaactccccgaagaaagcggccacagccagagccaagggtggctcggctctcctctcacagactgcgccgcagcgcctagcgctcggctggcagccgctccggccggtcggccccgcgcccccgcccctgctgcctacatccgcctgcagccagaagatctgcctccagcgaccgccctgcctgccccttgtggcttctgtggttctgcacaccagcacacgcacttgtccccaaacaacggcggcggcgatgagtatctcagaagagcttcccggcgaacgatctgacggtgaggagggaggtcttcatcaacgaggaggacatcatccacgagataaccatcgacgaagaagatctccccgaccgcgacgacgaagatgacgacgtcgtcacgggatggttgattccgaagacgtcgatgattctacata

SEQ ID NO: 27203 - DNA, 237 bp, Zea mays
  Clone ID: cC-zmle189110c09a1
caaacattattaaggggatatttggaatttttataatacaaatatccccctttacccccacaacaaaaaccacacccagtttacattcacaccatttacacaaaaccacaaaaatctacaactttaatccaccaaacatcttttaaaaaaaaaaatcaaaactttccttattaaaaatttaccacataaaaacccttacccttaaaaagatccaccctaataaaaacataatgagcc

SEQ ID NO: 27204 - DNA, 395 bp, Zea mays
  Clone ID: cC-zmle189110c09d1
aaaggcaaaccaataaactgcatgatgtaaattctgtcgactttctttatctaacccatgggcaacactacagggagggttatactgcaagccgctatcctaaaaactgtatccacttgctatacgctactactaccgaacctgactagcagcctacttccaccaagtaccaatgacatgtccaatgaacctgcaaaacaaagaagtcgggttggataacctggtggccaccatgaaagggtggagacggcaaacgaaactagaaaccgtggagaagatcgaggcggggccataaactcggtgtcaggttttttttgctgcgttgtttgcttcaactgcacatagagggtgaatttcccccctcaccttcttttggttttgatgacccggcaata

SEQ ID NO: 27205 - DNA, 193 bp, Zea mays
  Clone ID: cC-zmle189110c10a1
aggggattttcccctttcttttttctcgtttttatgtttaccttgggctaaccgaaatgttaagtttcttaggacggttaaaacacagccgtgcaaacttggtaagataagattaggcggaagaatctggaaaaaaaaaaaaaaaaactttccaattaatacaagaaaaatttgaaaaaaaaaaatatggggc

SEQ ID NO: 27206 - DNA, 615 bp, Zea mays
  unsure at all n locations
  Clone ID: cC-zmle189110c10d1
tgtcacatgctactatgcaaaaaagtttgaagcacttttaaggtcttgctgtccatctgagcttgaggttggtagatccattagtcgatgtaaaaaatggggagcacagggtggtaaaagcaatgtgttttttgcaaaatctttggatgatagatttataataaaacaagttacaaagacagagcttgaatcattccttaagtttggcactgaatattttaaatatctgtcagagtccataagcactggaagccctacatgcttagcaaaaattttggggatctatcaggttactagtaagcatgtaaagggtggcaaggagtcaaagatggatttgcttgtgatggaaaatcttttgtttggacggaatattaccaggctctatgatctaaagggatcttcaaggtcaaggtataatgcagattcaaatggtagcaacaaggttcttcttgaccagaacttaattgaagcaatgccaacttcaccgatttttgttgggaacaaggcanagcggctactggaaagagctgtttggaacgatacatctttnctagctggaatcgatgtgatggactatntcttgcttgtgggagtcgacgaggagaaacatgaact

SEQ ID NO: 27207 - DNA, 342 bp, Zea mays
  Clone ID: cC-zmle189110c11d1
acgctcaccacctcccccacctccaataatttatttattgaaacctaaacatctggaacgtttacttaacacttcccaactaccttacaatttcaaagccttcaaacatccaaacactgcttcttacagcatccacttccataagtgacacaactttaataaatacatagatgaatgccttgtccactgcccggcatatttaactttcaattgttctacgcacttgtgcttcacatacccttaccatatccaaataaataccttcaaatccatccaaatataataggaacctcattattcccttttcttttcactttaccttagaaatgctttcccaaattc

SEQ ID NO: 27208 - DNA, 261 bp, Zea mays
  unsure at all n locations
  Clone ID: cC-zmle189110c12a1
agcggacccccttttttttcttttttttctcttactcctctttcccaacccaacacccccccctaaagaantttttgacaattttaaacaccaggnccccccnnnccccccnnnacaaaaacaaaccccaaacaacaacaccaaaaaaaaacgtgggtaacactaacaaccttaaaccacaaaattccctccccctttataaaaaatcatttcttctaaaaaaatacccccaacaataccctcatttcttttaacttaaaa

SEQ ID NO: 27209 - DNA, 261 bp, Zea mays
  Clone ID: cC-zmle189110c12d1
gaaaagacttccacatcgtgaccttgttaaaagcctacactcgctggcgccgggtgctcccccacgacctgtaaatatgcaaaactgcatgtcctccgttaccgactaccggaggctggggatcaatttgagaataaaatctatcaacgcggatggactctgtgtatagtcctgctgctaaccaccctgtgtgggctgtggagaggattgacctgccatgcatatatgaatatagtgaacgtgtgaagcaacaactgggtc

SEQ ID NO: 27210 - DNA, 383 bp, Zea mays
  unsure at all n locations
  Clone ID: cC-zmle189110d01a1
ataacctaaccagtcctcgggtctcctgtatgaatagtgttctatccttgagcaacggaatcaaattgtcaacgtacaaacagacacaggacaggcagcgcttgccactagcaacagagcggcgactgcctttgttatggcatacacgggatataactcaaccgtaaacccaaatcaattcaaacgctgcacctaattatcttcgactagcagtttatactaacataaaaccatcggttggacgcaatgcaacaaacaataacagcttgtttcttttttctgctcnagcttgctaggaaaaaagaaaaaaggggggaaaataaaaggaaagcagttcccacatcctcctaacttgcatcaaacacgctgctgtgctcggacac

SEQ ID NO: 27211 - DNA, 391 bp, Zea mays
  Clone ID: cC-zmle189110d01d1
aagccccggctccccctacgcctcctcgccggaatccgccccttagcgtgccccacgctcccctccgcagcaggagcggtctccctccgaggaaggagatgacaaggagaaaccaacacatttgagatttctagtgtctaatacggcagcagggtgcatcattggcaagggtggatcaaccattaatgattttcagtcccagtctggggctcgtattcagttatcacgtagcaatgagtttttccctggtacaaatgacagaatcatcatggtttctggactgtttgatgaagtaatgaaggccatggagctgattcttgagaaactgcttgctgaaggtgaagaattcaacgaagcaaaaactacacctaaagttagacttgtagttcct

SEQ ID NO: 27212 - DNA, 533 bp, Zea mays
  unsure at all n locations
  Clone ID: cC-zmle189110d02a1
tgggatcctctagagcggccgcgccgtcggacccggccgccttcgccttcgcgaaagcgtcgcggacctgctccgtggggtaggggaacccggcgcgggtcatggagttgagcagcgcggcggcgccctcgcgcagcagcgcgcccgtgccgtccgcccgcgtgttgcccaccgcgtcctggatgctcatcacgtcagccccgcccacgctgcccgccgccgcgccgaagaagtggcccatcgacgatgacgtgctcgggaaccggccgccgaccgccgaccagatctccatcgggtgcgacctccagtagtcgcaggtgccgaanctgtgggggtccatggggacaaatgtcntcngtgacgaggtcccgatgccgccgtgcaagggggaatcgccgtaccggggcgtcggagagctcccataggcgccaccagcaccatgagcaggcgagggggacccgnctccgtaggcgccgccaccgctgggagtagacggagacccaccatacgcgccngcgncgctgggggtggac

SEQ ID NO: 27213 - DNA, 263 bp, Zea mays
  Clone ID: cC-zmle189110d02d1
cgtcgcaaaaagtgagcagcagacagcacagtgttgcatggaggcgtggagatctctcctcggagcgtgtgctcgcggctggcgcgcagccttggggccgggtcgagtccaggaccggtcccgtgagcaggcagcgaaggtgacgacgtgaagaagccggactgcgtgccgggatggacccggctcgtttccggggaccggcggggacacggatacgcccgtgacgccatcgacggaggctccagctccccgacgccgtccca

SEQ ID NO: 27214 - DNA, 412 bp, Zea mays
  Clone ID: cC-zmle189110d03a1
cattaaaaccaaaacgttatgatgaccatgcatatattattggtcataccacacatgataatgtgtgtcgtcttactgcattattacatatatagatagagagagatggatagaggaaatttcccaaatatcatgaatcagtagtagggcggaatggcagcggaaaccccacaggggttggtgcggtagctgggcagctggtactggtaaagtccacccatggccggcatgttctgcgccatcatcatggccatggggttgaaaccctgggctgccagcagctgctgctgctgctgcataaaagctggctcgtacaggctgctgctggcggcagcggcaccctcaagctgcatcatcatctgcagctgctgcgcgacggactgcacgtccatcatcctcatctgctgctggc

SEQ ID NO: 27215 - DNA, 603 bp, Zea mays
  Clone ID: cC-zmle189110d03d1
gtccgcgaacagaacagcatgaagatggtcatcgttctcgtcgtgtgcctggctctgtcagctgccagcgcctctgcagggcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatgttccagccgctccggcaacagtgctgccagcagcagatgaggatgatggacgtgcagtccgtcgcgcagcagctgcagatgatgatgcagcttgagcgtgccgctgccgccagcagcagcctgtacgagccagctctgatgcagcagcagcagcagctgctggcagcccagggtctcaaccccatggccatgatgatggcgcagaacatgccggcatgggtggactctaccagtaccagctggccagctaccgcaccaacccctgtggcgtctccgctgccattccgccctactactgattcatgatatttgggaaatctctctatccatctctctctatctatatat

SEQ ID NO: 27216 - DNA, 540 bp, Zea mays
  unsure at all n locations
  Clone ID: cC-zmle189110d05d1
gtccgggaatccacacaagcacttcgacgtcacacgggcgctgcgcacttacacaccaagcgtcggcaccaatggcttaggaccgggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcagggagagcttcctcgccagggctaactgagccgcccggcggccggcatccacgcccgttcgtgcttgcctgcgtgcttatgtatgtctgtgggtgactggctgtgcagggtcatcgtacttggctatcgtacgtgcacgcactcagctcctgtacgaattacgacaatangctcgtgacctgaataaaacttcttcgtaatactaatacctacatc

SEQ ID NO: 27217 - DNA, 293 bp, Zea mays
  Clone ID: cC-zmle189110d06a1
cttgtatcctctacaccggccgcccttcatatttttttatttttttacccatttatcttattctttcaatcggtttattgttaattttttactccttcacacccaaacacccccccctaatttccataattactccatttgtacaaacacaaactcatcattttcatccaacttccccatcaaaactcactaaaacatcccccaactcactcaccaaatcaacaaaaaaacccagtttttcccttaaaaaaaaaaatctttaatacccccccccttttcattctcatgccttt

SEQ ID NO: 27218 - DNA, 548 bp, Zea mays
  Clone ID: cC-zmle189110d06d1
gcagggcctagcaaggctgatcaaaatttattgctgcagctatacattcaatgtagatgaattttcattttagaatcgaaggttcataggatgagacttctcggctcttatccatttttttttttggaatgaatacatcattcaatttggcaggcagaatagtaaagatttcatcgaaaacttacagcagcttgccaaacaaacgctaatagaaaaaagagtacaggtatgacaggcataacatccacgattgggttgaaaatggcataagcttcgggtaatttggcgaagaaaaagctagtcggacaaagaacagaattaaaacagatacaggttaaactaagtatattaggcataacaagcatttcattcttgtagagtagataattggattttgattgagttatttttataagggaaaaagcaaaaaaaagggtagattccaaatccttttttcttcggactttcccaaacacaaaatacctccttgtatttcgcattctcaaatgagagtggaagaaattcgactttcatataatatcttaata

SEQ ID NO: 27219 - DNA, 205 bp, Zea mays
  Clone ID: cC-zmle189110d07a1
ttttcttttaataactttcttttattaataacattgagtatgtgcgggggttcactgcactcccctcctgtttcccttgaaaaaaaaactatacgtatcctgctatttcactgcagtagcgcagttgatcaatcgttttgggttttggccatatacagacttgagcatggcagcaaagagaagtctgaacttatcgtacgcgtgg

SEQ ID NO: 27220 - DNA, 558 bp, Zea mays
  unsure at all n locations
  Clone ID: cC-zmle189110d07d1
cgtgggcgtgccgtccgactaccgccacatggaagggttcggtttgatcacgtacacgttcgtgagcgcggcggggagggcgcagtacgtgaagttccactggaagccgacgtgcggcgtgcggtgcatcctgacggacgaggaggcggcgctggtcgggggacggaaccacagccacgcgacgcaggacctgtacgactccatcgcggcggggagcttcccggagtggacgctgtacgtgcaggtgatggacccggacacggaggagcagtacgacttcgacccgctggacgacaccaagacgtggccggaggacctgctgccgctcaggcccgtggggaggcgtggtgctggacaggaacgtggacaacttcttcaacgagaacgagcagctggcgttcgggccgaggctggtggtgccagggatctactactcggacgacaagatgcttgcatggcnnggtgttcgcctacgccgacacgcagcgctacaggctgggaccaaactacctgatgctggccgttaacacgccgcgcttggcgcaccacaacaaccac

SEQ ID NO: 27221 - DNA, 422 bp, Zea mays
  Clone ID: cC-zmle189110d08d1
cgcgtccgcccacgcgtccgcccacgcgtccgcccacgctttcttttctttctgcaagtgctgctacggcggccagtttcccacaatgctcacaagctcctatagcttcccttcttcccccgtacctctcaccaacgggtgtcttcggtatgtgaaaacccacttcttcaaccctacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgctttttaatttgcaacaacaacaactaccat

SEQ ID NO: 27222 - DNA, 288 bp, Zea mays
  Clone ID: cC-zmle189110d09a1
aaccttagatcctctacacctgccgcccttttttttttttaaactttttttttttattcttaacttttattcaagattttttgtaacattttaaaaaactatattcccccttatttacccaacatattttttatttttttcatttcttacagcaaaaaaccttttccttcatataaaatagattaaaaattcccccccacccatcttttacaatttaaaaatttctccccccacaagtctaaaaacaaccaacttttttcccaaaacaaaaaaaccaattttattttt

SEQ ID NO: 27223 - DNA, 335 bp, Zea mays
  Clone ID: cC-zmle189110d09d1
ccgggggagtacctgtacatcggggcggccgtcttcatcgttttgttctgcgtcatcgagatgggcaagccggacaggccgcacaacttcgagccggagatctacatgatggagaggtcggcccgcgacaagctcatcggcgactacaactccatggacatctgggacttcaacgagaagtacggcgagctctgggacttcaccgtcaacaccagggacgacatcgtcaagtcgacctagatgcattgcgtacaccgctcgctgcccttcagattgttgcctacagcaaaaaaaaccctgtgaaaggaagctgtagctgctaggaaaatctcttg

SEQ ID NO: 27224 - DNA, 323 bp, Zea mays
  Clone ID: cC-zmle189110d11a1
ctcttttttttcttttttttaaattttttttttttttagatttttttgaaaatttttaaaaccaaaaacccccaaaaaaccccaaaaaaacaacaaaaaaaaaacataaacattcaccaacaaacaaaaaccaataaaaaaaaggcccccccaaaaataccaacatttcctaaaaccaccccatttttacaaaacactaataaaaaaaacaaaccctctctaaattaaaaaaaaattcccccctaaacccaaaaccttcttaaaaaaaccccaaaaatattcaccctaaaaaaaaaaaacaactaaccccaccaaccccaaaa

SEQ ID NO: 27225 - DNA, 569 bp, Zea mays
  unsure at all n locations
  Clone ID: cC-zmle189110d11d1
agaaagtggaatccagtancaacaataaancaacaatggcgactaatatattttccctccttatgctccttgctgttcgacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgtttcaacaatcgccagccctatctttggtgcagtcattggtacaaaccatcagggcacaacagctgcagcaactcgtgctacctctgatcaaccaagtagctctggcaaacctttctccctactctcagcaacaacaatttcttccattcaaccaactgtctacactgaaccctgctgcttatttgcagcaacaactattaccatttagccagctagctactgcctactctcagcaacaacaacttcttccatttaaccacattggccgcactgaaccccgctgcttatttgcagcagcaaatactactaccattt

SEQ ID NO: 27226 - DNA, 213 bp, Zea mays
  Clone ID: cC-zmle189110d12a1
ttttctttgttgtaaataccagactaatatatttagcaacatcagaggcactttaacatcgtttgtcctcctaacacgcctgaatcaacaataactgaactaaaacagtaggaaaaactacctacaaggacaaaagagagcaccagccgccttggcccaatcccccctctactagttattcaatcttattgtatacacataaacatactatcc

SEQ ID NO: 27227 - DNA, 384 bp, Zea mays
  unsure at all n locations
  Clone ID: cC-zmle189110d12d1
cccccttcgccttgcgagggggcggaggggaggtgttttttttagggtatacaggagtgctctgcccgtngggaatgctttgcaacaacgccatgttatcggcggcggcggcaagaaggcgcccgcgctggggctgcagaagcagaactcgtggtcgccggacatcgagcgcgacgaggcgtgggagcgccggcgcaggggcatgcgccgcgggggcacggcgctgcgccgcgcccgcagcgtcacggacgacgacctcgacgagctccgcggctgcatcgacctgggcttctgcttcgagccggcgcccgccgccgcgtgcgcctgcgcctgcgccgggaggaaccgcctcctggagacgctgcccgcgctcgacctttacta

SEQ ID NO: 27228 - DNA, 342 bp, Zea mays
  Clone ID: cC-zmle189110e01a1
taagcttgcatcctctagaccgcccgccctttttttttttttttttttttttttttttttttttttttctttccgtttgttttttaaatataatttcttcttttacacctaatactttataacacttcaaagaaaaaaacccctttctctttacaaccccaatttatataccttacaaaaactacacctttcatataccctaaaccatacacaggacatacgaaacataataacttaatctacaaacacaaaaatacttttacccccccaaacacaaaaaaaaacactatttctcacaacatactcacccacagcacaaaatataaagccttgcttacaaaa

SEQ ID NO: 27229 - DNA, 277 bp, Zea mays
  Clone ID: cC-zmle189110e01d1
gcccacgcgtacgcggacgcgtgggagaacacggtaggaattcatatctggttactctggcggtggcggtgtgtaagggctttttctttttctgatgtttttgctcttgtggcgatggtccacgcttgggtgtgttatctgtagagtgcacatttctaaagtagctgtacctgttgtgttataatgtaactgcattgggaactaaaaaaaaaaactaaaaatactataaagaaaaattagcaaaaaaaccgctaaaaaaaaaataaatttacctttt

SEQ ID NO: 27230 - DNA, 435 bp, Zea mays
  Clone ID: cC-zmle189110e02a1
caagcctccacgccttggttaaggacctttgtgctggttcccttgagggcgatgaacccatcgagatcatgatgatgtccggtgtgagccgcagcactagttatctggagggctgagaaatgcagttcatcaggggatgctgtttttgttggatgcactggcggatgtttcgtctccatgaattttaagcctcccaagttatcccatgaagaccctgcattgctcctcacttggccataaagtggttgactaaagaaaagatttgtccgctgccttgtatcataaaacattgtcgatgaattgaatgaaattggtgtctgcctgacgtttactactccgtgcattatgatgcatcagacgcctacgacagcttcggttggtctgatcaaactccgctaaaccttgaaaactacaaacagagaaaggattaaagaa

SEQ ID NO: 27231 - DNA, 578 bp, Zea mays
  Clone ID: cC-zmle189110e02d1
gacccacccgtgcggtatttgccaagttacttttttttggcatctttaatgatgttaggtagctttgaaaatgtgaccagctgagggcagggaccagccactcaagttgtagagcgaagtggacttgtgctagtctatatgatgctcaattattttgcttggctcagactctcatgatatttatgttatttaatcttttctaattaaggtacacaggaacgctagcatgaaatgaatagtgaagaaaaattggcaattccttttgtttctggcactagctgtaatggtgtaggactgcctaagtggagtgttgaactgttgatgcaacatcttgagaaggagaaattgtacacaagcttataactaacatttacactttgatctgttgttgacataatgaagctccatttccctcttttctttaatccttctctggttgtagttttcatggtttagcggagttttgatcagaacaaacgaagctgtcgtaggcgtttgatgcatcataatgcacggaggaggaaacctcaggcagacacaatttcattcaattcatcgacaatgttttatgatacaag

SEQ ID NO: 27232 - DNA, 331 bp, Zea mays
  Clone ID: cC-zmle189110e03a1
attaaataaacaaaaaaataaaaagtatgttattatttaccaatcaaaaccaatccacaaaccacaactcctattccacaaaaaaaaacccaaacactacctacaaccacataagaacacataactaacacaacccgctaccccaaaccaaccctaaaccacgatcactaacttacacaaacacgcacaacccaaaaaaacatctttaccccgcaggagacacaccaaaacaacccaccttaccctgcccgaccaaaaacgaacaatccatctccccaacccaaaacctgaatcgctcctacaacaccatatgcaaaataacaacatagca

SEQ ID NO: 27233 - DNA, 245 bp, Zea mays
  Clone ID: cC-zmle189110e04a1
ctttcttttctcttttttttttttttttttttttttttttttttttttgttttttttgtaaaacttttaccaaggaatgcccatgcatcacttttttattaatacaactcctattacctaattcaataaataaataaaaaaaatttttaaaataacaaaaaggtggcaaatgcacccaggctttccttggataccactaaattaaggttgttaaataatactcccttggcgaacattttccattt

SEQ ID NO: 27234 - DNA, 442 bp, Zea mays
  unsure at all n locations
  Clone ID: cC-zmle189110e04d1
tgggaggacccacccgtgcggtcttcctgctcgtcccgtgacgccgctcatcagatctgttcatgggccctgcgcgacgtcacaaactcgggtgggctagatgattatgcgagccgaagaacatggatcagagcgaaccataagatggtattggtggattaatcttgtggatgcatcaagctagcaccagaatgggagatgctcgccaagcgagtatcatctaacaacactaacctagtggtatccaaggcaagcctcggtgcatttgccaccttcttgctattttaaaaacttttatcacttatctactgcattaggtgataggagttgtatgaataaacaattgatgcattaccattccttggaatttgattncnnnaaaaaaaangacctggngatcaacaccgngaagacttgtatcaaaaaacaaaaagggcggccg

SEQ ID NO: 27235 - DNA, 279 bp, Zea mays
  Clone ID: cC-zmle189110e05a1
gcaaaaaaaatacctatataaatgtttcatggggaaggttaaaattgcatttgcctttcgcccaccatgtaagtatgcttacaattacaagatggtaagtgtttacatatgatagctacaaaatctgtaagaatcaaagctcgctatgtggatcttttaaatccagaaaaagaatgaagacactgcagtttaatagttcacgaatccaatatgcgaacaacacctctgcacatctaacatctcatcgtggttgccttcaaggtgagggcttgtcatttc

SEQ ID NO: 27236 - DNA, 489 bp, Zea mays
  Clone ID: cC-zmle189110e05d1
gacgacccacccgtgcggagcaaaccaagtccatcctaagaattggtaccccattcttctggtattctgccgtccatggggtaaactgccggagaatgttccttgtcatccaaaacttgcacacttcgctaattgtatgaagaagaagggtcgcggtatgtccatttttgtctcgataattgatggtgattatcatgaactagctgaggatgcaaagactgcctgccgccaactagatgcttatattgactacaaacgctgtgagggtgttgcagagatcattgtagctcctaatatgtctgatggtttccgtagcattgtgcagacaatgggcctacgaaacttaaaaccaaatattgctgtgatgcggtaccctgagatctggcgacgtgagaatttgacacagataccgtcaacactttgtcagcataataaatgattgcatttttgctaacaaggcaatagtcattgtgaagggactcgatgagt

SEQ ID NO: 27237 - DNA, 236 bp, Zea mays
  Clone ID: cC-zmle189110e06a1
acaacaaaactacctttttcacgggccaattgagaatgttcaaaatcattttacctaactcccctcatatcagaaaacttaccctctctctaagacaagccaatacatctgataacaacatcccttgtaaatataaaagatcaatatatcaatcttttaaaccctgaataaatatcatccaaccatgttctaaaacctactgactgcattcactttacatcacatgtactcatgta

SEQ ID NO: 27238 - DNA, 307 bp, Zea mays
  Clone ID: cC-zmle189110e06d1
gacccacccgtgcggagatgacccagttcattctaaaaaaagggccctccatattcttctactgtgccgcccatgcggtcacgtgccgggacatgttgatgggcctgcaaaacctgcacactaaactaactccctgcaaaaaaatcaacacatcatggacattcgtggcttgatactagaagcagaacatgcaataccccgccgaggctgccaaacctgactgcccccgactatatgctcacatacactacggatgctaacaacgggttacacatactatacagacctcccccatgccctgtgaaca

SEQ ID NO: 27239 - DNA, 240 bp, Zea mays
  Clone ID: cC-zmle189110e07a1
accaaacacttacctaaaatttatgtgtaatcttgtgaacattccctaagcgaaatcactgctaaacatacaaccaaaatgatactgcacatgccactatatgtataacacaactcatatttccttattctctataacatttgctacaaataaccatgcacacaaattcacttacgtaacaacaacgtaaactcgcgcacatacaaatgcatccacttgtaattcacgcttatatatata

SEQ ID NO: 27240 - DNA, 452 bp, Zea mays
  Clone ID: cC-zmle189110e07d1
gggcagtcacacttgacgctgccccagttcaccatcggttttttttcatgacttctacgacatctcattcatgaacggttacaacctccccatggccttctcctgcagaaccagcctgcggctggtagtcactgaccctgtatgcccccacccataccacaacccccctcacatgaagacccatgcctgtggcgccaacaacagctaccaagtgaccttctgcccagtcatctgttcaaataaactctgcatccatagcctagtgatttggatatcgcaggaataattctgatctccatgagcacaatattatatatataacacgtgcattacacgcgcacgcacatgtatttacgcccctatacaacatacctacctagctagatctttgtgcctgcctgttctgtccccatattaatacaaattaacaaacatcacttcgtgtcatacat

SEQ ID NO: 27241 - DNA, 202 bp, Zea mays
  Clone ID: cC-zmle189110e08a1
aaaaaaaaagtccctctttacctcaataatccataacccagggagcaaaggtggtctctacaccctaaaagccaaccccatacaaaacaccactttttttttaacttaaccccttaaaatatccctttttaaccttcttaaaaaacactccttacaaaaaccaaccaaaccctgcctggtggcaaattccaacccttgcaaa

SEQ ID NO: 27242 - DNA, 466 bp, Zea mays
  Clone ID: cC-zmle189110e08d1
cacccgtgcggcgaattccccaatcggactctcctcttcttgccggatcttcctaccccattccaccccgcccatggggagcccgacccctcgccgctgacctgtgggtacactgccccctgctcccccgccccgctcccgctcgcccacgcgaaccctaggcagctaggctttgctgctagaagagctccagcgaccgacgaggagaggagaataaagctcaaatcttggatgcgcccgaaccgatggcgacacctgccgcagagaagccggaagatgtagagatccgtgaggtttgggcggacaacctcgagacagagttcgccgtgatccgcgacatcgtcgacgactatgcgtatgtggctatggacactgagtttccgggcgttgtgtgtcgttcgctcggcacttacaagtcggcggtcgagttcaactacgccactcttaaagctaacgtggacatgct

SEQ ID NO: 27243 - DNA, 349 bp, Zea mays
  Clone ID: cC-zmle189110e09a1
gacagatgacgatatataaaaggaccgcgtattaagagattgtctgcgcctcggcagctttgtatatatatctattacacattacacatgtatggtagccggagcttgcattcacatatatgttcctcacccaacgaatcgacagtcgttgcactacgtacgtaattgtagatggatgatgccatgctggatacatcagcaggagaattgttggaagcaaaaggaaccattgcatgcaggagaaaagaaatgatgagataaagggaaaaaaaaggagggagagagagagaggaaccaatgcaagaaggtgatccgatcaacaagcagaggcatggccatgggtcgatct

SEQ ID NO: 27244 - DNA, 425 bp, Zea mays
  Clone ID: cC-zmle189110e09d1
tgcggcacgctccggcagacgcagtgcgtcagcttcatctttattgccccccggcagcgagtagagacggggggtagatcgacccatggccatgcctctgcctgttgatcggatcaccttcttgcattggttcctctctctctctccctccttttttttccctttatctcatcatttcttttctcctgcatgcaatggttccttttgcttccaacaattctcctgctgatgtatccagcatggcatcatccatctacaattacgtacgtagtgcaacgactgtcgattcgttgggtgaggaacatatatgtgaatgcaagctccggctaccatacactgtgtatgtgtaatagatatatatacaaaactgccgaagcgccgacaatactttaataactggtccttttatatatcgtcatctgtct

SEQ ID NO: 27245 - DNA, 454 bp, Zea mays
  Clone ID: cC-zmle189110e10a1
ttttaatttatctcaacaactgaaataacataccgaggcataccgccagcgacaatgtacaacatgttcactccatgtccagcctcatggccacaagttgtacatcaaagcagcagacaaaacaaagctagaacacagacgtacactatcctaacgctctatgagacggcacaaggcaaaacaaatgctcccagaccatttggtcaaaacctgaacaactatgtcacgcgacacaccaggtcttgtcgtcgcgatgcgtcatagggtgcatgatagactatgctccaactcaagcagtcgcaatgggtttccgatttcacagttggacttccctaccatatacccagctgaaaggcagcgtgcctgctttcttggctctgctctgggccctctcgtctagcctccggatccttgaagcaagggtgcagaggtagtcctgcgccttgttcccctc

SEQ ID NO: 27246 - DNA, 475 bp, Zea mays
  unsure at all n locations
  Clone ID: cC-zmle189110e10d1
gtggcggaccaaactggtctgtctgctgtggttaacaaggcgcaggactacctctgacgcttgcttaaggatccggaggctagacgagagggcccacagcagagccaagaaagcaggcacgctgcctttcagctgggtatatggtagggaagtccaactgtgaaatcggaaacccattgcgactgcttgagttggagcatagtctatcatgcaccctatgacgcatcgcgacgacaagacctggtgtgtcgcgtgacatagttgttcaggttttgaccaaatggtctgggagcatttgttttgccttgtgccgtctcatanagcgttaggatagtgtacgtctgtgttctagctttgctttgtctgctgctttgatgtacaacttgtggccatgaggctggacatggagtgaacatgttgtacattgtcgctggcggtatgtttcggtatgttatttcaattcgtgacaactgtt

SEQ ID NO: 27247 - DNA, 366 bp, Zea mays
  unsure at all n locations
  Clone ID: cC-zmle189110e11a1
ctctttttaataaatcatacacaaaggtcacctttttggatctttgagacacattttaatacttaaagacctacaccatcnanattcntaagaatacacacnttacctaacggaaagctcacttccacccactttaantggattctgaacacaaataagccaaagcaatagcacacatgttggctgacgcacatctctctcacagcaacaatgacacaatggtccgttaagcatccatcgtggccgaggccgtggcattggccgggccttctgcctccgaagccaccatctgggccatgttctccacagcacatatcctgcccctgtccaatccggccgtcaggtcctctacttccattttcacca

SEQ ID NO: 27248 - DNA, 304 bp, Zea mays
  Clone ID: cC-zmle189110f01a1
caatccttcacgccttggtttaggacctttggctggttcccttggggggggaacccatcgagatcatgatgatgtccggtgtgagccgcagcactagttatctggagggctgagaaatgcacttcatcaggggatgctgtttttgttggatgcactggcggatgtttcgtctccatgaattttaagcctgccaagttatcccatgaagaccctgcattgctcctcacttggccataaagtggttgactaaaaaaaagatttgtccgctgccttgtatcataaaacattgtctatgaattgaatg

SEQ ID NO: 27249 - DNA, 448 bp, Zea mays
  Clone ID: cC-zmle189110f01d1
cgacccacgcgtgcggtatttgccaagttacttttttttggcatctttaatgatttaggtagctttgaaaatgtgaccagctgaagcagggccagccactcaagttgtagagcgaagtggacttgtgctagtctatatgatgctcaattattttgcttggctcacactctcatgatatttatgttatttaatcttttctaattaaggtacacaggaacgctagcatgaaatgaatagtgaagaaaaattggcaattccttttgtttctggcactagctgtaatggtgtaggactgccttaagtggagtgttgaactgttgatgcaacatcttgagaaagagaaattgtacacaagcttataactaacatttacactttgatcctgttgttgacataatgaagctccatttccctcttttcttttaatcttctctgtttgggagttttc

SEQ ID NO: 27250 - DNA, 268 bp, Zea mays
  Clone ID: cC-zmle189110f02a1
atgcccgggaggagagttaattctaaatagctattaaaattccctgcatattgtttctcatttacatcttgcacactgttcattttccatacatacaaacttactctaataaataccagaaacctcggggcagttccttttcactgccatgattttggatgtctccccattacacactgtacaccttaaaatatcgcgcacctgttcatgccaatagaccagaaaatcattcttgcttaggtccacaaacttccaaaaagcccttgct

SEQ ID NO: 27251 - DNA, 283 bp, Zea mays
  Clone ID: cC-zmle189110f02d1
cgacccacccgtgcgcccgggcttcttggcagcttgtggccctctgcgaggatgatcttttcgtctcttggcatgaacaggtgcgggatggcgtctgaggtgtccagtgtgtactgcggagacatccaaaatcatggcagtgaagaggaactgccccgaggtttctggtatttattagagtaagtttggatgtatggaaaatgaacagtgtgcaagatgtaaatgagaaacaatatgcagggaattttaatagctatctaggattcattatcttccacggcat

SEQ ID NO: 27252 - DNA, 329 bp, Zea mays
  Clone ID: cC-zmle189110f03a1
caccaaaaaaagctgggtgggacatttaaactgccggccggccattgtacatcatacatttgcttacaaaaaaagtgcatccttaattataacactgggatgggattccaccttcaccattttttatggggtttccctaaacacaccggatgactgaacacgacttaaagagcagcagtaaactaacagctgcattttgttatattttttggccattttttttacttgcttgctatacaaaaggaacttctacagtcgagccacactattcactaactcgaaccaccgttacttctacttgaaagagcacaccacgacagcggcggcag

SEQ ID NO: 27253 - DNA, 429 bp, Zea mays
  unsure at all n locations
  Clone ID: cC-zmle189110f03d1
gggacgacccacccgtgcggcatgagcgccgtggctgtttcgtcgtcgctgaacccggtcgctccgctcttcatcccggcggcgctggtgcaggtggaggacttctcgccgcagtggtgggacctcatcaccaccactgcctggttccgcgaccactggtcccgcgagcgcgcccacctggacgagatggccgagcagatcgacgcggccggcctccccgacgacgaagacctcttctacgacgaccagcccgagcagggccccgtcgctgccgccttaagacagattcggctcaggcctgaacatgacctcccgaaggcgggcgacccccgngnggttccgggagaaacccaggaacgccgagaagccgaccaagtacgccggcagccccaagagcagcgccccccgcgtgatccaccagcctcgcta

SEQ ID NO: 27254 - DNA, 266 bp, Zea mays
  Clone ID: cC-zmle189110f04a1
ctcttttttctctttgctttttttttttttggaatacgtgggcatttgaggttttttaaactgatagaccctcgggcacccacctgacttgtttctgttacatctctgtaacataaactgctatgtggaggaaacagcaaccgtttcacctaatgaactatgcgacgctgctactactcctcttgagctttggaactctccaatgcattgtatcagagctcactatcactctctgcctttgcaccgccggatgtcttcccgttgac

SEQ ID NO: 27255 - DNA, 362 bp, Zea mays
  Clone ID: cC-zmle189110f04d1
gggacgacacacccgtgcggaaaagaggaagctaaagatacctgcaaagatgggttatggtgatcgaggctccccaccaaagattccagggggggcaactctgatcttcgacacggagcttatcgccgtcaacgggaagacatccggcggtgcaaaggcagagagtgatagtgagctctgatacaatgcattggagagttccaaagctcgagaggagtagtagcagcgtcgcatagttcattaggtgaaacggttgctgtttcctccacatagcagcttatgctacagagatgtaacagaaacaagtcaggttttgcccgatggtctatcagtctatgcaaccccgactgcctacgtactcc

SEQ ID NO: 27256 - DNA, 411 bp, Zea mays
  Clone ID: cC-zmle189110f05a1
ttttattttaccccgccatcgttttttttttctgcgttaaaaaagacatcatttacattccgcgtggcatgtttcacaattcacgcgcgcacacgcacacacatgcagacatgctcactgatgcattactctgtgcatttttcttttcctatttccggtgaagaatcctaaaaactgtgggtacagatgagaggtcgcttctgacggacgcaacgcaacgcaacgcaacgcagcattcgtgcgcttattcaactgctagcttgcagtatcttcagctgcagtcgacgacactagcccgccggtgctggtggtctcttgctgagctccctcggcctcctcggtactacgactactactgggcgcgtcaaccaccaccgtcttccttacacggaacatggccaagtggatgtc

SEQ ID NO: 27257 - DNA, 494 bp, Zea mays
  Clone ID: cC-zmle189110f05d1
tgcggtgcattccgtgtcctgtcctgtcctgatggaagcagctttgtttgccacgtcctccctactccttgcctgcgggtccaggaggtggccagcaaccttgcctccttccccctggccccagcagcagcgtctggttttctgcctcgctgcaagaacgaggccgctggacagcaagaggggtagctggaggcgctcttccagtgccaccggcggccggtcgaccgccgtctcgtcgtcgtcggaaagatgggttctcgaccctgcaggagacggtgactggcgccacatcggctacaaagtcgcgcgccctgtggcgatcgagatattctcggaggacacggcggtgaccgttggccggttcgccgacaaggcggacatcgtgctccccatcgccacagttttaggcgctcacgcccggctggagaagaatggtggcagcctgctggtgacggacctggacagcaccaacggcacctacatcaacgagcgcc

SEQ ID NO: 27258 - DNA, 357 bp, Zea mays
  Clone ID: cC-zmle189110f06a1
ctcttttatgtgaccccgccatcgttttttttttctgcgttaaaaatgacatcatttacattccgcgtggcatgtttcacaattcacgcgcgcacacgcacacacatgcagacatgctcactgatgcattactctgtgcatttttcttttcctatttccggtgaagaatcctataaactgtgggtacagatgagaggtcgcttttgacggacgcaacgcaacgcaacgcaacgcagcattcgtgcgcttattcaactgctagcttgcagtatcttcagctgcagtcgacaacactagcccgccggtgctggtggtctcttgctgaactccctcggcctcctcggtactacaactact

SEQ ID NO: 27259 - DNA, 464 bp, Zea mays
  unsure at all n locations
  Clone ID: cC-zmle189110f06d1
ggggcattccntgtcctgtcctgtcctgatggaagcagctttgttctccacgtcctccctactccttgccggcgggttcaggaggtggccagcaaccttgcctccttccccctggccccagcagcagcgtctggttttctgcctcgctgcaagaacgaggccgctggacagcaagaggggtagctggaggcgctcttccagtgccaccggcggccggtcgaccgccgtctcgtcgtcgtcggaaagatgggttctcgaccctgcatgagacggtgactggcgccacatcggctacaaagtcgcgcgccctgtggccatcgacatattctcggaggacacggcggtgaccgtgggccgggtcgccgacaaggcggacatcgtgctccccatcgccacactttcaagcgcttacgcccggctggagaagaatggtggcagcctgctggtgacggacctggacagca

SEQ ID NO: 27260 - DNA, 390 bp, Zea mays
  Clone ID: cC-zmle189110f07a1
ttttcattaagaaattcggcggctcatccataaatggatccattgacgatgttatccgtgtgaaattaagttatgtatgtatgtatgtacattgatagatagagaatgtctttcatcatcgtaaggtatatgtacatcggtagatagagacctgagtctgacagactcgggcgcggcgacgagccaacgatttgattgatctccgcagtcgtcaacggaaggatggatcagtagacctcgacgttccattgctcgcccttcttgagctgcttcttgtactgcatccagtcgatcccgtccttggctgcaaggttgagcatgatgtcgtcgatgcccttctccatgcccttgagcccgcacatgtagacgtaggtgttgtccttcttcagc

SEQ ID NO: 27261 - DNA, 392 bp, Zea mays
  Clone ID: cC-zmle189110f07d1
cggctgaagaaggacaacacctacgtctacatgtgcgggcttaaggtcatggagaagggcatcgacgacatgaggcgcaaccttgcagccaaggacgggatcgactggatgcagtacaagaagcagctcaagaagggcgagcaatggaacgtcgaggtctactgatccatccttccgttgacgactgcggagatcaatcaaatcgttggctcgtcgccgcgcccgagtctgtcagactcaggtctctatctaccgatgtacatataccttacgatgatgaaagacattctctatctatcaatgtacatacatacatacataacttaatttcacacggattgcatcgtacatggatttatttatggatgagccgccgaatttcttcttgaaaa

SEQ ID NO: 27262 - DNA, 305 bp, Zea mays
  Clone ID: cC-zmle189110f08a1
aaaaaaggcgcttaagatgcgaaatttatatttacatggaactcacaaacctacactaccagagtgtagggcaacaagaggccagtggtgtttgaccgcccatcataaaagtagtttcacaaacatgagatgtcccatgatccaccacagatagggttcctattttcgtctatgtcgatgaccagcagatgatctggattcgaaccattcggcccctctttgtacagcgttggcaaatattcatggtatgccggtaggtagcgtgatacaaaatccataacctcctcatcagacattccaggctt

SEQ ID NO: 27263 - DNA, 543 bp, Zea mays
  Clone ID: cC-zmle189110f08d1
cggctcgccgtcgctgccgctccctcgtcgagaaaagcgtttttgttttgcccgctgctgggccactggacgacgggcgcgccgccgcgcgccatcccctcctcgtcgtcgtcgtcgaccccggcgctcatcgcgtccgtgcaggacctgtatgacttcatctgctgcggcccgctggtggacaggatcggctacaccagtgagaagatcaccgagtccatcgaccgctggcttctcgccggggctagggtggcgcgcctcttccgcctcaacgagctccagctgtcggacgccgagaaggcccggatataccacttctacatccccgtcttcctctggtgcgaggacgaggtcatggtgcacagagccaggtacaacgacggcgatgacatcccgccattggtgatcggggtcagcgctccccaaggaaaggggaagacgactcttgtgttcgcacttgattatctttttgggttgctggtaagaaatctgccacattgtctatagacgacttctatctgacagcaaaagaacaaaatgaat

SEQ ID NO: 27264 - DNA, 421 bp, Zea mays
  unsure at all n locations
  Clone ID: cC-zmle189110f09a1
ggaaatccgaaatcctgagcgcaggaggttctgtttatccgaaaacaggcttcttttatcgtcgtgagtgtttatgcggttcataaaacacaagtgtacaacatgagaattctcgtatgctctgactcagcttattcaatccacttacacatcagccacagatcgttaccagtggctgctgctacaaaagcgatactgatgtctgcaagcacgtggggtatgtgtagcttgaattttttttgacatatctgnggttctcttcttcttcttcagtgttctgacgttctgtcatacaacgtagcggtatgtaacgtatctgcccgccgtctcgctgggcctgatgatcttcacgacctggcctcgcctcaggccgtagtacctagcaataggatccgtgatctgtattcttggaagctgagtt

SEQ ID NO: 27265 - DNA, 497 bp, Zea mays
  Clone ID: cC-zmle189110f09d1
gaagcagaggaagcgaggcggcgggggcggagatgtcggttggtttggtgaccgacgaggccaccgtggggggggtgtaccggatccggcgcacggtgatgcagatgctccgtgaccgtggctacctggtggtggaccacgagctcgccaccagccgccgcgacttcctccgcaagttcggcgagtccttccaccgcgaggacctcctcatcaacaagtacaagaagaacgacccatccgaccagatatatgtcttcttccccaacgatgacaaggtagggatgaagcacatcaagaagtacgtcgaaatgatgacgcacgagaacgtctccagagctgtgctggttctccagcagaacctaactccgtttgcgaagtcgtttctcatagagctggagccgaagatccatctggaaatttttcaggaggccgagatgcttataaacatcaaggaacatgtccttgttcctgagcatcaggtgctcacaaacgaggag

SEQ ID NO: 27266 - DNA, 424 bp, Zea mays
  unsure at all n locations
  Clone ID: cC-zmle189110f10a1
aatacaaggccaangtaggggagtaaatgcataggcttaataactgtancacatccattgttaaggctgccacatcgaagaggctacatcagagacattcctgcagttacattgaactgcaacatttttcttaaaatgctaactgtttgcaccatcatctgagtgcaaaagtttgtgctcagaaatcgcgtatcattttcttgctatcgngggacggattatatcaaacatttgtgctcaggcatagcctgctatttctagtcgccggtgaccctccacggacgacccccgtccgagctgctacacgcttggttgacaagaaagctgtctccgtagtcgctggccagcctcatttgcctctcttcctgcggcgaaagaatcctgatgcaccgcacgcagttcacgaagtcctcccatgggtcat

SEQ ID NO: 27267 - DNA, 456 bp, Zea mays
  unsure at all n locations
  Clone ID: cC-zmle189110f10d1
cgttgagggaagcagttccagatagcgagtttgaggttacatatgcaggaaataactttctatttgcggcaggattgatggccatatggagcctcttaacgaagacgatttgcttggaactgccttcgaagctgacaagtacatggaacagatgccaggaaacggcatctctaactacatttcatcaaaggattctcagcaagagttatcatcttcaatgatctcacatccatttggcgttgctgatatcgcgttcaattccatagattcgtcgatcaatgatatccaattcttaaacagaaattcccgggctccaggtcctgttcaacaacgtatgcgaacatacaccaaggtgcacaagcgtgncgctgttggaagatctatcgacatcaacagatattctggttacgatgaactgaagcatgacgttgcccgtatgtttggaattgaggggca

SEQ ID NO: 27268 - DNA, 450 bp, Zea mays
  Clone ID: cC-zmle189110f11a1
gggagggagccatcaccaggggggggtttggtcagtttaacattttacaacatgcgtacagcgcatccaagcgtttccttggttatttcctactccagtccagcatgtgccaccgattttgaacacacacactgagacttgccaacttcctcaagcctcccgcttatgcttatgtctccagcaaatgtacattggcgcggtggggaagcatacctgccaccgttatatgccatctcgtcagtagcatggtcttcacaaacttccttgcacctcatgtcccgcttaagtaccttttgtacttgctttgtgcgagacttagtaagaagtctgtgaacatgcgctcatatcctggcattttgccgtaacctgggaagtacttgatatcaattatgtagtaccgatctttggttccaagttctctaatcatatctatattgaacaatctcaaac

SEQ ID NO: 27269 - DNA, 358 bp, Zea mays
  Clone ID: cC-zmle189110f12a1
agcaaccacaacaagggtgaacgtgcaccatgttattttattcaggcagagtgccgtgccctttgcattacggtattccattcagttacaggtgaattaatacctgtgtaccgccaaccggatttacttaaagaagccaaatttgtatcgctgccaattccacaaacagaatttgcagacttttaatcaccagactgggaacaaacaatggaccgactgactcaagatgaaaacaaaacaaggtatagaaataggtcgtgattgtcgacgatgttgtgtccgaagaaagtcccgataatattattcacagcagtcatgcgctctttttccttttctcctcttcaatcttagccttaat

SEQ ID NO: 27270 - DNA, 225 bp, Zea mays
  unsure at all n locations
  Clone ID: cC-zmle189110f12d1
cccacactatactanaacgccctnccttactcttgggaatttctttttgacacctccattaccatatctagggcttggtatttactcttacctcaaacctaatattcaaaaatataaattcaaaaatatctcataactacatgaaataatattatcttgaccttcactccacacaacatcatctacaatcactacctacttctataccttaacatcttaacatct

SEQ ID NO: 27271 - DNA, 216 bp, Zea mays
  unsure at all n locations
  Clone ID: cC-zmle189110g02d1
gcggggacacattttcaaacgcacancatcggcaggcatctttgcgtccgtgccagcgacagaccacacagcagctgcttcttttacaatgccgaggccatgattcatcttgacttctccgccgtccatccactgctgccattaccatctcccaattccagacatgctcgccctcatcttctcgttacacgacttccacttctctgcctcaaccgc

SEQ ID NO: 27272 - DNA, 224 bp, Zea mays
  Clone ID: cC-zmle189110g03a1
tttttttttttttttataaacttattaacaatcggtagagattaatttaacctatgtaaacaaacttcacatccatccctcataatacacacatatttacctaccaaattttatcacaacacacaagttatttcattcactacaataaccttcagcacttccaaaataacaccattgaaaaacaccttacatccctttcccacaaaatgcttccccacacctat

SEQ ID NO: 27273 - DNA, 221 bp, Zea mays
  Clone ID: cC-zmle189110g03d1
cgacccacccgtgcgcccacgcatacgcgtacgcctgcactcataacttacacctttatttatctaactatcagcaactcactggggaggggatgcaagcaccaccacaaaattctaacgcctctatcaatataaataactcaccatgacatattgatctcgtataaaaatgaccatttcgtatattaccaaaagacttcccagaaaattcataagagaag

SEQ ID NO: 27274 - DNA, 273 bp, Zea mays
  unsure at all n locations
  Clone ID: cC-zmle189110g04a1
ctcttaaaanaacaaaacatatcatccggggccaattgatatatttttatcaaagatgcacccggatcacccaacattcaggttgacacacctacgtacataaacacaaatactgacccccaacatgcatacagagatagcaaactgaaaaactgtgtttctctgtctttcacacacaccacacaatacctatgtattgcaggaaacataagcctagcttattatttttcaacccccaccacaagctaaacaataaataattatattcaacgc

SEQ ID NO: 27275 - DNA, 329 bp, Zea mays
  Clone ID: cC-zmle189110g04d1
gttgtttcattgattcttgaagagatcgagcttcttttgttcctctaaggtcgaggatgtcttgcaactgcggagggaggctgcggctgcggctcaagctgcaagtgccgcaagaagtaccctgacctgcaggagacgagcaccggcgcgcatgccaccgtcgacctcggcgtggccccggacaagaaggccgcgcccgagttcgtcgaggccgctgcggagtccggagaggccgcccaccgctgcagctgccgtggcaactgcaagtgcgacccctgcaactgctgatcacatcgatcgacgaccatggatatgaacattatctatct

SEQ ID NO: 27276 - DNA, 339 bp, Zea mays
  Clone ID: cC-zmle189110g06a1
ttttagctttacgaattagttttattcaggtcacgagcttatggggcgaattgtgacatgatctgagtgcgtgcacgtacaatagccaagtacgatgaccctgcacaaccagtcaaccacagacatacataaggcacgcaggcaagcacgaacgggcgtggatgccggccgccgggcggctcacttagccctggcgaggaagctctccctgcgctcgtggacctcgccggtgcaagtgttgatgtcctcttcgaccctggtctcgcgcaccacgaagccgtggccgccgtggtgaccatggtggtggtggtggttggcgccggcgcgtgagaccgtgtc

SEQ ID NO: 27277 - DNA, 443 bp, Zea mays
  unsure at all n locations
  Clone ID: cC-zmle189110g06d1
ggatgatgtgaaggatatgaaaccactgaatgatcgcattctgtttaaggttgctgaagctgaagaacgagactggtggtggtttgctattgacgcaggcaactaaggagaaaccttctgttggatcagtggtagccgttggcccagggccgttgggcgaggacggcagcaggaatcccctgtcgatcactcctggaagcaacgtgatgtattccaagtatgcggggagtgagttcaagggcgaggacggtgagtacatcgtgctcagggcgtctgacgtgatggctgttctttcctgatccccaaaccatacagcgccaggtgcgcgataggaagttttgatgttgaagccgaaccttatcttttatttgctcttgtttggaaattggtggaggccttttgaactgntattctgggtgcgcattataagggaaaataagccg

SEQ ID NO: 27278 - DNA, 365 bp, Zea mays
  Clone ID: cC-zmle189110g07a1
atattctcatatcatacccaacaagccatcttgaaaatttttaacaccgtaccccccccaaccccccaaaaaataaaaccccacacacaaaaacccttcttaaacacaaccaccgcctttttaaacaactgtcctggcaacctactaattttaccatacttttaaacctaaatcacacaacccaaaacaacaagagctccacactaaaacaagaggacaaagctcccccacccacctatccatccattgtaaccctccccaacccaaccgtatcgcataacacttacacctgaatccaaccataaatatcttacccctacctctaagcaaaccaccttttcctataaaaaatcaaattaaaactt

SEQ ID NO: 27279 - DNA, 199 bp, Zea mays
  Clone ID: cC-zmle189110g07d1
gtgcgataagttcagacttctctttactgccatgctcaagtctgtatattgccaaaacccaaaacgattgatcaagtgggctactgcagtgaaatagcaggatacgtatagtttttttttcaagggaaacaggaggggagtgcagtgcacccccgcccatactgcatgttattaataaaagaaagttatttacagaaaa

SEQ ID NO: 27280 - DNA, 414 bp, Zea mays
  Clone ID: cC-zmle189110g08a1
tttttatttgggccttttgtatacttattaatatcattttaaagcagaattggggtccgtcctctatcactgtcatcacaattgattccttctctccaaaggggggaaacggaatataaatacatcttttgttctgctgtaatagatactacaagtagagtcaaatgcaatacaaatgcacgatttttccatgagcagagtagtacaatcacatattaccatggcatgccatgatcaatcgtgcatcacaatcaagccatagcataaacatgtactccgtcccggtttccttcacttgaacatggagatgtcaaacacacgggcggagccatctgatgaggcggagaccatggtgttgccgtcggcagtgatagccagcgactgtactacatctgcatgcccactgaactccct

SEQ ID NO: 27281 - DNA, 81 bp, Zea mays
  Clone ID: cC-zmle189110g08d1
gcccacgcgtccgaaaaaaaaaaaaaaaaaaaaaaaaaaatttaatttaaaaaaaaaaaaaaaaaaaaaaaaggaaagggg

SEQ ID NO: 27282 - DNA, 357 bp, Zea mays
  Clone ID: cC-zmle189110g09a1
ccttttttttctctttttttttttttttttttttttttttttttttaagtttttttgtaaatttttaaaaaaaaaaacccccatttaccccccccaaatttccataaaagggtttcaaaaatcccttaccttttttaaaaaaaaaactcctttaaaataacacacccccaacccttaaaaaaataaaaaattggccaccccccaaaccttaaaaaaatcaaaaaaaaaaattttttaaaaactctcttttattaacaaaaaaaagaaccccatctattttaaaaaaaaccccttttttctaaaaatttataaaaaagggctttccttaaaaaaaaaaaaaatcaattccccggcatt

SEQ ID NO: 27283 - DNA, 441 bp, Zea mays
  Clone ID: cC-zmle189110g09d1
gccacgcgtccgatctctcttcgtcactagctcgtggttattaatttaagctcgatcatctttccttacgaggggggtgaagagcagcacaatcgtcgcgcttctgttggctgttgccattctgtcctcgctgtctccatgctacgaagccggcggctgcatcgggaaacccaagaagtcaccgccgccgccgagaaggccatacctctcgtcctattccgaggaccaccagaactgccgcttgatctgtagctcgaagggtttcaaggacggtggctggtgtgacgaaagcgtcgagcacaaagtgtgctgctgctcccattaaaaatataatatcgtatgttatgttgatgcatatatatgcatcatccatctacctgtggtggtgcaaacatctgaataaaatctaccctgtgtggtgcaaaattctgaacaaaatta

SEQ ID NO: 27284 - DNA, 310 bp, Zea mays
  Clone ID: cC-zmle189110g10a1
acgacgacacaagtgatgatactatggaactgttggattgattttaagaaaactaccactagggcataattacatctttgggaatatacacatccgatgcttgagggactcaatgatgcaatcggacctgtgccaattagcacaagagaatgcggtcagccagaatatcactttgacgcaacagtagcagccaaggcattgcgccagactagcagttcataacttttcacgacaggacaggacaaaaaaccggacttatcgaacatcatatcactcttgaaacccattttgagaatcttcttggcaaata

SEQ ID NO: 27285 - DNA, 73 bp, Zea mays
  Clone ID: cC-zmle189110g11a1
tcctctatagcttcctcccttttttttttatatattctcttacctctataaccaactaacaaaaaaacccacc

SEQ ID NO: 27286 - DNA, 285 bp, Zea mays
  Clone ID: cC-zmle189110g12d1
acatccacaataaaccaccctttttttgcacacagcctccaccaccttactgcatgacctttctctatctgtcttctatcgacaacaacatcatagatatacagtatctaccataggcgtttagaataggattatcaccacaacttcgtctttcctgaaccccaactcgccgctcttcatcccttcttcgtaccgtcatgtgtatgacttctctcccgaatggtgtgagctcgtcaacaccacctcctgcttcctgaaccacttcttcctgcagttccagctcca

SEQ ID NO: 27287 - DNA, 254 bp, Zea mays
  Clone ID: cC-zmle189110h01a1
cccccaaaaccaaaagggaaaactctccttctaattttttttttaaaaccacccccttgaccaacccttggtcaaccccgaaaatttcgaacccgaacctgaaggcttcccaatttttcttaaaaaaagccaaataaaaccttggccaaaaaagggtaaaaccttttccccgaaaaaaatttttatcccttcaaaattccaaaaaaaatacaaccgggaaccataaaatgaaaacccctggctcccaaacgagg

SEQ ID NO: 27288 - DNA, 392 bp, Zea mays
  Clone ID: cC-zmle189110h01d1
gacccacccgtccgcccacgcgtcctcttaaaaaaaaagataagaagcaccctttcctttttcactttgagcgaaaaaaaaaaaagaaggtttacttaaaaaaaaaaaataaaaaaaaaaaaaaaaataatatttaaaatataatatattattttttttttaaattttgtggccgcccttttttaagtttccaactttccttccccttccttccaccttttttcttttttttttgtgtcccctaatttcatttccttgcccttccttttccacctttctattttgaaaaccctttcctttccccaccttattcccttttcaacccttccccttttccccacttttccttttacccaaaaggcccccccccttcccctttcccaccattttcc

SEQ ID NO: 27289 - DNA, 392 bp, Zea mays
  Clone ID: cC-zmle189110h02a1
gcgcctcaaaaagggggagttagctttggagccacagattcattaccatcaaatccattacatgcacaaggctgcatatacttcatgatgtccggtcaaaaactagatggtcctcgccatcactcttccgcttataacaaaattttgtccattggaaaagtctaacataagcataaaaaatggcagagaatgaatctgggatctcaataacatcttgcacaccatctgatcacaaccggaaataatggccatttcactcttcctcctggctgcggagcctggcaagcttgtttgtgaccaccatgtccagttgcccagcacgttcgacgatctccttgcgcttccgggtggacacgttgtgggcaatctaggcacattatgtcctgttgtgc

SEQ ID NO: 27290 - DNA, 581 bp, Zea mays
  Clone ID: cC-zmle189110h02d1
ggcgacccacccgtccggcgcctctctcgcccgcatcgccgcagggttcgcaaagatggctttgccgctgctgacgcagaagatcgtgaagaggcgggtcaagcagttcaagaggccacacctcgaccgctacaagtgcctcaagccaagctggcgtaggcccaagggtatcgactcccgtgtcaggcggaagttcaagggatgcaccttgatgcccaacattggatacggctctgacaagaagacgaggcactaccttcccaacaagttcaagaagtttgtcgttcacaacgtctctgagctggagctgctgttgatgcacaacaggacatactgtgccgagattgcccacaacgtgtccacccggaagcgcaaggagatcgtcgaacgtgctgcgcaactggaccatcgtggtcaccaacaagcttgccaggctccgcagccaggaggacgagtgacatggccattatttccggttgtgatccgctggtgtgcaagatgttgctgagatccgagattcattctctgccattttttatgcttatgtagacttttccaatggacaaaattctgttttaagc

SEQ ID NO: 27291 - DNA, 383 bp, Zea mays
  Clone ID: cC-zmle189110h05a1
ttttgagttaggtattattattacgaagaagttttattcacgtggcgagcttgtggtcgtaattcgtacaggagctgagtgcgtgcacgtacgatagccaagtacgatgaccctgcacaaccagtcaaccacagacatacataaggcacgcaggcaagcacgaacgggcgtggatgccggccgccgggcggctcagttagccctggcgaggaagctctccctgcgctcgtggacctcgccggtgcaggtgttgatgtcctcttcgaccctggtctcgcgcaccacgaagccgtggccgccgtggtgaccatggtggtggtggtggttggcgccggcgcgtgagaccgtgtcgacctcctcgaacttctccttgacgacgtgct

SEQ ID NO: 27292 - DNA, 407 bp, Zea mays
  unsure at all n locations
  Clone ID: cC-zmle189110h06a1
ttttttctctttttttttttttttttttttttttttttngggaagaaaaatgtggggttctttttttctttcataccgggncccaaatggatcctgtaaaaattcccacttcataaataccgggtataaaatttatccaaaaagttccaatttcaaaacacatattcaaaacacattttagtaatgagttgttggggcatatcctgaatgtgcctgataaacaaaaatttttcatgaaaataaaaatattaaatttgactggacttgacactttattttttgttttctgagaaaaaaaaaaatgcttaaaaatgcatctaatctaccagttcataagagataattattctctttaataaactttttggtcgggcagggcacaaaaccattttttctttttctttatc

SEQ ID NO: 27293 - DNA, 484 bp, Zea mays
  unsure at all n locations
  Clone ID: cC-zmle189110h06d1
acccacccgtgcgcgtctctctcgctcacatcaactctccaggcaaaatatcctgtgtcgcgatggatgcaacgccagcgagcgggaaggccacgccggccgccgccgtcgccgacgcggtcccgctcgctgcgcagcaggcggcggagcagctgtcgtcgcccgaatccgtcgccggcgtgagggcgagcggcagcgaggacgacgacgagcaggtggagaggttctacgcgctgctggacaacatccgcgccatgaggggcatggtcagcaccggcggcgcggcaccggggaggaagcgggcgcgcgacgacgagcccccgtggcggccggcgttccggatggaggacttcgagcttgaagaattcnactccggctccgcggggtgcgacggnggaaagaagaagagggagagcagcatcgcgaagcggccggccgacgaggaggagcaggccgaggtagtggaggccaaaggtcccccggt

SEQ ID NO: 27294 - DNA, 429 bp, Zea mays
  unsure at all n locations
  Clone ID: cC-zmle189110h07a1
gagacgagtattattatgcaatatatatatagggggggctgttggtgccttaatttgataactccatacacatccatcttcaggtagcaggggtacatgtatgtgatagcgcaacaataatacacatccacttgactaggcttggcttgtattggtacaaatgcggacacgggcacgggctatacatatatatagagtagagatggccaaacgggccgggccggcccggcccggcccgggcccggtgaagcccggccaaaaccgggccgggcctgctgagccagcgggcttaagtttctgtccaagcccggcccgcagcgggcctaaacgggccgggccggcccgtttagcacgaaataacgggccgaaaagcgggctaaacgggcccgtaagcacgttttaatgtaaaaaaaaacnggtttaacgggc

SEQ ID NO: 27295 - DNA, 475 bp, Zea mays
  Clone ID: cC-zmle189110h07d1
gcgggcagcacactcagctatccagcaaaagagatcgagacgcaggtttcatggccaccgtcagcgccgccggggtgagcaccatcgttgcccgcgccgcgatcgccaggcccaatgctctagggctgcctgcgttgagggcgaggagcgagagggtgcggtgcagctacgccaaggatgccaagaacgcggccccagtcagcaccaagggcgcaggcgcgtcgctgctcgccgcagcgggcgcggtgaccgcgtcggcggggcccgcgctggcgctcgtggacgagcgcatgtccacggagggcaccgggctgagcctcgggctcagcaacaacctgctggggtggatcctactgggggtcttcggcctcatctggtccctctacaccatctacacctctgacctcgacgaggacgaggagttccggtggcctctcgctctagatccacctcctctcctggtaatgatctgaat

SEQ ID NO: 27296 - DNA, 671 bp, Zea mays
  Clone ID: cC-zmle189110h08a1
tcctatagagcaaccaccctttttttcctttttttcttcttttttttttattcaacaatttttttttttttaaagattttttgaaaaattttaaaacaaaaaacacacctacccccccaaaaaaaaaaaaaaataaaaaaaaaaaaacaaaaaaaaaaaaaaatccaaaaaaaaaaaacaaaaaaacccaaaccaattttaaaaaaccccaaaaaaaaaaaaaaaaaaaaaaaatataaaactctaaaaaaaaaaaaaataaaaaaacccccccccaaaaaacccaaatcaaaaaaaaaatctctaccaaaaaaaaaaaaaaattaaaaaaaacacccttacaaacaaaaaaaaaaaaaacccccaatacaaaaaaaaaaaaaaacaaaaacttaaaaactcatctaaaaaacaaaaaaaataactattttttctatctaataaaaaaaaaaaaaaccctatttatatataaaacaacccccaaaaaaaaaaacaaaaagccaaaccatcacccaatctcttcccaaaaacctaaaaaaataatacatttaaaaaaataaaaaaaactttaaaaaatctaaaaaaaaaaaaaacctccccacccccaacattaaaaaaaaaaatattcccaaacaaaaacaattaaaaaacacaaaaaaaaaaccaaaaac

SEQ ID NO: 27297 - DNA, 392 bp, Zea mays
  Clone ID: cC-zmle189110h08d1
gtgcggtctctattatgggttctgccataaggccaagcatcacaccaaatgtcaaatctggagggtctggatcatggcgggatctttcctgggtttctaccatcggcgccggaccaaatggcaaaaccatatcacgtgtgacatacaagatttggaggaaatgaggtaaagatagtatgtgcttgccatggcactcacatgtctccagaggagttcatgcggcatgcatgtgcagatgctccggcccaagataatagtgcaaccctgccagcattccctgctggtaaccaagccacgtccgcagaaaattacgttatcagccttagagaatgcttgactaatgatgcttgcccctcttgtgtctatatcaggcattcactgtaatacttaaa

SEQ ID NO: 27298 - DNA, 309 bp, Zea mays
  Clone ID: cC-zmle189110h09a1
gcaattcatgcagaaagttgaagcaagagtctggggaacatgtcgtgtattatatggcacgaggatagaacagattttcaggctctccagtcttacaggaaggatggctttcctttttattcaagagattttcctagcagctacagcttcctttcacagggttttttttgctgtaggcaacaatctgaagggcagcgagcggtgtacgcaatgcatctaggtcgacttgacgatgtcgtccctggtgttgacggtgaagtcccagagctcgccgtacttctcgttgaagtcccagatgtccatggagtt

SEQ ID NO: 27299 - DNA, 137 bp, Zea mays
  Clone ID: cC-zmle189110h09d1
ccaaattcttccgcctaattttaggttagcaagtttgcacggttttgttttaaccctcctaaaaaactttacattcaggttagccaaaggtaaacattaaaaccgagaaaaaagatgggggttaatcccctgtttgg

SEQ ID NO: 27300 - DNA, 318 bp, Zea mays
  unsure at all n locations
  Clone ID: cC-zmle189110h11a1
tagagcgcccaccctttcctcccttttttttgtctttcttttctttttttccctttttttttttttttggtttttttgaaaatttttaaaacccgttttcccccctnnnccccccccccaaacattatcaaaaaaattttttttttaaatcccccctaaaaaccccttaaaaaaagcccccccccaatttttttttttttaaaaaaaccccttttttcttcaaaaacaattttaacaaaggccaacaatttttttttttaaaaaaagtttccgggttaacccccaaaccttttaaaaaaaaccaacaccttttttttt

SEQ ID NO: 27301 - DNA, 209 bp, Zea mays
  Clone ID: cC-zmle189110h12a1
ttttctttgttgtaaataccagactaatatatttgggaacatcagaaacacttttaaatcagtttgttcccctaacacgaattaattaacaataactgaactaaaacaatatgaaaaactacctacaaagaaaaaacagagcaccagcccccttggcccaatcaaattactaatacttaacaaattttatttttttcacatttttttac

SEQ ID NO: 27302 - DNA, 384 bp, Zea mays
  unsure at all n locations
  Clone ID: cC-zmle189111a01a1
ccacatgtatacttgtatagaaatagaatgtccgagtaaaaaacaaggacacgtacagaaagaagagaaagaatatcanaacagccttgtgttgggaaaggatacattgggcattagttgtacacagtatgtaacgctgagccaaaccagcccagctcagtatggccttaagacttcgaaagaattgcctgctagtaagtgagctactttccgtgctaatccgcacctatgtattgccagctaatgatcatgtctagcctgtctgctttacctttctctttctcttttggaactcggaactcttcagtggtacaagtgtaacaaaaccagactctacccgccaggtttactcaagatccccgctggcactcaatctgcaagtat

SEQ ID NO: 27303 - DNA, 578 bp, Zea mays
  unsure at all n locations
  Clone ID: cC-zmle189111a01d1
cgtgcgggctgttacagataagatatataaagagcattatcacaaaaaatttatttatgaaagtaaaaaataggaaggttgggacaggtaatgtgggctgtcataaacttctctaggtcttagctatgagtgggcaagaatccagtattcttacaggctacaaactgaaggtacattttgctacatgtaacacaacaagaatgacttttttaaaaacaaaacaagaatatgacatctcatgcctgatgctctctctatattacctgcagtgctgatacggtggtaggaaatgagatgagccattggcaattttgccattatcatttgtgggcttcgccagtatgccatcggacccacaaatcatagacacagacggtcccaccagtcatagacacgggatggcataataataggcagccaaaattgagagtggcaaaatagcaaatttctcgaaatgtgagatgatgatgggtatttttggtgcttcattngcatgtccagtaccatagctcataacctgcttgcctctaggaatgttgcgaacaacgactttactggttagattcccaatcagctta

SEQ ID NO: 27304 - DNA, 349 bp, Zea mays
  unsure at all n locations
  Clone ID: cC-zmle189111a03a1
cttccccccccaaaaaccacacctggtcccaccccaaaaaaccttaccctaacctgaaggcaaacaaactttccctaaaaaaaggcaaaaaaaaccttccggaaaaaaagggaaaaccctttcccttccaaaaaaaatttttccctaaaaaataaaaaaaaaaaactggccggaaaaataaaaaaaaaaacctgcggtccctaataagggcccaaacccccattaatattcnntacaccactgcccccttttaaaaaaaaaaaacttcccacccacctaaaaaaaataatcccccaacccccccaaaaaaggttttttttttatttacccaaaggtggttttttttttt

SEQ ID NO: 27305 - DNA, 547 bp, Zea mays
  Clone ID: cC-zmle189111a03d1
cacccgtgccagaaaaaaaaaaaaaaaaaaaaaaaaaaaaaaaaaaaaaaaaaatttaatttaaaaaaaaaaaaaaaaaaaacaaaagaaagagttaaaaaaaggtcggcccctttaaataatccaaccttcctttcccttgcttgcacacacttaactttttttttgggtcccctaacatcatttacctggccgcacccttacaacttcctaactggaaaaaccctgccgttcccccccttattccccttgcataaaatccccctttccccacctcgctttttattcaaaaggccccccccgatcgcctttccaaacatttgccccccctaaatggcaattagtccccccccttttgcggggcattaaccccggcgctttttttgtttccccccccctagaccccttcactttccaaagccttaatgccccttcttttagatttcttccctttcttttttgccccgttagccggtttttccctttaagctttaaatttggggctccctttgggttccccctaaatgcttttcgggacctcgccccc

SEQ ID NO: 27306 - DNA, 264 bp, Zea mays
  Clone ID: cC-zmle189111a04a1
ttttggaatcaacgaaaaaaaatcatattccgacatatggaagagaccacctcctatatagtactgtgtcccattatccttcaaggaaggcaaccatacatacagaatcctgctggctacacttattaaagagaacatggctcactcacgcgagagagatatgtgatacacactatgcttgacattctgtattcacacactcagattatgagatacaacagacagtcggacaagccactcatatgccagaagctcacatatgct

SEQ ID NO: 27307 - DNA, 408 bp, Zea mays
  Clone ID: cC-zmle189111a05a1
cacaaattattcagcaagagagagacggggaccaattttccataacagacgagcatacagctgatgcattcacagcacaacacatccagtgaccagagtgcccagccacactagcaaagctcaaactttaccttccaccagacagacttatcacttagacacttattcccctagcaaagtatattcacatctccgacctggagcggcgatgaacagacaccggaattcaactggagcggcgatgaacacacacgacgaacaccaggacatacgtaacacacactcgggggagaaagacgaccaaaggacggtcacccacacgtacaggaacacagcattcctcgacgaccctgctgatactgacagacacgcacgcgcgcatccatccatgcatggatgacttgctta

SEQ ID NO: 27308 - DNA, 285 bp, Zea mays
  Clone ID: cC-zmle189111a06a1
aacttccattccatagatgcgcaataactggatgagatagctaatcacaggaaattaacactggactcgattatgagtctctagctcagggaggaagcactagcactaaaccacactagctagtagctaacatcttggctacagttacttgttactacacagaagaagcagaatcctcctggagtcgcagctacgcacgagccgtggccgccggagctgacgaggcaatgacgccgtcgtcgaagttctgggagtagctgcgcaggtcgtaggcgaacctcgccg

SEQ ID NO: 27309 - DNA, 309 bp, Zea mays
  Clone ID: cC-zmle189111a07a1
aaacaagtccatccaatgggctgggatggtaatggattattacaaaacagcatgcagattgtacgatgcttattattacaatatgtataatatgccaagattttccacttggacttgacaacaagagtgaatataaagaggcaggaaattacatatgcatagggaaaacagacgctgccagttcggcatttccatccaaaactgacaaaacgccaccatccggaagctgattattgcggtgcactctgcaggtgagtgaagagaagccgcctagccagtgttctgcatgccggcggcgatgcccttcat

SEQ ID NO: 27310 - DNA, 343 bp, Zea mays
  Clone ID: cC-zmle189111a08a1
tttttaatttagggaagcaattcttattcattgcactgtcgttccggatttcacaaatcacaagttgaaaagctgcaggaccagggagtccatctatccattattccgacatcaacaacacactcagaatcccgaaagtgagaccctgcagcctgtaatcagaggctcgcgggcgttggagcatctccgacgacgaagtccaggaccatcacctcgtccagcagcggcctgaccgaggccttggcctcctccaccttgccgtccccttcacggcgtccagctcctccacgctgtcgaacaccgccaccatcccgaactggtaccccttggcccgcgccgggaa

SEQ ID NO: 27311 - DNA, 318 bp, Zea mays
  unsure at all n locations
  Clone ID: cC-zmle189111a09a1
gtgaaagataagatttttttttggggggcaggttatgcaacatgccatcctgcattataattattacaaaagcgacaaacacctccaatcacacgtgaaggtggggcccagggtgagagagaagtcttattagaaggaaggaggaaaatgacgaaattaagaaataatgggacactctgtcacgtccactcatcatatatccaacgacgcgcgccggccgggcggtttactcgctgcccggaccggaagtagctttcgtgacaccggtgaagatgacgctggtgccnagcagcttcttgccgacctcggcggtgaatg

SEQ ID NO: 27312 - DNA, 532 bp, Zea mays
  Clone ID: cC-zmle189111a10a1
ttttgatcatctaatgtgtattaaactagttatttgcacgggaacaggttagcacaagtggtagaaagagagtgttgagggagctctgaatcaagaagagaaaaaaaacagaacctagacgtgtcttgaaaccaatcacaccgtggaaggatagtagtgctaggcttgcatcgtcgctgctttcttgaagtcgatcttgtccaccttcacctcgccgtcaatcagctcgtagacgcacaccaccacacggagtccttcgatgtccatcagcacaaagcttgggttcacgtcgtaagtgatgctgctgtaggcgcccgtggcagagccagggttgatcaccacgcctccctcgtgcttatatgccttgaactgaatggctgtgcccggtcaccaggatgtccacgtccagctgccgctggagcatcgcagggagttcaggtcgccccatggaacaacctgatgaccatggcacagcccaagcttaaactgaccaattgtaagtgtcttaatctctgggtatcgagcatactca

SEQ ID NO: 27313 - DNA, 452 bp, Zea mays
  Clone ID: cC-zmle189111a11a1
aatgatgatatatatggccagttgaatcgggaacgattcaacaatatacatacagctggatgaaaatttcaaataactccaatgactgaccagattcccctatctggatcatctggttgatatatatacataatgaaatactactctatatatctacgtaacaaagaattaataatctctatcttgaaagaataaaagatttagatccctaatctactacactggaaaaggtccaacacagcttcaaattgcccgtgttgggtcaaagacctggaccatctgttggtccagatggcccatgcatggcttcccctctgcatcgatgtccatcagtatcgtgtcaccgggcttgaactcgccaaaaagaatcgcttcgctgatgacatcctcgataactgtgggtgacagctctcctcagaggccgagcgccatagcttttgtcgtaaccctct

SEQ ID NO: 27314 - DNA, 536 bp, Zea mays
  Clone ID: cC-zmle189111a12a1
ttttgacatctataactgcacttgctatatagctttcctttctttggcattgcactgttgatttacagtatataatttacacaatctataactgggagaggctacaaacattgcatctaccccttctcaccacacccttgggtaaaaagattgatttcatgttgccctacaaagaatcatttgccccgctttaaaagataaggccttttctaactgtaagggcggaatcccatcccaaccctaacaaatacctatatgaatttttacaaaagctagctgaaaaggataagataactaaaaaaaggcacatgtggtacaaaagatccaaaaaatatacaacaaatcaataaatgatctgacaagatatctagcagcataaaatgctcgaggacttcactagcgctaatcctgtaaaaactggaaggcagggttctcgagtatctcatcagccggttgatatccgcgaagtccttcttctgcattgagttggtgatatcatccaccgagaacgggatgctcgattatcatttaacaag

SEQ ID NO: 27315 - DNA, 430 bp, Zea mays
  Clone ID: cC-zmle189111b02a1
aaattgcaacagaattgaacatagccggacatagcagttatgtaaaggctgataataccacaagataaaatggaccatccatgacacagagtcagcacagggaactctgcgtcagatcacacagctaagcactcatcattcgaacaagttcaagaaaactagataatattattatattgggtaacgctacttgtccatcctcactcctcatcctcatcgccagcatcgccgccaccgcttgccttcttctgattctttctcttcacccttcctgcggggcctccaccgaatgggcttgacagtgaaaagtcaatgtgcttctcagactccaccctcaccatgaatgatgggacgttgacaatttgcctgccaaccctgatgtgacgctgcttgatcaagaacgagcatggtgaatggacttggccatgcc

SEQ ID NO: 27316 - DNA, 606 bp, Zea mays
  unsure at all n locations
  Clone ID: cC-zmle189111b02d1
cacccgtggcggcacagaagncggcggcggcggagcaaacgcaggcgaaggcgattgtgttagggaaggagcaccagccatggtgcgcgtcggcttctaccgcaactatggtaagaccttcaagaaaccaaggcgtccttatgagaaggagcgtcttgatgctgaactgaagctggtcggtgagtatgggctgaggtgcaagcgtgagctttggagggtccagtatgcactgagcaggatccgtaatgctgcaaggcacttgctcacccttgacgagaagaacccccgtcgtatctttgagggtgaggcgcttcttcgccgcatgaaccgctatgggctgcttgctgagggtcagaacaagcttgattatgttcttgccctcaccgctgagaacttcctcgcaaggcggcttcaaacacttgtcttcaaggctggcatggccaagtccattcaccatgctcgtgtcttgatcaagcagcgtcacatcanggttggcaggcaaattgtcaacgtcccatcattcatggtgagggtggagtctgagagcacattgctcttcactgtcagcccatttcgtgaggccccgcacgaggggtgagagaaaga

SEQ ID NO: 27317 - DNA, 172 bp, Zea mays
  Clone ID: cC-zmle189111b03a1
caagtaatacaaaaacggatagtttttggggagtttgccattgacaagacactctacatatttaggaattattactgctcctgtacgtatggtgggagcacccctttcagaaaggagtccaataatactaatgctctatcagcctgggcggacgcgtgggcggacgcgtggg

SEQ ID NO: 27318 - DNA, 169 bp, Zea mays
  Clone ID: cC-zmle189111b03d1
acgcgtccgcccacgcgtccgcccaggctgatagagcattattattattggactcctttctgaaaggggtgcgcccgggatacgtacaggagcagtaataattcctaaatatgtagagtgtcttgtcaatggcaaactcaataaaaactatccgcttttgtattacttg

SEQ ID NO: 27319 - DNA, 172 bp, Zea mays
  Clone ID: cC-zmle189111b04a1
caagtaatacaaaaacggatagttttggttgaggttgccattgacaagacactctacatatttaggaattattactgctcctgtacgtatggtgggagcacccctttcagaaaggagtccaataatactaatgctctatcagcctgggcggacgcgtgggcggacgcgtggg

SEQ ID NO: 27320 - DNA, 457 bp, Zea mays
  unsure at all n locations
  Clone ID: cC-zmle189111b05a1
ttttgaacataactcctggtaggattgtacataaaaattcgagggaccgaaattccattttagtcaaacaagagtcacgagatgttaccattgacaaaagacaggtaaaatgtaagaattgcaattacacagctcatggcagatgcagttgtcataattccatgggcaagcctcaatgacgtcaccactcgctgtgacaggatcaagaatgacaagctaaaccattcaattcgggttgctttgcaattcacaaagtttctgtcagttcaggagaagattatatttccatcttcagaccttcaaaagatgtttgaaggtcaagttccctgtatagtgccaagaaatttggaaggggacttggaactagcatcatcaaaatttgcacggngtcttcaggctgcatagttgatatgaacatgccttgaccatcaagcatttgacttttcttccttcaaaa

SEQ ID NO: 27321 - DNA, 423 bp, Zea mays
  Clone ID: cC-zmle189111b06a1
atacacaaaagagttgtcttcttaaataggtgcgtccatcatcaacaaacatatgaacataaataattacacattcttgtaatgatcacccccaaatcggaaacaaagaaaaccccacactacaaatgtacacgcggttcatcgagacgacgacggtacaaagaataacaaattaatgtccatgcatgccaagtgtttgtctgcttttacttgataacttttcactccgtgcggctacgcttaagtatcacggcaacttaatttaatttaccagcagcaagcaagggagcgaggagggagcgctttgcatgctcgatccgtcacaggatcacttctcctcagcagcagcagcagctgctgctggcggcgccgcctcttcggcagccggcttatcctcctcttccttcttctcttcttccttct

SEQ ID NO: 27322 - DNA, 350 bp, Zea mays
  Clone ID: cC-zmle189111b07a1
ttttggcgtttatattttttcgtaattgacatacacaaccggtgtaggggtgaaaaatacatgcagctcctgtcctcaagactcgggcagaggcgcagagcacatccttctaatggcgtatacatatgctttccctgtctatcgtggccatggactttgcaataccatagataccatacgaaaacacgaaacgggagaagcaaggaaacgttacaaatcgtacatgtggatacaacactaaaacaagcgttccacacagttagcacggcactgatcactgtgcctgatcccgtggagagaaacggtgaacggtccgacccacaggacaactgaactgaactgaactgcac

SEQ ID NO: 27323 - DNA, 453 bp, Zea mays
  Clone ID: cC-zmle189111b08a1
ttttccggtttattcattttcatttctggttcaagtatggggcaccgttagttgtcgcagctacaaagtaacatgatcaaccatttcttacccacttctgcgaaagacagtatgctacatgtccatgctgaatgcccccttggaatgctccaaatgatcaaaacaaacttttctgtgtgtgaatcacattccgactgcaaaatgccctcagaacattgggggcccaatctactgggaacctattttaccccaatattggcactaaaagttcacgcccaataaaatacagcaatatctttagaaatttaattcaaaaacaaatgaagtgtaaaaatcgatgttggagaatctggctaatcttcctccattgcacttgtggtacgtcccatttgtcttcctcgatagcttggtaatgacgagataggtgacagtagaaaacatgttaaagaaata

SEQ ID NO: 27324 - DNA, 420 bp, Zea mays
  Clone ID: cC-zmle189111b09a1
ttttaacgagtatcccctttttacactggttacaacatagggcagggacaccatgcatcgcactcgcaccacgagcattccatcattgacagtctactcagcagtccttccccaccaaaaaaaatgtgaagtttcatatatatcggccatcaacctgacgatgcatgtgtggtagcactcctcaaaatgctaataataagttcaactcctcatttgggggtgaaggcctggaagatggtggcgtggccagggtcggcgaggtgggcgaagaggttgtcgatggggccggtgccggtgtactcggcctggaaccaggcgcccatgacggcgagcatggcgaggcgtccgttcttgatctccttggtgcgcagctccttgatcttctccggcgagccgctgccccagccgagcgggtcaaac

SEQ ID NO: 27325 - DNA, 475 bp, Zea mays
  Clone ID: cC-zmle189111b10a1
ttttaagattcaaggatgacacaaataaataccaccattgggtcaggcatagttttaaacaaaatactaataaagagaaaaagactccgcgccagcagcgtcttcctcttcatactaatgaacccccacagcagcacattaccacaaggcctaggcagctacaaaaattccaaaacatggcataaaggagaaaaaatcacaaattgtccatgaccacgacttcaacatagaaaccccccaccgtccttatcaccccctctcccacggtatttcgacaaaaccaatccttaccaggttccctcaccacccttttttgttttgttttttcttcaaattgatcacagaaggtcagcaacattggcaggcagctcctcaataacacgttgtagaacttctgaatgtcaaacagcatacgttcgtcgtcgcgggtcacaaagttgatggcaacacccttcctaccaaaacgaccactacg

SEQ ID NO: 27326 - DNA, 500 bp, Zea mays
  Clone ID: cC-zmle189111b11a1
cccgtgaggcccaggccgatctacgtttaccatgaggtgcgccagcgcgacggggagggcgaacggggccacggagcaggcgacgagcgggagcacgacggactgcgtctgcaggtagcggagcaggcactgcacgaaggagaaggcgaagaggccaggcgcctgcgcgcggacgaacgccgccgcggcgcgggacgcctcgggctcctgccgcaggagcaggagcaccggctccgtgaaccaccacagcgcggagacgagcgccgacgcggcggccgacatgatgagcgacgactgcaggtagaggcccagcatgcggtgcagccccgcgccgtacgcctgcccgacagcgtcttcagggcgccgctcagaccggtcacgaacgcgtagccggtgacggtggcccaagagttgtcgagcgtggcgccggcgaggtggacgtcgccgagctggcccgagaacatcaccgacaccagcgggatgccgtagtaggccatgct

SEQ ID NO: 27327 - DNA, 591 bp, Zea mays
  Clone ID: cC-zmle189111c01a1
tcttttttttttttttcttccccttttttctttcatttcgtttttttttaattaaaatatcctctccaacctcccctaacttatcacaacatcaaatatacaaccttaatatcaataactttcccaaaaaaaaaaaaaaaaaaaaccctctataaaaaaaaaccataaaaaaaaaatttcaaaaaaaaaaaaaaaccaaaaaaaaaacccccccccccaaaaaatttttaaaaaaccccccaaaccccataaaaatccccccactttttttaaaaccaaaaaacaaaaaaaattttttaacccccccccccccccccaaaaaaaaaacccccccccaaaaccccccttaaaaaccccccccgtggaataaaaaaaaactcacaacccccttcatttaaaaaaaaaaaaaaaataaattcccccccattcaggaacaaccctctttctctcctaaaaaattaaaaaaaaaaacccccccaaaaaaaaaacacccccccccccgtgggcccccataaaaaaaaaaaaaccccctctttaaaacattttttccccccaaaaaaaacaaccccccttaaccgcaaccactttttt

SEQ ID NO: 27328 - DNA, 409 bp, Zea mays
  Clone ID: cC-zmle189111c01d1
ggaggggtcttgattcttcttcaagtacatccatcagcagcttcagtttatttcctcatgcagcgttccttctcgtctggacttcttaactgaacatgagctcatcagcctgacagtacgtactgaattttgtttttatataaatcatcataggattgtaatatctatctatatgctgagtgggaaacttagctagcgtatgtgtaagtggacttgtaatataggcggcacgcaggatgtacatagaattaattagctatatggctttgagaaagaccaggacatcaataagaggtccctgggtgtagataaataacattatgggaaggaatgtattgcttcaggtatttcactcttcagcaacttgttgtcaaagtcgattctataacaaagtattctattttttgtt

SEQ ID NO: 27329 - DNA, 252 bp, Zea mays
  Clone ID: cC-zmle189111c02a1
tttcttttctttttcaccattaataatattttctccgacgggctaacataacaaaacgttcctcaccccacaaagtttaacttcaacctctggaaacaaaaacacccccgtcttctacataaaccactaacttgaccccaaaaaaatacacgaataaccccatacgcaaattaggcagaaacaccccccccatggccctcgtccagcacatcttgatataacttcacattcgtgattcctctctcatccttt

SEQ ID NO: 27330 - DNA, 274 bp, Zea mays
  Clone ID: cC-zmle189111c03a1
aactaaaaaggggtggagtatacttactaatttgacaaataatcccaaacatcacacattttattgaaactaccaatctagttaatccccaacattacacgctgctgttcatcctaaccaactaattttacctacaaactccatgaaatgcccacttcctataccggtatacatactacaccgatacacctgcgaaaacgttctcgcatttcctcttgcgaaattttaaccttcttcacttacatgccatgctgttaccaccttccccaatttc

SEQ ID NO: 27331 - DNA, 356 bp, Zea mays
  Clone ID: cC-zmle189111c03d1
cgtgcgatccgaagaaggcggcttgccctgcccgccgctttggttccgcgcgcgccatggccaaaagcggggcgtgcgtcaaggccggccccccgctcctctgcaagtacgagctcggccacctcctcggccggggcaacttcgccaaggtataccacgcgcgctgcctctgcggaggcgaccccgtggccgtgaaggtgctggacaaggccgggctggccgccacgggcatggcgtcgcggctcctgcgcgaggtgtccgccatgcgccgcctgagccaccccaacgtgctccgcctccacgaggtgcttgcgacgcgctccaaggtgtacctcgtgatggagctggcccccggc

SEQ ID NO: 27332 - DNA, 367 bp, Zea mays
  Clone ID: cC-zmle189111c04a1
ttttacttaatttgttgcattaattgttgtacatgtgaggaaagcaagtagagatggatgcatcatccatcgacgggcggagtacatacagatcgagatgcatggaatggatagctagctttagttgactgtgatcttgccgaccattcctgctccttggtgcggctcgcagtagaagccgtaggtgcccggcacggtgagggtgacggagtaggtctcgcctggcgcgttgaggtactcctcctgcgagatcttggaggcgtcgacgccgctcggcacctcgtcttcgtcgaacacgacattgtgcgggaagccggcgttgttcttgaaggtgatgagtgtcgccggccttgacggagaactggct

SEQ ID NO: 27333 - DNA, 328 bp, Zea mays
  Clone ID: cC-zmle189111c05a1
gtacatgggcaggatcctttcaattcatgagaggatgggtcaacaaccgctacattacgacagccaccaccatgagcaaccggggctcttgatgggggcagaacgacgacgacagactacaaaccaatcactggggttcttcaatgtttcgacaagcctggcgaaccaaaaacacaaggagtgggtgtgtttttttttcacgctttcttattgtgcccctatcgggcacggcgagcatccttatgcactagtcggctgtccagctctgctccacgatctcacggactttgccgttgtactcccgcttgttctcgctgaacagtcttgc

SEQ ID NO: 27334 - DNA, 441 bp, Zea mays
  Clone ID: cC-zmle189111c06a1
ccttgcatcctctacagcggccccccccccccccccccccccccccccccccccccccccccccccccccccccccgccctgtccccctttcccccaccaaacccccaccccccccccaatcccccccccccccccccttaaaccaaaacacactataaaaccccccccaaaaaaaaaaacccaaaaaaaccccccaacccaccaccccccctaaaaatccaaaaaaccaaaaaaccccaaccccatcccaaaccaaaacccaacctcccttaccaccactaacaaaaaaccccccccccccccgaccccacccccccaaaaaaaaaatcccccaaaaacccatacaccaccctcctcccaccaaaaccacaaaaaggcccccaccacacccccattcccatcctaaaaaacccccccctcccccccacaaaaaacaaaaa

SEQ ID NO: 27335 - DNA, 524 bp, Zea mays
  Clone ID: cC-zmle189111c07a1
gcaaaaacagcagttttcccagttaatagcgtgggcgaaagcgaacaatacaggaaaatatccaagggcattaacagccttttacaacgatgaaccaccgatttatggagacctaagaaatgccgactaatcattcaggactcacaaagtcaacatgctgataaatactctcaactgataaacgctctcaactgctgacacagttagccgcagcatattttacaactctagattactcaacagcagccatctcagcgaagttatgagacagcacatgctaaacctattttccaagctaagctatggaaaaggtcaaaacttatagtggggctgctagaaccccatgtcaatcggccaaactatcaaggaagctttgcagctctctcaagccttctgcagatatgctcctctgtacacgaggctaggagttgttagaacaggaggcggctatagttgaagcagacgacaaccacaaaaggttatcaccactcttcctcttaatggcctcataactagttctttac

SEQ ID NO: 27336 - DNA, 331 bp, Zea mays
  Clone ID: cC-zmle189111c08a1
tttttttttttttttttttttttttttttataataaacttgttcttgttttttttttttttttcccaaacacataaaaaacccttttcaaaatttatcaaaaactataaaccaaacctaactttaaaaaaaacattcattaataatttattgctacccaaaaaaaaaaaactttctttcacaaaaaaaacataaaccaaaacatttaccaaaacaaaactctaaaccaaataaaaaaaaaaaaaaatccttatctaaccacttcaaacttccaaaaactgggcaatatccatcaactccaaaaaccactaaagaggagttaaaccataatc

SEQ ID NO: 27337 - DNA, 370 bp, Zea mays
  Clone ID: cC-zmle189111c09a1
gccacactggaatgggaataaaatgcgtataaatacctgttgttcaaaatttaataggatcgatgcaaactgatcggccaaaaaacaattaactacagcacaactaaattcttgcttgcttgcctaaaaagtttattaaaaaactagagacggcatttcttttaaaccctatgcaacccaaaaagaaccagctgtcgacaattgtgactgctactttgcttgaaccaactcggggtcccttttaatttggtccaatatgaaaagtctgggtccaggaggaatcttcacatttttcaaagcactgtccgtaaggagtggtaacgtttgatcattgaggagacccctcttgaaattcttcttatacttttca

SEQ ID NO: 27338 - DNA, 489 bp, Zea mays
  Clone ID: cC-zmle189111c10a1
acgttgtgtctgcaactcaattacactatagcaccgaacgcagagagtatgggggtcgtggaaagatccaacgtcctgtgtgtaattccaacacctctcacattttgcaccatccgcacgagtcacaccaatccatatgtctccagtgcgtgggttactgaactttcctgtgtatggtacagatgatgtaatctcttcatttaggattggaagaatatcgacctgagatgtgataaacaggcgatgcagagcgtctgcatcattggatgcagaagatagctcctttagctttaataccgtatctgaactttcggtatggagataaacctttgcatctaagctagaaccaatcaactttccagtgcgagcattctccaaaattttgttgacctctgacctcaactccaggataacacccaggaaatcaacatcatccttcggggccgagagccattcttcattcttttctggccatttcagatcaaaaac

SEQ ID NO: 27339 - DNA, 519 bp, Zea mays
  Clone ID: cC-zmle189111c11a1
tttttaaggtatcgacgaatcaaatgatatttttgttctgagttcgggcgcttcttctccctctgaatcaaacttttttttgccataatgtgccgttcctattattaccaagtatatggttctaatcctagatagaaaaataaatagcaaaaatctaaaaaggcggatcctccctctccatcaagagtaatgaactgggttctgatacagtacaaaaaaaaaataactaaattaaccaaacttgcctgatgttgaggcaatcaagaaagctgcataagtgaatatataacccacggaaaagtgggctaatccgaccaatcttgcttgcacaatggaaagagccacgggcttatctctccagcgaattaaattagccaaaggtgttccgttcatgagcccatgctaaagtctcaattaattcctgccaatatccacgccaggaaattaagaacataaatcctgtagcccaaacaagatgtccaaataagaacatccaagcccatactgataaactattca

SEQ ID NO: 27340 - DNA, 471 bp, Zea mays
  unsure at all n locations
  Clone ID: cC-zmle189111c12a1
tcatcctctacaacgaccgccctctccctttttttttttttttttttttttctcttttttttttttattaattgaaatgttttaattttatttatccttcttaattcaccccctcccttctcaaaaaaaaaataatcactaaaaacaaaaaaaaaaaaccaacacccttcccnnacccaaaaaaaaacacccccaaaaaaaaaaaaaaccccccccttaacacaacacatataaaaacttttcttaaaacaaacaaaaaattcccccccccacaaaaaaaaaaaaaaccccccccaaaaaaaaaaaaaaaaatataaaaataaaaaaaaaaaaaaaacccccaaccaaaaaaaaaaaaaactcctcaaaaaaaaaaaaaaaaaaaaccccaaaatatttttgttttacccccccccccccaaaaaaaaaaaaaaaaaaacaccttttacctcatacaaccccccacccccc

SEQ ID NO: 27341 - DNA, 291 bp, Zea mays
  Clone ID: cC-zmle189111d01a1
ggacttccaatagagttgttatgaaaatatataccataaatattagtacattttcgtatacaatatggtaaagtcaaaacaaattgactcgttaaaaagcaaagcaagaattgcgccattctttctagaaacggagatacgttcgagctcttcccatctatctatctatatatattatgcctcaaaagttacagcaccgtcatgctctaagcccaagagatcaactggcgctaaataatctcagccgcactgctctgctgctagattgatttaattggccatcctcttggt

SEQ ID NO: 27342 - DNA, 449 bp, Zea mays
  Clone ID: cC-zmle189111d01d1
ttgatttgcacagcagcgagatctcgctcagaagagactctgaatagataacgagctgcgcttcttcgtccgcgatggactagcttctctgatcgcttccatatggagagagctgcgtcaagctgcgctagcctcctagcacaaaggaggtgctactccgtggccgcggtcgtggtgaagggatgcgggcggaaggccgtggagaaggtggccaagcgcatcatgggcaaggaggtgaacaccgcggctgcctccggggagaagacgccgtgggtgccggacccggtcaccggctactaccgcccggcgggtggcgccaaagaagtggactcggcggagcttcgcgccaggctgctcaccaagaggatcgccaactaaatcaatctagcagcagagcagtgcggctgagattatttagcgccagttgatctcttgggcctagagcatga

SEQ ID NO: 27343 - DNA, 378 bp, Zea mays
  Clone ID: cC-zmle189111d02a1
aatatcgaactggctactaggatagtcattcgggaatgataaaaaaaaaagaatatcaagatgacccccctcctcctccctctatacactgaagaagcgaggcccatcgcagtacccctaatcagatgactggctgattatgtatgcatgattgatgagttactaattatgtgtatgcatgattgatgagttactaattatggtagcataggctataaggctgctgcttgctcctactgcaggatgggatgcatggatgggtggttcatttgctgttgtcgcgtgacccagcgtacccgtacgggttcttgctcgcccagttccacagatctctgcacatctcctcgatcccgtacttggccttccatttgagctcct

SEQ ID NO: 27344 - DNA, 203 bp, Zea mays
  Clone ID: cC-zmle189111d02d1
gcaaacccaaccatcttcccactgcagaagaggggaagaagcaatcgacagaattcaaattggactgcacagaccgacgtcctgtaccacaccaataccacccatctgctcatctcgtgacagccaccttatagcctatgctcctatagactataatatcatcctatagtactataatatctctatagcgcattattaggtct

SEQ ID NO: 27345 - DNA, 409 bp, Zea mays
  Clone ID: cC-zmle189111d03a1
ggtataaagtcacggcttgtaagtctgtaccatgttctttgttaaattatataatcccgctgggcacaattccgagtatatgaacgaaaccaattttaaatatattctagttaatattctgatgtatatatgtgataaactcacatgcttatgaatttctatgacgcaaaaaaaaattaatcccaaaactattatatatgaacttgacaggcaataagaccatcagcttacctatattcaaactgcacactataaataatacgatctacaatataaaaaagtacaggagttcacccatatatgatcactacaaatacaatgtaaaaaggtacaatgtacacccatatatggtcactacaaactccttttggatatttttgtagtgtagattatattattcataggtcac

SEQ ID NO: 27346 - DNA, 430 bp, Zea mays
  Clone ID: cC-zmle189111d03d1
gttcggggtttaaccctctagatctctatatctatctgcgtattagcatttttcatttgtatttatcatgttttgtcaatagggatacttgtttcttgtaagtctgttaacatgtttgaaccatagcaattggcggacgtgtgtaaaactgcagtatgatggattccactattcatcaaccgaaattatggcgcgcttcaatcgtggctacgctgatggggacctcatccgttatggtgtgcttgaatcgtggctgtggagatgtgtggaactcattggttaaagtgtgctttattaataatggtgatgctgatggaactgattttgctccccttggacggcctgattggttactttgccctgttgactgtttgagaacgtaccgcccaggtttacttatacttacttgcttttgacggtactgtacata

SEQ ID NO: 27347 - DNA, 405 bp, Zea mays
  Clone ID: cC-zmle189111d04a1
aagacttatttccagcttattaattggttggaataatttgatgaagttagaatgtgagcgctatagctgcctagattatccgatatctgataatgccatgttgagctcctcgaccttggcaccgacgaccctgcgctgctcctcgccctccttgatcaggaggaacgtcggcagagccttcactctgaacttctctacgacatctttaaacttatcaaagtccagctggcagaatacggcctcatcctttttagcgatggccagatcccagtacgtggccttgctctgctgggttcagtccgcccaaaacatcagcaccaccggatgctcttgggtcagagcgggtactaactcttgaatattattaatgatgtaataaaccctgtaccaccctggctggggcac

SEQ ID NO: 27348 - DNA, 304 bp, Zea mays
  unsure at all n locations
  Clone ID: cC-zmle189111d05a1
ctatacaccagacccccctccctctttttttttattttttttttaccaccacccacaacccnccaaggggttgttttttttttctttncaaaacccccaaaaaccaaacaccctcaccgtccattataactccaaattaacttacacaaccccataaaaataaaccaccatcataatcccacctgactaaaacatcactaacttactctccaacccaccgatccttacccaccttttaaccaaacaaccaaacccttcaaaaactcaccccttcactaccccaccctttcaaaaaccattcctc

SEQ ID NO: 27349 - DNA, 389 bp, Zea mays
  unsure at all n locations
  Clone ID: cC-zmle189111d06a1
ggatacagtagacgcccccgccaggccgtgtcaggctcaatgtttgccgcagctganggtgagagcgcggagggcgcggtgcggcgccgcccactcgaggcggccgagccagcggcgggacggcaacaacggcgcgtcgtcgtcgcttctggccgtggccaccagcgcggtgaccacgtcgcccgcgctggcgctggtggacgagcggatgtcgacggagggcaccgggctcagcctggggctcagcaacaacctgctggggtggatcctgctgggcgtcttcggcctcatctggtccctctacaccgtctacacctccacgctcgacgaggacgacgactccggcctctcgctctgaactcatccgtcgattattcctagctacgact

SEQ ID NO: 27350 - DNA, 373 bp, Zea mays
  unsure at all n locations
  Clone ID: cC-zmle189111d07a1
gtggggggcaccccacttttgtttacttattttncaccaaataccgattccagtaaaaagaaaaagaaaaggagttcctgtggtttcaaaatcaccaactagctgtgaggtttgcatccaccaacagcaattcctaaaccaacaacgaccggttctttttggacatttcaatcccagcttcttatttcaaaaaattaggatttcaattaaccgctacaaaattttttttaatgggagaggcccgattaccggatcaccccgcgcgagccgaatacacaattaaattggctgctttacactacatgagatgagatgacagcccttccttatgataaacctgaatgcatgccatgcaaccccggaaaaactaccg

SEQ ID NO: 27351 - DNA, 308 bp, Zea mays
  Clone ID: cC-zmle189111d08a1
acaggtagcacgagtaataatatgggagcgggaactgcctcattacactaacagttgcacgatttcactgatatgttttctcaacgattagctgacatgaatggcgcctgcttataccaggttcaccactggtggcacttcaggattgtcaaacattagtagagcccaggccacacgatacaccacgtcccaatgcatttctggtgcaccaatgaacagacgctaaatggaaaatacacaagatgtcagatgagcattttgaggttgaaagcaaaatctcgtaccctgacatggcacggttgacttcc

SEQ ID NO: 27352 - DNA, 334 bp, Zea mays
  Clone ID: cC-zmle189111d10a1
gagggaaaaaaattacaaaaaaattttttttaaggcccaaacttttttttttaattcacaaaaaaacttaatgcctccccctcccaaaaccaaatacaaaaacccttcacaaacctttaaccccaaaaataaataagggaccccagccagcccaaaagggcctttattccccccccccggccgttaaaaaaacccttgaaaaaaaaatctccctccccccttgaaccccccccgggcaggtttttattttcccctaaacccttgatttccacaacaaaaaacccgggccccccggggaaacaattggggggggggggtgggttttgcccccccc

SEQ ID NO: 27353 - DNA, 54 bp, Zea mays
  Clone ID: cC-zmle189111d12a1
gggacgataaacatctacaaccctctccctttttttattttttttttttttaac

SEQ ID NO: 27354 - DNA, 401 bp, Zea mays
  Clone ID: cC-zmle189111e01a1
gcacaattctgatggatactaggcaaaggctagatattacacaggtacaatgaaaaaggtgacttgaagttcgagtttaggacgcttcaaacgacagcaagtaggtatacagacgcaggacatgcttcacagtgccgaagctactgacagatacacaggaggaagaacagacagcaaactaaaggcaaggtataacgcacagagcattaagcaataagcatcgtcatatccttacttaattagtttgtaacctgaacagcgtcgcctcgatctccagtggaatccgtcatcatggaaagaacgctacccccgttttcaggaaagagggaatctttcaccacctccgcagccattctaatcccttgtctcactacttcgttgcggatagccgtcgatagcgt

SEQ ID NO: 27355 - DNA, 492 bp, Zea mays
  Clone ID: cC-zmle189111e01d1
gggcgacccacccgtgcgcccacgcgtccgcgtggacattcctgccgctctcccctctgctgctgctcctccggcggcagggagcggggcggggctatcgacggctatccgcaacgaagtagtgagacaagggattagaatggctgcggaggtggtgaaagattccctctttcctgaaaacgggggtagcgttctttccatgatgacggattccactggagatcgaggcgacgctgttcaggttacaaactaattaagtaaggatatgacgatgcttattgcttaatgctctgtgcgttataccttgcctttagtttgctgtctgttcttcctcctgtgtatctgtcagtagcttcggcactgtgaagcatgtcctgcgtctgtatacctacttgctgtcgtttgaagcgtcctaaactcgaacttcaagtcacctttttcattgtacctgtgtaatatgtagcttttgcctagtatccatcagaattgtgc

SEQ ID NO: 27356 - DNA, 313 bp, Zea mays
  Clone ID: cC-zmle189111e03a1
ggaaagaagaaacagctctttatctgaaaaaagaaaaacaaagtcaacgaacagctaaaagtcagatgcccagttccgaaaaacacacacacagtccagtactccagaatccagtctgcgtaaaccacagctttgatacaagtcaatctagataccagacttcaacgaaaggagtttcacatgacatgggtcaaaataataaattgtgacaaattggccatgtccagtgggtcaccccaaagggatcggagatttcaacagcaccaaaaacaccaagtctgggcaaatcgtcctgtttcttagtcagcatcca

SEQ ID NO: 27357 - DNA, 581 bp, Zea mays
  Clone ID: cC-zmle189111e03d1
cgtgcgaatcagaagctgccagttatgaaaaggtttatggagaacccatttctgtgaaggaattggctgatcgtggggcagggtatgttcatctttgcacgctgtactggtggctcaggccttttggttgcggtgttattcttggaggttatgatagggatgggccacagctctacatgatagaaccctcaggagtttcctacaaatacttcggtgctgcattggggaagggaagacaggctgcaaagactgagatagaaaagttgaaactttcggagcttacctgccgggaaggcattgttgaagttgcaaagataatttatggagtgcatgacgaagcgaaggacaaagcttttgagttggacttgagctggatctgtgatgaatcgaaccgtcagcatcagaaggttccaaatgaactgttggagcaagccaaagctgctgctcaggcagctcttgaggagatggatgctgactaagaaacaagacgatttgcccaacttggtgcttttggtgctggtgaaatcttcgatcccttggggtgacccactggacatggccaatttgtcacaattattatt

SEQ ID NO: 27358 - DNA, 272 bp, Zea mays
  Clone ID: cC-zmle189111e05a1
tttttttttttttttttttttttttttttttttttgtttgtttttcacaaaattttttttttttataaaattttttttctctttcttttttttttttccttttaccccttcctttttcctctttccttttaaaaaaaaaaaattggcttccaaaaaaaaaaaatataatccctaaatttaagagtaaaaacaaaacccccaccattacctaaatcttttaaccattaattctcccccccaccccactgaacccccttttaacccatcccatt

SEQ ID NO: 27359 - DNA, 170 bp, Zea mays
  Clone ID: cC-zmle189111e06a1
aaaaccaaaaacccccccccaaaataaatttaaaaaaaaaaaatccctctccaaaaaaaaattttaaaaaaataaactttccaaaacaaaaccccccaaaaaaaaaaaaattttttttttggaacctaacttttaaaaaattcttttttaaaaatttttttccttaaaaa

SEQ ID NO: 27360 - DNA, 386 bp, Zea mays
  Clone ID: cC-zmle189111e08a1
gcaaaagcgttactaatttaacaaggacatgggtggcacgaggagtctttatagtacatagcagttgcaaacatccaaacgtcaggaaatttagtcttccaactagttaccacaacacattcatgctaatcaccatagccgatccatgctcacgagacatctaaggccttgttcggttattcccaatacacatggattggatgagattgaaaaaaattcttaaaaagtttgacttgtttgggattcaaactcatccaatcccactcaatccacatggattgagagctaaccgaaaagccttaatgtggttaggatggtgatgatgagtcgtgagcccaacaacatgatgacaactgacaagattagtcaccgctggcacaacccct

SEQ ID NO: 27361 - DNA, 402 bp, Zea mays
  Clone ID: cC-zmle189111e09a1
gggggaccatcaaaattaaaaggccctcatgcattttatttaccttggggaggaaataccagggtcccacaatcaaatcaaaggatttttaacgaccgtcgatttaaaaacctaccaaaacatatttgctttttagggtgatgataatgctcaaaaacttttaaaaatgagcgttcctctgttatgatgcattcataggccctcggaaaaaaaacgaacccacctggccacctccgatgctggatcatgaattacttgtttgataatatgggaccaatttcacgtacttacactgccccgacactcaataaagacccaaaaatttccaccataatgcaccaacaacttcccaaattacagcattgattgcggctgttataaaacccagcttgaatacattcg

SEQ ID NO: 27362 - DNA, 368 bp, Zea mays
  Clone ID: cC-zmle189111e12a1
tttttgaacaaaacttgcaagccattaccccgggggcagggacaccgtcactttgcgctaaacatgttcatctacccagccatacggaactgaattttcttcagcagaatacatcgcattaacagtttaccacgcatcacgtttcacacactcgttttcagtttctggcttcctatttctttgatttagattcctcaccatccgccttcactatgttgaggtcaccgccctctttgctagcaagattcgcagcttttatttcgttgcactggttgatgaacttggtgagttccttctcggcgtccatgtcctttgtgaacttggtgggcttgacggctctctttcctttacgaacatgaggcgccttg

SEQ ID NO: 27363 - DNA, 290 bp, Zea mays
  Clone ID: cC-zmle189111f01a1
aggcacacggccctacggttgtattctctacagcggcacgccctacatatttttttatttgttaacccaaaccatactatctggctaggggagggtatttatttatgtactactcaacacataaacaatggtctactatgatcacgagtacaacgcatgtacagtcacacacttattataaacaaacaccagcaccatcatggcttacttaattatgaagaactcacactcactattgacgcacaacaccacatttttcttctaacggtcaaaagcgactattgcttctt

SEQ ID NO: 27364 - DNA, 521 bp, Zea mays
  unsure at all n locations
  Clone ID: cC-zmle189111f01d1
ggggcgaccacccgggcggagccgccaggacggcgaccaccgccgcccggagcaccttgccttgaaccctttcgggaaggtgccgggggtcgaggatggcgacctcacgctcttcgaatcacgtgcgatcgcgaggcatgttctccggaagcacaagccggagctgctgggcggcggcaggctggagcagacggcgatggtggacgtgtggctggaggtggaggcccaccagctgagcccgccggcgatcgccatcgtggtggagtgcgtgttcgcgccgttcctgggccgcgagcgcaaccaggcggtggtggacgagaacgtggagaagctcaagaaggtgctggangtgtacgaggcgcggctggccacgtgcacgtacctcgccggcgacttcctcagcctcgccgacctcagccccttcaccatcatgcactgcctcatggccaccgagtacgccgctctcgtccatgcgctcccgcacgtcagcgcctggtggcagggcctcgccgcgcgcccgg

SEQ ID NO: 27365 - DNA, 275 bp, Zea mays
  Clone ID: cC-zmle189111f02a1
ataatattaaatttaccattcattacacattatttatcacaaataactttgcgagagaaaaacaaataaacactcaaaaaaacaacacttttttttaaaacaaaaaaaaaaaaaaaaaaaaaaaaaaaaaaatgtgcatcctcactccccaaaaaaaattaaaaaaaccccccaacacttacctttttttaaaaatttttttttaaacttacaaccgggccaaaacccaatgggcttgtcaaaaaaaaaacaattttcttataaaaaaacaacct

SEQ ID NO: 27366 - DNA, 556 bp, Zea mays
  unsure at all n locations
  Clone ID: cC-zmle189111f02d1
gacccacccgtgcgggcacaactcacaacccgagccccccaaacccgaagcatcaggttctcccctgaccttgctccgcctccgggcagggaaaaggaagatgagctactacggccagcagccccccgtcggcgtcccgccgcagcaaggctacccggggaaggacggctacccgccagcggggtacccgccggccggctaccccccgccggcgcagggctacccgccgcagggctacccgcagcagggttacccgcagcagggctacccgccgcagtacgcgcagccgcctccacagcagcagcagagcagcgggccttccttcatggaaggatgcttggctgccctctgctgctgctgcctcctggacgcctgcttctgacggaaccatccgtgccgggttcaacacggctgcaagtgaagcaaccagcttacggaagagctggaactgggccgtgctattctagctttgtcctgcgttatcgccctctnttcttttctttttnttttctctctctctctctctggtataagactactggtattttgtcgatgt

SEQ ID NO: 27367 - DNA, 396 bp, Zea mays
  Clone ID: cC-zmle189111f03a1
ttttaatggttgaaaaggagctcagagaatcgtagccgcgttacagcattcggtcgctgacgaagcgccacaaccatggcatgcaggataactcaatcctacaaccaagagttactgcactatgatacaattctgtcctcccaactcccatgaaatcgaaacgcataatctcctaaaatggctatcaatatgttccagcacctactttaaatctgttccaatgtgcagggaggcgccaaacaaggctccaatggtgttgtgtgcgcgcgcctgttgtatgccaaaaccattctcctcaatcgcaaaaggttttagaaccttttcaacctcacacggctatatgggtatcaatatcgaaactccgaacatctgaagggctggctcctaacctttttg

SEQ ID NO: 27368 - DNA, 560 bp, Zea mays
  Clone ID: cC-zmle189111f03d1
gacccacccgtgcgagattgaagacccccaacttttcacctgggccagagtctctggtttgtgcactttttgctctggatgatagaccaggcgattctctagcattttcttcaatcattgtcaccttaaggatggtatttcctcctccctaattgtctcctgcctgcttcacatttgctcttgccatttatacgctttacactaaatgctttaaacatgtctactatttgccacagtatactgaagatgtgaggtctggaagcatcaaatttcactattgcacgataaacaaaaggttaggagccagcccttcagatcttcggagtttcgatattgataaccatatagccgcgtgaggttgaaaggttctaaaccttttgcgattgaggagaatggttttggcatacaacaggcgcgcgcacacacaccattggagccttgtttggcgcctccctgcacattggaacacatttaaagtacgtgctggaacatattgatagccattttaggagaatatgcgtttcgatttcatgggagttgggaggacagaattgtatcat

SEQ ID NO: 27369 - DNA, 339 bp, Zea mays
  Clone ID: cC-zmle189111f04a1
ccacacgcgacaggaggcggcggggccacgctacgcgctgcttatatttcatactttcttcaataacaaggattcatgttcggaatgacttacaggaagaaacaccagaggctgggaagcaatagcagacaagaacacgttacatcaatgtaaacgtcggctttacatgtccaattattaaccagccagatttcaagtacaacaaatacaggtctttaaacagctgatccttaatgaaaaatgaagctttatccgtgcccccgtgacatgatggcattcagtgcctgcaacaggcccttaccaaacctcagggcggagctcaccagtagccgggggcat

SEQ ID NO: 27370 - DNA, 423 bp, Zea mays
  Clone ID: cC-zmle189111f05a1
ttttaggaaagccatacgacgcactttattgatggtcaggacatgttacatcgtttaccagtctgaagaataacaccagagggttcatcgaccccaaatacagtttcctttcaagagaaagctactctgctagttcatgtgccacctgtgcgtttgtaaattggacacagcattctgggagcagtgcacggcatcctcgtgaaaaacgagaagaaaaaaaaggatatttcttcactgcctccgtctcctttcatctccggtatacgtatggctggacaagacacacatctatacacatcgcatcactggtaaacttgcacagagtaaatgattacacgtccagctccttatgcggctacagctagaggtcttttgcggtctttaattctttgatagctcagcgtaagctggagccccaaaact

SEQ ID NO: 27371 - DNA, 273 bp, Zea mays
  Clone ID: cC-zmle189111f06a1
atcctctagagcggccgccctccccccccccccctttcttccccccccccccccccccccccccgggccggtttctctctctccctcccccccccccccccccaaaacaaaaaacccctccccaaaccccccaaaatgaaaacacccaaaccccccacaacaaaaacacacccctcccaaaaaaaaccccaacgaacaaaaaataacaaattaatcccccttcaaaccaaaaacacccccgccaaaaccccaaaaaacccaaaacccgccaaa

SEQ ID NO: 27372 - DNA, 412 bp, Zea mays
  Clone ID: cC-zmle189111f07a1
gcaaaagcgttactaatttaacaaaggcatgtgtggcacgaggagtttttatagaacataacaattgcaaacatccaaacgtaaggaaatttagtcttgcaactagttaccacaacacattcatgctaatcaccatagccgatccatgctcacgagacatctaaggccttgttcggttattcccaatacacatggattggatgagattgaaaaaaattcttaaaaagtctgacttgtttgggattcaaactcatacaatcccactcaatccacatggattgagagctaaccgaaaagccttaatgtggttatgatggtgatgatgagtcatgagcccaacaacatgatgacaactgacaagattagtcaccgatggcacaacctctgtaaccgcaatggacacattctatca

SEQ ID NO: 27373 - DNA, 417 bp, Zea mays
  Clone ID: cC-zmle189111f08a1
ttttaaaaatccaacatcaactcatcactcgtcaggaatcggaaagcatgatcccatacaatcgcctccaacaatcgtctccaactggcatgccaaacataatggtaagcgtctaagtgcacatccatgtctcatcaacttacaccagagttcaaagctaatatttggaatcccaataaggaaacaacaggcaatttaataaccaccatcgaaatcaggtgatccacatacaccaaggtaatatttggaatccccagacttcttgctctctgtcacacatagcaagtagttcaagacatgctggggaaacatcagtgccttctcctgggtggggtccttgaacgagctcttggtggtgaccttttccgagtatttctgcgtttagcagggccactgctaaatgcccaatcaacactc

SEQ ID NO: 27374 - DNA, 359 bp, Zea mays
  Clone ID: cC-zmle189111f09a1
gctcttgggggttgtattttattaaaaatattctttcgggctcacaaaaaccccttaacataccccccaaattaaattccacctaacctatacccgattcacatgaccctcaaagaggaaattctacccacacaaaaattaccaaatttttatttaaaggggaaatactaaacttgaacctccccgacatccccttgaaaaaaacgaaaaaacaccctaaaaccttaggcccttactccccgcctaaagtacccctccaaatggaaaccccaacttcactgcagaccaggctatcatttaaaccttgcccttgaaagttagtgcaaagccaaaccaaacatcaccctgaaccaaaaagc

SEQ ID NO: 27375 - DNA, 52 bp, Zea mays
  Clone ID: cC-zmle189111f10a1
cccacacggggggcgacgcttttctccacccgttcatttacccaccggttcc

SEQ ID NO: 27376 - DNA, 439 bp, Zea mays
  unsure at all n locations
  Clone ID: cC-zmle189111f12a1
ttttaaaagtcattattagcttgttttattcctgagcagggagtcgcatgcgatggcatgccgacttcattattgggtacaacacaaatgcttatatctagaatgcagcaccaacaaagggctgctgtaaaaacatgggtgagatcgccatggctgtggggctgaacatgaatggtaattgttgttgttgtataatgtgcgagatggaatcagagtaacattgtggcactgtcatcatgtttggcattatcattgatgacaccatgctcggcatcatcatcggtggtatcatacttggcatcattatcggtggcatcatactcggcgtcatcgtcgaaggcatcatactcggcatcatcattggtgaaaccatgtttggcatcatcatcggtggcatcatactagctatcngtattggtgacatcatagtcggcacccc

SEQ ID NO: 27377 - DNA, 317 bp, Zea mays
  Clone ID: cC-zmle189111g01a1
ttttttttttttttttttttttttttttttttttttttggttttttttaaattttttttttttatttttataatttttttttttaattatttttaatttcaaaaaaatttctttccttaactccttataaaaaaaaaaaaaaatttttttaaaaaaaaaaatacttttaaaatattccaaaaaaaaatatatatcacccacaccaaaaaaaaaaaaaaaaaccctttcaaaaacccaaaaaaaaaaaaaaaattaaataaccccaaccccaaaaaacattttttaaacacacccacccggcgaaactatattacacc

SEQ ID NO: 27378 - DNA, 468 bp, Zea mays
  Clone ID: cC-zmle189111g01d1
gacacacccgtgcgggacttcgacgtcacacgggcgctgcgcacagacacaccaagcgtcggcaccaatggcttactaccaggaggtggggtactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcagggagagcttcctcgccagggctaactgagccgcccggcggccggcatccacgcccgttcgtgcttgcctgcgtgccttatgtatgtctgtggttgactgggtgtgcagggtcatcgtacttggctatcgtacgtgcacgcactcagc

SEQ ID NO: 27379 - DNA, 356 bp, Zea mays
  Clone ID: cC-zmle189111g02a1
ttttttttttttctttttttttttttttttttttggtttttttttttaaaacaccaaacataatttttaacaaaaaacattaaaaacacacggccacaaaataattgtcctacttcaccctcctttttaaaataaaatcaccaaaaccaatttacaaacaaaaccctaaggccatgacaactctaaaaaaccgggccatgcaaaaacccaaacacagttttattcaaccccaaggcactggaacacgcattatttcaaggcaggagaccacccaaaaagtaatttcacatttttttttaaaccaaccaacatttccaacaaggctttctcaacactataaaaaaaaattttgtttt

SEQ ID NO: 27380 - DNA, 335 bp, Zea mays
  Clone ID: cC-zmle189111g02d1
gacacggccgtgcggacccacgattcctttcgtttttctcttcctatattccctcaagctacgtactgcactatacctatatctgggcccagctactacaacgagcacctattctacaactctctgttctaccatactaaatactacctcaatgctgctctcttgcattcttgcttgcaccacacactccgcttttttaatgcctacatcgactgctcctatgacttcaaggcacgcgcggtcctcagtttcgacgtgttcactttactatcaaccttcattatgaagatctccctcaatgccacttttagcggacactttctaggggtaccaca

SEQ ID NO: 27381 - DNA, 253 bp, Zea mays
  Clone ID: cC-zmle189111g03a1
agctgctcatgcatatcaggagggtcaacacgatgcttataataggtttatttccacacggtacaggggggaagtcgaataaaaataaaagcgacatttattcgttgggcatcatatcacagtgcattgcccggcaggaaacacagttacagtattattccatgcacacttgacagaaacgcaaacagagacgacggtacggtgtatcagttgtccatggcgacgccaggcagctggaaagggttcgtcgtcc

SEQ ID NO: 27382 - DNA, 269 bp, Zea mays
  unsure at all n locations
  Clone ID: cC-zmle189111g03d1
acgaccacgcgtgcgggacgacgaccctttccagctgcctggcgtcgccatggtcaacttatacaccgtaccgtcgtctctgttggcgttgctgtcaagtgtgcatggaataatactgtaactgtgtttcctgccgggcaatgcactgtgatatgatgcccaacgaataaatgtcgcttttatttttattcgacttcccccctgtaccgtgtggaaataaacctattataagcatcgtgttgaaactcatgatatgcatgagcagctna

SEQ ID NO: 27383 - DNA, 329 bp, Zea mays
  Clone ID: cC-zmle189111g04a1
ttttttttttttctttttttctttttttttttttggtttgttttttttaaaaaaaaaataatccaacccccatattttcccatacaaaccaaaaaccaataaatccatttggaaaaaaaataccctacaccaaaaaacctcttctaaaaaaaaaaaaaattcaacaccccgatccccctcaaaacaaaaaattaaaaccccccttgtacaacccccaaaaaaaaaaaacccacccccccaacaccaccccataccctaaaaaaaagcccaaaaaacaattcccaaacaaaactaaaaaattccggcccgccaaaaatattttttcctcc

SEQ ID NO: 27384 - DNA, 235 bp, Zea mays
  Clone ID: cC-zmle189111g06a1
cgcgagtgggccaccactgccagtaagctttgaaaatttaacaatatttggtaatttctgcagtttgaggcaagccttatatagtacaataaatggtgttagcaggcactacccagtttcataaccactaaagaatgatcctccatgtgctgtttggagagcaggaattttcacaagaaaacagtccaatcggcaggtcttggaaaaaactatagccttgcaaactgaaaccaac

SEQ ID NO: 27385 - DNA, 281 bp, Zea mays
  Clone ID: cC-zmle189111g07a1
aacctcttaaattccttacccttaccttcagtcttacaaaatttccaaaaaaccaattaaataaaaccttgccataacaaagtaaaaaccagtacccagaaaaaaaacattatcattaaaaatttcaacacaaaaaccaacccaaaaccaaaaacagaaaaccctgacataccaaacaagtgaccaaacaaaaaaaaatccaactgaaataaattcccacaaacaacatgcaaaacctatcttccaaactaagttaaggaaaaggccaaaacccataaaaa

SEQ ID NO: 27386 - DNA, 416 bp, Zea mays
  Clone ID: cC-zmle189111g08a1
caggagccgggtgcttttccattcacggggaagtctttataaccttccctccaagtcgtatcttacatttgataatattgattgtggggaacaatccaggacggtatagctgcatgagccgtaggtatacaaatctgcaatccatgcagctcaacttacactggtttgtatcaaagtttgcaatgatggatcctaagtatccacaaccctactagtgcaacgcgcaagtatgaaatcatatccactgctctaatggtgatccaagtaggagatcattttgctcaccggtgcaggtactctggtgaaatacatacacgtatatgctccatgtttcacatgatcacaaaatcaaacttgcaccgataagatgtatggaccacgttttcttgcccccacaaaaaaaaacgatcgaactg

SEQ ID NO: 27387 - DNA, 373 bp, Zea mays
  Clone ID: cC-zmle189111g09a1
gcctcccgccggcgctcggcctccggggcccgctggtcggccgccttgtccgggctcggcgttggcgccgcgtcggccgcagccgcctggggccgaggccgccacgagagccgggcggacgaggaggaggagaggccggccgcggagatgtccgccggcgacgagctcaggatggagaaggccaggatcttgtccatggtctggtcggtcacagacgacgccccggcggatggaaatcggcagaggtgggggtccccttttcttgcttcgtgtggaactgttggtttctgctgtggcgtgctcttgcacctgcagttgcagttgcgtttggtgtgtgcgcgcgcttgccgcttgctggttgcggacgcgtggg

SEQ ID NO: 27388 - DNA, 405 bp, Zea mays
  Clone ID: cC-zmle189111g10a1
ccaatgaaaaatatctccagaagtgatttaagtactttccaagactcgtatatgtccgacaacatatatgctgccctcgtacttaattaagctcgggcatctatatattaatatcagtagggcagaatccctaacgccttgccgtactcaaccacattgtcgtagatctcgtccagcgtgttgtgcctgtactcaaacccttcccggacgagcttttccgacgacaccctcaccctcggcttctcgagtagctgctgttcatcgtcgtggaggtttgttttcacgccgtactgcgggtacttgtgtgccaggaaacgcgcgagctcgaggacggttcgtgttgaggccgcagcaaatgtacctcccgttggccgccgccgcctccgccaggaacagctcggcgcg

SEQ ID NO: 27389 - DNA, 487 bp, Zea mays
  Clone ID: cC-zmle189111g11a1
aaaacatgaaaaagggtttggttataaaagtctcaaacaaccagcatgaaaaatatattttcgtattttgaacatttttggaataattttccttaaaaattattaatttcaaagtttattatttatttacatcatcgggatagtaataattgtattagtttaataaataaatactccttatgtacacacagaacgtttaaaatttacaatattcacaggattgaaaatcgtatctcttttaggatgattaactttgaaaaaatgaaaaaaacaaataaactatatacataattcgaagctatgcttggaagttaaggaaaaagtaggtatacaattatcaaattaacttgaacagtgtattgaatgcgtcctagatcacaaatttcatttgtgattgacaataaagaaataaaaacttcatggaaattcttcagctattataagattggtaactaatgatagagttctatgaatatttggctgattt

SEQ ID NO: 27390 - DNA, 236 bp, Zea mays
  unsure at all n locations
  Clone ID: cC-zmle189111g12a1
aaaaanaaaaaaaaaaaaccatttcttatttctccaacagtttgggggaagaccacaaaaaaaaaaaacccggccattaaaaaaaaaaaactcaccccaataaaaaacaaaaaaaaaatttctttccaacccccaaaatgaaaaaaaggcccaaaaaaacccccccccatttggtgttaaaaaaaccctttatttcatccccaccccgggaaccgaaaaaaagggggggggccccc

SEQ ID NO: 27391 - DNA, 318 bp, Zea mays
  Clone ID: cC-zmle189111h01a1
gaaatgtatgtattggaggctcaagtttgttcatgaacaatatgtgccctcgtttcagaacagtttgttttggtttgcaaaatatcaacacaagggcataaaagcagctattctgaatgcacacagaatatcaggacttgctatgccacccttatcaaatctcgtcttaatatcatacatatatatagtcacgacattcttgaagctaggtttctattgataatactatcttggctttccccctttcaactggggaaggtggtacattgttcgatcggcatctaacatccaaaatcataaggaaccaatccttgtagc

SEQ ID NO: 27392 - DNA, 619 bp, Zea mays
  Clone ID: cC-zmle189111h01d1
gtgcggggacttgggcaactccaacgtctccggctccatcggccctgatctcggccgccttgtcaacctcaaatgcgtggggctgtacaggaacaaccttgacggcgacatccccaaggaattgggcaacctcaagaacctgatcagcttgcatctgtatgccaacaagctcacgggaggaatccccaagtcactctccaagctcgactcactcagattcatgcgcttgaacaacaacaagcttacaggatcaattccaagggagtttgccaagctctccaacctgaaagtcatcgatttgtctaacaatgatctctgtggaactattcctgttgatgggcctttctcaacctttcctctccgaagcttcgagaacaacagcaggctcaacggtccagagctacaaggattggttccttatgattttggatgttagatgccgatcaacaatgtaccaccttccccagttgaaagggggaaagccaagatagtattatcaatagaaacctagcttcaagatgtcgtgactatatatatgtatgatattaagacgagatttgataagggtggcatagcacgtcctgatattctgtgtgcattcagaatagctgcttttatg

SEQ ID NO: 27393 - DNA, 367 bp, Zea mays
  Clone ID: cC-zmle189111h02a1
ttttagcttaattgcatgcatgcatcattagataggggggcagtgatggatcgttacacgctgcaaaagcatgcgcttagtcgttatttgcagacgataataagtagatcgatggagtagtgatcgagcaacacacacgtgacgacgtttgctcttatttacttacacgcacgcacgtgtacggcgctaggggccgtatatatatcgagttctgcatgcatatctcgatcgatgggatgatcagtcgtttcagtcgcagtagtaggagtagccgtgcccgtgcccgtgcccgtgcggcaccctgtgctcctgctgcctgctctcgtagtgggcctccttctgctcgcggtgctcgtggtacgcgtag

SEQ ID NO: 27394 - DNA, 413 bp, Zea mays
  Clone ID: cC-zmle189111h02d1
agatcgaggccggcgtggcaacggcggcggcgctgggcgccggttgctacgcgtaccacgagcaccgcgggcagagggaggcccactacgagagcaggcagcaggagcacagggtgccgcacgggcacgggcacgggcacggctactcctactactgcgactgaaacgactgatcatcccatcgatcgagatatgcatgcagaactcgatatatatacggcccctagcgccgtacacgtgcgtgcgtgtaagtaaataagagcaaacgtcgtcacgtgtgtgttgctcgatcactactccatcgatctacttattatcgtctgcaaataacgactaagcgcatgcttctgcagcgtgtaacgatccatcactgttactatatctaatgatgcatgcatgcaattaagctaaaa

SEQ ID NO: 27395 - DNA, 338 bp, Zea mays
  Clone ID: cC-zmle189111h03a1
ccggtctcaataagagcaggactagtttgttgttacaggcagcaggctggccatgcatgaatcatgaccgatgcaacgcttcaggttcctttacaacacgcatgcatttagctttccacagcaaacaactggcggcggcggcagcaggtatgctgatgcaccaacgttctagtggaacttgaggctggtgagcacgttgttgttgacggggtcggcgaggtggtcgagcaggttctggaacgggccaacgccggtgacgagcccctggatgaagtaaccgaggatggcgagcatggcgagcctgccgttcttgatctccttgagcttgagctcattca

SEQ ID NO: 27396 - DNA, 457 bp, Zea mays
  Clone ID: cC-zmle189111h03d1
gggcttcgacccgctgggcctctcggacccggagggcaccggggtcttcatcgagcccaagtggctggcctgcggggaggtgatcaacggccgctacgccatgctaggcgcggtgggcgccatcgccccggagatcttcggcaagatgggcatcatccccccggagaccgcgctgccgtggttcaagacgggcgtcatcccgcccgcgggcacctacaactactgggccgactcctacacgctcttcgtcttcaacatggcgctcatgggcttcgccgagcaccgccgcctccaggactggtacaacccgggctccatgggcaagcagtacttcctcggcctcgagaagttcctcgccggctccggcgacccgtcctaccccggcgggcccctcttcaacccgctcggcttcggcaagaccgagaaggagatgaatgagctcaagctcaaggagaat

SEQ ID NO: 27397 - DNA, 323 bp, Zea mays
  Clone ID: cC-zmle189111h04a1
aagaagagatgataaacaggtgttcttggtttagacagtgtgtatatatagagagagacaaagagcaagtgaatttgtaggaacaacgcccacggagaacgaacgcaagcctatttcctcatcacaaggaacggaggcatacataggtctcatgtgtgagcactgagcaccgctggttccggatcatcctcatgccttccaccatgggtcctcgccggtcctgaagtcggtctccacccacgggacgaagaggaccttgccgtcgtcgacgtcggcgtgaaccagggccagcgacagaggcgccggtccacggaccaccttgc

SEQ ID NO: 27398 - DNA, 133 bp, Zea mays
  Clone ID: cC-zmle189111h05a1
ggaaaaaacatgcaggtaaacaatgtccccccccttgccaggttcaacccatatttaaaaccccggggagagagataatccaatgcaatgcgacaggcgacagcccccaacatgtttcggttgaacccattga

SEQ ID NO: 27399 - DNA, 173 bp, Zea mays
  Clone ID: cC-zmle189111h06a1
gggggggtaggattaccaaaaagttttattcaggtcaccagcttattgtcgtaattcgtacaggagctgagtgcgtgcacgttccatagccaagtacgatgaccctgcacaaccagtcaaccacagacatacataaggcacgcaagcaggcaccaacgggcctggattcccgc

SEQ ID NO: 27400 - DNA, 453 bp, Zea mays
  Clone ID: cC-zmle189111h07a1
ttttgagatcagtttcctctttcaaaagaaacgggagtcgggaagtttttgccggtgtacaaggacaggaaaatgtgtttcgaaatttaggaaatgctaaataccaccgttactggatatcattttttcattaataatgtaatgctacccaaaaaaaagtaacggtctttggcagatttttcatacggtcggccatgggcccaagctacactcggagccaagtggaaaaatgcagaactccgttgctagcctcgtcagacttcctcaacctggggaagattcattaactccaaaaccgccttagttggagttaactcattatcaattatccgtgccaccgctgtcaataccggcattttgaccttgtacttctgcgccaacgcaatgacagccccagcagttgatacgccttcagcaacctgatttatagaacccatgattcttgtcagcttt

SEQ ID NO: 27401 - DNA, 319 bp, Zea mays
  Clone ID: cC-zmle189111h08a1
ttttgagatcaaagaacactgttaaatgacacgggctgggtaaaacatcgtatgaaacctatgacactaaaaagatcccgacaagccaggaccatctacataccaccgtgcctcaatttctcataatcattaataaggaggggctaccgatacaacacaaacggggcatgataaagtacttatacgctcggacataatccgactctacaacatgtgacagcactgaacattcttaagcccaggtgctaacctcaagcctacttcctcagcctaaagcttatacattctcttgaacaccctcttactgggggggaaccta

SEQ ID NO: 27402 - DNA, 338 bp, Zea mays
  Clone ID: cC-zmle189111h09a1
gagcatcaacataaacccataatgattttttttgagtgaaaaattatatttacactcatgtcacatacaagtatactgatagtttgaccctatggcacacatcattttcaaacaacaaacatgaaatatgttcaaatagctgccagggacaacaaacatttattttatccaaaagtaaaacctatactgagttggcgctgccctttaacaattttatgtacctcaccgcacgacctgttggaactggccaactgcaacctcaaagactggtgcaaccccaccacttcaaaagctagtcaccttacctgcacctgcttgcaagccaaaaccgaggagga

SEQ ID NO: 27403 - DNA, 434 bp, Zea mays
  Clone ID: cC-zmle189111h10a1
ttttaaacacaactgaagccgcgtgtcttccgtggtattgtggattatatgcattattatatacaagttaatgcagtatagatactgctttctacccacccaattctcctaataatatgcattcacagtaaaaacaacaatctcctagcaacaaaaacctttaaaaacgtattcatgagcgtgtcacttgtaggcgtggatgtagtcttgaaagtagaagttcttctggatgaagttggcaagccaacgggaggcagcgaagcacagcacggtcgccgacacgactgcggccctctgaacagttgacgtgaggaccgttcccttagcgacggcaaggaacccgacgacggcgaccgaggccacctgcagggcagcctcgagcgccttcatggccttgagcgccccgttgcagctcctgcactgcaccacgtgcg

SEQ ID NO: 27404 - DNA, 347 bp, Zea mays
  Clone ID: cC-zmle189111h11a1
taagcttcatcctcaaagcggccgccctcccccccccccttccctttcccccccccccccccttattccttggttttgctcttttttttttctccctacatttccaaaccccccctttattcaaacccacccccccaaaaaaaaacctaaaaaaaaactgaacccaacaaaaacaaaacccacacccctaacaaaaataaaccctctcacaatttcaaacaacaaacaaaccccaaacaaaaaaaaaaaaaaccccttaaccccaaaacccaaaaaaaacaaaaaaaaagaaatccaaaaacattcccctttccaaaaccaaaaacatacccacccccaaaatgaaa

SEQ ID NO: 27405 - DNA, 546 bp, Zea mays
  Clone ID: cC-zmle189111h12a1
tttttggatgaaacgtgagacaagtattgttattgggcaagaagaacatatcgatcgtgtagtaactttggcttctataggaacacaacttgaagaaccaaccagctatagcgggtccagggtacaaccgtacaagcatatttcctcaagccgagcacaagcgcccgaggattttttacatctacagacgtcctccaatatgaaaacacgaaacatggaatactagcagcgccgtccaacttttaagaatcctgcaaaaaacaaactgtaatgaagaatggtcaaccagttcctcttccttccccggatccaatccaatggagcacctcagacgaattaagcgaccgcgggcatgtccttaagccaggcgtcgagcggcttgccgatggagtagacgatgaagccgatctccctcagcttctccgggtcgacgatgttgcggccgtcgaagacaaagcgggctttgcatgttgtcgaagatcttctggtagtccagggtcttgaactcgtcccactcggtcaggatgcacaccccgtgggcgccct

SEQ ID NO: 27406 - DNA, 419 bp, Zea mays
  Clone ID: cC-zmle189063d09d1
attccaaattgctcggacaataggcctgtgtaccctcgtggtcaaggaaggaagcttttaagtgcggcgatggcggggtctgtctgcgcgtcagctgtacacgcctaggctaccgcgaggcggggtctgtctgcgtcagctgtacacgcctaggctaccgcccgaacggcatttcatttgccttcttcgtactgcatgtgtatcttcttttttccccttgtatacaatctgctgcagctataccggccatgagtatggcatggtatggcggctggcagccgctaacttgtttttacctacttggtgtagcgcctgtgtaacagttttcgatcgatcttgcttgttgtgttgtcgatgctaataaccgagtgtaattgacgaaatgactaatatgatgagtagtgtagtagatgtccata

SEQ ID NO: 27407 - DNA, 361 bp, Zea mays
  Clone ID: cC-zmle189063d11d1
cggaatcctggtcgaccacgcgttcgcccacgcgtccgggaagagcctgaaaagcagtctgttggtgtgcctggatcttctggtggaataatgagtgaatgtggaaccaatcaacctattgaaaaagtacttgcagctgatgatgcggagtgctgcatttgcctctcagctgatgatgatggcgcacagctccgtgaactcccttgtggccaccattttcattgtgtttgcatcgataaatggctgcacatcaatgccacgcgccccctatgcaagtacaacgcaccgaaaaaacagcagcagcagtggctgcgaagaagtatgaatctctatacgagaacattgagaatgcatacccaac

SEQ ID NO: 27408 - DNA, 270 bp, Zea mays
  Clone ID: cC-zmle189063d12d1
gcggtggttcaagggcgccaggaagggcgtcgagatggccgccgtctccttcagcgtcgcgtgaccgaggtaaactattgtttctttgatgcttttcatcagggatgcacatgcacgcaccgtgtgtacgtagagagctaggcatggcctggctcgccatgcttgttgtgtgtttctttgattgtacatgagaggacccgtttctgctgccatccaagttgtttgagaaatcttggtactaatattgcttcgtcttttttttttttaaaa

SEQ ID NO: 27409 - DNA, 573 bp, Zea mays
  Clone ID: cC-zmle189063e01d1
ggttgacccacgcgtccgcgaggaatcttattacatgaacaggtccccaagcatccgtattgttaacaggagatggggtgacaatgggtacatgaggggaggcaggaaagaggcgaggccagtgaatactgatgtggctgctggtccatccaggactccgaagaagaaagagaaagccgcatcctcttcggcgtcggtgtcagtgtctggttcggggtcaggatcggggtctgtatccaaggatgtcgctggaaggcgggcgaagagggcgcagaagcgagaagctgcagacaaggcagctgcagagaagcacctgaagcacctgcagaggttggggctgagaaaatcgccagagcctgtagtgcccgaggaggttgggccacaggtgaatgagtgacttaagccgccgcctagtgctatatggtgctgctaaaaacactgcagccctttgggccacaaaataatcttccactgtgaagagcttgagcgtggccttgtatcatggcagcttttcgcctcgtggacatagtctagtttctcatcactggtttagattcagcacagaaatgcagc

SEQ ID NO: 27410 - DNA, 646 bp, Zea mays
  Clone ID: cC-zmle189063e02d1
gcccacgcgttcgcccaaaccaatccgtcgcagacactcaaggtctcaggatgccgccgtcgcgtgagcaccaccaggcccaggacgaagaggacgacgataccgcaggcgttgtcaagctcatcagcgccgagggcttcgaattcgttgttgacaggaaggccgccatggtctccaacaccctccgcaacatgctcacatccccaggcggcttctctgagacgcgccagggcgaggtccgcttcccagagatccccaccaacatcctcgagaagatctgccagtatttctattggtcgctccattactccagtgggaaggagacagcggagtttccaatcgaaccggagataaccctggagcttatgatggccgcaaactatctggacacttgatgaggagcctgagggatttgatctgatctgatccgatccagtgtggtctggcacaatgtaatgtaaaggtgggagggaagcagataccaaggaatacattttgcaatctacagtgtgtgctactatcaactcttggcagtgttttggtgtcttctgggaggccgtgactgctgctgctgtctgatgatgattacttttgcttggacggtttcgatggaaacccgaccgagacgctttgtttattggtgctg

SEQ ID NO: 27411 - DNA, 592 bp, Zea mays
  Clone ID: cC-zmle189063e03d1
cggacgcgtgggtgccggagtcttccctgaacacaagtacgagatcgtgaagagactgcaagagaagaagcacatggttggtatgactggagacggtgtcaacgacgccccggctcttaagaaggccgacatcggtatcgctgtcgcggacgctaccgacgcggccaggagcgcttccgacattgtccttactgagccaggtctcagtgtcatcatcagcgctgtcctcaccagcagatgcatcttccagaggatgaagaactacaccatctatgcagtctccatcacaatccgtatagtgcttggatttatgctcattgcattgatctggcaatacgatttctcccccttcatggtccttatcatcgccattctcaacgacggcactatcatgaccatctctaaggacagagttaagccgtctccgttgccggacagctggaagctgaaggagatctttgccacgggcatcgtgcttggaagctacctcgctctgatgactggcattttcttctgggctatgcacaagaccgacttcttctcggacaaattcggtgtgaggtcgatcagggacagtgagcatgagatgatg

SEQ ID NO: 27412 - DNA, 477 bp, Zea mays
  Clone ID: cC-zmle189063e04d1
aagctatcgagactgccaaggctcttgctctgaaagaagggttgttggttggaatctcttctggtgctgctgcaggtgcggcagttaggcttgctaagaggccagaaaacgccggaaagctatttgttgtcgtgttcccgagcttcggcgagcgctacctctcatcggtgctgttccagtccatcaagaaggaagcggagagcatggaggtcgagccctagagcacaaaattctgggcttctggcaaactatttcctgagacgttcaccatttccatcacagaaaaataaagctcgggtgccttctgttgatttcgacgtacatttacctgccgatggtgtccagcccactgttgtcgctggagaacacgtcgtttttaaacttgtgatatttaactactgatatgacactcgttgtatttctgtatatcgcgttatacttggaaatataagcagtaccagtgtgttttttgcaaaa

SEQ ID NO: 27413 - DNA, 624 bp, Zea mays
  Clone ID: cC-zmle189063e05d1
cactaatacacggctatcaccgttcacactcgttctcaacgacctccaacgccttataacttaataccttgcgtatttcaataccactcccccaaaccaacaatcaagatgcgttccttcgccgtcattgctggcttcgccgccgttgcccttgctgctccccagtacgaggcttaccctgctgcccctgcctcttcctcggctgccgctgagtacccggcctaccccgccgagacctcttcagcccctgcctacgaggctgcctcctgcgctgctgagtacccagcctaccccgctgagacctcctccgctggatacgaggcttccaagcccgactacgaggcctgcaagcctgcctacgaggccagctccgctggccccgtctacagcgcctccaagcccgcttacaccaccaccgaggctgtccacgccaccagctacgtctgccctgagcccaccaccatcacctacggagcctgcacctacaccatctgcagcagcaccaccctcagcatccctgagttcactgctacctacgtgcacaccgctatccccgagattccggctggtcccatgcacactgtcttctctgagatgccttccgttctcgaagctttccacact

SEQ ID NO: 27414 - DNA, 523 bp, Zea mays
  Clone ID: cC-zmle189063e06d1
ccctcgcacacggagcggagaagccttactagggcaggattggttaggccggcttggaccccaacatgcctaagagggctaccaacgctttcttcgagttcatggaggaatgtcgcttggagttcaatgataagaaccctaacaacaaggctgccgctgcggtgtcgaaagctgctggcgacaggtgtaaatccctgagcgagtcagtcaaggctccctatgtagccaacgctaacaagctcaagctcgagtacaacaaggccatctctgcctacatcaagggcgagagcactgcagctaacaaggctgctgccaaggaggatgaggaggacgatgacgaggactccgacacgtcctagtcggacgtcaacgacgaggatgatgaagagggtatcgaggacgatgcagatgttgacaagtgatgcagctcatcatgacaatgtaccgtgcttcattcaacattggatcggctacacaaagccacgccgtgatcacaataacggagcctatattcctgtactag

SEQ ID NO: 27415 - DNA, 559 bp, Zea mays
  Clone ID: cC-zmle189063e07d1
tcccgggtcgatcccacgcgtccgcgacttgtttcattgattctggacgagatcgagcttgttttgcaccacaaggtcgaggatgtctcgcaactgcggatcaagctgcggctgcggctcaagctgcaagtgcggcaagaagcaccctgacctggaggagacgagcaccgacgcgcaggccaccgtcgtcctcggcgtggccccggagaagaaggccgcgcccgagttcatctaggccgcggcggagtccggcgaggccagccacggctgcagctgcggtggcaactgcaagtgcgacccctgcaactgctgatcacatcgatcgacgaccatggatatgactattatctatctagcttgaggtggtggctgaacaataataagcgaggccgagctggctgccatacataggtattgtgtggtgtgtgtgagagagagagaaacagagctcttcagtatgctatctctctatgcatgtttggcgtctgtctttgtgctcatggacttacgtgtgtatacctgcatgtaggttgatccgattgcatctgctggaaccata

SEQ ID NO: 27416 - DNA, 574 bp, Zea mays
  Clone ID: cC-zmle189063e08d1
ggcctagtggccaggtgctggtcaagaacgaatacagctggaacaaagaggccaatgtgatatacctggagacgccggctggtgttggctactcctactctgctgatgctgcttactaccagggcgtggatgacaagatgacagccatggacaacatggtgttcctgcaaaggtggctccaaaagttcccacagtacaagggcagagacctctacatcgctggagagagctacgcagggcactacatcccgcagctcgcggaggccatggtggagttcaacatgaaggacaggatcttcaacctcagaggagtcgccctgggcaacccggtgctggagttcgcgacggacttcaacgcccgcgccgagtacttctggtcgcacggcctcatctccgacgccacctaccgcgtgttcacctacggctgcaactactcccgctacgtcaccgattactacagcggctcgctgtcgccggtgtgcgcccgggtgatgaaccaggtgacgcgcgagaccagccagttcgtcgacaagtacgacgtcacgctcgacgtctgcctctcgtccgagctctc

SEQ ID NO: 27417 - DNA, 560 bp, Zea mays
  Clone ID: cC-zmle189063e09d1
agcagatgctgagagcagggtagcagagcgaccacggctgaatctgaagcctcgttcctatgtaacaggacagtctgatgaaattgctgtcaaggaaaggccatctctctttggtggtgctcgccccagggaacaagttctcaaagaacgtggagtggatgttttggccagtgatctcgagaagacttcaccagttggcaggcctaaaggcgaatttgcaaaggttgagcagaaggttgaagctatgtccattaacccttctgttgaaagacatgagagttttgcagctggtcatagaggcccaaggaatggtgataagaaagatcataagtggaatactgacagggctgatgcatataggcttactcgtcgagaggacaacaggagggttgctagagatatggagaagccacaggagcaaccacgcccagagcctgagacctggcgtaagccggtggagcctacaaagctagaggttgcaacacctcgttttgggaaagcagcaaccgcgttggagctcgcccatgccttctcaacgtctatgtctgatactgcaccac

SEQ ID NO: 27418 - DNA, 538 bp, Zea mays
  Clone ID: cC-zmle189063e11d1
ccgtttgatgtctcgttcgtccgattcgttcctatgcaatagggcatactcaagattttgaagtgaattatggatatctgccatacatccgagcaactgaaccagttgtgtgttacatggacagaagcactggcaacactataaaaagactactcctggtcaagggtccttaacacagaccttagagaagatgtggactgcccgtgtatgtcacactaaacgggagctacacctagacttcaaaacatgatcccgaggaacgagatcgagaccactacacgccaactacagcttatgcttgaaaaaggaccgtgtgcgaccccgttcttgaaacgccaggcttacttatattgcacctcctgttggtactcaggcttggtcttattctacacgggcgtgtacaggctcaagcccaggctcttgggcaccgacttgtccatgctggacgcgaactccttgggagtagctgaggttgaacccgctctgcataaggagcgtctggatcaccagacttagcggctgcttcagataatctgtc

SEQ ID NO: 27419 - DNA, 233 bp, Zea mays
  Clone ID: cC-zmle189063f02d1
gtcgacccacgcttccgcaagagcaccatggggaagccatacagggtgttctaagtatgctcttttgtgaagtctgctaggttctggcagcgaggttttattgaattaaactcttgttaaggatatgtttttggacgatcctatatttcgtcctggcgctactatgtttcagaatggtggtactactataagtatcctagcgctataagtattgcttgaaaggatcaatatat

SEQ ID NO: 27420 - DNA, 594 bp, Zea mays
  Clone ID: cC-zmle189063f03d1
ataggctcattcatcgaaacgcaaatcagagagacaggaaaagataaaagaattttgatcaaatcaatagaaggaaggatcccttacctgatttgaatttcatcctcctttaaataggatatgctctaagtcttcccatactttcctataatgactgcaacgattttctccattttgcgaattcctattttatttgaagtatattactatcatatacattatctaaatcgatccactttaaataaaatagaaaaaatcgaaagaaaaaaaaaaaagaaagagtaaataataaaacaggatattctgtttcataattctgaaatagagttcttttttttagtattactcctcattaggatgtatatattaatcatcctattttaatatatattaatcatcctattttaattaggttctaatccaattagtagtaagtattttcttttttatttaatagtctctgactatcattaaataaagggtagagcaattctttgtttctagagattctagagaaagtgagacaaagtgaagcgaaagagttttctttgtataagaattaggtctatatcatatctaaatagaatggaaatc

SEQ ID NO: 27421 - DNA, 447 bp, Zea mays
  Clone ID: cC-zmle189063f04d1
cggacgcgtggggatgcgctctagctagttaatcatatatacatatatacacgtccgatccattcgtgtggatgacatccatgttgcatatgtacaagtacatgtctcttcttcaagagtcaagactagctgtaattgagctgagcatacttggtgttgctgttgttcagttaatttgcaaaaacgcacaacacaagaaagaaggagaaaaaaaacagagtggaaatgttttttttttaagatctggagaacaacatgattgagaagggagggaaggtgattctgagcacagttttgttggaaaggctgtagttaattctggtggatgtaatatattatatgtatgtatatgcttagattcgttaatatatatgcatatatatgcacccacatgaatatgatttacagagattatattaaaaaaaaaagacgtgtagttaaaaggtt

SEQ ID NO: 27422 - DNA, 276 bp, Zea mays
  Clone ID: cC-zmle189063f05d1
ggtgcagaggtctatgactgcaactacatgttaaatccaaatatttttactttgcctaaataaatactagaataggggggtggatttaaattgacaacaaggatcatgatcatatcaccatacacacactataactataaaacagggatactacgctattagctctctttaaatgcatttcatggaagcaaggtatatgatcagattattgtataccagagaacactcaagactcccaaatgaccgtctgccgaggtgagctccgaatgcctgccc

SEQ ID NO: 27423 - DNA, 497 bp, Zea mays
  Clone ID: cC-zmle189063f07d1
aaagctgctggtgcttctcgagttattggcattgacatttacaataaaaagtttgatgttgcaaagaactgtggagttacagaatttgttaacccaaaagagcatgacaaaccgatacagcaggtcctggtcgatcttacagatggcggcgtggattacagctttgagtgcattggaaatgtttcggttatgagggctgcactggaatgctgccacaagggctggggaacttccgtcatcgctggtgtcgccgcctctggccaggagatcgccacacgaccattccagctcgtgactggtcgtgtctggaagggaaccgctttcggtggcttcaagagccggacccaggtcccatggcttgttgacaagttcatgaagaaggaaattaaggcggacgagtacattacgcacatcatgaacctggctgacattaatgacgccttccacctgctccacgaaggtggctgtctgcgttgtgtgctggcgatgcagatctg

SEQ ID NO: 27424 - DNA, 517 bp, Zea mays
  Clone ID: cC-zmle189063f08d1
cccactcgtccgcgtggagacgcgatactacgatggcctgataggcatcttctagcagcatcacacgtctgggacaggctttatcaaagtggagagatcctatggcagcaccttcagcgtgatgactaacggctacccacctgccagctctgtccgctgcacgagcaatcctgcgacaaatgatcggataccatcttctgaatcgatcatccctgcttcgaacaagcccagcaggagcgactcctgaccagcctttccttgccttgaagtgccgtggattgcttacctgcaaagataataaaatgcactgcttctgtgtggtagtaccgtagtagtgcagcacgcggcagagatcctgacttgacactcgagagagagagaagggaagcatactgccggagtgccgggcgcacgggttggggacacgagatgtgactacttcaacgaagaatgtggacgggcacgggtgcgtcagcacatgttacttagtgctgcacctgcacactactgatcgagt

SEQ ID NO: 27425 - DNA, 451 bp, Zea mays
  Clone ID: cC-zmle189063f09d1
cccacgcgtccgggcgacgggaccgtgcactggtactacgacaggcaagaggacctggaggcgtctgcgagggaggagctgctgcgggaggagctgctcgaggagattgagcagagggttgggggcctcagggagctggaggaagcgagcaaggaggagcagctcacaaagtgatcacgcgggcgaatgggctactcatcagctctctatctgagcttcgttagcaaataagttcagacttctctttactgccatgctcaagtctgtatatggccaaaacccaaaacgattgatcaactgcgctactgcagtgcaatagcaggatacgtatagatttcttttcaagggaaacaggaggggagtgcagtgcacccccgcccatactgcatgttattaataaaagaaagttatttacagaatcaggacaggctctacaggatacatggcatta

SEQ ID NO: 27426 - DNA, 511 bp, Zea mays
  Clone ID: cC-zmle189063f10d1
gtatagacactggccttccttgtgacttcaatcacagcacatgcaatgggaagaatgaattatgctatggacgagggccaggatatcctgatgaatttgaaagtactcgtatcattggcaataggcaatttcaaaaggctgtagatctttttagttcagcttctgaagaaatacaaggcaaaattgactacaggcatacttacctagatttctcacaacttgaagtgaatgtccgtacaagcacaggaggtcagcaagttgtgaaaacatgcccagcagccatggggtttgcctttgccgctggaactacagatggtcctggagcttttgactttaaacaaggagatgtcaagggaaaccctttctggagattatgtagaaacttacttaagacaccagggaatgagcaagtcgaatgtgaagcaccataacctatcttgcttgacactggtgaaatgaaggaaccatatgattgggcgcctgcaattcttccaattcagatcataagaat

SEQ ID NO: 27427 - DNA, 377 bp, Zea mays
  Clone ID: cC-zmle189063f11d1
cgttccatttaaacacacacccagcgaagcgcactagcaacttcctatcttcaatggctaccatgacattataggtctatgcgcttcttgccctttctgagagcgcaacaaatgcatccattattccacaatgctcacttgctcctagcgccatcatttcacagttcctgcctccagtcacttcaatgggcttcgcacacccagctgagccagactacttgctacaacaagcgcttgttgtgtgcgtcttactacatcctatcgggcacatacaacagcaattgtgggcacaactaaacataccaacggtcgtgtcgcatcatggacaacaacgtctaccatgactgacccaactggccgtggtgaacccttgttcc

SEQ ID NO: 27428 - DNA, 541 bp, Zea mays
  Clone ID: cC-zmle189063g01d1
catgctcaaaaaggtgtttctcatcagctttttataaagtcattagtttgagttcatacattaactatcctcatacgggcaacacttacaataatcaaatcccgtatgaagatcacttctttttttcctttaagccaaggtacagatttgcccgtccaatttgcatttcctaacctgggttacgcttacgcagtttccgttgcagcaaagactcgtatccactcgatcgttcactcacagatagagtatgaaactcccagtcatgtctcaaagatgcccttcacatagaccatccccttctcgctgaacttgaggtccttcctcatctgctcaacctggacgtcatcgccctgcacaaggatctcggacacgttcccgtcatcggataggatcatcttgaccttgatctctgctttgcttgacgctttcgtccagtagtacgctcccgccaaggggctcagggtcatgagccagaaccagttgttgccaccttctgggacagcgatagatagaacatgcccgacactcccgaggctaatgc

SEQ ID NO: 27429 - DNA, 366 bp, Zea mays
  Clone ID: cC-zmle189063g02d1
ccggtattcccgggtcgacctatcgcgttcgcgcacatccacatcttcgctgctcctgatagaattgtttttggttcccacataaggtcacctggccagggattgattgatcatccaatgttatctgcatgtctgtgcagggctttatacagatgatcttctgcaactggtgcgcctacaagcatcatcaacggacttgaaatggcgctcccgcacttgctggcactcctgctgatacgactgtcatgatgctggatgctgcagctgacttgtttgctagctacaactatgtcgttagggtattgcggccactgaggtctctggctgaaaagggttgatggcctgatcgtaagcgttagattgcat

SEQ ID NO: 27430 - DNA, 52 bp, Zea mays
  Clone ID: cC-zmle189063g03d1
cccgggagaaaggctaaaacagcgtatcagcgtaagcttcataaagaggaaa

SEQ ID NO: 27431 - DNA, 563 bp, Zea mays
  Clone ID: cC-zmle189063g04d1
cggacgcgtgggagcacccatcttgcagcaggcggagccgcccgacccgatccgtgcgtgtgtgttggtagagatggctacagcagcttacgctcccatggcgagccaggtgatgaagagcagcccggtgcactcgaggccgaggggcctgtcaggcgctgcgctcacgcggccccggccccggttcagcgtcgtcaaggccgccatccagcccgagaaggcaacgtaccaggtggtgcagcccatcaacggcgacccgttcatcggcagcctggagacgcccgtcacctccagcccgctcatcgcgtggtacctctccaacctgccggcctaccgcaccgccgtgagcccgctgctgcggggcgtcgaggtcggcctcgcccacggctacctcctcgtcgggcccttcgcgctcaccggcccgctccgcaacacgcccgtgcacggccaggcgggcgcgctcggcgccgacggcctcgtcgccatcctcagcgtctgcctcaccatgtactgcgtcgtctacttcaacgagggcgacccgttcacggtgcccacgctcacgc

SEQ ID NO: 27432 - DNA, 474 bp, Zea mays
  Clone ID: cC-zmle189063g05d1
gcgacacacgtgcatcgtggacagaatgtcttgcactcgttttgcggttacctgtgctaaccgagacatgcatcggcagcataatggctggctggactgttcctgctagggatggcagcaggatctatgctcttctgagagaaaggtacgcgatcacagtggtcagagtgaagggtttagactgacgactggagaatgaattactgaaagcactccattagtcgcatagcagtctatgaattatggatgcagtcactgagctgtaggtgtgcaaatcactcgtgtactcagactgaaggatccagaccgtgacatgttgcggaaagaaaagagtagacctatggaggtggtctggagataagctgattcaggggaagtacgtcaataagttagatgctgtccaaggaaatgaaatgttggattaagcctttctttctgaactgagcaacttgatgcattagtggtgtatttaat

SEQ ID NO: 27433 - DNA, 579 bp, Zea mays
  Clone ID: cC-zmle189063g06d1
aattcctgggtcgacccatcgcgtccgcccacgcgtccggattattagaatgttacacaagttctcctcgggttagggttccttagggttttgtggaggggcgagggcggcggctgatgtggagtaccgttgcttcgtcggcgggcttgcctgggccaccagcaacgagtcgctggagaatgccttcgcctgctactgcgagatcctcgactccaaggtcatcaccgaccggtagacggtgaggtcccgcggcttcggcttcgttaccttctcctgcgagaactccatgctcgacgctatcgagaacatgaacggcaaggagctcgacggccgtaacatcaccgttaaccaggcccagtcccgtggcggtggcggtggcggcggcggctacggcggctgtggcggcggcggctggagggactgatgtgcgggcccatcctgggttcagccgagttatcttatctatctatagcatcgggttaccggtcgcttctgtcaccgtgttagtgtccggtctacctttggattaagtgttggtaccctgatgttcgctttggctgctcccgctatgaaacgaga

SEQ ID NO: 27434 - DNA, 343 bp, Zea mays
  Clone ID: cC-zmle189063g08d1
cgaggacgatgacgagttcgaagagttcgagatcgacctagaatgggatgaccaggaagatggcatcgaagccgtgctgcagtgggaggatgattgggatgacgatgacgtgaacgatgatttctcgctgcagcttatggaagagctggacggttgctacggccagaagagctgaagtattatgtctctactgtatataaatgatttttatatggcagctacttttggaaccgttgatgtgctttggatgtgaaagtttttggacatcagtcggcattttgacagcactgtacgtgttaattgtcgtttggatatgtctctagccgatacgctagaatccgcc

SEQ ID NO: 27435 - DNA, 462 bp, Zea mays
  Clone ID: cC-zmle189063g10d1
cacgaaaaataaacgaaggaaccatctagattaagtcttctatcgtatactggaaagtttatctcgcacaagccttccaaatctatctatccgataagtatgaatgtatagattgaccttaaatggttctttatggctgtatttcctggatgtgctcaagagtgttgcatttctcactttctctctcgggcggctgatgtcatgacagattatctaggcgatctgaatgaagatataatcaaggacaacctggtaattgagtatcacattatggatgatatgatggataacggtgtgccactcacaactgagccaaacatctggaaagagatgatcaccccacctaacattgcgaacaaaagtgcgaatggtgatactggcatgagctctacccttggcagcacacttccagatgcagctgcttcttttgtaccttggcgaagaacaacagtcaaggatgca

SEQ ID NO: 27436 - DNA, 530 bp, Zea mays
  Clone ID: cC-zmle189063g11d1
cgaccccgcgttcgcagaggcccattaatcaggcccttgaacggttaatccctacacggcctagagagaaaggaaagaagtgctccggggaagcaccgtgacacccttgctcgcccgcatctctctaaccgccggcgccggcgccggcgccggccatcgttcacatggctgctatgccaccggccttcacgggcaacctgaagaaagcacttgcaggtctgagaagaatcaatttacatgggcttcgatggcgcgttttcgatgctaagggtcaggttaggattgtttttctagctggagtagcatggatgaacttatctcaagaaggatagaggctacgaggtgaattttctatgtgatataggcgctgggacgattggcttcccaaatagccgctgtgcttgaaggcaaggataatccgacctatgcgccccatgtggaaaatggacacatgtgcattggacttaatgcacaggatatcagtgttacacgaaggaaaatgacagataacatttactactggcatacag

SEQ ID NO: 27437 - DNA, 552 bp, Zea mays
  Clone ID: cC-zmle189063g12d1
aattcttacttttcatctttctgcattttaattcagtccttatgatgtttattatatgcttttgacctaactaaatactgcaataaagccagtcatgatattcacttggttaattacaccatctgtatgtttaaaataaaactttttttttttgcgacctgaaaaaccaaatatatataattttagaaaatctcacattcagaatcagtcttgacccatttgttggcgtcaacacttgaacgagcttcatccataatcttatgattactttccaagtacttctttgctatagaatttgaacgttgtggatgtatcttcttgttgagtattggccttagcatctacacacaaaataacatatggaaaaaatgtttctagtgtacataactattattgaattcacttcttttcataataaaaataatattttgcttaaagattgaataatttgatcatatatgcttaccttttccattcgtgtgttgtgcaatgaatctcctctagataaatcaagaagaggaggtggagttttgaagccacttgtgcaaacca

SEQ ID NO: 27438 - DNA, 575 bp, Zea mays
  Clone ID: cC-zmle189063h01d1
gggaaaggcgacgagctggtgacgacgaggagcatctagcgtcgttaagccgccgtgccccaggcgaagtcacaggccgccgctgcggcgccggcgcccacccgatccgtcgccgtcgccgacctcgtgctcacgcctccggtcggaaggagggtgtgtcaaacccatggagcagcctgccgctcccgatcggagcgattttcccgccggggagtgcgaatggcgggaggagctgcggcagcagcagtctcaggtggacgcgctgcgggagcggctcgtggaggcgaaggtcgggttgcggtgctccgagggcgattcccggaaggagctagaacacctgtgccgcagggtgaagaccatcgccacgctgctggcgtacctcaagtccaaggcgaggatcatggcgataccgtacctcgcgcacacctactgcgggatcaggcagcatgatggcgtcgggtacgtcgaccggcacggggtggccgttgcggactggcctaagggcgccgaccctgcgccctgcggtggagcttccgttgacaggactgtggcggagggtggtgctcgtcctgagc

SEQ ID NO: 27439 - DNA, 605 bp, Zea mays
  Clone ID: cC-zmle189063h02d1
taaaggagtataccgtacgtacatcgggtacagagcaaaaccactacttgcgggagacacgtaggttgcaggtactgctacaacggtcggatcaaacgcactctcctgcgccgccgtccgaggcatgagggatctccagaacgacatcgaccttgtgaacccgccggcagagctcgagaaactcaggcacaagaagaagcgcgtcggacaatcccccaactacttcttcatggatgtcaagtgccagggatgctgcagcataaccacggttttcagccactcccagactgttgttgagtgcccaggctgccaaactgttctctgccagcccacgggaggaaaggcgaggctcacggagggatgctctttccgccggaagggagactagagtggagtctgttattagcactggatcggttgtcaatctccaggatgtggattcaaattttgctctgtgcccagacgttaaggtcatgaactaccttagctaaggctatccgcatgttgatctggtgctgctatgtatcgcacgttggttattgctgaacatataagctgtttggatcggactatgattaaccaaagggatatttgaatgatattaa

SEQ ID NO: 27440 - DNA, 489 bp, Zea mays
  Clone ID: cC-zmle189063h03d1
agaaggaggaggtcatggtggaggtcgaggacggcaacgtcctttagatcagcggcgaacgcaacaaggagcaggaggagaagacggacacctggcaccgcgtggagcggagcagcgggaggttcctgcgcaggttccgactgcccgagaacgctaagacggagcagatcacggccgccatggagaacggcgtgcttacagtcactgtgccgaaggaggacgccaagaagcctgaagtgaagtccattcagatctccggctagacctcggtctgcggtcgtcgtacctgcgtggtttgaggaacggcagttcgcctcggtcgttctgtgaaataaaattgggttacaagaattatggcgttcgtcaatatggtcgaaatgtcgtaggatggcggaatgtggtcacaaactttgcgtatgttgggtctactggtggtgtctgaatctatgtatggatgtcatgagcttgtctaaaaaaaaaaaaataagg

SEQ ID NO: 27441 - DNA, 490 bp, Zea mays
  Clone ID: cC-zmle189063h05d1
ccttaccgtctctggagtctggaagtctgttcctcctcggctcctactccggcatgggcggcggaaacctgtacgggcgggcgctgagctacgtagtcaacgagctcctcgtcgagggcctggccaacaaccgtgcattccataggtacgctgtgaagaccaacaggactcttgagagcctatcgtctaaagctaaggaagtgagggaggagttatcggaacaatggagggaagctcgtggccagaaagatcacttcaagcagtgaagctggttcccacatcgattcagcaagatgatactgacaatcttgttacgagtttagtccttgtctgggtactatttatgaatgacatgctggatgtcattcaatggaaatgagtcttaagttaatctgcacttagatgagtagacgcattgcagttggtctcatgtcctttgtcataaactattgcgtaattcgtaataatgcgtgcccatgatgatatgaaa

SEQ ID NO: 27442 - DNA, 178 bp, Zea mays
  Clone ID: cC-zmle189063h06d1
gatagatagttcatagctagactgctagactagataattccatctccgtcgtgacgacgcaaggcctcatgatgagtgagctcgagcatggctggcatggcagcacttcctgcttgactgcgtctgcgtggtcagattaagcctttgataattgtaagacgatctgaaaatctgagtg

SEQ ID NO: 27443 - DNA, 452 bp, Zea mays
  Clone ID: cC-zmle189063h07d1
gaagacccacgcgtacgctgacgcttgggcggacgcgtgggttgataagaatggcttgaagattgctgtcttcgtgccaaatgacgggtgtttgaactacattgaggaaaatgatgaggtctcgattgctggattaggtcgtaaggggcacgctgtgggagatattcctggcgtccggttcaaggtcgtcaaggattccggtgtgtactctgcttgcccttttcaaggtgaagactgagattccaaggtcttagatggctcttgctaccaaaatcagcatgcgtggagctgaaacgggagggcgttagatgatgaagaagaatggttgcttgctatgttagcagtgcattcgtgcaattgttaacctaatattatgttggtgaaaacgttttcttttcctacttgctacagttgagtgctactatttcatatcaatgtacttgctgttgtaa

SEQ ID NO: 27444 - DNA, 60 bp, Zea mays
  Clone ID: cC-zmle189063h08d1
tgggtatccgggcagtgttcccgaggcgtccgtggacacgggcgtagatgctggcgcgca

SEQ ID NO: 27445 - DNA, 435 bp, Zea mays
  Clone ID: cC-zmle189063h10d1
gtcgaaccacccgtcccaattaagggtcctttccgcttgctttccagtttgcggcatcagtctgtggcgcctgcgatggagtctgtgttcggccaatcgcagcggaggaggagggcgggcggcagcggcttcgaatcgctcaagcgtctgggtcacatctcacccgctgtgcagtcccacctcaaacatgtgtacctcaccctatgctccgcgctggccttctctgcactcggcgcgtacctccacatcctcctcatcgtcggtggctccctcacgaccgtgggatgcgtggcctacatcgccttcctcatctgcctgcccgcttcacgggaccaggagaggaaccgcttggcgctgctcatgtctgccgcgctccttcaaggcgcgtccgttggtccgctcgtcgaccttggtattgacttggattcgaggatt

SEQ ID NO: 27446 - DNA, 446 bp, Zea mays
  Clone ID: cC-zmle189063h11d1
acccgatcgaggactcgggggaaaagttctgcttcatcaagggctccatgactctccacccactcttactccgttgaggagagggtgttggactcgagctcacctatagctgcgccgcgcccgcgccgacgtgctgaacatcttgcccacttccaccggcgccgacaatgccgttctcgctggtgctccccaacctcaagggcatgctcaacgggatcgcgctccgggtgcccaccctgaacgtttccgtggtcagacctcgtcgtgcaagtctccatgaagaccctcgacgatgaggtgaaccatgcgttccgcgacgccgaggtctacgagctcacgggcatcctctaggtttgggacgtgccgttcgtgttcgtctacttaggggctccgacgtcttctccaccatggacgccttcctcaccatggggatgggcgacgacatg

SEQ ID NO: 27447 - DNA, 141 bp, Zea mays
  Clone ID: cC-zmle189065a01a1
gggcggcatttaaaacaggagcttaaataaatatctaataacccctcttttgaccggcctgtttcaaatatcccaactcaatccatagtcctagaaaagttttcacctgatttttgccccacaacacaggcttttttaaaa

SEQ ID NO: 27448 - DNA, 565 bp, Zea mays
  Clone ID: cC-zmle189065a01d1
cggcttattaccttcattaattagtttagcttcccgccggcggcgcttcgatttcctccggagataaagattctttggggcatgaatacctagcacctaaacctatgcttaattccatgtccatcccatatgtaatgttcatatgccaactgctcttttcgccatgccttccgatcttgtgaaatgcgaatacaaaaaaagagagagcaaattcttaagaattgcgcgccgttgttgactcttgaattcctcgtcggccttagccacacaatatacttggtcatcgtccatgtgattattattagctcgccgaccgtgctggtaagcgaaagctataccctgtttatcttggataatcagatgctgttcatcgttaaccgcttaaccatcgtcgcccggcccgggtcattagacgacgctggctggctggcggagaagctttctcctccgatgctgcctttcgtctttgtgtataagttttaatagcgctgtggtgtggacgaatatcaggtgaatacttttctagtactatggattgagttcggatattccaaacaggccggtc

SEQ ID NO: 27449 - DNA, 485 bp, Zea mays
  Clone ID: cC-zmle189065a02a1
gtctttttttttttttgctttgaaaaatgactaaaagggaagtggcagcaaaactacagttgacaacaacaaaataagttgctttggaattaatccatatacacaagataagctttgccaaaaaactttggggatttagagttcaaaatgaccaaagtagcgtgcctgttttttctttataaattttgatatggcagagacgtcgccttgaatgattatctggccatcttccatatagatggcaccatctgcatatttcagctcttccaaccgatgagtcacccataatgcggcgacctccccatcggcagccacagagtccctcactgcatttatcacgcctatctggtcatgttcatctaagaatgtggtcagttcgtccagcagtaatactttggatgcttcagctaacgcaccagcaattgcaactctctgtttttgcccaccactcaaagtttggattggcctctgagagtagctcaaca

SEQ ID NO: 27450 - DNA, 628 bp, Zea mays
  Clone ID: cC-zmle189065a02d1
cgcccaccattcatcgaaccctggtcgctccccctcgtcgaagcttttggattttctcctcgaccttccctcctccaggggcgggcgccatcgagggtcgtgacgtcagcctctcggtgaccacgcggcggggcagggtgttgccggtgcttaagggatgctccctccttgtcccgcccgggcagctctggatgctcctcggccccaacggctgcggcaagtccacgctgctcaaggttttcagaatccaacggccggtacagtgtatataaacagaccatgcagctatgtcttccaaaatcctgatcaccaggttgtgatgcctacagtgggatctgatgtcgcatttgggctcggtaagctcaaacttccgttagatgaggtcaggttaagggtatcaaaatctttggatgccgctgggatgttgagctactctcagaggccaatccaaactctgagtggtgggcagaaacagagagttgcacatgctggtgcgttagctgaagcatccaaagtattactgctggacgaactgacccattcttagatgaacatgaccagataggcgtgataaatgcagtgagggactcttgggctgccgatggggatgtcgcccattatgggtgac

SEQ ID NO: 27451 - DNA, 406 bp, Zea mays
  Clone ID: cC-zmle189065a04a1
aaaaaggggacagggcattaccgagttaatccaaagttcgatcttaattatacaggcgttttgcagttccgctgaacggcccgatacagagcacaagcttagttttccacacatttacaacacaccagttacacaagggtggaacgggaaagccaaaaatgaattgcctgaaacagcgtacctaccccatgggcattgggcacttgatgatggattcctgcgcccagattgcacttgcatacctatttcgctacaaagcttgttcaggaaaacgtgcgttaccgcaaagatggctgcccctatgctggggaaagctatatgaatccggtctcgaatgcctacccccgtggacaggaactgctgttcaaggatgccagagccataccgtttctttaagccttgtttt

SEQ ID NO: 27452 - DNA, 476 bp, Zea mays
  Clone ID: cC-zmle189065a04d1
ggtgctcccaatggaggcgaaaacgccgagcatctccatgtctttcctttcttactacagctacgacagaacggggcttgaagtagcggtatggctctggcatccttgaacagcagttcctgtccacgggcgtaggcattcgagaccggattcatatagctctccacagcatacgcgcagccatctctgcggtaacgcacgttctcctgaacgagctttgtagcgagataggtatgcaagtgcaatctgggcgcaggaatccatcatcaagtgcccaatgcccatggggtaggtacgctgtttcaggcaattcattcttggctttcacgttccacccttgtgtaactggtgtgttgtaaatgtgtggaaaactaagcttgtgctctgtatcgggccgttcagcggaactgcaaaacgcctgtataattaagatcgaactttggattaactcggtaatgctttgtctggtttaaaaa

SEQ ID NO: 27453 - DNA, 110 bp, Zea mays
  Clone ID: cC-zmle189065a06a1
gctgtaattgataaaataaaaataagggaaatcgggaggttttgcctcctattatgtcagaatgcataagtatatcatccagaatccccacgcgtccgcggacgcgtggg

SEQ ID NO: 27454 - DNA, 451 bp, Zea mays
  Clone ID: cC-zmle189065a07a1
ttttattttttttttttttttttaaatttttttaatttgggactatgggtaaatttttttttatattttttttcttaaattttttaataattttattaaataatttcatatatactttttaaaaaaaaaaaaaaaaaaaataaagaataaaaagggaaaaaaaaaaaaataaaaaaaaggcaaaagaagtggtgaaaaaaaacacaaaaaaaataaaaaaaatgaagaaaaaataaataaaaaagaaaaaaaacccccccccaccaaaaaaaaaatcaaaccaagggataaaaaaccctaaaaaattttggcccgaaaaaaaaaaaaaaaaaaacaaacgaggaacgcctttaaaaaaaaaagatccaaaaaaggaaaaaaaaaaaaaaaaaacacccccctcaccccccggcaccgggttattaataaaaaaaaaaaccccctatttttt

SEQ ID NO: 27455 - DNA, 482 bp, Zea mays
  Clone ID: cC-zmle189065a07d1
gcccacgcgtccgtaattttctgctggagaattatatgccaggcgctttttccttttagagctcttcgtcaacaagaaactggggggtcaccctttcagaggtttcagctaacccacgtttgccgtacggcggcggcggcggcacgagctctgggctgtcagccatctgccctcctgaaatccagtgcccagttgtgatggacaacatgtcgtctaaccaagtggccagcatgagtgctgtgcctcctgtttcgaaggctacaattgacatgggtattcctgaattctcagctctggcagacttggtgaatgaaggctccgtcgatatccctggaggggcctttgagatgcctggtcctgagtttcccctgccagaaggcgatgacagtgttcccatcgagaccgatgagaccatgtacaacaacgacgagacttagagcctttcaggcatcatcgactccttttgggagcagttcctggta

SEQ ID NO: 27456 - DNA, 413 bp, Zea mays
  Clone ID: cC-zmle189065a08a1
ttttttttttttttttttttttttttttttttataaaaaggaacagtggtttatattaaaaaaaaaatccacccaacccaaaaaaaacaaataaccaaaaaatatccaatatatcctaaaccaaagaaaaacaaaccccaacctcaattccattctaaaactaaacaacttaaaatggaaaaaaaaggctttgatcccccgccccttatctccacccccaaaataaaaaacaatcattcataataaaaaaaaatcttattcatctaaaacgaccctgggatcgaaaaaagaaacccggacccaccccggccgccggaccaaccacccccaaactaaccccaaccctaacctgaccaaaccaataacaaacccctttccaaaaaaaaaattgtttcccatttccaatccacacc

SEQ ID NO: 27457 - DNA, 304 bp, Zea mays
  unsure at all n locations
  Clone ID: cC-zmle189065a08d1
taaataatattttacacaaatatgaaagattgtctcctaatatgtaagtttatcataggtgcttgcaagcaatagcgtngcgggtccaatatatatcctctacaaaaggaaaggagataaggatacagcttcttttgccaacgttcctaatatatctgaaaatttctaggaacttgtttattatgggacggatggagtatgttaaagatgtatgttagtgtttcattcaaaactgtcctatctgttactaatgctatatattatatttgttttccttgagtttttttttcgggccccttcgttg

SEQ ID NO: 27458 - DNA, 442 bp, Zea mays
  Clone ID: cC-zmle189065a09a1
ttttaatttttcaagttgttcatgaccggatgttgagaggggtgagggagaatgatcacaattacacatgaagatttaatttccctgcagtttggacatatctagggtcgacaagacaggtgatgatctcctccattcccatcagacgctgctgctagctgcttcaccacttccagaaaacgttggagccgcacttgaacttctgcttcccctcgcactcaatctcgaggtcgtcgctgatgaaggggactttcttctgcttggcgaggtcctggcacccattgaagttgtaggggaactggcagctgccgaactccacggtgtaggctcgcgcaaagttggctccactggtggccagcctcttcttgtcgttcagctccttgttggccttgctcttctcgaggtactcatcgaagatcgaggccttggccgaccccgtggt

SEQ ID NO: 27459 - DNA, 51 bp, Zea mays
  Clone ID: cC-zmle189065a09d1
caccaagaccaggagcacgagagggcaccaattttgattttcgcgaacacc

SEQ ID NO: 27460 - DNA, 319 bp, Zea mays
  Clone ID: cC-zmle189065a10a1
gggagccaaaaaaaaaaccggttttatttttttttgaacacaattttcccccccttcaaaaaaaacaaatggagtaccggaaccccccttttttgaagtacccccaccccccccacctttttttccttaatttaacacttttattccccaaaaaaaaacctttcccaagggccgggaaggggcctttttttgggaaccataaaattacccccccctgcccaaaaaaaataaaaagggttgtggttttgttccccaaaattatataattttttcgccccccggccggttctaagggtaaccaaaaaggggggggggtttt

SEQ ID NO: 27461 - DNA, 549 bp, Zea mays
  Clone ID: cC-zmle189065a10d1
cgcgtgggcacacagagagacaagtggtttccaaagccaagtgtgtactttctgtctagcaaccagctagctcgggcgggggggggcagccatcatgtcggaggagaagcaccaccacttcttcaaccaccacaagaaggacgaggagcagcccgccggcgagtacgggtactccgagaccgaggtggtcaccgccaccggcgagggcgagtactagaggtacaagaaggaggagaaggagcacaagcacaagcagcaccttggcgaggccggcgccatcgccgccggcgccttcgcactctacgagaagcacgaggcgaagaaggaccccgagacgcgcacaggcacaaaatcacggaggaggtcgctgtcgcggcggccgtcatctccggcggctacgtattccacgagcaccaccaagaagaagaaggaccactaggaccccgaggaggcttaccgctagaaaaagcaccaccacctcttcggctgaccgtaataccgggtcggcgcgcgaccgaactagttagcttcggcgcacacaaccacaca

SEQ ID NO: 27462 - DNA, 395 bp, Zea mays
  Clone ID: cC-zmle189065a11a1
gacatcttgttatgcatttcatgggatcggtcacaagagttgaatcagaaaaaacacatccacacatacacctgacaaacatcttgaaaaaaaattttgcagaaggtttggtagggcagcaagacaagacagttggccctgtttgtttcggcttttttctgaccagcttttctgaaaatctggctgtgggaagaatctgagtatcattacgattacgtgtggaggaagataaagttgtttatagggctcaggatctagaaagtgacggattcctactattacaacgactcaaccgattatgtgtttatgttgattttggatggtttttgccgcaacgaattttatagaagctggctgaaaagctgagcgtttggcagtccgcaacagcttttggt

SEQ ID NO: 27463 - DNA, 573 bp, Zea mays
  unsure at all n locations
  Clone ID: cC-zmle189065a11d1
ggccgcctgtcatatctgatagtgcaaaagatcttataagacggatgttgtattttttctctgccaagcgcttaacagcacgggaagggctatgccatccatggattcgtgatcatggagtacctcctgaccgtccactggatccagctgtcttatctcgcattaagcaattctctgcaatgaataagttgaagaaaatggctttgcgagtaatagctgagagcctatcagaagaggaaattgcggggttgaaggaaatgttccagaccatggacactgacaacagtggcgcaattacctacgatgaactaaaagaaggattgagaaaatatggttccacactgaaggacactgagattcgtgatcttatggatgcagctgatatcgacaacaatggaacaattgactacattgaattcatcgctgcaactttgcatctcaataagctggagcgcgaagaacatcttgtggcggccctttcatatttcgacaaagaaggtagtggctattttacagtggatgaactacagcaagcttgcaaagagcataacantgccgatgctttncttgatg

SEQ ID NO: 27464 - DNA, 355 bp, Zea mays
  Clone ID: cC-zmle189065a12a1
aaaaggggaaccaaccctttgaaaccataaaatttgatctccttccatatttaacaagctgggggtagtctaacactccatttgcaagccggtttgaaaatttcattaccctcacaaacaaaaacgccccctttgttacgagcttgtacacaggcttttaaagccccaccattagctgcttgaccaggtgcatttccccaaggatgtcctaaagttcctccaccaaattggaatacggaatcatttccaaaaattttgggcagagctggcttttgccaaacattaatacccccaaaagccaccggtataacacctgggatggatacccactccttagtgaaaaagataccgggcc

SEQ ID NO: 27465 - DNA, 362 bp, Zea mays
  Clone ID: cC-zmle189065a12d1
cgcgtgggcgcggtatctttttcactcaggactgggtatcctattctatttttttataccggtggcttctgggggtagggtgtggggcatatgccagctctgaccgaaatctttggagatgattccgtattacaatttggtggaggaactttaggacatccttggggaaatgcacctggtgcagcagctaatcgtgtggctttagaagcctgtgtacaagctcgtaacgaagggcgcgatcttgctcgtgaaggtaatgaaattatcaaagcagcttgcaaatggagtgctgaactagccgcagcttgcgaaatatggaaggagatcaaatttgatggtttcaaagcgatggataccatata

SEQ ID NO: 27466 - DNA, 387 bp, Zea mays
  Clone ID: cC-zmle189065b02a1
gcttggaaaaaggactaacgggggagggggagcaaaactacagtcgacaacaacaaaatacaggagctttggaattaatgcatatacacaacgataagctgggcaaaacaactatggggatttagagttcacaatgaccaaagtagcgtgcctgtattttcttgataaatattgatatggaacacaccttgccttgaatgactatctggccatcttccatatagatggcaccatttgaatactgtaactctaccaaccgatgagtgacccataatgcggccacctccccatgggtagcctcagaggccctgactgtatttatgacgcatatctggacatgcgcatctaagaatgaggacctgtccccagcagtaatgctttggatgc

SEQ ID NO: 27467 - DNA, 469 bp, Zea mays
  Clone ID: cC-zmle189065b02d1
caccattcatcgaaccctggtcactccccctcgtcgaagctttttgattttctactcgaccttacctcctccaggggggggcgacatcaagggtcgtgacgtcagcctctccgtgaccacgcggtggggcatggtgttgccggtgcttaagggatgctccctccttgtgccgcccgggcagctctggatgctcctcggccccaacggctgcggcaagtccacgctgctcaaggttttcagaatccaacggccggtacagtgtatataaacagaccatgcagctatgtcttacaaaatcctgatcaccaggttgtgatgcctacagtgggatctgatgtatcatttggtctcggtaagctcaaactctcgttagatgaggtcaggttaacggtatcaaaatctttggatgccgttgggatgttgagctactctcagaggccaatccaaactctgagtggtgggcagaaac

SEQ ID NO: 27468 - DNA, 335 bp, Zea mays
  Clone ID: cC-zmle189065b03a1
aaaggggttatgggttttttttttttacggacccgggggcggcccctggggcccacccggaaatttcggaccggaacccggaggccacccaacttcccctaaagggaacccaataaaacccggggggaacaaaggggaaaaccgcttcccggaaaaaaagggtacccgataaaaattccacaaaccaatacgacccggaaacaaaaagggaaaagccgggggccccaaaggagggaaccaactcccataaaaggggtttccccaaaagccccgttcccagagggaaaaaccgcccccccacactcataaaaaaatcccccaaccccccggaaaag

SEQ ID NO: 27469 - DNA, 132 bp, Zea mays
  Clone ID: cC-zmle189065b03d1
gcccacgcgtccgaaaaaaaaaaaaaaaaaaaaaaaaaaaaaaattttttattttaaaaaaacaaaaaaaaaaaaaaggggaaggggggcgccctatatataagaacccactcttccttccccttgcttcca

SEQ ID NO: 27470 - DNA, 498 bp, Zea mays
  Clone ID: cC-zmle189065b04a1
ttttgttttgtaaagtctgacagaatctgattgtatgcgcaacctgtatgctcaaatcatgtacactggctccaagtcagatatcgactttcagtatcataacttcatcaatacatcaccaaccgtcgagacttgactcaaaatcggtctgctgactagctctttcattgtcgactgtgcggttgtatcggtagcggtagcggccctgcttattcaagcgggttaacgtgtgaagacttcagatcaagtggttgtgcggaggcgtgctgaggtgtcgctgctccagaggcaacatctggtgtaccgatcccagacaaggggcttaccgctccgctaggggccacagggatctggatatcctccggactactgcgaacgaagctttcgggaagaccgggtatcttgatgcgctttgcaacattgttgtagctcgatggaatgatctcgatgatctcgtctcgggggaactcgagctttggaaaatcagccgcgttgcac

SEQ ID NO: 27471 - DNA, 461 bp, Zea mays
  Clone ID: cC-zmle189065b05a1
aaaaaaaaacccctacaagttcgggatacattgccaaataaacactctggttaatagacaggaagattaggcgtcgcaccagcaaatgcaaaggtattcctaatatacaacagcacatgatttcctcaaaatttacatgcatgcaaggttttccccccttcctgactgcacagaaacagtggggagcaaagattaaatggttttgcacagaaacatgtgagcagctaccctaacaaacatctctaagatggctaagcttgtcttgaagatgacggttcacccagcgaaacagaaggaaatgaggaagcccaagctcgagcattacttgctcccttcctcaagtctgtcgccttattgctcagcctcagcttgctccaaagcctccttacatcaagaacattcaaggcttcgttccaggagctggtttgatcccctacggatccctaagttcaagttttgga

SEQ ID NO: 27472 - DNA, 634 bp, Zea mays
  unsure at all n locations
  Clone ID: cC-zmle189065b05d1
cgcacacaccttctctctgagaaaattcctaagcggaagaagttctttctgtttatagagagagaggggacgggaggagaggggattgtattttttactcttttttttccttaccctttttatttcctttttctcctttttttcatttttttttcttttttacctcttttcttttttttctttatatttatctttctttctttgttttcccccctttctttctttccatatacctttgtgatcttttatttactgtttttttacttttactttttatctttttccctttctatctttttttttattgtttttcttttcttaataattactttttctccctctcaatctaattttatttttgttccccaaccttttactttttctttcttccttcctttattcttttctcttttttcctctcactcttctttttccataattctctttctttatatatcattttagtcttttttccattatctttttttttccctttcttttccctatttttatattttttccccaactatatttatttcttttattttaacttctccncctttttaatttttctcctcccttcaccttattaataaaacttttcctttcaaaatccttttttttttttcctttt

SEQ ID NO: 27473 - DNA, 436 bp, Zea mays
  Clone ID: cC-zmle189065b06a1
tttttttttatttttttttattttttttattttattttctggggttgggtgtatttttttattttttaaaaaacctctaaaattaattcaaaaaggaaataaagacaaaaaaaaaaaaaaaaagaaaaataacaaaaaaaggaaaaaaaaaaaaaaacagggaaaattcaataaacactaaaaaaaaaaaatgaaaaagatttgcaaaaagcacaaaaaataaaccctaaattattgaaaacctgaagaaaaaaagaaaaaaaacgaatataaaaaaaaaaaggggaattataaaataacaaacccaaaaaaaagagaagcgataaaaaaaaaaaaaaaaaaaattgccccccttgcaacaccaggtaaaaatagtagaaaaacgaaaaaatataaaaaaccaagaaaaaaaactgaccattgattatatatttat

SEQ ID NO: 27474 - DNA, 392 bp, Zea mays
  Clone ID: cC-zmle189065b07a1
gcccatcaatcaaaggttacattcttttctggaaaagacaaaacacaactggtacagatcatccaagcgaagggggtgccacatcaatttatgagccctggttagggcccacgattttgtttcacaaaattttatttcaacctttcccaaaataaaaactggggggacaaaaagcccattgggaatggtccacctcaaatgaaattcccttttttccttgggggggagctttttttacccccctcaaaaaatatgaacaatggcttaagccaatgtcccaaacagccccaatgacataaggcccccaaaaactccttcaattgaaatcctggccccactatcgaagtttgtctgcactgaaaactttgactttgctaaaagcccggtggatg

SEQ ID NO: 27475 - DNA, 447 bp, Zea mays
  Clone ID: cC-zmle189065b07d1
gtccctcttttctttccgcggctctgccccaacttctgcatccgaatctcccacgaagttgtcacggcgatggcagcgaccggcggcgtttcaactgacgatatcccgatcctgcaggcagagaacctcaccagcaacgtcaagtccgtccactacagtcgaacattcttgtcgatcattggtggagttgttgctggaatctggggattcacaggcttgacgggatttgtcttctcctttctgataatgatggttgcatctatcgggctcttagcaaagtcaaagttttcagtgcagacatacttcgatagttggaccaggatttcaattgtaggagtttttggtggccttatgtcattcgtgctgttctggacatttgcttatgacattgttcatatcttctgatggacgtagaaagagcctccctccaaggaaaatatggaattt

SEQ ID NO: 27476 - DNA, 461 bp, Zea mays
  Clone ID: cC-zmle189065b08a1
ttttttttttttttttttttttttttttttttttttttttgtgtttgggtttttttttattaaaaaaattttatatttattattggaaaaaaaaaaataaaactgtcttaatataataaaacaaaagaattcttactttattttaaaaacaatggaaaggcccaaccatataaaataaaaaaaaaataaaaaaacaaataccaaaaaaaaaaccgggggcacaaaaaaacaattggaaatgattaaaataaaagaaaatacatattttccttaaaaagaaattttttctacccccatcaaaaaaaaagaaaaagggggtaagaaaaaaaccaaaaaaattttaatgaaaaaaagccaccaaaaaacccctcaaaagaaaaattgggccacaaaaaaaaaaaaggggggaatgaaaaaattatattttaaaaaaacccgtgggatggaacccttattttcgg

SEQ ID NO: 27477 - DNA, 415 bp, Zea mays
  Clone ID: cC-zmle189065b08d1
ccgcgtgggcgtcttgttcccagtctcgcctgctccctggcctgtttttttttttgagctcccccagactagccgccggggatggagccgctcataccatctccctggtgctgagctccttattccccacctctcgccgaccacgcgtggttccttggaagatccgagctcgcccaagtcgcccgctgccacccatctcggactgtgccctactccctgctctcggcgaaccaaccatggtcgcgcctcccatgtccttggagcttgccagcgccagcacctcaccggtgtcatccccgtcacgccatgatgcttggcctcgtcctgtgcgccgatcaaacctcaccagccatgttcaccatgccctcgggattgccttcccagccggacgcacgagcttgctccggcgtaaacc

SEQ ID NO: 27478 - DNA, 511 bp, Zea mays
  Clone ID: cC-zmle189065b09a1
ttttaagcttaagagaacttattcgcagtcatcagctcaggtcattggcacagatcttgacaagatccaagacagccatcacctcatgattttgtcaatacaaactgattagagtgcttagatcttctcgagggcctgcacgagatcgttcttaagatcctcgaaatcctccacaccaatgctgaacctgatcaggttgtccttgatcccgtagatgtcccgctgctcctttgaatcccagtaggacatgatggcaggctgatcaattatgctctcacagcctccaaaagaaggcgcatgatagggtattttaacagaatcaatgaatttcctcgtagcatcaaagtctccagcaacctcaaaactaacaacaccgccaaagccagtcatttgactcttggcaatgtgatgttcagggtgacttggcaagccaggatagtagacacgagcaatctttggatgctcctctaaaaactgggccatccggagagcagtgtcgttctgacattgc

SEQ ID NO: 27479 - DNA, 519 bp, Zea mays
  unsure at all n locations
  Clone ID: cC-zmle189065b09d1
gcgtncgaccacgcgtccgcccacgcgttcgggagactcctatatatttttttctcagatgcatagatattgaacggggatgggatatgtgccatagcaagggagcgttgctttgcattgacagtactttcgcgtcacctatcaatcagaaggcattaactttaggtgctgacctagttattcattctgcaacgaagtacattgctggacacaatgatgttattggaggatgcgtcagtggcagagatgagttagtttccaaagttcgtatttaccaccatgtagttggtggtgttctaaacccgaatgctgcgtaccttatacttccaggtatgaagacactgcatcttcgtgtgcaatgtcagaacgacactgctttttcgatggtccaatttttagaggagcattcaaagattgctcgtgtctactatcctggcttgccaagtcaccctgaacattacattgccaagagtcaaatgactggctttggccgtgttgttagatttgaggctgctggag

SEQ ID NO: 27480 - DNA, 449 bp, Zea mays
  Clone ID: cC-zmle189065b10a1
tttgattttcgattcgagagaaagttaatcaacaaatgggggaagggagaataaattaaagagaaacgagtgaagccccgtggataaatcgtcaagcaaactccatgggttccattgaatctaatatatgcaaagaggcagcaataacggcgacgtgcatgcagctggagtggagagaaacgaaaagtcatagcttcagagacaaatccagcgactcgccgccgtgctccagagagctgctcctgccgcgcagcaaggcggcagagtgcacagcaggcacctgacgcgcttccaccagcctggacctcatcatctcatgatgcccggaggcggcgtcggcgtcgtcctgccgggcgccgtgcgcgcgcatggcggcggcgatctcccggcggcgcttggcgagggtgcgctcgtacttgtgcgcgttctggtgcccgccgagcgcctgc

SEQ ID NO: 27481 - DNA, 447 bp, Zea mays
  Clone ID: cC-zmle189065b10d1
gctgagtaatgtattatttcttaagctctcgcacaacagtctttatcttattatagactactccagctagctgcaggggagcgggaggagctggacctcgagctcagcctccagccctgctcggacttggcggcggaggcggcgccttccggcttcttcgtctgtacctactgcgaccgcaagttctacagctcgcaggcgctcggcgggcaccagaacgcgcacaagtacgagcgcaccctcgccaagcgccgtcgggagaacgtcgacttcatgcgcgcgcacggcgcccggcaggacgacccctacgacgcctacgggcatcatgagatgatgaggttcacgcttgtggaagcgcgttaggtgcctgctgtgcactctgccgccttgctgcgcggcacgagcagctctcttgagcacggcggcgagtcgctggatttgtctctg

SEQ ID NO: 27482 - DNA, 407 bp, Zea mays
  Clone ID: cC-zmle189065b11a1
ctcaaaacatactaaaccttggggtgggggtcctttttatcttcctggtactcatcatccgatatttgcttcttagtggtcttctcgacccagagagagatggggacgctgatgaacatctgagtgcttctggatcagatccttcagccggcgctcctcaagatactctaactgtagaaaacacaagcacatgttaagtagtatcgactttggctattctaatgatgcattcacaaaatttcagggccattgcaaacatgtacatctattttctatctaaattaaccaacggctgaacctaattctcagatgttacagcttaaagttcaaacaactaataatagtcatcatgaccctgtccgtcagtcactaaactcatatctatagctatcaccggacgcgtggga

SEQ ID NO: 27483 - DNA, 388 bp, Zea mays
  unsure at all n locations
  Clone ID: cC-zmle189065b11d1
gctataaaaatgagcatactgactgacggacagggcgacgttttctttttttagtcgtntaaactttaaactgggggatgggataattatgttcaaccgttggtgaacttatatagaaaataaatgttcatgtttgcaatggccctgaaaatttgtgaatgcatcattagaatatcaaaagtctatactacttaacatttgcttgtgtcttctacagttagagtatcttgaggagccccggctgaaggatctgatcaagaagcactcatagttcatcagctacccaatctatctctggatcgagaagaccactgagaaggaaatatctgatgattaggacgaggaacattataaggacgaggagggcaacgtttacgactttgattat

SEQ ID NO: 27484 - DNA, 325 bp, Zea mays
  Clone ID: cC-zmle189065b12a1
cggttggtgttgggtttttttttttttttcggggaaacccatggcccaatgggccaccactggaatactggatcactgaaattctctctaccccctaattcggaaaaaaaaatgcatgcgggatttttgacaccctacacaaaagtacttactggccatattaacatttaaagaatatctacccttgaaaaggcaccctattgattagcatatgtcccaggttcaccccttaacaagagatcatcccaaaacaaccctatactggtcctagggctctgctcaaaggccaccgtggcccaaacctaaatgattaccgccttttgct

SEQ ID NO: 27485 - DNA, 590 bp, Zea mays
  unsure at all n locations
  Clone ID: cC-zmle189065b12d1
cgggcgtggtacaacgggcaacagatgttcccgacgctgcaggctatgactttttgagcggagggtgggcaagctggggagccgggtgcctccttcggcgtcttcgccatcctgacgctcaccgtctgggttgccgtgtacgaccgcgtgctggtgcggcccctgttccggcttaccggccacgcgcgcggttttaacctgcggcagcggatgggcgccggcctggtgctcttcgccgtggacatggccgtggccgctcacaccgagagcgttcgccgagccgccgcgctcgccgaggggctccgtgactccaacccgctgacgggggaacgcccggtgcgcatgtcagccattaatctggtgccgctgcactgccttacggtgctcgtccagggcctgaacctgatcgggcagatcgagttctactacttcgagttccccaagaccatgttcagcatangggtgttcctgctcgccctcggacttgggtttggcgcggtgctgggcaacgccatccatggggtcatctaccccgggaccccgagcggtggcagtcccgacggttggcttgctagctaccttgaacaggg

SEQ ID NO: 27486 - DNA, 349 bp, Zea mays
  Clone ID: cC-zmle189065c01a1
ggggggtaaaaccccaaattttttaaaaggccgccccccgaaaaataaaaggggtttactccttttacacaaaggggggggaaatccaatccctttttaaaccccttttgggttgggcttaaatcccttgggctgggagtacaggaaaactccgggaagggcaattgcattacccaaagagttgttaggaaaaacaggggtcctgaaaaaaaacactggtgttacaatgaccccaaaacggttaaaacaggtgcccccaaaatgggggacagggaacaccctcgccaaaaatatgtaaaaaacctgtggggttgcatgggaacccagtccaaggaaaaaaccccttggg

SEQ ID NO: 27487 - DNA, 567 bp, Zea mays
  Clone ID: cC-zmle189065c01d1
gtgccgccagcgacaggtgtcatgcagcgcggccggggatgctttggttgccccgaaggcggaagaaggaggcgggctgatgaagacgctgtggctcggctcgctcttcggcctctggtacctgttcaacatctacttcaacatctataacaagcaggtactcaaggttttcccataccctataaacatcacagaagttcaatttgctgtcggaactgtagcagctctgttcatgtggatcactggtattattaagaggccaaagatttctggagcacagcttgtagccatcctacctctggctattgttcatactatgggcaatctcttcaccaacatgagccttgggaaagttgcagtgtcatttacgcacaccatcaaggctatggagcctttcttttctgttattctttctgcaattttccttggcgagctacctactatttgggtagtatcttctcttcttccaattgttggtggtgttgcattggcatctcttactgaggcatcctttaactgggcttgcttttggagtgcaatggcttcaatgttacctttcatcccgaa

SEQ ID NO: 27488 - DNA, 490 bp, Zea mays
  Clone ID: cC-zmle189065c02a1
tttttaatttataattgatgatgtattgaagaacagagtgggggaacgatggagcagtttggaagttttacatgactggaaaaaaaagggagatgggattgtagcttttatgagcactgctactagtaatgttcacatagcatggctctgtaataatactgttgatcaccacatccaccagcagcaggcaatccggttgccaacgaggaggcagcctcagacaagcacctgagctgcagctagcctagcaatcggaaccctgaaaggggagcaagaaacgtaatccagcccagccttcgcgaagaaggccacagacgaaggctctccaccgtgttctccacaaatgcccaccttcaagttaggcctagctttgcggcccctctctgtagcaaacttcaccagctcgcccactcccctctggtccaggacctcgaaggggtcatgttggaggatgccctgagcaagatagacgggaatgaactttcccaca

SEQ ID NO: 27489 - DNA, 652 bp, Zea mays
  Clone ID: cC-zmle189065c02d1
tcccagagataatggttcctcttgttggaacaccacaggaactttggcttcaagtgactcttatccgccaaggggctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtgggaaagttcattcccgtctatcttgctcagggcatcctccaacatgaccccttcgaggtcctggaccagaggggagtgggcgagctggtgaagtttgctacagagaggggccgcaaagctaggcctaacttgaaggtgggcatttgtggagaacacggtggagagccttcgtctgtggccttcttcgcgaaggctgggctggattacgtttcttgctcccctttcagggttccgattgctaggctagctgcagctcatgtgcttgtctgaggctgcctcctcgttggcaacccgattgcctgctgctggtggatgtggtgatcaacagtattattacagagccatgctatgtgaacattactagtagcagtgctcataaagctacaatccatctcctttttttt

SEQ ID NO: 27490 - DNA, 382 bp, Zea mays
  Clone ID: cC-zmle189065c03a1
gcattaaaactccatccatcacaccgggggaccgggggataacattgatataaacattgcttcttcatgttccatgcatcaagtttggtggcactaactcggggaaggcgaccttttctttctagaggctttgttttctgataagaggatgttaaaaccatcgaccacactcaaatggccagtttaacaggaagcgcgcatgaatcccaaaacaaaaaagcgaatgccacctgtttagagaaatgggaccaactcaagtgcaacgcatcattcaaatcacttctttgaacataaaaaaaaaaaaaggggggaccttatccaaacccgtgggtactcccggaaattcctgacctgtgacagtaagggtccccatttttcctat

SEQ ID NO: 27491 - DNA, 294 bp, Zea mays
  Clone ID: cC-zmle189065c03d1
ttttgtgcctagtagtgatttttattttacgtttgacttgagttggtccggtttcgggaagcatgtctcattcgcttttttcttttgggattactgcgtgcttccattttaacatgggattttagttttatcgatggttttaacatcctcctatgaggaaacaaagcctctatagagacgaggttgccttcccgaagttagtgccaccaaacttgctgcatggaacatgaagaagcaatgtttataacaatgttattatcaagtaatccgatgtgatggataaaatattggtac

SEQ ID NO: 27492 - DNA, 85 bp, Zea mays
  Clone ID: cC-zmle189065c04a1
attataaattttttctcttttataaaaaaaaaaaacaactggtaaaaaaaaaaggaaaaaaaaaaattgttacaaaaaataaaat

SEQ ID NO: 27493 - DNA, 593 bp, Zea mays
  Clone ID: cC-zmle189065c04d1
cgcgccgcacccgcaccagcccgcgccgtggtcagaaggaggtcctttaccgtgcgcgcctctctccgcaaggccacgggcaccgccgccgtggcaatggctgccagcgccctgcttgccggcggtgccatggcccaggaggtgctgctgggcgcaggcgacggcgggctcgtcttcgagcccagccagttcaccgtcaaggccggcgacaccatcacattcaagaacaacgccggcttcccgcacaacgtcgtcttcgacgaagacgaggtgccgagcggcgtcgacgccaccaagatctcgcaggaggagtacctcaacgcgccaggcgagacctactccgtcaccctcaccgtgccgggaacctacggcttctactgcgagccgcatcaaggagccggaatggtcggcaagatcaccgtcaactaattaagctagctatcgatcgatatccattcatgtattagctgttgcttcctgctttgtactccgccgatctgtccatctctacatgttttcgtcttcacacaacaacctctgctacgactacgtatatatgcatgctactagctgattgatttaacgcgaccagc

SEQ ID NO: 27494 - DNA, 475 bp, Zea mays
  Clone ID: cC-zmle189065c05a1
ttttgcattttaatgttctcgttccataaaagcatcagagggcacgggtaccattaccagggaaatgtacattactcaccgaaacagcagctgagtttcgatacgacgcgatgccaagcataaaccccaatccaaatccgttcccaacactgtccccaacaaacaaacccaagctaaattattcactgcatgcaatacgccaagtacatgcacgagctcacggattacagaaccaaatgaggcgcaaactttggtgcccaaatgaccaaaacagaacatgactaacttttagaagccctgctcgatcaggtaatcgacgagcctatacaccaccatgttgcattgccctggagtcattggctcgtcgtacacaccaataatcaaggacatgccggtttttttgatagtaatgcccccagtgcccttatttcctcggatgacaactccaggttcaccttggatcaccatgtacttt

SEQ ID NO: 27495 - DNA, 404 bp, Zea mays
  Clone ID: cC-zmle189065c05d1
ggtgtagatgttggggcacgcgtacctcgaccagcaccttttttgttttcatccaaggacagcatctcaccggggccgggatcgtcggtcacgacgggagcgctcgctcgcacctcgagagctttccccattaaagcctgaggaggtcgctggaatcataaaggactttgatgaacctgatactcttgcaccaactggtcttttcgttggaggtacaaagtacatggtgacccacagtgaacctgaagttaccatgcgccgaaagaaggccactggaggcattactatcaaaaaaaccggcatgtccctgattattggggtctactacaagccaatgactgcatggcaatgcaacatggcggcggagaggctccgccattacctgatcgagcagggcttctaaa

SEQ ID NO: 27496 - DNA, 471 bp, Zea mays
  Clone ID: cC-zmle189065c06a1
actaaatctaacggggcccgggctgacattatgacaatgttagccgatgatgacgacaatggaaacagtaatctagggacaagcaggcgcctttgctggctggcaagtgtgaccacacacaaacacaccagaccagaggcagaaccacccgccagtggcgccaacgaggagcgctattcgttttagcacgacaaaagttaaaataaaacatcacgatgtggagtgaaactgaataattctagtacatggatataggctccttttttgggatcgccacggggccttgtggagccgctccattgttggatgaagcacggtccattgtctcgaggagctccatcactcgccatcatcttcatgctcctcactaccctctttatcatcctcggcattgaccttcgacttggacttgacagactcctcttcatcttgctgctcttcctccttggcaggagccttcttagctgcagt

SEQ ID NO: 27497 - DNA, 509 bp, Zea mays
  Clone ID: cC-zmle189065c07a1
ttttaacgtttgatgtcacaactttactccacacaatcgggggattgggcaggtcaggaaaatgcagtcaatctgtctgaaatagtctaccacagctgggaaacccacactacaacaaacagagtgaaccacatgaataaactgaagggatagagaggataactaattttctgagacatgatttctagcgacgtacatctatgagtacctatatttactgcactgcaaattcagctcaggttgccaccactggctgatgccgtgagcgtacttgaaatcagacgaagggctcacgttgaccattagatcggcagacggaagaaggtgcaacggttctgactcccaccctagtgccttgaagaacaggtctccgatggaattctgtgtcgcaagcttttcgataaatccggcaccaagatccttcatgttcttccggtgctggaagtacccaatgtactctgagcaaatgtggtcttctggattaaccaacaggtacggcgtccatgatg

SEQ ID NO: 27498 - DNA, 394 bp, Zea mays
  Clone ID: cC-zmle189065c09a1
aaaaaaaaccccctttttttattcaagggggaaaattgggggatatgggtatcgcacaaaaaaaagcttgcggggtaaaaaaaatgctaaaaaaaaacaaaagggggggggaactgatcccgcctgcccaaggaattaagggccaaaaaaggggggggcccgccccaaacaattttataaaaatccaattttttttcgagggggaggaaacgtacccaaacctcccggaaaaaaaaaaaatttttccttggggggcaaaaacatttgttgcccaaaaaaaaaaaaaaccaaaattaaaaaagtcccgggggggccgaaaaaaactttggtttttcccttaaatttaagggcccgttaaaaaagggtttttttatttcccagggggggagggcgg

SEQ ID NO: 27499 - DNA, 552 bp, Zea mays
  Clone ID: cC-zmle189065c09d1
gcgtccgcttcccggtgtccgggccggggctgcaggccggtcctctacattttcgcgcccggaaggaagtacgtggtgaagagcggcctggacctcacccgctacgactactacaccatcgggtcgtacgacggcggcaaggaccggtactaccccgacgaccccgccggcgactaccaccaccgcctgcgctacgactacggcaactactacgcgtccaagacgttctacgaccccgtggagcgccgccgtgtgctgctcgggtgggccaacgagtccgacagcgtcaccgacgacaaggccaagggctgggccggcattcatgcgatcccaaggaagatctggctggaccccaccgggaagcagctgctgcagtggcccatccacgaggttcagaagctcagggggaaggccgtcagtgtggacgccaagctggtcaagcccggcgaccattttgaggtcacaggcattgcaacttatcaggctgacgtggaggtgagcttcgagctggagctggaagcggagacgagcctgctggagaaagccgaggcg

SEQ ID NO: 27500 - DNA, 483 bp, Zea mays
  unsure at all n locations
  Clone ID: cC-zmle189065c10d1
gcgtncggtanagagaaggaaaaatatccccaaaccctagctttctatttttatggcgaaccctcgcgtcttcttggagatgagcgtttgtggctccccggcgggccggatcgcgatggaactgtacgccaacgaggtgcccaagaccgcggagaactttcgcgcgctgtgcacgggcgaaaagggcgtgggcaagttcgggaagccgctccactacaagggctccaccttccaccgcgttatccccgagttcatgtgccagggcggtgactttacccgcggcaacggcaccggcggcgagtccatctacggcgagaagtttcccgacgagaagttcgtgcgcaagcacaccgcccccggtgtgctctccatggccaacgccgggcccaacaccaacggctcccagttcttcatctgcaccgtcgcgaccccttggctcgacggtaagcacgtcgtcttttgccaggtcgtctagggcatgga

SEQ ID NO: 27501 - DNA, 367 bp, Zea mays
  Clone ID: cC-zmle189065c11a1
acaaaccccccccaaaaggggcaaccccccccatttttatttatacccccaaaggggtgcccccccttcctaacggtattccaccaaaaaccaggaaaaaaaaacccccgggtcccccccccccctttttaataaaaaaaaccaaattttttttccccccaaaaccacccgggggcccccccaaaaaatcccaaccccacccctgaagggctcccaattttccctaaaaaaaaccaaaaaaaaaccggggcaaaaaaaaccaaaaattatttcccgaaaaaaaattttttcccccaaaaaaacaccaaaaaaaaaaaacgggaaaaaaaaaatgaaaaccccggggcccccaaaaaggccccccccc

SEQ ID NO: 27502 - DNA, 152 bp, Zea mays
  unsure at all n locations
  Clone ID: cC-zmle189065c11d1
cgaacaaatttggcttttttaagtaaatccggnnggtgttacactttttggattaattcacctgtaactgaatgcaatgggggtaatgcaaagggcacaacactctgcctgactaaaataaaatggtgaaggaacaccctcgttgtggttgc

SEQ ID NO: 27503 - DNA, 60 bp, Zea mays
  Clone ID: cC-zmle189065c12d1
cccacgcgtccgcaaacgcgtggtaaaaaaaaaaaaaaaaaaaaaatataatttttatat

SEQ ID NO: 27504 - DNA, 201 bp, Zea mays
  Clone ID: cC-zmle189065d01a1
gtctagtatagaaccagcccacgggtaagggacgttaaaaccagcaatttacatcacttataaaatcagaaggcaacgcaagcgtattagcccgataatgcaccaataccagcaacttgcatcactaataaaatctcgacttgcaccctacagtttggtggactcgaattgcaggacttaagcacagcccggacgcgtggg

SEQ ID NO: 27505 - DNA, 253 bp, Zea mays
  unsure at all n locations
  Clone ID: cC-zmle189065d01d1
cacacgtacaggctgtgcttaagtcctgcaaaccgagtccacttaactttttggngcaagncacagataccattggggagggcgaggtgcatggtatattgtgcattaatcggtctacatacgcttgcgtatgccttaatgattttataacgtgatgtaaacttgctggtctttaaccgagcattaccntggtgggcctggattctataacctgatgcaaacaaaaaaaaataataaaatataaacagggcgt

SEQ ID NO: 27506 - DNA, 440 bp, Zea mays
  Clone ID: cC-zmle189065d02a1
ggaaaccaaggggtttggttttactggacatgttgccggaatgaggccaggggtgtgtgccaggcactggcggggctctaaaaaatggatctgggcgcgtgggcgggcgtcgtggctgaaaaacccggtgacgtgcgcgagtgcccactcgtcggtccacggtgagagcggggaaggcggaactgacaaggcaggtccacggcgcaaaaagagaaaaggggacccccgggggcaatggctcggcactggcgaaccaggcccgcgagacaaaaagagagagagcgaacgggcgaaggaaactggtgcccacaggtcggccccactgggcaacgagcgataaagggagggcgcgcgcgagggaaaactgccgttgacggcgcaggcgcgcaggcacccgttctatctgggcttagtgggccgactaggctgctttctccttt

SEQ ID NO: 27507 - DNA, 561 bp, Zea mays
  Clone ID: cC-zmle189065d02d1
cgcgttcgctttccgctatttactttgagcaatgtgtgattttgtttttttatgcaattgctgtgtacgtgagtttgggatccaaaatcatgtgagtttctggcacgtacatagtttgcattcggtttgccttctaaaaccgggggtgacataagtggtatcaaagcctttctgactgtaggaccgctaacctagactatgtaacaccctgattttggggtataaaatttctttctaattatcatccaaaatcatgtgttactccttttctcactcttggctttttacctctctagattctttctctctttttccttttggttagaaatggcttaaactagtggaggttaattatttatttttgccaaaaccttatgagtcatgacatgttgcatcatgctgagtttaaaatattctttgaagtgttgcacaagtttgaatttagttgaatttgaaacctaacttgaatttggatttgaaaaccctatagataaagaaatagaacaggaattagaaaatccagagaaaacagaaaaggagaaagcagcctagtcggcccac

SEQ ID NO: 27508 - DNA, 540 bp, Zea mays
  Clone ID: cC-zmle189065d03a1
ttttaatgtcaatgaacacaattattccttgtcgattgaacaataggttacatcatggtacaaaccgaaaaccagcgtgcgctcacatgcatccggacacctaaaggtcaccggcggcgcctccctcacttgccggggacgaagttggtggcgtaggcccaagcgttgttgttgacggggtcggcaatgtggtcagcgaggttctcgagcgggcccttcccggtgacgatggcctggacgaagaatccgaacatggagaacatggcgaggcggccgttcttgagctccttgaccttgagctcggcgaaggcctcggggtcgtcggcgagaagctccgggaagacgcagccgagcgcgcccagcatggcccagcgggagtggatcacctccagctcccggttcttggcgaacgtctccgggtccgccgacagccccgcggtgtcccagccgtagtcgcccgggaactcgcccgtcaggtagctcggcggctcgccggacagtgggcccaggtacagcacgcggtcggggccgtaccacggc

SEQ ID NO: 27509 - DNA, 470 bp, Zea mays
  Clone ID: cC-zmle189065d03d1
cgccacgcgtccggcaagacggcggcgaaggccaagccggcggtttcgttttggagcccgtggtacggccccgacggcgtggtgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagcttctcgccgacgaccccgaggccttcgccgagctcaaggtcaaggagctcaagaacggccgcctcgccatgttctccatgttcggattcttcgtccaggccatcgtcaccgggaagggcccgctcgagaacctcgctgaccacattgccgaccccgtcaacaacaacgcttgggcctacgccaccaacttcgtccccggcaagtg

SEQ ID NO: 27510 - DNA, 446 bp, Zea mays
  Clone ID: cC-zmle189065d04a1
ttttattttcttttattcttatatatatataatataaacggcctgggtgtacaacgacgccccctctctctttatgtacttatatactcatcacacgcgctatgagtatacatattaaaacttaacacacggacacggccaagaaaacctgatacgcttggaactggggccgatggatcagcaggaccctctgaggatctcggcgaggccggcgcgctgctctgcggtgagctccttggggaagacgacgtccaacttgaccctcaggtcgccgcgcgcgcccttctgcccggggaccggcatgccctcgccggcgatcaccttctcgtagccggggcggacgacctcgtcctggaacgagcagctcaccttcctgccgccgaggaggcggaacgagaaggaccagcccgtgagcgcgcccaccagcggtaccttcgccttgagca

SEQ ID NO: 27511 - DNA, 358 bp, Zea mays
  Clone ID: cC-zmle189065d04d1
cgttctagaaccccctctccctatgttcgccactaaatttctgttttccaccacaccactcccgaaagggtctgcgtgatccttcactttcccttacgccacacccgccccgacattacacaaccacattctaattccccgcccccaccaatagggaaacccacagagctttaccacacaaaacctcaacatacccaaggacacctgaacgcactaaatccctgccgcatacaataacgttgtcaaaaagttacaccccgacaagcacccggcatcatacatacaagatgacgatgaacacttaaaggccattaacgaggcctacgaagcgctcctggatcaacaggagaacatgggc

SEQ ID NO: 27512 - DNA, 279 bp, Zea mays
  Clone ID: cC-zmle189065d05d1
ggggatacaagggaaaaaaaaaaaacaaaaaacaagctattttatttttagacaacaaaccacggccaacagggcgagggtacccaagttaaaccacacctacacacacaaacacgcctccacaatggacgcccccaaagacacataatcgaccgacgaaccccaaaaaaaccgtcagaaaaaaccctaaactcacccacctaaaaaaaccggcgggacatcccccttgacccacacggagaacccccgaaaaggccccaacaacaggcccttaccaac

SEQ ID NO: 27513 - DNA, 419 bp, Zea mays
  Clone ID: cC-zmle189065d07a1
aacaaaatcaggggacggggcattataaatttatttcttgacggagttcacaatttatgaccaagccataatgttgcctacatacatacattgatacatataagcaactttccggagctgacaaatcctaaccttcatattgggcgccgaccccgtggcttcagaactgatcgactgaaaaccgtgaacctgaatacatcgcagctacattactggtaagaactaccatctaccaagcacctatatatatagggtcttttatttacagaacatagcaacaacactctactggcactgtgtaaaccaagcacctgcagaaagatacatagtagacaatctcgtagtcagcaacgtgcgggtcgtttgtaccttgggggcaaggacggacagttctcgttcattttcgcataagggtcaat

SEQ ID NO: 27514 - DNA, 506 bp, Zea mays
  unsure at all n locations
  Clone ID: cC-zmle189065d07d1
ggcccggcttccaggttggtgcaacgcaaacacggacaagcttcccttangctttttctcggagagtacagaatggagtggcgagaggacaacacgattgaaccttatgcgaaaatgaacgagaactgtccgtccttgcccccaacgtacaaacgacccgcacgctgctgactacgagattgtctactatgtatctttctgcagctgcttcgtttacacagtggcagtagagtgttgctgctatgttctgtaaataaaagacactatatatataggtgcttggtagatggtagttcttaccagtaatgtagctgcgatgtattcaggttcacggttttcagtcgatcagttctgaagccacggcgtcggcgaccaatatgaaggttaggatttgtcagcttctgaaagttgcttatatgtatcaatgtatgtatgtacgcaacattatggcttggtcataaattgtgaactccgtcaggaaataaatctataattgcacctcaggt

SEQ ID NO: 27515 - DNA, 524 bp, Zea mays
  Clone ID: cC-zmle189065d08a1
actgctaactcatgctgcattatatatataggaccggggccctaaaaggttagataaggtttcctccaatccccaagcataaagatagccatcctagcagatggtgaccatgagtgatgaacaatatagacaagcatcactctggtaccaagatcatcattatattatatatataatagtgggggtggtgttcttcaacagcaacagcggcaacagcaggcaggcagcttagtgtttggcgacagaggatccctgcaggaggccgtctcggatctgcgtggcgatgtctcgcaccgctccggggccatgcgggatgaacaccgaggacgccttggacgacgcgccgatctccttcatggtgtcgaagtactgggtgatgagcaccatgtccatgacgtccttggcggtggtgcccggcacgttgacggagaaccccagcacgctgtccctgagcccgtccacgatggcctgccgctggcgcgcaatgcccagccccgacaggtacttggcttatgcctccccct

SEQ ID NO: 27516 - DNA, 493 bp, Zea mays
  Clone ID: cC-zmle189065d08d1
gcccacgcgtgcgcggacgcgtgggagtttggcaagtttgacagcgtgttctattttaatgccactgcatgccttggttcgggggcgggcgtgtatctgggcatcttacactcatgctgcagcaactggatgtgcgctgtgagacaaaaacaaaggacaatgatttttgtgaatgtggtggcatctattcagtaccgcgctctggctgacaaagcaagtgacgctttttacaaactgagcaacacaaggtcccagatccaagcctacgtctatgacgtgatcagagcaagcgttcccaagctccatttggacgatgctttcgagcagaaggacgagatctcaagggcggtggaagaagagcttgagaaggccatgtccgcttatggctttgagatcgtgcatactctcatcgaggacattgagccagacgagcatgttaagcgcgcaatgaacgagatcaacgcaactgcgaggctcagggcggttgctaact

SEQ ID NO: 27517 - DNA, 551 bp, Zea mays
  Clone ID: cC-zmle189065d09a1
ttttgtctgttaccatcgtacttgatcattcaaactcaagagtgaattacaatcagaaccaaaaagcacaacgacttgtcacgagatttcatattgttgctccaaaaatttaatgtgatctatataatcgagggtcaaatatactcgatggcaaaacgacggtacaacatttttgcttaaaaacctctcccttcacaataccattttaacgccaatccttttcttcatataggtcaagccaaaaagggaaaaaaaaccagtatcaacacagcatgctctgctttataagttataaccggcgcactctactcctgcaaccaagtctcatgccatgtagtgtggtagcttcatagtagcttctcgtttccgcactctccgcgccctcgaaagactatgcgccatatggctctccaagaagaatctgtgcttcctcattagtcatcgaggtagtagtaggacccggccgacttctggtccctgtcctttgtagagtccaacttgtttatacgtggcctatagttggtcgggtctcttctaaaagtaatgtcaag

SEQ ID NO: 27518 - DNA, 585 bp, Zea mays
  unsure at all n locations
  Clone ID: cC-zmle189065d09d1
ctatatgcctctgccttggaaagcctgcagatatctatctgatttatgatttcaagtgcttatcttgattcggagcagggtattgtggcctcaaaggttatcaagagattcattcttcacgctaagaaaactgcatttattgttgagcatgatttcatcatggcaacatacttggctgacaaggtcattgtttatgaggggcgaccttctattgactgttctgccaatgcaccacagtctttagtatccgggatgaataaattcttatcgcatcttgacattacttttagaagagacccgaccaactataggccacgtataaacaagttggactctacaaaggacagggaacagaagtcggccgggtcctactactacctcgatgactaatgaggaagcacagattcttcttggagagccatatggcgcatagtctttctagggcgcggagagtgcggaaactagaagctactatgaagctaccacactacatggcatgagacttggttgcaggagtagagtgcgccggttataacttataaagcagagcatgctgngttgatactgggtttttttccctttttg

SEQ ID NO: 27519 - DNA, 501 bp, Zea mays
  Clone ID: cC-zmle189065d10a1
tttgaatttttttttttatatctatagaaagacattggggcttgggacttacatatgcatggaccattctcacctccctggagatacggagcgccactccctcttgtaaatccacctggaagctgaaagtctcacttaaaaccacacgactaagcttccttctcaaggctgaactttgaatggattaggaacagtttgataaacactactataccacttgacattaacggactttttaagggaacgaagaacactccacatgacgggtgaaacaaagaacaaaactactccaatgacaatggcactttttatgccaagagtcatgagccaattcaccaccgaccctgcaaggacgactcccacaaaatttgctgtgaaacctgaccagaacggaatgcctagcacagatgcaatgaaggcccctgtccacgctcccttgcctgagaatggaacggcaacgaacaccttcaagccgagccactggaattcctcaacaggagc

SEQ ID NO: 27520 - DNA, 407 bp, Zea mays
  Clone ID: cC-zmle189065d10d1
acggaccgggaggcgcccgatcggcatgctaagaattttttgttttttctcgcgcttggctgctgcactggggcgccgggcattgctgcagcacaggaacgtcagacagtcgaggactacatcaaggcgttagggttctgactacgatggcagaaccttgcggatgctcagaaggcccgacaacaccgacgatgatagcgctcgagacactgccggcgatctatctgcagggggcaaacccagatgggcattgactgtggcttcattcagtccggctcaacatactatccactattgggaacatggtgcctgtaccattcataagactctacactgaagaaactagcaacgtttttgtgtcagaacagaccattctaaacttaaattatagaccacctctttgagcg

SEQ ID NO: 27521 - DNA, 520 bp, Zea mays
  Clone ID: cC-zmle189065d11a1
ttttcaccttttggtttagatcgctcaactcaatccatgcgggtggggattctctctaacatcagcagctctcaacaaggagaagggaggaagtctgggaaccaaaacaaaccgggaaaatacttcagctatacatcacaaaaggcatgacggaaaaccctataataaataagttgactcccagcggattcatcacaacaaagccggttcattcatctcgccgacgatgacgacatcattttttttacatcacaaacaaaacaaatccgagcaaactgcaagggcgatccatccacccaaacggtcacgctaatcaaatggaggatttggatttgattcgccgcgtcaacgtctccactcagctttcagtggtctctcgcttgcatctcttgatgacagcatagccttgtcacctttcgctccatccttgcaaccagcattagctggcctttgtgtacgtggagaatgtgaaaccatcttaccgttgttagaggatggaagggagtgactaccagtgaag

SEQ ID NO: 27522 - DNA, 422 bp, Zea mays
  Clone ID: cC-zmle189065d11d1
cctgaatatccagaaaatggctccaaaaattctccaacttttccattttcatggcagctacacaatcaacaggggcgaaggggcgaagaaatagctcaccaaaacccaaccctgattcaacatagaaaaacggcttcactcgtcgaaactccctttcatcctttaacaacgggaagatggttccacattctccacgtacacaaaggccagataatgctggttgcaacgatggagcgaaaggtgacaaggctatgctgccatcaagagatgcaagcgagagaccactgaaagctgactggaaacgttgacgcggcgaaacaaatccaaatcctccattcgattaacgagaccgattgggtggatggatcgcccttgcactttgcacagaaaatgttatgtttgtgatgtaaaaaaaatgatgt

SEQ ID NO: 27523 - DNA, 466 bp, Zea mays
  Clone ID: cC-zmle189065d12a1
gatacatgttacaataattttagatatggaattatcggagtgattacaagataaaatgattcaaaagaattacaaatttgaaatgttataaaatatttgtaaatttgaagatacatgctagcttaagtgacaatcctcaataaagaaactaaagatgggatatacttatataagaaggccgagcccaccggcacttagcaccatccacaacagaacaaaattacaacctgggataacactaagttagtgttgttaattgacgaccacttggtgagcatcttctatcctggcacttggttgattcatccattttagcttcatccatcagcatcacttggagatcaattccactcgtcttccatagcacgtgatcacttaacgtaccgggggtcgacggtgtcgcaggtggggctgcacacaacacaaaactcctcatggtcatttcgtcgagcaccagggagatgac

SEQ ID NO: 27524 - DNA, 634 bp, Zea mays
  Clone ID: cC-zmle189065d12d1
gccctactgtgcttgcctgtgctcgtcggccatatccctggtggccttctctttttcctgccccagccacagcttcccctggggccctgctgctgcaagcactcagcctctcctatggcacacggtgctcgttcagcccctttctactggtgtttgcgtcatctccctggtgctcgacgaaatgaccatgaggagttttgtgttgtgtgcagccccacctgcgacaccgtcgacccccggtacgttaagtgatcacgtgctatggaagacgagtggaattgatctccaagtgatgctgatggatgaagctaaaatggatgaatcaaccaagtgccaggatagaagatgctcaccaagtggtcgtcaattaacaacactaacttagtgttatcccaggttgtaattttgttctgttgtggatggtgctaagtgccggtgggctcggccttcttatataagtatatcccatctttagtttctttattgaggattgtcaattaaagctagcactgtttttcaaatttacaaatattttataacatttcaaaatttgtaattcttttgaatcatttaatctggtatcactccgacattggttaatgtaaaatattggtacatgtaatcattttgtatt

SEQ ID NO: 27525 - DNA, 491 bp, Zea mays
  Clone ID: cC-zmle189065e02a1
ctaacattacaatcatattggaggggtgggggtatgaacagttctcgtgcctaatatggctaaatcgttcggtactctattacatgaacaatcttccactgtgatagctgctagcctgctaccttacattcatctctttattctggcccaagactataaatgtgaaaaaccaaactatccaacttaatccagggagaatgaactcaagtactgcggtcaacaagagaccgatttctttctgcaattgagtgttcttgtgcgtttttttttgggtaaggcaatctgtgttcttgaattttgtttgatccacaacttctcaatagataaacctcggtactcagggaggcagatcaaattccttgtgctactgcagtaatgtctgaacgagcgtcctgcgcttggggactaggacgagcggaatccgccgcggcgtcttcagccccggcgccttccccatgtcgaggtcctccagcgcatgccggcggggagct

SEQ ID NO: 27526 - DNA, 569 bp, Zea mays
  Clone ID: cC-zmle189065e02d1
acgcccacagcgttcgattcttgagtctgcaggacatgatatttgcttttttctgaaacatcatcccaaacgctggaatggaccatggccgaactcattgccaacccgcgggtgatgagcaagctccaaggcgagatagcgcgagtcgtcagcgccgatcagacgaccatcgctgaaccggacctgaacaaaatggagtacctgagggcagtgttcaaagaggtgcttcggctccacccaccagcgccgctcctcgtcccgcacgaatcaacaacgcccgcggttgtgcagggctacgagattccggccaagacggcgctcttcgtcaacgtgtgggccatcgggcgggaccctgctgtgtgggacgcaccggacgagttccgcccagagcggttcgtgggcggcagtccctcggtggacttcagagggaccgactaccagttcatcccgttcggcgccggccggaagatctgccccggcatcaacttcgcgctgccagtcttggagctcgcgctcgtcagcctcctgcaccactttgaatgggagctccccgccggcatgcgcctgga

SEQ ID NO: 27527 - DNA, 330 bp, Zea mays
  Clone ID: cC-zmle189065e03a1
ctggggccgatgttatgctttggcccgcccccgccgcggcgccggggctgagcatcttctacggcggcagggtggtggtgttcgaggacttcccggcggagaaggcggccgaggtcatgcgcctcgcggccggcgacgacctgcccatcgcccggaaggcgtcgctgcagcggttcctggccaagcgcaaagatcgcctcgtcgagcgcgcgccctacgcccgcccgtcgtcccccgcggaggcggtcaagccggcctcgggctcggcctcggcctcctggctcgggctccgcagcacggaagccgaccgcctcaccatctagaactagt

SEQ ID NO: 27528 - DNA, 331 bp, Zea mays
  Clone ID: cC-zmle189065e03d1
gactagttctagatggtgaggcggtcggcttccgtgcttttgatctctagccaggaggccgaggccgagggggagggcggcttgaccgcctccgcgggggacgacgggcgggcgtagggcgcgcgctcgacgaggcgatctttgcgcttggccaggaaccgctgcagcgacgccttccgggcgatgggcaggtcgtcgccggccgcgaggcgcatgacctcggccgccttctccgccgggaagtcctcgaacaccaccaccctgccgccgtagaagatggtgagcggcggcgccgcggcgggggcgggcccgggcatctcctcggccccag

SEQ ID NO: 27529 - DNA, 498 bp, Zea mays
  Clone ID: cC-zmle189065e04a1
ttttagctttgaacaaaaaccttgctcattctgggctcgggtcgtttcatagcgggagcaaacaaagggaacaacaggggtaccaacacctaatccaaaggtagaacggacactaacacggtgacagaagcgaacggtaacacgatactatagatagataagataactcggccgaagccaggatgggcccacacatcagtcccttcagccgccgccgccgccgtcgtagccgtcaccaccaccctcgcgccgaccgtcgtagccgccaccgtcttcgtagccggcgccaccacccttgcgccgaccggcgtaggcgccaccgccgtcataaccgccgtcacggtgcccgccaccatagccgccgccgtcgcgaccgccgtcgtagccaccgtcgtcaccgtcaccgtcacgggactgggcctggttaacggtgatgttacggccgtcgagctccttgccgatcatgttctctatagcgttcagcatggagttctcgga

SEQ ID NO: 27530 - DNA, 428 bp, Zea mays
  Clone ID: cC-zmle189065e04d1
gtggcttctctacccctcttaccaagtcctcctcggtttttgtttttcttaaggatctgcggaggggcgagggcgggggctgatgtggagtaccgttgcttcctccgcggacttgcctgggccaccagcaacgagtcgctggagaatgccttcgcctcctacagcgagatcctcgactccaaggtcatcaccgaccgggagactgggaggtctcgcggtttcggcttccataccttctcctccgagaactccatgctcgacgctatcgagaacatgaacggcaaggagctcgacggccgtaacatcaccgttaaccaggcccagacccgttacggtggcggtggcggcggtggctacagcggctgtcgccgcagcagcggctattgaggcggacgccgtgacggcggttatggcggcggtggcggcta

SEQ ID NO: 27531 - DNA, 403 bp, Zea mays
  Clone ID: cC-zmle189065e05a1
ttttacacttcactggaacacaattcttgacatggacgaaggaatcggtcacagcattgcgcgcaaggtccagcagcgcacataacactgctagtccagactgtcagcgcatagttaacttaagtattcgaccctagcaataacaccagcaaaggtagcagcaacagtagcagaagagaaacttgcgatccacaaaacaaaccctactcatatgtccttacaatggcaccagattaacaataaccccaggacttcatgtttttgtcacgatgtttgaggtggcgattaggccctctcgccgcggatcctccttgccagctgaatgtcctttggcatgatggtcacacgcttagcatggatggcgcacaggttggtgtcctcaaacaggccaacaaggtatgcc

SEQ ID NO: 27532 - DNA, 408 bp, Zea mays
  Clone ID: cC-zmle189065e05d1
gtacgggcataccttgttggcctgtttgaggacaccaacctgttttccttttcatgctaagcgtgtgaccatcatgggaaaggacattcagctggcaaggaggatccgcggcgagagggcctaatcgccacctcaaacatcgtgacaaaaacatgaagtcctggggttattgttaatctggtgccattgcaaggacatatgagtagggtttgttttgtggatcgcaagtttctcttctgctactgttgctgctacctttgctggtgttattgctagggtcgaatacttaagttaactatgcgctgacagtctggactagcagtgttatgtgcgctgctggaccttgcgcgcaatgctgtggccgatttgttcgttaatgtcaagaattgtgttacagtgcgtgtaaaa

SEQ ID NO: 27533 - DNA, 472 bp, Zea mays
  Clone ID: cC-zmle189065e06a1
ttttgcacttcacgaacaccatttttattccggggaagggggcacacatcggcacgctcttatttccggtgtttccaccatcagatggtctctgcgccccagcaccgggcgcatggctcacgcatgcctttggcaatatacacatagaccacgcagtagaataaaaaaagagaaaggaaaaccttgccgaacttaacatcattgtccaagaaaacacggcctatttcgtcatcatcattgttccgagttattggatttcaaaggcggacttcactgactggcgggatcggagggggtcgtcgctgcacacagccgcctagtagcctccctggatgtagtcattgagccggttcagctcctccctgtgctcggccaccaccgcgcgcacgacgttgtcgatggagaccattcccagcatccccgtgccgtcgatcaccgggatgtgtctgacgcggttttctgtcatgagctg

SEQ ID NO: 27534 - DNA, 500 bp, Zea mays
  Clone ID: cC-zmle189065e06d1
cactcgttcgacaagtcaactaaggttggcgacatttttactttttagaacaaactgatcacagtgaggggcgaggccaatgtcctgcaggcaatgcagctcatgacagaaaaccgcgttagacacatcccggtgatcgacggcacggggatgctggggatggtctccatcggcgacgtcgtgcgcgcggtggtggccgatcacagggaggagctgaaccggctcaatgactacatccatggaggctactaggacggcgtgtgcagcgacgaccccctccgatcccgccagtcagtgaagtccgcctttgaaatccaataactcggaacaatgatgatgaccaaataggccgtgttttcttggacaatgatgttaagttcggcaaggttttcctttctttttttttattctactgcgtggtctatgtgtttattgtcaaaggcatgcgtgagccatgcccccggtgctggggcgcatagaccatcttgtggtggaaacac

SEQ ID NO: 27535 - DNA, 314 bp, Zea mays
  Clone ID: cC-zmle189065e07a1
ggaccgggtaattgttggttacagcaaatgcaattggatcaaccaacatgcaggtagacacacgtacgttcatgagcacaaagactgacgccaaacatgcagagagagatagcaaactgaagaactttgttttttttttttttacacacaccacacaatacctatgtatgggagccagctcggcctcgcttattattgttcaaccaccaccacaagctagatagataataattatatccatgggcgtcgatcgatgtgatcaacaattgcaggggtcgcacttgcagttgccaccgcaactgcagccgtgggcg

SEQ ID NO: 27536 - DNA, 530 bp, Zea mays
  unsure at all n locations
  Clone ID: cC-zmle189065e07d1
cggattctnaagagatcgagcttcttttgcaccacaaggtctttgatgttttgcaactgcggatcaagctgcgggggcgggtgaagctgcaagtgcggcaagaagtaccctgacctggaggagacgagcaccgccgcgcaggccaccgtcgtcctcggcgtggccccggagaagaaggccgcgcccgagttcgttgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgtgtggtgtgtgtgagagagagagaaacagagttcttcagtttgctatctctctctgcatgtctggcgtcagactttgtgctcatgtacgtaccgtgtgtttacctgcatgttggttgatccgattgcatctgctgtaaccatatattaat

SEQ ID NO: 27537 - DNA, 333 bp, Zea mays
  unsure at all n locations
  Clone ID: cC-zmle189065e08a1
aaaaaaacaanaataggacggggtaagggatggttacagtaaatgcaatcggatcaaccaacatgcaggtagacacacgtacgtacatgaacacatagactgacgccaaacatgcagagagagatagcaaactgaaaaactttgttttttttttttttacacacaccacacaatacctatgtttggcagccagctcggccttgcttattattgttcaaccaccaccacaagctagatagataataattatatccatgggcgtcgatcgatgtgatcaccaattgcaggggtcgcacttgcagttgccaccccaatttcaaccgtgggcggcct

SEQ ID NO: 27538 - DNA, 82 bp, Zea mays
  unsure at all n locations
  Clone ID: cC-zmle189065e08d1
tttgtttttttgcaacngcggancaagcaccgggggcggcgcacgctttaaatgcggcaagaaataccctgacctggaggag

SEQ ID NO: 27539 - DNA, 347 bp, Zea mays
  Clone ID: cC-zmle189065e09a1
gggggctggtgtttttttttttttttggccaccaaacccagggaacaagccccttggcccccttttttttatttgggccttggattttttcatcccccaaaccccggaaaagctccaaatcttttaaaaggggcgaccattatttatttcggggccaacaaaatattgggggggggcttttattgaaacctttgcaaccccccctaggggggaaaaccgagggttccggatactttcataaccaaaagggggcggcccttgtttttctcgggcccctccatgggcgggttgacctcccccattttgaagacctcaaccttgggcccgaggcccggcttccccgggaa

SEQ ID NO: 27540 - DNA, 466 bp, Zea mays
  Clone ID: cC-zmle189065e09d1
cccggctggcgtggcatggcgcgcacgcaccacatcgagggcgtttttacttttttcggcggcggcgtcacgcggttcggggccggcgacactgtcggcgtgggctacttcctggggtcctgccgctcctgcgacagctgcggcaagggggacgacaactactgcgcggggatcgtgctcacctccaacggcgtcgaccacgcgcacggcggcgcgcccaccagggggggattctccgacgtcctggtcgcgagcgagcactacgtggttcgcgttcccgaccgcctggcgctggaccgcaccgcgccgttgctctgcgccggcgtcaccgtgtacagtcccatgatgcgccacggtctcaacgagcccggcaagcacctcggcgtcatctgcctctgcggactcggccacgttggcgatatgtttggcaaggccttcgggatgaaggtcaccgacaatagcacgt

SEQ ID NO: 27541 - DNA, 496 bp, Zea mays
  Clone ID: cC-zmle189065e11a1
agatcctcccggtctttcattttctcgcttagctcgttcaactgcgtggagagggcgagcttgtcgcgcttgagggactcgacgcgggcgtggaggtcgtcgaacttggcgcggagcacggcgtagtcgtgctcgagctgcttggagcgccagcgggcgcgcttgttctggaaccagatggccacctgccgcggctgcaggcccagctcccgcgccagctccgccttctcccggggctccagcttggcgtgcccgtggcgcgcgcggaacgtggactccagcgaccgtatctgctcctccgtgaaccgccgcttcctctcccccctcgcggacgacgacggcccatctccgcccccgatgcccatctccgccaagaacgacgacgggtcgtccatcatcggcacgcaaagctgctgctgctgcggcggcggcggcatgaagaactggtgctggtggtggcctggcctgtccatgtcgatcgattgatcgacgtcgt

SEQ ID NO: 27542 - DNA, 440 bp, Zea mays
  Clone ID: cC-zmle189065e11d1
cccgggagagagcccggctggggaggaagaaccgatcgaacaacttttcttttttctagctataggatccaacgacggggggtcgggggatcgacatggacaggccatgccaccaccagcaccagttcttcatgccgccgccgccgcagcagcagcagctttgcgtgccgatgatggacgacccgtcgtcgttcttggcggagatgggcatctggggcggagatgggccgtcgtcgtccgcgaggggggagaggaagcggcggttcacggaggagcagatacggtcgctggagtccacgttccgcgcgcgccacgggcacgccaagctggagccccgggagaaggcggagctggtgcgggagctgggcctgcagccgccgcatgtggccatctggttccagaacaagcgcgcccgctggcgctccaagcagctcgagcac

SEQ ID NO: 27543 - DNA, 517 bp, Zea mays
  unsure at all n locations
  Clone ID: cC-zmle189065e12a1
gcttggatccttagagcggcgnacgccgaacgagctttcgtttgatcccgtcaccttcagcttcggacgctgaacaccacgcactgcggcgcacgcgccgccttgtcgtcatcgtcgttttccttgccggcatcttcctgctccccctcctcctcctcctcctcctgctcctgagcagcaaacttgccgccgtcgtcggcggtggccttggcgtcatcagggctctggaacggctccttcgcgccctcggatgaggccatcgtcggatcgccgccggcagcgctaggcgcgacggaggaggacttcttggcctcgtcgtccggcacgacgccgatgtccttgcactcgtcgtcgtgcgcgtcaacgacgtcgtcccctcctggcgcaggcagcagcaggtcgagctcctctgcttcttcttgatcgtcaagggtattattgttgctgccgtggtggtggcgcacggaggatgagctcctgtggtctggcagcaggacctcccagntccagtcccacg

SEQ ID NO: 27544 - DNA, 408 bp, Zea mays
  Clone ID: cC-zmle189065e12d1
ccccgctgtttccgtttccctgcgtgaaggaagaggaagccctttcctttttacagcagcgtacaatcaggctgatggtggggggaactcatctgttgatgcttgtaagcctcgctgcctggctgcgttctgtgctgtagataccagatcccgcagcgttcgtttgttgcacttgcaccggcttgctgctagcttgcgacaggactaggaggagctagccgaggaggaggtgtgtgactccatggacgcgggccagcaggatgcgtgggactgggactgggaggtcctgctgccagaccacaggagctcattcttcgtgcgccaccaccacggcagcaacaataatacccttgacgatcaagaagaagcagaggagctcgacctgctgctgcctgcgccaggagggga

SEQ ID NO: 27545 - DNA, 393 bp, Zea mays
  Clone ID: cC-zmle189065f01a1
gggattcattacttagggagaaggggatcgggatgatccatatattcccacaaaaaaggttcatattagatatatagaagacacgaaacggattgccacaatatatttgttcgtcgaccaatcaagagcttctgcagtaaattccaattatttatttgcaaatcttcccttcgaacaggacgaagtaatagccttgattattctttgtacgctcaggcacaaaaatatctgttctttttcccttcggcgaatgagtagttgcctcctttatccccactattttctgctagactcttcagcttctcttgctttagcttgtggtatctgtagcctttgtctgtcctatataaataatcacagaaggtgaacaggggtgcaaagttgctttggcta

SEQ ID NO: 27546 - DNA, 444 bp, Zea mays
  Clone ID: cC-zmle189065f01d1
tctgcccgctggcccctgctactacctagagcatttctttttcgtccgtagcgctgccgtacaaggtggaggcgcgggtactgatgcccccgacagcctccctcatctgctacatggacgcggactgcatgattccgctcgccggtggcctacagatcgcctcctatcctgcgggcgccaagatactaaggacccgaatgggactgtcgataccatcggtgagggagaccatcgcgcagctagtcatatactctctagcggaggattacctaagctactggatgcaccggctgctgcacacccaacggtgctacgagaagatccaccgcgtgcaccacgagtacacagttcctacaagcttctgcatgtcgaacagacactgggccgagaacgtacacctttctatcccagccttggacggcccaagctcgtgccatgccatgt

SEQ ID NO: 27547 - DNA, 319 bp, Zea mays
  unsure at all n locations
  Clone ID: cC-zmle189065f02a1
aagaanggacaaaactgcaggggtataggtggtaccccaccaaaactaggcagaaaacttccataatggactctttcggatgggctatttataagagggctccaccaaggaggggttgcagggataacaccgagaacactgtgcaatcacaatggctgaagggaacacattgtattgccaaatagaagaggtcagcgagccccctagccagggagtatacacggagcaactgaggttaccaaaacaaagcaaaagggcgaaaagaagcatgcacacgctactatctaagtagaccacacatgcaccaacccatggatgt

SEQ ID NO: 27548 - DNA, 381 bp, Zea mays
  Clone ID: cC-zmle189065f02d1
cataaaaagaaccaaaatgaaccaaaatttttcatttttaagatatcgcatccgccctcgcggagggggggcttcaagctgctctagaccaaccaacaacccacaacatagaccattctgctatagatcccctatgaaccgcatacctagcacgatcgacaacaagaacagtgagaaaactcattacgtgcaacccttcatgatccagacaaaaacagcacaatgacatgcacaacaaccacccttgagtctactacaacgaatcaccctaatacaggagttaccttatgtgcatcagagggcacaaaacatcctggcacaacagcgacagaagatgggactggaaaagcactcacattactctcagcaagatggcatata

SEQ ID NO: 27549 - DNA, 553 bp, Zea mays
  Clone ID: cC-zmle189065f03a1
ttttgttttttaaaatccagtttaaaacaatatggggttacgggttgtaccaaataacaatggtaggttctgacagtactagtcacgtttgccgctaaagctgcggcggcttattccgtagttacgaacaggaattatggatacaagcgggcatattattcctcaccactctcactcttgacaaaaataaatagatcgacggtacaagtctgcgagcatagttcgggaacagcactcctcagttcttgacggtggtgacatgccgcagaagcatctgaatgacatccggggagatgcttgtggcctgctgggtgagttgctcgatcttcgccgccgtttctttctcgagacgcttgacgtttgcaccggagtcgccgctgctctctgcaacctttctctgaaactcagcctccatctgggcacggtattcggctatttcccgctcaacctacttttttgcttgcctgagcctcgctgacttggcagctctagcggcattcacaatttgctgagcctcctgctccgcagccagcaacctgttggatcccactct

SEQ ID NO: 27550 - DNA, 505 bp, Zea mays
  Clone ID: cC-zmle189065f03d1
gtgcgccgcaaccgctccaccgtcctccactccggctgccgattttacttttcccgatccagatcaggagctgagggatggacgcgaacaggcgccagagtgggatccagcacttgctggctgcggagcaggaggctcatcaaattgtgaatgccgctagagctgccaagtcagcgaggctcaggcaagcaaaagaggaggctgagcgggaaatagccgaataccgtgcccagatggaggctgagtttcagaggaaggttgcagagagcagcggcgactccggtgcaaacgtcaagcgtctcgaggaagaaacggcggcgaagatcgagcaactcacccagcaggccacaagcatctgcccggatgtcattcagatgcttctgcggcatgtcaccaccgtcaagaactgatgagtgctgtttccgaactatgctcgcagacttgtaccgtcgatctatttatttttgtcaagagtgagagtggtgaggaataatatgcccgcttg

SEQ ID NO: 27551 - DNA, 529 bp, Zea mays
  unsure at all n locations
  Clone ID: cC-zmle189065f04a1
atctatggaattttttttattaggaaaatggacagctctaattcagcaataacacaaggagtattttacatgtttcctattcccacaaaaaccatcacaaggcacactacagggcacatcaaaactacaagctcaagttatttgagctcaacaacatcaaaccttggtcgtcaatacagttagtttcagcatactcttggatccagcgatttaatttacaacgtgtttggtttgccggacaacggtctccggaatcatccgatcctatatccgaacctaatatatttgtttggtttacatcatagatctgtgtcgtccgacatcagatactccatgtagtgctcgttagaagtgcaattatgcagcaccggttcactcccagaaaaacatcggacgacctcatgcaggagcagctcatgccggatcaactgaattcgcaaaccaaacacgtccttagggtctctcgttgctcctttttctcagcattttngattgtttcacctgcatgctggagagcggctacatcttt

SEQ ID NO: 27552 - DNA, 508 bp, Zea mays
  Clone ID: cC-zmle189065f04d1
gtgcgcccacgcgtccgggcgaccgccgcgagggagaggcgcctgccgttttcgctgcccctggcgactctcatgggccgggagctccgcgcggggggctccgagcgcccggccctgcgctacggccacgccggctttgccaagcgtggcgaggactacttcctcgtcaagcccgactgcctccgcgtccccggggaccccgcatccgcgttctccgtctttgccgtgttcgacggccacaacggcgtgtcggcggcggtctacagcaaggagcatctgctcgagcacgtcatgagcgcgctgtcgccggacatcggccgcgaagactggctgcaggcgctgccgcgcgcgctcgtcgccggcttcgtcaaggccgacatcgatttccagcgcaagggggaggtgtccggaaccacggcgacactggtggtcatcgatgggttcacggtcacggtggcgtcggtgggtgactcgcgctgcatcctggacacgcaaggcggcgagttgc

SEQ ID NO: 27553 - DNA, 331 bp, Zea mays
  Clone ID: cC-zmle189065f05a1
aaaaatatatttacatcccgggggaaggggggttattttaacacattgttgacccaaccccaaaaaaaagcatggcgacccccaagggtaccaccctttcattttgggacaggccctgaaggccttaaaaattacattcaaaagaggggtctccaccatactggctttccctcaccatagcaactccagaccgaaaaggaaaccccaaaaaacaagcccgcggtgccccatgcggaaacctcaaggcactaaatggggggggcaaaaaaaacaattaaccccccaaaaaaaggggggggaggatgcccaaaatacaacctcaaaacccccc

SEQ ID NO: 27554 - DNA, 532 bp, Zea mays
  Clone ID: cC-zmle189065f05d1
acccgtacgcggacgcgtgggcggacgcgtgggaaaaaaaaaaaaattttatattttaaaaaaaaaaaaaaaaaaacagggggagagagaaaaaaaaaaaaaaaaaaatgggcgccccccctaaaaaaccctactttattgtcccctaaattcaaattactgggcccttaatttacatcacctaaacccatttaaccccccgctgtcccacaaaaaactgactggaaaacccctccctttccccaacttaatccccttgtaaaaaaccccctcccatcccccttgcccacaaccaaaaagcccccaccccaaatgggacccccccatttgcacaaccacaatccccattgtgacgcccccttacacccagaattaatactccacattcctaatgtctaccccccaaacccccgtctcatttgcccgccctctttaggcactatccttttattttccccccacactttaaaattaggtcccccgttttttatctgaaagttttcattttggggcccctttccgggaaaaatta

SEQ ID NO: 27555 - DNA, 467 bp, Zea mays
  Clone ID: cC-zmle189065f06a1
acagggaaccctgcttgtagcggggcagggtgaagctttattcaggtaacggtatttacagtgtttacatgtatgtgaagaggcaacaagaactctttgaagacaaactgaaggcaacgaaggactactaaaactatgatggtatcattccctatgctgttcatcaagtgtcgtaacaagaggcgcacaacgtctctctcttaaatcttaattcatgggacagtagatcttgatctcgcataacctgtgtatctttgagcctagttgacctatacctgtaaaacccatgacccaatgatgcagcagcacaagtgaaatgttgcacgccccctctatttctgcttcagaaaaggagtgcagcttcagatatcattggcgtgcacgacctgatgctggtttgctccttcttggttatccagaggcatgtactgagccatgatggcacggatctttgaatccatgtaact

SEQ ID NO: 27556 - DNA, 596 bp, Zea mays
  Clone ID: cC-zmle189065f06d1
gtccggaaatgtccaatgggtttcaagggtgatggagaaaatttttgttttgacattgatgaatgccaagagaaggtttggtgtcagtgcaagggttgcagctgcaagaatacgtggggaagctatgaatgcagctgtggtgatgacaatatgctatacatgagagagcatgacacttgcatcagcaaagagggaactgccactactgttggctggagcttcctctgggttattttctttggacttgtttttgccggggttggagcatacgctgtgtacaaatacaggctgcggagttacatggattcagagatccgtgccatcatggctcagtacatgcctctggataaccaagaaggagcaaaccagcatcaggtcgtgcacgccaatgatatctgaagctgcactccttttctgaagcagaaatagagggggcgtgcaacatttcacttgtgctgctgcatcattgggtcatgggttttacaggtataggtcaactaggctcaaagatacacaggttatgcgagatcaagatctactgtaccatgaattaagatttaagagagagacgttgtgcgccttttgttacgacactt

SEQ ID NO: 27557 - DNA, 510 bp, Zea mays
  Clone ID: cC-zmle189065f07a1
gggaaacggtgttttttttttttttttttttttttaaatcctttttttttaaaaaaaaaaggaaataaattaaaccttaaacccaaaaaaaaaaaaaaaaaaaaaaaaaaaattacacaaaaaaaaaaaacaaaaaaaaaaaaaaaaaaaaaaaaaaaaaaaaaaaaaaaaaaaaaaaaaaaaaaaaaaggtttataaacaaaaaaaaaaccaatcttataattaccaaaacaaatcacaaaaacccaaaccccaaaacaaacccagaaaaagaaaagccaaaccccaaccctaccaaaaaccacctttatgaaaaaattaaaaaaaaactagcaaaaaaaaaaaaaaaataccaccccatttaaaagggaataacacgaatacccaaccaaaaaaaaaaaaaaacgtggtaaaaaaaaaaaaaaaacttagatgacacaaagaataaaaaaaacaaaaaaaaactaaacccaaaaacccctcaacaacattaaaaacaaaaaacaaaaa

SEQ ID NO: 27558 - DNA, 194 bp, Zea mays
  unsure at all n locations
  Clone ID: cC-zmle189065f07d1
gggtttacctaactaacagnagcaacagcagcaactagaagtttttgttttttaaacccattaattgcttaatttgcggagagcgggcgttaggcaagtgatttgaattagctgttcctcgtttggtttgtgtatcaacaaaacaattgttcgttgatttttcttggaagcaaagtaaagtaaaccaaccttct

SEQ ID NO: 27559 - DNA, 322 bp, Zea mays
  Clone ID: cC-zmle189065f08a1
ggaaaaaaaatgctcctggtgtggggttcaaacgcagcataatctggaaattcaagtacaatgaactcctgaatcagtcacactcggtacattgttgtgcatcacatgggactatgggagtgaaagccatccaagacgaaggcacagataacgcaaacaaagagcataaagttgaatgtggcattacattcttgtgtattcatatgcaagtatacaacagtccccatacaagagagctagctattggcatgcaccattctcctgtatggggactgttgtatacttgaatgtggcattacattcttgtgtattcatatgcaag

SEQ ID NO: 27560 - DNA, 353 bp, Zea mays
  unsure at all n locations
  Clone ID: cC-zmle189065f08d1
cccgctngatatgaatacacaagaatgtaatgccacattcaagttttcattttttcccatacaggagaatggtgcatgcgaatgggtagctctcttgtatggggactgttgtatactcgcatatgaatacacaagaatgtaatgccacattcaactttatgctctttgtttgcgttatctgtgccttcgtcttggatggctttcactcccatagtcccatgtgatgcacaacaatgtaccgagtgtgactgattcaagagttcattgtacatgaatttccagactatgctgcgtttgaagcagacagaaggagcaatttttttcaaaaaacttaattcaaaaattaataccag

SEQ ID NO: 27561 - DNA, 434 bp, Zea mays
  unsure at all n locations
  Clone ID: cC-zmle189065f09a1
aagctnggataccgtagagcggccgcggccagctgctgctttttggatttttctgctgaatagctgccagaggggggagcgggatataccttatcgatcgatggcaataagatcagatccctcactcctgaatccggacgaaaaagtgatgggtggtggtggtggcggatcagatcagcatcagcttgcgcgcgcgcatgcaggcagctagggtgctgtcacaattgaagcggaacaggcagcagcaggatcagatctcacggtcgggcggctttgggcgacccgatcatgtgcagtgtgcatccgttttggtgcgtggtggtacttgcactcgcacccaaatcagatagagcctgtcctgctcctgcaacaatggggactggggactcacgcacatatcacgggactgcccgactggggactggaggacgcct

SEQ ID NO: 27562 - DNA, 517 bp, Zea mays
  unsure at all n locations
  Clone ID: cC-zmle189065f09d1
cccgcccacgcgtccgcgcagcaggtcccttacatctatcggctttttccttctctccaatcgatcagcttaactagcgggggcggggagctagctcctgaccactccactccacccgtccgtccgtgcacggcaccaaataattccatggcgctgtggtggtactagcccgacgtaccatcaacaagtcgtccccttgagattcaaggggaggatagctgcggcctaggcgttctttcgtccccagtccggcagtcccgagctgagtgcctgagtccccagtccccactgctgcaggagcaggacaggcactagctgatctgggtgcaactgcaagtaccaccacgcaccactacngctgcacactgcacatgatcgggtcgcccaaagccgcccgcccgtgagaatctgatcctgctgctgcctgttccgtttaattctgacagcaccctagctgcctgcatgcgcgcgcgcaagctgatgctgatctgatccaccaccaccaccacccattaca

SEQ ID NO: 27563 - DNA, 298 bp, Zea mays
  Clone ID: cC-zmle189065f10a1
ggaccaaaaaatactaacaatttattaaattcatatttaaaaaccgaacaacaaaaataaaactcccccagaaaataactaggcatctttttctttatttttcaaaaaaaaaaaggatacatacccccaaaaaggaaaccggaatgatatacaaattcaaaaatgtttaaactaataaactttttttaagaaaaaacatatttcccatattattcatttgaaaccttatcttccaaaaaaaaccaattcagcctttttttaatttttaaagaaaactaaaattcccccgtaatccaaa

SEQ ID NO: 27564 - DNA, 389 bp, Zea mays
  Clone ID: cC-zmle189065f10d1
cggatactctgtcgcttgctgcgtacatttagttttccttagtttttaattatacgtaggatagcattcttttgagaggtcagggttcagactaatgacatggcatacatgtatctacctaaagacagatgactagtgtatacattattcatattgtatatcattcaggtttcgctcttcggtgtatgtatcgatattcattcagatagatagagatagagatgactagtaatttcctggtgtagttttctctttgttgctccgattatagatatgaatgtaatgaatgattagtatttattggtctctaaaaaagcgtgtaacctttcgataccgacctattgaccaatgatccctatgattttatgattcaaagggttgggccgcct

SEQ ID NO: 27565 - DNA, 410 bp, Zea mays
  Clone ID: cC-zmle189065f11a1
ttttgtttttttttttttttttttttttgagaaggaaatggggaggcatggttgatgaaacaaatacacaccccaggattacactacacgactcccaacaggaaatggaaagcggaagcctgtaccgccagttcggtgactgcatacaactcatatttatatataacatacgtctctttcgtcgaataatctgtatattattctctatggaaagaaccctcgcgcccgtgctgtacgtttcgtcgtggaaagaaccctggccttatgcttcgtacaccttgcactcgtcggtctcggggttgtccttgcagaagtcctccagagggtcgccgttgccggccgccgccgcgccgggccacttggccgccaccaggtgcgccagatcaaccacgcgttggctgtacccccac

SEQ ID NO: 27566 - DNA, 494 bp, Zea mays
  Clone ID: cC-zmle189065f11d1
ccccgcggacgcgtgggcggacgcgtgggcgcgcggcggcgctgattatcttttctacgagcacgggcgccgccaagggcgggggggtggtgctgtcgcagctcaaggggaagctgaacggcatcgcgctgcgggtgccgaccccgaacgtgtccgtggtggacctggtgatcaacaccgtgaagactggcatcacggtcgacgacgtgaacgcggtgttccgcaaggccgccgccggcccgctgcagggcatcctggaggtctgcgacgtgccgctcgtgtccgtcgacttcaagtgctccgacgtgttctgcaccatcgacgcgtcgctcaacatggtcatgggcgacgacatggtcaaagtcgtcgcctggtacgacaactagtgggggtacagccaacgcgtggttgatctggcgcacctggtggcggccaagtggcccggcgcggtggtggtcggcaacggcgaacctctggaggacttttggcaggac

SEQ ID NO: 27567 - DNA, 472 bp, Zea mays
  Clone ID: cC-zmle189065f12a1
gggctgggtttcttttttttttttttttttcccctttcctttttcctcgccaaaagggaacccatttcccgtttcctcccccccccctaccttccttttttccccccagccaaaacccttttctttatattaaaagggcccaaatcccccgcccccccccttataaaaaccccggttcccaatcacccttctttacccccgctgggttaccccgttaccgccctccccccaggcccctttccccccccctttcaaaagcccttgggaatataaccaaagggggggcccccccccaaaaaattattaccggcagggggccccccctgggggtctcccccccccccccccccgcggggtaccacaaccggtccggccccccctccctggagaaaaaacccccccttgcccggaaggtttaaattcccctcttcaaccttttttttacccctgcccccttttggtccaaaacccc

SEQ ID NO: 27568 - DNA, 529 bp, Zea mays
  Clone ID: cC-zmle189065f12d1
cgggccaaggcagctcctcctctcctcgccgccggcagccgcttttccttctcagcgcagcagccatcgtcgaggaagggcggcgctggcgccggtttgttctgcagtcgcgtcatcgtcagcaagcgcgccagggtaacagcgaagctcggagacggagagctgaagcctgcaggcaagcggaagttcatcaccaaggaagaggagccagaacagtactggcagaccgcgggggagagggagggcgagaaccccatgatgacacccctgccctacatcatcatctttggcatgtccacccccttcgtcatcctcgccatcgccttcgccaatggctggatcaaggtccctgtgcgatgaccgtaacgcgatcagccagcctggatcatagatgctgactcgtcaacctgcatcatatccaacgtgtgtcctgcgactttgtaccttcatatatagagacaagagttcttgcttgtgagcataattgcatgatcgcgtggtgtatgtaacccgaaactgtttacctttt

SEQ ID NO: 27569 - DNA, 387 bp, Zea mays
  Clone ID: cC-zmle189065g02a1
aataacatatgggtgaagggtgttttttttttttaatttttcattaccggccccaagggggaaaccggaaaatcccgaccgggaccacgggggctaccaattttcacaaaagaggggtttaaaaaaacttgggggaacaacagatacaccagcacccggaggaaaaatggtaaccgatgaaaaatccacaaacaaacacaagcgcaaacattaagctaaaaaccggggccccctaaggggggcaagaacccaaattaattgcagtctcccaaagaacgcctttgaagaagggaaaccaccggggccaccacaaataaaaaactgcaaaaaacgccgagaaagggggctttctttttggcccacaggggggtttttttttttcccctg

SEQ ID NO: 27570 - DNA, 83 bp, Zea mays
  Clone ID: cC-zmle189065g02d1
ccgaaaaaaaaaaaaaaaaaaaaaaaaaaaaaaaaaaaaaatttattttttaaaaaaaaaaaaaaaaaaaaagggaagggggg

SEQ ID NO: 27571 - DNA, 429 bp, Zea mays
  Clone ID: cC-zmle189065g03a1
ttttaacattattcctccaggtgagaaacaacaggacatgggtgttcacaagacagcaacaaaacatgtacagcagcagatgatctttgaagccctcacaacctacgaatgatctgtcgcttccattcgcgtacagttaacaattggagaaaaaaaatcctatgctttgaccacatccacatggagaaatttccattacgtgagactggcttacattacttgtacgtgtcgtcctgtgcttcagatatattccccttgctcatgtgctggacaccatttcatttttcttctccaggatagaacccagcagctcgtcgatcttagcaaagacagcatccactgtggcatctccttgcactttgacaataatgttctcatatgttgatagcaaggactcgatattttggtaataagtctccagcctcaact

SEQ ID NO: 27572 - DNA, 423 bp, Zea mays
  Clone ID: cC-zmle189065g03d1
gagttgaggctggagacttattaccaaaatatcgagtctttgcttttaacatatgagaacattattgtcagagtgcgaggagatgccacagtggatgctgtctttgctaagatcgacgagctgctgggttctatcctggagaagaaaaatgaaatggtgtccagcacatgagcaaggggaatatatctgaagcacaggacgacacgtacaagtaatgtaagccagtctcacgtaatggaaatttctccatgtggatgtggtcaaagcataggattttttttctccaattgttaactgtacgcgaatggaagcgacagatcattcgtaggttgtgagggcttcaaagatcatctgctgctgtacatgttttgttgctgtcttgtgaacatacatgtcttgctggttctcaactggaggaatggt

SEQ ID NO: 27573 - DNA, 343 bp, Zea mays
  Clone ID: cC-zmle189065g04a1
aacccggggacgggtggaatttttttatctgaaaacgcccgacaccccccaatttgcaaacccgtaatttccggaaccaaacttttaaaaattaggaattaaacataaacagagccgattcatgggcaaaagtgataactggtaaaaattgtaaaccggtaaaaattccacaccataaaataaccagccacctaagggtaaaaagcgggggagcccaaagagagagcgaaccaaaaaaaaacccctttccaataaagccccctttccagccaggaaactgggggagccggcaaccctaaagaaaaaggcaatttacctattgagccccccgggggatagggct

SEQ ID NO: 27574 - DNA, 294 bp, Zea mays
  Clone ID: cC-zmle189065g04d1
acccgtccgcccacgcgtccgaaaaaaaaaaaaaaaaaaaaaaaaaattttttttttaaacaaaaaaaaaaaaagggcggggggtgtgtaggtctcacgttctaaaacaccccccctcccacgcgcaggctaacataaatttgaacgcccaattcaattcaccgtcacggagtgttaaagcccgggccttccaaaacccagacgggccaaactcatacgcttttcaacaaatgcccctttcaccaaaaggccctttccccaagaggccacaaccgaacagcccccccaccaatc

SEQ ID NO: 27575 - DNA, 502 bp, Zea mays
  unsure at all n locations
  Clone ID: cC-zmle189065g05d1
gacgcgtgggcagagccttgggatttgagatgactgttttatcttattaggcaaatgattgctgatgtggcaaggatggcagtggagcgatcgactaccaggagtttgagcacatgatgactgccaaaatcggagagagggatagtaaagaggagctttcaaaagcattccgcattattgatcaagatggaaatggaaagatttctaacattgatatccagaggattgccaaagagctgggtgtaaatctcaccctcgatgagatccaagacatggtgcaagaggctgatagaaatggtgacggtgagatagactttgacgagttcatcaggatgatgaggaggaccagctttggctactaagtgtatttatctgtgagtgcttgacgctgccagtttgtttatgactaccgggcgtgtgttaatcgactggtgttgttactatgaacaataatgttgtgctctggtttcgcttatatatataattnaaattaattttaaaa

SEQ ID NO: 27576 - DNA, 456 bp, Zea mays
  Clone ID: cC-zmle189065g06a1
ttttggatttatgattccttatcaatcctaccggggaggggagatacatatgttacctgtatttctattatgagtcttgtcaacatgacaatgaatggatcaccccgccggctgaaaaaaatcctaaaaatctgcattctgctagtgtgtgtttgatctacgccgaactgggggtggtcgtcgtcacctaggaactggactctccccaacaaggggccaaaattaacagtgtagtgtcgatagctgagggctgacggacaagcaactttggatcgagcgatcgcgcgcgcacagttacaaaagaacaagaagaatgaacgaatcagcggcggcggcggcagctagctcttcatcttaccgtcctcgaggtcgaccgcgggcacgccgctcaccctggccttgaggggtacgtcctcgccgtcgagcattttgctcttgatccgggggacaggggct

SEQ ID NO: 27577 - DNA, 303 bp, Zea mays
  Clone ID: cC-zmle189065g07d1
gaacctgcccctggctcacgcccgatggcaagaccttattgttttttggagcaccgcaaccagggaggcgggcggggcgccaaacaagcgcacacagaactcacctttacccaacacgacgagactgtcaccaacgactaaattgctggtgacctgaacgagcactgtattaaaccagtcattcccgaacagtacctcgaccagaagacaatcttccaccctaacccgcttggccgcttcgtcatccgcggacctcacggcgatcctggccttactggccggaagatcatcatttacacctaa

SEQ ID NO: 27578 - DNA, 56 bp, Zea mays
  Clone ID: cC-zmle189065g09a1
cataaaaacttgaggggaaggggattcttttctccacgcgtccgcccacgcgtccg

SEQ ID NO: 27579 - DNA, 100 bp, Zea mays
  unsure at all n locations
  Clone ID: cC-zmle189065g09d1
cgcggacacatggacggacgcgtgggcggacgcgtggggngattttatnctttatcttatgaaaaaaaaaaaaaaaaaggggaagggggaaggccaacca

SEQ ID NO: 27580 - DNA, 512 bp, Zea mays
  Clone ID: cC-zmle189065g11a1
ttttacacttttcatgattgattacaagcagacgtgcaggcgataatcaatgatttcgtccatactggcagcaaatccgaggaggagggcagagagagagagagagcgaaaaggaacaaagaaaaaaaaacagatcttgatctggatcacggcggcggcgcaacctactactccgtatatcgcatcctgctccgggcggctactagcccgcgtagacgtggatgccgatggcgatgaggaagatggtgatgagcgcgaagtataggacggcgtggacgaggatggccaggccgctggtgtgcatgctgccgaactctgcgacgcggccccggcccggcagcgtgcagagcagccccggcgtgaggaccacgaacagcaccgtcgctacgatcacggggccccagtccgccatcggggagacctctctgattcccctcctccctctttcttccttcgcctcgctaccggagctctccactctccagtgaagaagctcccccaaatccacacgc

SEQ ID NO: 27581 - DNA, 448 bp, Zea mays
  Clone ID: cC-zmle189065g11d1
gcggacgcgtgggcaaagagagcgtgtggatttgggggagtttttttttttgtgagtggagagctccggtagcgaggcgaagggaggaatatggaggaggggaatcacacaggtctccccgatggcggactggggccccgtgatcgtagcgactgtgctgttcgtggtactcacgccggggctgctctgcacgctgccgggccggggccgcgtctcagagttcggcagcatgcacaccagcggcctggccatcctcgttcacgccgtcctctacttcgcgctcatcaccatcttccttatcgccatcggcatccacgtctacgcgggctagtagccgcccggagcacgatgcgatatacggagtagtaggttgcgcctccgccgtgatccacatcaagatctgttttttttttctttgttccttttcgctctttctctctttctgccc

SEQ ID NO: 27582 - DNA, 511 bp, Zea mays
  Clone ID: cC-zmle189065h01a1
tcggcgctgtgctccacctttcgcaggccggtgccgttcgggtgcaccagggagatggcgaagctgccgccgcccgggttgtgccggtccgaggcgaacgcgatccactcgccgtcgggggaccagttgcacatggtgtcggaccaaggaccctcggtgaggcgccggatgccgccggcctcgccgtcctccgcgtccatgatgtagaggttcttgtgcccggaccgtccggaccggaacaccacccacttgccgtcgggcgaaggggacgggaacgcgttgttctcgccgcccacggtgagcttcttgatggagacgctggggtcgttgccgtcgccgtcgccgagcgacacggcgaccacgtccacctgggtgctctcgctcgcgaagtctgggccgacgctggtgtagatgacccctttcctcttccaatcccatgtcgtcgggaacgcgttgcccgagaagacccggcgggggccaccggagccgttccgacgcgtgggcggacgcg

SEQ ID NO: 27583 - DNA, 519 bp, Zea mays
  Clone ID: cC-zmle189065h01d1
gggacccacccgtccgcccacgcgttcggacggctccggtggccgccgacgggttttcttttgcaacgcgttcccgacgacatgggactgggggaggaaaggggtcatctacaccagcgtcggcccagacttcgctagcgagagcaccgaggtggacgtggtcgccgtgtcgctcggcgacggcgacggcgacgaccccagcgtttccatcaagaagctcaccgtgggcggtgagaacaacgcgttcccgtccccttcgcccgacggcaagtgggtggtgttccggtccgggcggtccgggcacaagaacctctacatcatggacgcggaggactgcgaggccggtggcatccggcgcctcaccgagggtgcttggtcccacaccatgtgcaactggtcccccgaccgcgagtggatcgcgttcgcctcagaccggcacaaccctggcggcggcagcttccccatctacatggtgcacccgaacggcaccggcctgcggagggtggtgcacagcgccga

SEQ ID NO: 27584 - DNA, 591 bp, Zea mays
  unsure at all n locations
  Clone ID: cC-zmle189065h03a1
ttttttttttttttttttttttttttttttatggggaacngggtttttttttttttttttaaaaaattatttattaatttatttggaaaaaaaaaactctattgaaaaaaaataatatatcccattggggaaaaaaaaaaaaaaaaaaatattaagggggaaaaaataattataaaaaaaaaaaagagtcgtgggttggccccaaaaaaaaaaaaaaatacttgagggggaaataattttaaaaaaaaaaaatcggttttgaggttgggaaaaaaaaaataaaaaactttaacttgagaaaaaaaaaagtctgtaaaaaataaaaaaaaaaaaaaaagggaaaaaaaaaaaaaaaaaacctggggggcaaaaaaaattaaacaaaaaaaaaaataaaaaaaaaggctcaatggccaaaatataaaataagaaacccggggccaaaaaggaaaaaaaaaaaaaaaaaaataagagggaaaaaaatgtattatataaaagaaaaaaaagggttttaatacttaaaaaaaagaaaggcaaaaaccgtctgaaacttgctctctttttaacaaaaaaaaggaattatttcttatc

SEQ ID NO: 27585 - DNA, 375 bp, Zea mays
  Clone ID: cC-zmle189065h03d1
gtccgtgtgtgtttgtaaatatgatttcgctcttcatgtatttttctttttttggatgccaatgaggcaatgaggtataggcaaaaggctggattactccacaggatgaataaaccattatttcacaaaaaaaaaaaaaaaaaaaaaaaaaaaaaaaaaaaaaaaaaaaaaaaaaaaaaaaaaaaaaaaaaaagggagaaccaaataaaaaataaaaaaaaaaaaaaaaaaaaaataaaacaaaaaaaaaattatataaggggggcgaggtttattaaagtggccatttttttccaccgtgggggacgaggaaaactttttttttacggaccttaataatttttatggggggcccgctttaaaaaactggtgtat

SEQ ID NO: 27586 - DNA, 470 bp, Zea mays
  Clone ID: cC-zmle189065h04a1
ttttattatttaattattacaaaacagcatgcagattgggcgatgcttattattacaatatgtataatatgccaagattttccacttggacttgacaacaagagtgaatataaagaggcaggaaattacatatgcatagggaaaacagacgctgccagttcggcatttccatccaaaactgacaaaacgccaccatccggaagctgattattgcggtgcactctgcaggtgagtgaagagaagccgcctagccagtgttctgcatgccggcggcgatgcccttcatggtgaggatgagcgtgtcttccaggccgggcgggtactcgctcgccgggttcagcttgaccagtccggcgggcttgttctcgtcggcgaactccttggacagcggcggctggggcgtcaccttgaagttggggtcccttatccgctcagcgtgtaggcctggaacacgttcagggtggtgatgt

SEQ ID NO: 27587 - DNA, 564 bp, Zea mays
  Clone ID: cC-zmle189065h04d1
gtccgcggacgcgtgggcgagtggccattcttcagggtcaccctttactttctggagatggttttcgccaagggagaccggggcattgccggcttgtatgacgagctgcttgtggcggaagaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcgagtacccgcccggcctggaagacacgctcatcctcaccatgaagggcatcgccgccggcatgcagaacactggctaggcggcttctcttcactcacctgcagagtgcaccgcaataatcagctttcggatggtgggcgtttgtcaagtttggatggaaatg

SEQ ID NO: 27588 - DNA, 408 bp, Zea mays
  Clone ID: cC-zmle189065h05a1
gattccttatcaatcctaccggggtggggggatacattatgttacctgtatttcaataacgacaatttgtcaacatgacaacgaatggatcaccccgtcccccggaaaaaaaccaaaaaatctgcattctgctagtgtgtgttagaactacacccaactgggggtggtcctcctcacctatgaacaacactctccccaacaaggggccaaaattaacagcgcagtccctatagctgacgcctgactgacaaacaactttggatcgaacgatcgcgctctcacagttacaaatgaacacgaagaaagaacgaatcaccggcggaagtggcaactaacttctaatctgaccgatctagaggtcaaccgggggcacgccaatcaccctggcctttaagggtacggccttgc

SEQ ID NO: 27589 - DNA, 457 bp, Zea mays
  Clone ID: cC-zmle189065h06a1
ttttggatttatgattccttatcaatcctaccggggagcggggatacatatgttacctgtatttctattatgagtcttgtcaacatgacaatgaatggatcaccccgccgcctgaaaaaaatcctaaaaatctgcattctgctagtgtgtgtttgatctacgccgaactgggggtggtcgtcgtcacctaggaactggactctccccaacaaggggccaaaattaacagtgtagtgtcgatagctgagggctgacggacaagcaactttggatcgagcgatcgcgcgcgcacagttacaaaagaacaagaagaatgaacgaatcagcggcggcggcggcagctagctcttcatctcaccgtcctcgaggtcgaccgcgggcacgccgctcaccctggccttgaggggtacgtcctcgccgtcgagcatttcgctcttgatccgggggacaggggctg

SEQ ID NO: 27590 - DNA, 453 bp, Zea mays
  Clone ID: cC-zmle189065h06d1
gggacacacacgcgtccgggctggctgtgttgttaatgcgctcatacaccacgctaaccggttttctcttcacggtcaccgtgatcgtcggggggatcttcaactgcacctgctactccgtctgctagcacgtcccgctctgggagctggtctggttgtctctcggggtcaacacctccatcaacgggatgaacctcaggctgatgctcaacttcgtgggcttctaccaggtacgttcaccctgatctgctctgacatctgctgcggcagcgcctacgccggccattttcggcctgagttgcttgcgtgcgcgcgtggctgaagccgggaacctgcctatctacaaactgagcatgaatccgggggtctgcctcatggaatgggtgctgaacagcatgctctacaccaccaacgtcatctccgtggtggttgtcgtggccgctggtgtcggca

SEQ ID NO: 27591 - DNA, 400 bp, Zea mays
  Clone ID: cC-zmle189065h08a1
acatacaattgaggcggaaggggaccgggagaagaaggagcaaaaaacacgcgagtccccattgcattgggttgaagtagatgaggggggactactacttcatataatagcaacctcacctcaccgaaattgattgaaaaacaaatattccaaacgtgcacgcccatgcatgatgacgaagaccatatagatgaacatggtgatgggatgatcaggaaggagctagcctaggcggcctgctggctcaacatctgctcctggaactcgggcaggtgctggtcctggacgcacatggtcatgatgccggcgccaggcttgggcctaggcggggcgccgatgacggagacggccatgaacgggtggtaggagaagggcacgacctgtgtgggggtgccccaac

SEQ ID NO: 27592 - DNA, 136 bp, Zea mays
  Clone ID: cC-zmle189065h08d1
cccggaaaagaaaaagggaaacacaccaacctagagaaacgaagatttgtcttcataccgacccaacaagcaaaaccatggggaccgcggacaactacaacggcggacgcgcagcgaacaagacgagcccgaccct

SEQ ID NO: 27593 - DNA, 455 bp, Zea mays
  unsure at all n locations
  Clone ID: cC-zmle189065h09a1
gtcgttttcacacgctcgcctccttccatggggcccaggaacgctctccccgccgccagcgccgtggccaacggcatggtgatggagccgaggttccgcggcgtccggaagcgcccgtggggcaggttcgcggcggagatccgggacccggccaggaaggcgcgcgtgtggctcggcaccttcgacaccgccgaggccgcggcgcgcgcctacgacgccgccgcgctccacttccgcgggcccaaggccaagaccaacttccccgtcgcgttcgccgcgcttccgccgccgccgccgcccaagaagccggccgccgtgaccgtgagccccagcagcagcagcaccgtggagtcctcttnctcctcctcctcccgggactcgcccgccacgccgcccaggggccgcgtctccgtcccagcaggccccgtcgctcgacctcagcctaggcggcacac

SEQ ID NO: 27594 - DNA, 471 bp, Zea mays
  Clone ID: cC-zmle189065h09d1
aagcacaagacagtcgatttttattttattagcgggtaatatgttacatattagggcggagctacaaaacgattcgttctttttttttgtaacatcggcaaatagctattaggtgccgatgcaaaaaggtctatgtacacctggctagcagtaacccatcgcggcaaattgaacgatcaagtacccaacctcatactaatacagcttttttctaatcatctacgcgacctctcggagccgtctcgtctcgtgtcaccggtcggtccacctacgccacctcggccggcggcggcatgttgaggtcgaaccccacgccgaccgctggggaggcgtccaccacggatgacgacgacccggtgtcgctctgctccttttcacggcaggatgccgcgttacgcttgttggcaccggcggcgaccgcggtcggccggtagggcacgggcgccggcacggtcacggtcaccgcgagcc

SEQ ID NO: 27595 - DNA, 372 bp, Zea mays
  Clone ID: cC-zmle189065h10a1
ggaatcctcacttttccaaataactttattgcgaccaacagttttaataaaaatcgtacatttttcagtttcactgtacagtgtaaaggaaaaaaaaaggggagttttgcctaccattttgacctccaccttttactttttcggaaagaaaaaaaaagccctgaatttttacttcgaaactcactcggggctgcactgcacacataacctggatgctaaaaaccaaaaacatcacatggcactttgaaaaacccaaagaacacatggctattgtatgggaacttcctaagcttgctcctccctaggggccgagccggaattcacaaagcctgagggtttgggggcccccttgggctgggtaccttgctcatg

SEQ ID NO: 27596 - DNA, 600 bp, Zea mays
  Clone ID: cC-zmle189065h10d1
cggtaagactgtacctattttccttcccagaacttccttttttttttgttttaggaggattcaccactaaaggcgacggattggggtttgtcagatttcattaagccagggaagaagttccatgacattgttggaagtgcttactatgtcccaccagaagtactaaaacgacggtctggtcctgagtcagatgtttggagcataggagtcataacctacattttgctctgtgggaggcgccctttttgggataagaccgaagacggtatattcaaggaggttctaaggaacaagcctgattttcgtaagaggccttggtcaagcatcagcccaggtgctaaagattttgttaaaaggttactagtgaagaatccaagggccaggctaacagctgctcaagctctctcacatccgtgggtaagagaaggaggggaagcatccgatatccccgtcgacatatctgtgttatcaaacatgcgtcagtttgtcaagtacagcccgttcaagcaattcgcgcttcgggctttggcgagcacccttaacgaggaagagctatcagatctggaagatcagtttgatgcaattgatatcgataaaagt

SEQ ID NO: 27597 - DNA, 358 bp, Zea mays
  unsure at all n locations
  Clone ID: cC-zmle189065h12a1
aggatggggaaaaaattttattcaggtcacgagcttattgtcgtaattcgtacaggagctgagtgcgtgcacgtaccatagccaagtacgatgaccctgcacaaccagtcaaccacagacattcataaggcacgcaggcaagcaccaacgggcgtggattccggccgccgggcgggtcaattagccctggcgaggaagctctccctgcgctcgtggacctcgccggtgcaggtgttgatgtccttttcgaccctggtctcgcgcaccacaaaaccgtggccgccggggtgaccatggggggggtggtggttggcgcccgcncctgagaccgtgtcgacctcctcgaacttttccttga

SEQ ID NO: 27598 - DNA, 535 bp, Zea mays
  unsure at all n locations
  Clone ID: cC-zmle189065h12d1
cccgcccacgcgtncgcagcaatccacacaagcacttcgacgactttttttttttgcgcacagacacaccaagcgtcgggggcagggcttactaccaggaggtggactactgctcgcaggaggtgaggtcggtggccccggccggcttcggccgccacggcggtggcgtccaccagcacgtcgttaaggagaagttcgaggaggtcgacacggtctcacgcgccggcgccaaccaccaccaccaccatggtcaccacggcggccacggcttcttggtgcgcgagaccagggtcgaagaggacatcaacacctgcaccggcgaggtccacgagcgcagggagagctttctcgccagggctaactgagccgcccggcggccggcattcacgcccgttcgtgcttgcctgcgtgccttatgtatgtctgtggttgactggttgtgcagggtcatcgtacttggctatcgtacgtgcacgcactcaactcctgtacaattacgacaataacttgtgacctgaataaacttcttcgtata

SEQ ID NO: 27599 - DNA, 429 bp, Zea mays
  Clone ID: cC-zmle189066a01a1
ttttaacaaatcttctattttttaaaacagagggaatatcaaatgggtagaatgtagacaggaatgcactcccctcatcaattgaagccacgtgtgttgtgagttcccctcacctatcaaaaacagaacacgggcaaactaaaccatgttatcattacacctcaatgtcacagaagcatggctagaaaccaaaactgattgtggatattgcaggcacatcactagtatcccttgttcccgcgtattcgggcccgcatgtcaacctggcccctcttgcagttgaagtaggtctcccgcaggccaacgcactcgctggtaatgtttggcaccttcttcccagcgcactccttgtacggccttttctgcaccttgacgcagtcggtctcgctgagacacttgacgagctccatggccaaccccttgcacgac

SEQ ID NO: 27600 - DNA, 511 bp, Zea mays
  Clone ID: cC-zmle189066a01d1
cacgcgtgcgcccacgcgtccgtagacgcgtgggcggacacattttcaattttctggggccggcatcgccatcgggggaaggggaatttactccaaagccataccgtcaccacgctggtcgagctggccacgctgcgcgcgctgacgcgcgacgccgcggagcaactttagctgccgcgggccggcacgtcggcgtcggcgtcgtcgtcgtcgccgtggcgcgggcgcgaggaccacctccacggccacggcaagacggccaaggtgatgcacctgctgctctggggacccaagtgaagcggcggcgagaggccaccgtaccgtcgggctctcccgccagcgttgctcgtcttgctctgcctgcaattccgcccgcacggactgtactgtacctatacacctatatactacgacgtgcacctgtactacgacgtgctgctggaccatactaatactaatgcgctgttgttccttgccttcttgcttgcaccaaccacttccgctttttttt

SEQ ID NO: 27601 - DNA, 312 bp, Zea mays
  unsure at all n locations
  Clone ID: cC-zmle189066a03a1
attnnaatttttttttttggggtggggttttttttttttttttttttggccaaaccaaagggcaaaaaaaggtgccccattgggccctttttgattgggtttttaataaatgcacaaatccttttttgcctggaccttttataccgcccttggtcggccttcgccccctcccagggaatttcttggggggttaacttgggaaccccaccccccccccccgggttttttttattttttaccaaatcccctgggaccaaggaaaaaggccttcaaaaacctttttttttttttttttaatccgttttttcttta

SEQ ID NO: 27602 - DNA, 379 bp, Zea mays
  Clone ID: cC-zmle189066a03d1
ataggtcagccatactagtagtagattagagaaagatacgtatttagagaaagagagagaggttctggaaggcgtacttcactcgtcccagctgctactgtacaatatcaatgaagcactgggtggtgggcttgggatctcaagttgaaccacgatgagattcacctggagcgtgccgatgccgacgcagtgccgtatgagatgtccatgcaaaagaggatttgttcaattattaataactcaatcaaatagcgaccaattggtcaactttctttgaccttttgttttgcataaaaaataaaaaaaaaaaaacataaaaaaaaaaaaagggaaaaaaaaataaattttaatcttataaaaaacaaaaacaaaatttcgg

SEQ ID NO: 27603 - DNA, 313 bp, Zea mays
  Clone ID: cC-zmle189066a04a1
tttttattatttatgactttattcttattgctgggcagttgaacaaagaaaatcatgaacccatcatgacttacaagttaaaggcaaacttaaccctaacttgagcaacactggagggcaatatgagaccaaaatatgtcaatacaacttgcacagagagaactgaccctccagccatctgcaaatgcgttttgagtttgcagccagcagcccaacattcacagatcgggctatggaatgactccaaccaggggggtgctccttttggggtctagcgagccaaaaacaactcagggagcttatacgggaaaag

SEQ ID NO: 27604 - DNA, 410 bp, Zea mays
  Clone ID: cC-zmle189066a04d1
gtccgcccgcgcatgccactggatgagtgcttccgaatacaacatctttatttctcctgccttaagtgcacaaacggggaggagacaccattgatatgtggattaacgctcttaagatctatacaatcccagattactaccttgctctcttgagtactggcacctgtaaaccaaaagacgagcttgatgaaattcttaggggcccaaaggacttccgagcacatgaggcccttgattatagactatccgatacgatattacaatctgtcgaaggttctttcaaaccaagtgacctaaccgttcacctagcccaggcacaagcgatgcaccagtcaggcaagcatacagcttatgtacctcaaatatagagcactccaaccgaacccacgtacatactacaataactgaac

SEQ ID NO: 27605 - DNA, 389 bp, Zea mays
  Clone ID: cC-zmle189066a05a1
atataaacacacgtaaattcagggtatggagaacatctctcgatacaaaaaaaaagagataaattttaaaaaaagatatatgcacacacacacacttattgaaggcctgatttgatcttgatacaagaacgccgaggaccaacacagttcctacgtccgtgcaaatatcggtagctcaaagcctcaaatcaaggcctgcccggcacacagtagacgaagacgaggctgggagaacagatgaaacagcaaccgcgacgatgtgctgctgcttcggctgaggcagcctgcgacggatcagttgtgggcgtgcttcttggcgtccttcttctcgtgatgctcgtggaaggcgaacccggcggagcccacgggggcgacggcggccaccttct

SEQ ID NO: 27606 - DNA, 456 bp, Zea mays
  Clone ID: cC-zmle189066a05d1
atatctagctagtagctccctgaaaagttcactagattttttatttttatggaagagccatgtctgaggagaagcaggggcaccacctgttccaccaccgcaaggcagaggaggaggaaagcgcctcctgcgaggtcgactacgagaagaaggagaagcaccacaagcacatggagcagcttgtccagctcggcgccatctccgtcggcgcgtacgctctgcacgagaagcacaaggccaagaaggacccggagaacgagcacagccaccgggtcaaggaggaggtggtcgccgtctccgtcgtgggctccgtcggtttcgcctttcacgagcatcacgagaagaatgactccaataagcacgcccacaactgatccgtcgcaagctgccttatccgaagcaacaacacatcgtcgcggttgctgttcattctgtctcccagcctcgttttctcta

SEQ ID NO: 27607 - DNA, 493 bp, Zea mays
  Clone ID: cC-zmle189066a06a1
ttttgtttttaatcaagctctggcttattctagatctggctggcgtactaggaactttccgatacaattccatagaacgtatttacagttcctggatccctacgtacagaatggaagctagatgtatctacagctaccaactctcaatccattgctgcgcaaaaacggcagcaagaaattatatcaggtaagttcccgctgccgatctgccaccccggatgagccttataatttatagcaggagtgatggtcaggtggcggctgccttgatgctctcagaacacatcggattctcggtggttgaaggcgaccaacagccgtcaggtttcaggaaccttgtgcacctcaagcaatccccagtactgctttattgccttcaattggagcgactaatcttccaccgccgtgttgaagacgaaactagggagacggttgtgatgtccctcagaaaggcagtggcatattcttaacaggttagggtggcgtaacgcaa

SEQ ID NO: 27608 - DNA, 572 bp, Zea mays
  Clone ID: cC-zmle189066a06d1
gcgtgcgcactccaggcccagggcgcccggtcgccatgaactcccgtttctcctcctgcggcgtgcggtccgagagcgggctgtcgttgggggagcgcctctgcgcggtcttcttccccgtcatcgccatcgccgaggccgttttcttcgccttcaccgactgcctcgcggacctctgcaccgactccggctcctcgcactcgcgccgcttcggcgcgggcgcgtcctcctccgccgccaggaacagtcggagcaaccattgccagccccaccacagacctttcctacgccgcgccgctgcgggtggatggaccttccccaacctccgccagctcgcacgccttgccgacgagtcccgatgcttctcggtgaacgaggtggaggcgctctttgagctctacaagaagatcagctgctccatcatcgacgacggcctcatccacaaggaagaacttcagctggcactgttcaaaactccaagcggcgagaatctttttcttgatagagttcttttattcgcttgatgagaagaaaaatggcgtgatcgagtttgatgaatttattcattccct

SEQ ID NO: 27609 - DNA, 353 bp, Zea mays
  Clone ID: cC-zmle189066a07a1
ggacccccgggaaaacaataaattgggggcctccgccccaaaaaaaaatttccacagttttccccaatgggggggggtccctcccaaaggaaattggttccaaagcgcccatcgggttaaaaaaaaaaaacgggttttaaaaaaaactggggcccggggcgaaaacccacaggggggggccccccccccctaattggacttcttgaggggggcctccacccggggaaaaaaaaaccccacggggacccccacaaacacaaggcccttaatgggggggggaaacctaaaaaactcgggggggtctttaaattggggcccaaacaccccccccggccttttttttcccggggggt

SEQ ID NO: 27610 - DNA, 545 bp, Zea mays
  Clone ID: cC-zmle189066a07d1
gtgcgggggatggcgtcgtcgttcgccgtggcaacggtcccgtcgtttgcggtcccggcggccaagaagcggtcgagaggcgggacgtacgtggagggcatgaacgcctacagcggcctcaaggggctcaacaaggtgaacatgctcggggtgcgcaagaccgtcgactactccttcgccaaggtcgtggcgtcgctcagccccgcgggcaggaagcggcgcggcggcgcgttcggcgcccagatgaacgacgccgccgagatcttcaggatcgccgtcaccatgaacggcctcgtgctcgtcggcgtcgccgtcgggttcgtgctgctccgggtggaggccgccgtcgaggagtccgagtagggtgcgtgggcctgccactgtcggctgtcgtcccgggccgcattctgcttataaaccgtgatatatatttaaccagatgtacgctttcgaatcaatttaccttgggatggatccatgacaattggtgaatactggggaaataatgttttggaagtcgaagcctgcaattgatcgatcttcag

SEQ ID NO: 27611 - DNA, 98 bp, Zea mays
  Clone ID: cC-zmle189066a08a1
gggcggcaggcagagcgtttttctttcgggagaagcggaacgtggaggcgagctgcgtgggcagcgcgaagcgggagcggctgagcgacgccatcccc

SEQ ID NO: 27612 - DNA, 94 bp, Zea mays
  Clone ID: cC-zmle189066a08d1
ggatggcgtcgatagccgctcccgcttcgcgctacccatgcagctttcctccacgttccgcttctggagaaagtgggcgctcttcctgccgccc

SEQ ID NO: 27613 - DNA, 541 bp, Zea mays
  Clone ID: cC-zmle189066a09a1
acaaaaaaacgatttttcttggggacttttcgatcatgctcaacaaaaaggtagcacttccgtcactacatcaaaattcggatttacagcaggaagcaactagcccaaattctacaatctaaaacagatgagacaacaaaaggagagaagaagctataagccgctgaacaaacccgcttgaaattgaggttgcggcaaacaatgagccatttgaactccactacttcggtggcgtcattcaagccgttttggcagtggctgaaaaaaccgtcctctaggcaccataaatacgttcgtttttactccacctcctgtgcgcctcctggaagcaaatgactatgcaagatgatcttcatccttcccatgcatatttttaacaaaatggacggctctcaccaccccagtttagaaccattgccacacatgatggcccgcacaggtgatcactttggatcaataggttggcaccagcccctagcccgtgacagggcatgggaaaacacagccccatcggctgatttctcctttctcttttttcttt

SEQ ID NO: 27614 - DNA, 560 bp, Zea mays
  Clone ID: cC-zmle189066a09d1
cgcccacgcgtcctcccactcgtccggcgagcagcccttttgatgatcctttatgctgaagtgattgtcaaagggggtggggttcttattcagggtggagacaaacattacgagctggaaaagctacagaaggaagagaaagagcgcttgttggctgaaggtactgcatccatggaggcttgtagagccgaagctgaagctgaaaagaagcgtaaacggaattttgagagggagaaggctcgtcaagccctacaggaggcaagtgttgaccttacccaccagcagttgcaatttctcattcttattgttcctataagaaaataaatcctttatgcagatggagagaactgtataaattaatgataacctccatctcaaggatttggaattgcttggaacagccacaacagaacatattgtaagctctgttgatgagactagtccaaaacgctctcatgatggcatggtcggctatcattcaagagctgtcaatcctttggagcaacctggactgttcataaaggtagacgatgaggaagacgaccagcattgttccctgc

SEQ ID NO: 27615 - DNA, 268 bp, Zea mays
  Clone ID: cC-zmle189066a10a1
aagaaaaagatactctggggccggtaatcagcgaacagcaaaggccactgccaaccaacatgcaagtggacacacgacggcaagacccaaagactgtcgacaacctgcacagaagatacaagacggacaacaacattctcttgtcattaacacaccacacataacctgaggatgggggacaaaacgagcccgcttaatacaggaaaactcccgccacaagctagactgatcagacaaagtgccagggaacccacccgatggcaccaga

SEQ ID NO: 27616 - DNA, 554 bp, Zea mays
  unsure at all n locations
  Clone ID: cC-zmle189066a11a1
tttttgtttaataggnttgcatcatagtcaaattcgggtggcacaattattgaatatacacatatatatataaaagtagttgctgcatctggcaagcagatgtttcaagtctcagctaatgtattggcaaatgcattccgctgctgttgcttctgtaactaaactacacttctcctggtagcatggtatcttccggaagatcacagaatgcattcccctctcctgtaagatgggcaacgcatttcttctcagcaagcaattcagcttcgctctttttaatccgttcccagagaaaatcgtccatcaacacatcactagctagttcgtaatcaccatcacccttcgatctgcatggcatgctgaacacgatatcctctgctatgccataaggatttccagtcgtataaacccctgtagaaaaccagtcaccttctggggtaggagttacgagnggatctaatagcatccactatcgaaacagcgggtcgatgcagctgatgatctgccccatttttggatgagcacaccctcacgctttgaactgtgagggtgac

SEQ ID NO: 27617 - DNA, 381 bp, Zea mays
  Clone ID: cC-zmle189066a12a1
gctgctgactcgtaccaggtccgggttagggagcaagaagaaaacagagaggaacaggaacaaacagacaacatagtgagtgagtgagtgagagtggcagaaaccaccatgcacctactagccacgacatccactttactctacctaatgcttagccttcagccttgatccgaagaagataaggggggagaacctagccatgaggtcagagatcatcgcaatccggtcgccgccgtaggatgatggggtatcccttgagggtccgggtggtggggaagaagacaatcctgtcctccttgggttccttccagctaaagcgcgtgacgaggtggtggaggaagacggaaaccaccacccgggcgagcttttatcccgggcaca

SEQ ID NO: 27618 - DNA, 458 bp, Zea mays
  Clone ID: cC-zmle189066b01a1
tttttagcaagtttaaatttatcatattttttttcattctcatccgagtccatatgccataatttggtatcgacatgataattttagaacgcgttcttacattacagaggggtggtaagtaatacaacctgctgctccgaaccacacctagtacacgtccgctaactttggcatggagggagtacccaaaaaaaagagaggagctttacagtggagtggacacacccaaactgacgaccggccgtggcccgacgcgacacgagcagtcgatcgttcgagcaaaaaaaagcgggagtggctggtgcaagcaagaaggcaagggagcagcagcgcactagtattagtatggtacagcagcacgtcgtaatacaggtgcacgtcgtagtatataggtgtataggtacagtacagtccgtgcggggcggattgcaagcagagcataacgagcaacgccggcg

SEQ ID NO: 27619 - DNA, 505 bp, Zea mays
  unsure at all n locations
  Clone ID: cC-zmle189066b01d1
ggacgcgtgggcgagccccgagagcgggtttagttagagttttcaggttgtcgggcgcggcggcggcggggggcatgggcagcgtgagcgagagcactaccgccagcaggtggctcgagctggccacgctgcgcgcgctggcgcgcgacgccgcggagcagcttcggctgccgcgggccggcacgtcggcgtcggcgtcgtcgtcgtcgccgtggcgcgggcgcgaggaccacctccacggccacggcaagacggccaaagtgatgcacctgctgctctggggacccaagtgaagcggcggcgagaggccaccgtaccgtcgggctctcccgccggcgttgctcgttttgctctgcctgcaattcgccccgcacggactgtactgtacctaatcacctatatactacgacgtgcacctgttctacgacgtgctgttnaccatactaatactagtgcgcttgtgttcctttgcttcttgcttggaccaaccacttccgcttttttt

SEQ ID NO: 27620 - DNA, 533 bp, Zea mays
  Clone ID: cC-zmle189066b02a1
ggccatcgccacgctctcggcggtttaccttatggcctacgtcgactacttcgggtccgcgcccgagcacatctcgcgcgccatcaaggccgggctgaaggacaagggcctcgacgccatgctggcgctggttgaggacgagacgctatcgtcgttctcctccgcgtcctcgtcgtccgacgaagaggcaggccggacgcagctgaggcgcccgtcgtcggggagctacgggcggcggtcagccgaggagccggtggtgtgcagccccgcgagctcgctggtggccgtcatggtgcaggccctcgcgcacagggtgagctacgtgtgggtcctcgacgaggacagcgactgccgccttgctggcatcgtcacgttcgcggacgtactgagggtgttccgggagcagctgctgtgagatctggaagagtgtttgctggttcctcctcgatcgcatcttgtgctgtaatgagagaagaacatgagctcttgtcacggaccgagcgccttcgtttctaaaaaacattttggtttgg

SEQ ID NO: 27621 - DNA, 390 bp, Zea mays
  Clone ID: cC-zmle189066b02d1
caatgttgttgttcattggcactggggggcaagggggcaagcaaacacatacatactctgatccaaaccaaaatgttttttgagaaacaaaggcgctcggtccgtgacaagagctcatgttcttctctcattacagcacaagatgcgatcgaggaggaaacagcaaacactcttccagatcttacagcagctgctcccggaacaccctcagtacgtccgctaacgtgacgatgccagcaaggcggcagtcgctgtcctcgtcgaggacccacacgtagctcaccctgtgcgcgagggcctgcaccatgacggccaccagcgagctcgcggggctgcacaccaccggctcctcggttgaccgccgtccgtagctccccgacaacgggcgcc

SEQ ID NO: 27622 - DNA, 456 bp, Zea mays
  Clone ID: cC-zmle189066b03a1
tttttcttaaatttagattacgatcgagccagttaataatgcaagaggttcatgatcggatgttgagatgattgaaacagaatgagcacaattacacatgaagatttaatttccctgcagtttggacatatctagggtcgacaagacaggtgatgatctcctccattcccatcagacgctgctgctagctgcttcaccacttccagaaaacgttggagccgcacttgaacttctccttcccctcgcactcaatctcgaggtcgtcgctgatgaaggggactttcttctgcttggcgaggtcctggcacccagtgaagttgtaggggaactggcagctgccgaactccacggtgtaggcgcgcgcaaagttggctccactggtggccagcctcttcttgtcgttcagctccttgttggccttgctcttctcgaggtactcattgaagatcgtggcct

SEQ ID NO: 27623 - DNA, 477 bp, Zea mays
  Clone ID: cC-zmle189066b03d1
ggtcacggtcaccaccgggtcggccaaggccacgatcttcgtttagtacctcgagaagagcaaggccaacagggggctgggcgactagaagaggctggccaccagtggatccaactttgctcgcgcctacaccgtggagttcggcagctgccagttcccctacaacttcactgggtgccaggacctcgccaagcagaagaaagtccccttcatcagcgacgacctcgagattgagtgcgaggggaaggagaagttcaagtgcggctccaacgttttctggaagtggtgaagcagctagcagcagcgtctgatgggaatggaggagatcatcacctgtcttgtcgaccctagatatgtccaaactgcagggaaattaaatcttcatgtgtaattgtgctcattctgtttcaatcatctcaacatccgatcatgaaccttttgcattattaactggctcgatcgtcttctcagtttaag

SEQ ID NO: 27624 - DNA, 356 bp, Zea mays
  Clone ID: cC-zmle189066b04a1
aaagacgatcgagccagtcaaggggggggggaggtttatgatcggatgttgacatgattgaaacagaatgagctcaattacacattaaaaatttaatccccctgcagttttggacatatctagggtcgacaagacaggtgaagatctcctacattcccatcaaacgctgctgctagctgctacaccacttccagaaaacgttggagccgaacttgaacttctcctttccctcgaactacaatcttgaggtcatccctgaaaaaagggactttcttttgcttggcgaggccctggcacccattgaatttgtaggggaactggcaactgccaaacttcacggggtaggcgcccccaaa

SEQ ID NO: 27625 - DNA, 453 bp, Zea mays
  Clone ID: cC-zmle189066b05a1
gcacaaaaaaaaaggggatacatgggcacgattattgatacgtccagaggtaaacattattagcaagctcaagctagaagttgggggcaggcaaaacagtctctgctcctgcgcaaaagctactagcttacatagcacagttgagcaaaaaaaaagtatgttcgtcttcagcgtagcatcttaagcggacttcacggtggccgcgttgatgatgtcgatgaactcaggcttcaaagaagctccaccgacaagaaaaccatcgacatcaggctgtgctgctagctctttgcagttcgcagcagttacagagccttcgtagatgatcctagtagattcagcaacctcagggctggcattggtctttagccaatccctcagggaggcgtgcacttcctgaacctgagctggggtggcaactttaccagttccaatagcccaaactggtttataggc

SEQ ID NO: 27626 - DNA, 518 bp, Zea mays
  Clone ID: cC-zmle189066b05d1
gcctcaccgagatgggccgcaagttcttcgtcggtggcaacctgtaattctatggaaccacagatcaggtcgggaagatggtcaaaaccctgaatgaaggacaggttcccccttcagatgttgtcgaggtcgttgtcagccctccttatgtcttccttcctgtggtcaagagccagctgcgccaagagttccatgttgctgctcagaactgctgggtgaagaagggaggtgctttcactggtgaagtcagtgctgagatgctcgtcaaccttggtgttccctgggtcattcttggacactctgaaaggagagctctgctgggagaatcaaatgaatttgttggagacaaggttgcgtatgccctgtctcaaggactaaaggtcattgcatgtgttggtgagacccttgagcagagggaggctgggtctaccatggatgtcgttgctgcacaaacaaaagcaattgctgagaacatcaaggactggacaacgttgttgttgccatgaaccactttgggc

SEQ ID NO: 27627 - DNA, 282 bp, Zea mays
  Clone ID: cC-zmle189066b06a1
acacgcaatactcctcgacgctgatcacatcttcgaataagttaaagcatttccggctggttcacagtctaaaaacacacaacatggcctgaacatgcttgaggccttaaacctctctaggtaaaagatgacacgttgggtaaactaatgcgccaaggaagcacacggtaacctgtgaaaccgcaggtgatgcttactatatagacactctcttgggccaacctcacttagacgtcctaactgctctgttccacacaacatttatgatggtttgaatcctgc

SEQ ID NO: 27628 - DNA, 496 bp, Zea mays
  Clone ID: cC-zmle189066b06d1
aagcactattgattcatagaaagaagctcccgaaaagggttttctttctttccaagcgctgctcagtaggagaaaggttcctcatagcttttctcccccacaaacacaaagctcgatggaagttggcaaggaggaggaagatgaagtcaccacagtggcagttgacctcaacaagagtaccacaagcattgatcatgacctctacacacttggtgaaccaagggcttcctttcccaaagaactgactcccctgaagctgaaatcgcgccgaacaggcttgaaaccatacaagagatgttctgtggaagcgaacgaaaatagggtgccggatagcgacgaggttgttaccaacaggattcgccttgatagagaagcatcaacattagcgatttttacatggttaccgctcggacttcctatggcgccataaactttatgacaaagtttgttttacatctaaactagtataggacttaaagaccttgcaatgcaatgc

SEQ ID NO: 27629 - DNA, 449 bp, Zea mays
  Clone ID: cC-zmle189066b07a1
ttttctttaattttgcatatatagaaattatttttggggagagctcgccgtcaagcatacatgcattatctcagacttcgcagtggcgagctcgatcgatatatatgatgactagcatcagtactaaaatagtattgtatcagggacacacgtacggcatcgaccagagcaccatgcatggtccatggatcatatcatcattatcatggcttcatgggatgggaatggatcggagtacgtgcttaaccatgatcagtacacacgtttctcttggaggggcggcggtatcccgggtgatggccgggccattaaatagtagctgtaattcttgacgaacattccctccttgggctcggcggcctctccgtcggaggtgtacttgccgagctgctccagggaggttgtacttgtccccaataacaacgcgtcctgcgccgccttgaccttgt

SEQ ID NO: 27630 - DNA, 426 bp, Zea mays
  Clone ID: cC-zmle189066b07d1
ccacacgtactaccacgcttccgcccacgcatccgcatcttttgagttctcctactaccaacagagcgcaggattcgggaagtgtctcaccgtcatcagcatccctaacagtccctccgagctcaccgtcaaggaggccgcgtgggggctcgcacgctacgccgtcatctcacaggacaacgggctcgtgccgatcgtggagccggagatcctgctggacggcaagcacggcatcgagcgcacgttcgaagtggcgcaaaaagtgtgggccgaaaccttctacgccatggcggataacaacgtcatgttcgagggcatcctgctgaagccgtccatggtgacgcccagcgcggaggccaaggacagggccacccccgagcaagtggccgcgtacacccttaagcttctccaccgtcggatcccccc

SEQ ID NO: 27631 - DNA, 132 bp, Zea mays
  Clone ID: cC-zmle189066b08a1
tatattttttttttttgaaaacaaaccattatattggggaaggtttttactaatttaaatattataccaaccccttaattatacacaaaaacaaatctttttattaaaaaaaacataaatctctctactaat

SEQ ID NO: 27632 - DNA, 375 bp, Zea mays
  Clone ID: cC-zmle189066b08d1
gtgggagcacggtgccaacttactcggctacgagaggcttttctccttttcagcaggccccatcacatgggacaatggattgttctttcatcccctggaagctgcaacagagccaaccctgcagatcgggttcgctcctgagcatatgaataacttcatgccaacatggctaccctgaagatggatcttgaggcaaaggaaataaataaagatgcggtggcagcatcatactctatgcaagctaagagtgacagctgtgtttcagtcacatatatgatctagtctgtgtgtcaatgtgtcgaaaaacatgtctgtgattttgttattatgaatgtaacgcgcaatgaatcctattatataccccacttatttcat

SEQ ID NO: 27633 - DNA, 232 bp, Zea mays
  unsure at all n locations
  Clone ID: cC-zmle189066b09a1
ctaatncctgaattaaacccaagtatggaagggaatccatgatccatagtactagagaaatgatattttaactagcctagaaggtgaagatctgatcaggaaaccatcacaactcgcagcattatgagagcgactaattcaaattaaattaatcttactcaggggcacaacagcggggggtgagaccatgaaccctaactctcctagctagcttagcttaagtagcagatcg

SEQ ID NO: 27634 - DNA, 244 bp, Zea mays
  Clone ID: cC-zmle189066b09d1
gcgatctgctacttaagctaagctagctaggagagttagggtttatggtttcaccccccgctgttgtgcccgaggagtaagattaatttaatttgaattattcgctctcataatgctgcgagttgtgatggtttcctgatcaaatcttcaccttctaggctagttaaaatatcatttctctagtactatggatcatggatttacttggatacttgggtttaattcaggaatttcatcgttaaaa

SEQ ID NO: 27635 - DNA, 412 bp, Zea mays
  Clone ID: cC-zmle189066b11a1
atccttaagcgcgcctttcttttttttttttttttttttttttctttacaccgggggggtattaaacatgtctgataaaaaacaagccattgatgtttgatggagccttttttcaaggttcacacgacgggacaagcatacacgcaggggggggcctatatgtgtaataggaggaacgcgcaggcggggtactaggcctgcttgcagtacacagccagatagatatgctccacctcagatattatatataataagctggccctgcatgcagggttggtttgctatggacccggcggttgctcaaaaaccatgaatcttgatgggctccttcttcacaatgccggcctggaccaggaaattcgagacgttttttctctgatcaccctggagctgaatgacctgtcccagtttt

SEQ ID NO: 27636 - DNA, 346 bp, Zea mays
  Clone ID: cC-zmle189066c01a1
ggggaagggggcatgatcagcacagccccaaaacaatacttttttttttgggttcgggcataacaaacaaggaccgcttccgggggaaaaataaatgaagcttggaaaggacaaacaaaaaacaaacacttttatttttttttcccagcttttcctttcttccttttgacaacttcatccatgtatttgaaacccttccccttggatggctcagggggcctccacttttttatgggagcagcgaactgaccgatcgcgcttttgtcgtaacccctcacgaagaaccttgggttctttttcaccttgaccgccaggcctttgggaatggccatcccaacaggggggg

SEQ ID NO: 27637 - DNA, 502 bp, Zea mays
  Clone ID: cC-zmle189066c01d1
ccgtgcggtggaatgcaaggaatctagaattggaaagcagcccatcgtttttccatcaaatgttactctcacattagaggagcagggggtcaaagctaagggtccgctgggggagttatctctgagctttccaggtgacttgaagatcgtgaaagaagaatccggtaacctgagagtttataagactgcagagaccaagagggcgaaccagatgcacggacttttcagaacgttgacagacaacatcatcgtcggtgtgtcaaaaggattcgacaagaagcttcagttagtaggtgtcgggtaccgtgcggcggtggagggcaaccatctcgtgatgaacctgggattctcccaccctgttcggatggccattcccgaaggcctggcggtcaaagtggaagagaacacaaggatcatcgtgagcggctacgacaagagcgccatccgtcatttcgctgctaccataaagaagtggaggccacctgagccatacaaggggaag

SEQ ID NO: 27638 - DNA, 91 bp, Zea mays
  unsure at all n locations
  Clone ID: cC-zmle189066c03a1
tttttctatcttttttttttttttncacgaaaaacctcccatcagggggggggggctgttatcaaaaaaatgtttcataatacctcccccg

SEQ ID NO: 27639 - DNA, 394 bp, Zea mays
  Clone ID: cC-zmle189066c04a1
attatttttttttttttttttttatcctctattctatgggggagggggattatttttaattgttaatttactcaaacacataaaaacaattttaacatgtctaatacagcccacaaatttataaaacaaaaaacaacagacaagagaaacacaaaaaaaaacgccccagaaaaaaaaaagcaaaaaacttatttccaaaaaaaaaggaaataaaaaaatacaaacaaaaaaagagcaaacacttcacccccgaaagaaaagggatcaacctaaatccccaacacaaggaattccccgggaaaaaaaaatccaaccctggaggtacacaaaaaaatcaccaaaaaaaaatattaaaaaaaacctgggccacaacccctaaaaaaaaaggaataaa

SEQ ID NO: 27640 - DNA, 388 bp, Zea mays
  Clone ID: cC-zmle189066c05a1
ctggatccttaagcggcgccttttttttttttttttttttttttttttttttttttttgggggggttttttttttttttttttttttaagaaaacccccctttaaaagggtgggggggtttttaataaaaacccttgggttatcaaaccctggacccccccctaatgggttaacaaaaatacttggcccaaaagcccaaaaaacaacgtcccaaccccggaacaaattttgaacccttacttgttttgacaattcccgttgattccaaacaaattttttgggggaaccaaggggggggggtaaaaaatccccttttttttccaaccattttaattttttcccaattggagtccggatgcattttgggcatcccgacccctgggtccac

SEQ ID NO: 27641 - DNA, 327 bp, Zea mays
  Clone ID: cC-zmle189066c05d1
ggatgtcccaagtatgcatctcggacctccgattagcgacaagacattgttttatggttgtgaaagataagagagcattattctagggcaaccggagactggttccatccataataatttcgtctaggatatcaaccgggatattcgtcaaatacaaagtcagcagttcagatatctgtttccgggcgttgtagacgtcagtctctttgaggcttttagggccactagtatcttcgttgtagcccattagagggtgcgttccagggtttgcataacccctagtgtctttattaatagccgccacatcctctgtagaggcgggttttg

SEQ ID NO: 27642 - DNA, 403 bp, Zea mays
  Clone ID: cC-zmle189066c06a1
ctctccctttttttttttttttttttttttttttttttttctttttagggggggggtttttttttttttttaaaaaaagccccccaaatgggactttttggtgctccttccttactaaacaaacaagcggggggattttcaaataccaacccctctgactgaatccccccctgacaaaacccatgcttttaagggtggtcaaacccaccctgatggcatttttggttcccgggaacgaacaacaaaccccctttttactttcttttgaaagccccccaaactgggtaaataaagtccaaaaaccccgtccccttgaaaaggcccctgcccgttaaaagcctttaacccttcaaccggaggaagccctttttgggggtgttttttaaaaaaaacgggcccgtgg

SEQ ID NO: 27643 - DNA, 388 bp, Zea mays
  Clone ID: cC-zmle189066c06d1
aagaagcaccgccataatcggcttcctcctgcttttcgatttcgagcttctaactggcaaggggggtctgggggggacggggttcttggacttcatctacgcagtttcgggagctttcaactgagagtcatatgtgtgtttgttgttcgttccttggtatcaagaatgccatcgaggtgtacttgactacccttagaagcctaagttttgtcagcgtgcgattcagtcagctgtgcttgtatttgaacatcaccatgcttgtctgtgaagtgaggaagggacacgagaaagtcacatttgcggtgcttcttaaaaaatataatggatgggtaaaatttcctcctatgcccagaataccctattttaggttccttttaaataaccacgg

SEQ ID NO: 27644 - DNA, 486 bp, Zea mays
  Clone ID: cC-zmle189066c07a1
tccttaagcggcgcctcgcgccggcggccgttttcatttcggcgggggccggcgctggcgggcggctgctcttctgctgcggcgcggcgggcgcgggcgtgcgggccacttcgtccggtctccgcttctccaagacgtccgggcggagcttcctgtcgcgccgctgcgcgggggacctgctgtacgtgtcggacccctgcgagcacgccgtggcgggcgccaacgacgacgtcggcgcctaccgcggcgtgttccgcgggttcatgcgctcccggacgcgggcgtgcctggtgggccaccgcaccgcgctggagccgcgcgtgcgctgcccctactgcggcgcgcgcgtctggagcatgaccgccgcggggcttgccccgcgcagcgcgtcccgcaggctcggcgcccacgaagaccgcctcgagtacttcgtttgcgtcagcggccacactcacggcagctgctggctcgcgcgccttttccaca

SEQ ID NO: 27645 - DNA, 363 bp, Zea mays
  unsure at all n locations
  Clone ID: cC-zmle189066c07d1
gcgccgccctttccttttnttttttttttttttttttttttggcattgcaagagacaacgggacaatttcataacgccaaagcctttgcatttacaagatgaatctaagaccgcaaggtggggaaaatgccaagctgacgctaactaaaactttttgtacacattccttccgttcatcgatcggcgtcaaaagctggcatcatcctcctctctggcggcggcggacacgtcatcgtcatcttctttggcgccgcctggtccaccaccctttcttttagaaaagctctcaaaccatcatcttccgtggaggtggccgcttactcataccaattacttgaggcggtcctcgtgggcgcctatcct

SEQ ID NO: 27646 - DNA, 320 bp, Zea mays
  Clone ID: cC-zmle189066c08a1
acttcgcggggggggcaggaatctttaattatattacaagaacaaattcggatcccctttaattattgttccggatgaaccaaccgagaaatgcattcatcttcttgctgggcttattattcaaacatatgagctaactacaagctcattcctcatgcactatgctcttcgcacttacttggagggcattgttccgccccccaaaatccaggggcattctgcgacctccttttatggtggccaggttgcactcggccttcgagacgagggggggggcaaaacccttttgtacctccctagggcagcccggcaggtccttt

SEQ ID NO: 27647 - DNA, 491 bp, Zea mays
  Clone ID: cC-zmle189066c08d1
gcggacgcgtggtctgacgcgtgggcggacgcgtgggcaactttttattgttccaagaaatccatcgagaggcggtcgacgggggaattaatggcgtcgtcgtctatcagcagccaccgtcgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatctggccgcgcctcccgtggccggagctgaagaggagatgctgccgggagctggcggacatcccggcgtactgtcggtgcacggcgctgatcatccttatggacggcgcgatcccgccgggcccggacgcgcagctggagggccgcctagaggacctgccgggctgcccgccggaggtgcataagggattcgccgccaccctcgtcacgggagccgagtgcaccct

SEQ ID NO: 27648 - DNA, 478 bp, Zea mays
  Clone ID: cC-zmle189066c09a1
cgtgatatgtggagggctatgtccaaatttgatgaattttagaggagaatgtttttcacgtaacaccacccgcccaccagctagagactagcacgatggaacacacaactaaagttactgtaaccagtatacaataccacccatatatatcgtacgacataataaaaggtagctcagcatcatcaagtacatggaaaaaaaatactctagtcttcacgatatactgtaataataaaaggtagccctgccttaatagcatcagtcttagcagtagaacatgacccgcttcacgttttccttgagggcaggtaatggcctcacagcaacattcccaacaccggcagccttggtgttgcgcccccctggtggagggccacggcttgccatagatccactgtcactcgtatctggctccatgtagaaccgagctcggaaggctgccaggtgagcatagtatgcaggaggaacaatcgatact

SEQ ID NO: 27649 - DNA, 515 bp, Zea mays
  unsure at all n locations
  Clone ID: cC-zmle189066c09d1
gcccacgcgttcgtccactcgttcgtccactcattcgcccactcttcncgttcttctcaagactggcctgaggtggcaaagggtgcaggattggtgagtgctcaagcccatcgtcaagaattgatacaggatcttttcaaggtatggcaagatcccgaaagggggactgtctctggtggcatgatcagggagcttctcatatctttctggagggcaactggacagaaaccaaagaggatcatattctacagggatggcgtcagtgagggacaattctaccaagttctgttgtatgaacttgatgccattagaaaggcctgtgcgtcattggagtctgactaccagcctccagttacttttgtcgtggtccaaaagcgtcatcacaccaggttgtttgctaataatcacaatgataatcgtgctgtcgataaaaggggaacatactgcctggcaccgtggtggactcgaagatctggcattcaactgagtttgatttctacctgtgcaggcctgct

SEQ ID NO: 27650 - DNA, 312 bp, Zea mays
  Clone ID: cC-zmle189066c11a1
ccttttctattttttttttttttaggaccattattctttttcgggggggggtaaatttatattacaggggcctccccagaaacaaacatacgcccacagaagagagagcacttacacactggggcacaaaaaaaataacaaactgggggctaacacagaacacgaaatactcgggataaaaaaacctccccctgtaaaaacactgccccaaaataggaagaccaaaaaaacacccgcagcacaaagaaagtaaaggcaggcacacacaagaagacagtggaccaaaataaaccccatacctcaaaggcacca

SEQ ID NO: 27651 - DNA, 233 bp, Zea mays
  Clone ID: cC-zmle189066c12a1
accaaacaacacctttatttgggggtgggtgaattttttatcattatttcttttccctccaaaaaacaccacaaaggacaacaaccaagagatttttatagaaaaaaaaaaaatgtgacacattaaaaaaacaaaagtgaactctaatatatggttataataaacaacaacacaggagaagaaccccaagttactctgaaaaagaacaaacgttaaaaaaagggccttttttt

SEQ ID NO: 27652 - DNA, 494 bp, Zea mays
  Clone ID: cC-zmle189066d01a1
acgataacgccataaggatataattattccaggagactacatgttggtcagattacttcaacgcactcggtctgaatacaacttccatttaatatgtagcagctttttatatagtactacaaaaacattcatcacccagtaatagaggaaaaaaaaacatatattttctccttactacaaatatagtgagtcacgctatcaagatagcagtgcttcgcgtttttgtaatgcttgcttctttagtttgttgcgaaagcttcttttcctgctgaatgctctctccactggctgagccaactcctctgcttgacgaactgctcttacaagatcacgatttgcctctgtgtataggctagtaactataccagattgaccagctctggctgtgcggcccaccctgtgcaaaaaatcaacagcacaggcagcaaattctgcctgaatgacatgagaaacatttggaacattaagcccacgggcagcagcatcagtgcata

SEQ ID NO: 27653 - DNA, 357 bp, Zea mays
  Clone ID: cC-zmle189066d01d1
cttagggtaacctcgacctcggtgctacaacgttgttcatgctgttttttggctattgacctgggcagaaaacaatggtgaggtctgtatccattatgcttttgagcttaaatgcgaaggagtatgatgctaaagttcagacgcactatggttttacaaacaccgtagctgtattatcttgattttgatggtggattcatgttttgaccatcggagagttctgagagcggctatatttacagtcttcggaaaaggggggcttgatgcactgagtgtgccgggctgagttcaatgtttatgtattagcaaatgtgctggcgtgattttgacagggggcgaagcgagtggcattgttag

SEQ ID NO: 27654 - DNA, 226 bp, Zea mays
  Clone ID: cC-zmle189066d02a1
acacaaggatcatcatgcacatgggaaagggtgccaccaccgtaccagcagccaaattacaatatactgtaattaatagaagaagaagttctttaatttggatccccggctggggcgtgcggcgtacttgaagtgtgattagtcgaaggtggccttgccggtgaacttgacgtcgatggggttgacgttcttgccgatgctgcggaagttctggccgacgccctcc

SEQ ID NO: 27655 - DNA, 240 bp, Zea mays
  Clone ID: cC-zmle189066d02d1
acttacgtcccgaccccaccgatccaaataaagaacttctttataatacgaatgaattgctgtggacgggggctgatgaaggctgagaccggtatttttaaaaaaaaaaaaaaaagggcggcgttaagaccaagcttactcgcgtgctgcagcatacttttatggtaccaaattaattatgccgcgttacacgctgacggaaaactgcgtccactaatgctgagacatccccttgcagtg

SEQ ID NO: 27656 - DNA, 505 bp, Zea mays
  unsure at all n locations
  Clone ID: cC-zmle189066d03a1
ctgatactnagagccttctttttttttgcaacaacctttaaattttctgncaaaaaacngggaagccacaagcgtcagccaaaaaacttcattattgaactataactcataagcaatctaaaagagggcaccaccaatgatgggttgttggtagaaacgctgttgggtttgtcaaagcaagttggttgaatggcagcaattgttgcagttgtaagagggtgccagcgttaggcgcagcgtgcaggtagaacggcaacaactgttgctgtgtcaagaaggcaatagggctcacatcagctagctggctgaatggtggtagttgttgctgttgtaaataagcagcagagttcaatgctgccagttggttgaatggaagaaattgctgggggtaggcagcagctagctgactgaatggtagttgttgttgcaaataagcagcagagttcaatgcagccagttggttgaatggaagaaactgctgttgctgagagtaggcagcaaggtt

SEQ ID NO: 27657 - DNA, 590 bp, Zea mays
  Clone ID: cC-zmle189066d03d1
ccgtccggctccttggtctttctgcaagtgctgctaccgcaaccattttttcacattgctcacaagctcctatagcttgggttcttgccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggctgcattgaactctgctgcttatttgcaacaacaactaccattcagtcagctagctgctgcctacccccagcaatttcttccattcaaccaactggcagcattgaactctgctgcttatttacaacagcaacaactaccaccattcagccagctagctgatgtgagccctattgccttttgacacagaacagttgttgccgttctaccttgacgctgagcctaacgctggcaccctcttacaact

SEQ ID NO: 27658 - DNA, 482 bp, Zea mays
  Clone ID: cC-zmle189066d04a1
cattactatacggcccatgctatgctggatgcaacatttgcgattggattatggcaccagggcatcggggcacagctcatagtgtatcccggttaacaacatacaagcgccatctggcgaactaagctccctaggaaaaatgctagtgtacatgacattgggtgactaaagccatcagttttatcaccacaagaagccccattgacaggccttacacaaactctctggtatagaggagcaaaatgctttcagctttgcaatggacagctctgcctgcttcccaccaccttcagtagagttacacatgagtcaagcctgctcaacaagtcatgttgggttcctgaagaatggatggtccagagcttcttctgctgtcaggcgttccgatggctcgaaccgtaggagaccgtatagcaagtccaccagtgccacctttgaatggtcagcgttcctcgatcccaaggctttagtcgatccagttt

SEQ ID NO: 27659 - DNA, 196 bp, Zea mays
  Clone ID: cC-zmle189066d04d1
tgggctggaagcgaccccagcagatggccgcgccgcccaacaaatggacaggggccgtccccaggagagagacggatggccttgattcactgcgaactgacgcgttaaatgacaaaggagaggtgggtttgatcgcgttcctttgtggattcgtattatctaagaaagctcagtgattcgaggtcatggcggtttg

SEQ ID NO: 27660 - DNA, 51 bp, Zea mays
  Clone ID: cC-zmle189066d06a1
attttattttttttttttcccaccaatttcacttactcgggtggggttttt

SEQ ID NO: 27661 - DNA, 302 bp, Zea mays
  Clone ID: cC-zmle189066d06d1
cacttgagttaattcagccatgaggagccaggtcgcagcatcagccatgtttttgctcctcctggccttgggtgctgaggccgacctctgcgtcacgcgtagcaggaccttcaaagggtggtgccaccagagcgagaactgcatcaccgtctgcaagagcgagggcaataccggcgggttctgcaagctcggggcttgcatgtgcaccaaagagtgtgtccgaagtactgacgctgctggtgctaataaagccccacagcagcatttgagttgatgagtagtaaagaagaacgcttttgttt

SEQ ID NO: 27662 - DNA, 517 bp, Zea mays
  Clone ID: cC-zmle189066d07a1
gtcgctgatccttaacgccgcctttttttttttttttgattgaaaattagacaaaccaagcgctgctataatttattctaggggtaacttttatatagcctctgcactactgagcacagcagacaaatcagcagagttaccgactaacgacaaactggcagaataatgaactgaataatctagagcttttcctcctcatggctcatattgctggtcctcttcatcctctccggctccgctagccttcttggcctcttccagcgccttcaccaagtccgcgaggcacgagtccggcccgtcgtcgaggctcttgggcgtgaggttctcggcgacgtcggccggcgtcatgtccacctcccggagtagctcgccgacggcgtcgaacagagggtgcgagtccacgttgaggtacgtcttggccaggaacttgaacgccttgaagccgcagtaggacatctcgatgtggttggccatgcgccctttgcggatgagcgccgggttcagctttttgacgtgg

SEQ ID NO: 27663 - DNA, 212 bp, Zea mays
  unsure at all n locations
  Clone ID: cC-zmle189066d07d1
ctcctgtacggtgccccccgggaccggggaagtncggccatcgatctttcgncattggncaactatcctcgatctacgacagggtatcgagagtcgatgctcacagtccagtgcatctccaacatccgatcctccgcaaaggctcttcatcgagaanccaccagcaaagtccaatcaatcgtcattcgagagaacatcgatctgggctccct

SEQ ID NO: 27664 - DNA, 212 bp, Zea mays
  Clone ID: cC-zmle189066d08d1
gcggacgcgtgggcggatcacttctttaatttatataagtttttatcatctagaaaaaatctggagctattcggggagaaacgaacatggcctcaatcctcttcaatccatttgctcccaaacaagccaacgggtgtttggtgcaggagctatgtgctcgaacaatttaatcaacaggttcttctgctgcagttacggcattttctgtgctc

SEQ ID NO: 27665 - DNA, 253 bp, Zea mays
  Clone ID: cC-zmle189066d09a1
aaaatggggagggggttttatttaggtcacgaacttattgccccaaaaaaacaggaacttagtgcctgcaacttctattgccaaattccatgaccctgtacaaccagtcaaccacaaacatacataaggcaccccggcaaacacaaacgggcctggatgcccgccggcgggcggataaaataaccctggggaggaaaccccccctgcgctcgtggaacttaccgctgcaggggaagaagtcctcttccaccct

SEQ ID NO: 27666 - DNA, 519 bp, Zea mays
  Clone ID: cC-zmle189066d09d1
gggcgctgcgcacagacacaccaagcgtcggcaccaatggctttctacctttaggtggactactgctcggaggaggtgaggtcggtggccccggccggcttcggccgccacggcggcggcgtccagcagcacgtcgtcaaggataagttcgaggaggtcgacacggtctcacgcgccggcgccaaccaccaccaccaccatggtcaccacggcggccacggcttcttggtgcgcgagaccagggtcgaagaggacatcaacacctgcaccggcgaggtccactagcgcatggagagcttcctcgccagggctaactgatccgcccggtggtcggcatccacgcccgtttcgtgcttgcctgcgtgccttatgtttgtctgtggttgactggttgtgcagggtcatcgtacttggctttcgtacgtgcacgcacttatgtccttgtccatttacgacaataagctcgtgacctgaataaaacttctttcgtaatactatgtattttaagaccccttttct

SEQ ID NO: 27667 - DNA, 121 bp, Zea mays
  Clone ID: cC-zmle189066d10a1
aggaaggaaatttttctatttttacagtgtccggtgtgcaccggagtgtggggtgccccttatgacagaaggcaagaatcctcttattatttttttatcattttttcataaactatttatt

SEQ ID NO: 27668 - DNA, 325 bp, Zea mays
  unsure at all n locations
  Clone ID: cC-zmle189066e01a1
atnnagaaggaaccatctctctctgggtctggacgccatcatagtcatagtgaaaacacgacgacgaaatgatctagtaataagctagtcctaggaaaaaagaaaatacgaaaaaaagaagagaggatctagtaataatactattatacaagctaggtagatatcctcaaaagttatataatctgttatatcttcgagcgccgagctgattcggcggtgaactgaactgaggcctgagagccagacgcgcgcgccaagggcggctactgcttggcctgggagtagaagaaggttccgaggatggcgatggcggccccgagcgcgt

SEQ ID NO: 27669 - DNA, 459 bp, Zea mays
  Clone ID: cC-zmle189066e01d1
gggccgaaccacgcgtgcgcccacgcgtccgcagacgcgtgggcggacgcattttcaatttttcggggccggcatcgccatcgggggaaggggtatttactccaaagccctaccgtcaccacgctggtcgagctggccacgctgcgcgcgctggcgcgcgacgccgcggagcaacttcggctgccgcgggccggcacgtcggcgtcggcgtcgtcgtcgtcgccgtggcgcgggcgcgaggaccacctccacggccacggcaagacggccaaggtgatgcacctgctgctctggggacccaagtgaagcggcggcgagaggccaccgtaccgtcgggctctcccgccggcgttgctcgttttgctctgcctgcaattccgcccgcacggactgtactgtacctatacacctatatactacgacgtgcacctgtactacgacgtgctgctggaccatact

SEQ ID NO: 27670 - DNA, 405 bp, Zea mays
  Clone ID: cC-zmle189066e02a1
gggggaagacgaaaacatgtagaggggggcagatcggcggagtacaaagcaggaagcaacagctaatacatgaatggatatcgatcgatagctagcttaattagttgacggtgatcttgccgaccattccggctccttgatgcggctcgcagtaaaagccgtaggttcccggcacggtgagggtgacggagtaggtctcgcctggcgcgttgaggtactcctcctgcgagatcttggtggcgtcgacgccgctcggcacctcgtcttcgtcgaaaacgaccttgtgcgggaagccggcgttgttcttgaatgtgatggtgtcgccggccttgaccgtgaactggctgggctcgaagacaaacccgtcgtcgcctgcgcccagcagcaccttctgggccatggcac

SEQ ID NO: 27671 - DNA, 429 bp, Zea mays
  unsure at all n locations
  Clone ID: cC-zmle189066e03a1
ttttgttttcttattcttngaattcatggtttctcttttggatcaggttcttttattcattaagcggtagggtctcaatcaacctctttcccgcatcttcatgcatcaaccatcctagttcctgatgttcccccggaaggagtcatcaccaccgttgttgttgatataagtctgattcctctcctcaggtgcgccgacacctccgtgagcaaagtcacccgccttggtaggttgaccgttggccttgatggaaccaccctcgtcgagcgggatctcgcggttgttgccagcgccgctggcagcggagccgtattttacttttgcgccagggaacttgccctctacgtttgcggtgtcgaccccggattccgtggtggaaaaaccaacgatgtggcccttgggagcgctatcgctgctgagttcctgctc

SEQ ID NO: 27672 - DNA, 555 bp, Zea mays
  Clone ID: cC-zmle189066e03d1
gtgcgcttctttgatacccatatctccgattccaatactttcctcttttacaaatttccaaactacttgggggtacagggatcacaatgtctgccgaatacaagaacaccaacgtcaacgagatcgccaagaaggctgagcaggaactcagcagcgatagcgctaccaagggccacaacgttggtctttccaccaccgaatccggcgtcgacaccgcaaacgtagagggcaagttccctggcgcagaagtaaaatacggctccgctgccagcggcgctggcaacaaccgcgagatcccgctcgacgagggtggttccatcaaggccaacggtcaacctaccaaggcgggtgactttgctcacggaggtgtcggcgcacctgaagagaggaatcagacttatatcaacaacaacggtggtgatgactccatccgggggaacatcaagaactaggatggttgatgcatgaagatgcggtaaagaggtgattgagaccctaccgcttatgaatgaaggaaatgatccaaagaaaaccatgaataaagaatctgaatgc

SEQ ID NO: 27673 - DNA, 406 bp, Zea mays
  Clone ID: cC-zmle189066e04a1
aacgggagcgcacactcaaatataacttcaaaaatagtacaatttctatacatatatcgttggaccgatgaaccgagattacaatgtgggtttgccattttgcatcaaagtttaggttggaccaattagtccccaaaaagaaatgcaggatattggcagctgactaacgattgttctttgttgtttggccttccattaacactgggtcagtatttcagggccatctttggtaatgagtatcgggtgctcgaactgggctgacaagctgccgtctttttgtcactgcggtccagtcattggaccacatgacaggggtggaagctccctatgggtaggcatgggcctttgatgacatgggaatgattaaaaagggtgatgaaagtgagatagcctcatatgctttacc

SEQ ID NO: 27674 - DNA, 495 bp, Zea mays
  unsure at all n locations
  Clone ID: cC-zmle189066e04d1
accccgcgtgcgtcttgttccaactactatacttacgacatttaatttttgattgtatcatgcagacaagntcaagagtggtgtggttagacagtttgttggccatggggttggcaaagtttttcatgctgagcctgttgtgcttcatttcagtgagttccccactttaacaaaaacatctttttattaattgttgtcttgcctcccggctatctcaaggttctggttgcactctgcaccatattatgatgtgatatctgtgccaatgacttcgaaatttgcaagaaacaatgaatggggacgtatgatgttgaatcaaacatttactataggtacaccttttcacagcttgcccgtgttctattaacctgtgattaaaattgctgctctttttctattgacctgtgattaacatttcacactgtggaaactagagataacattttaaaaaaaaacagggtcattatttttgtggttcctttcaaccatgaatct

SEQ ID NO: 27675 - DNA, 386 bp, Zea mays
  Clone ID: cC-zmle189066e05a1
caaaatgctttttacggggggggggttttttattttggaagggtaccccgccaccaagcagaaaagtgaaaccttattaagggacaaagttcgaaaaaaaaacggggcgcaactagaagggggacaggccccggcttgttaaaagggatccgagccatatgaaagggaaaaaagtaaagcactttttccttaaagtgagagaccccaaatatgggctgaagaaaaaacgggagggggcttttgggcccaaattttgtgtaccggggtacaaattgaacaagatggggaaaaacaaggggcttttttttttccaaaaaaacccattgggaaaaaaaaacaagccaaagggggacaacgaaatgggccataaaaagctagggcctaga

SEQ ID NO: 27676 - DNA, 161 bp, Zea mays
  Clone ID: cC-zmle189066e05d1
cgtccgcggacagcgtggggactttgcatcccttatagagaggttttctcattttagttagactctttggcgatgggtgaggtgatgaggcagggttctatagacgcagtaatactacctctcagagataaaagagattacccttctcgttagagaaaagc

SEQ ID NO: 27677 - DNA, 351 bp, Zea mays
  Clone ID: cC-zmle189066e06a1
accaacccaaagataatggggggggtacaaaaaaaaatggttaagcgtgtataccaaacagcggctgatggtaggttcttcaaatcttttacttaggagttgacatggttcgacacggacagaattattagatgatacatagctcgcagagctaaggcttgatctgcgctgaacttttatccattgcatggaggcgaacgaagcgcgcaacgaggagctcgtgggtcatcaagtcgcagaccaaccctttagtcccctacctaccctgaggctgaggatgcgtaacctgcttctgctgctgcgtgccccctatcttgttactcatcccaaacttgaccgaaccgacggacg

SEQ ID NO: 27678 - DNA, 354 bp, Zea mays
  Clone ID: cC-zmle189066e07a1
gcggaaaaacaggggcttgtataaataaatgcacaaactgtactcttaaagatacaccagtgctattagtcttggagcggagctcaacaagggaagcataggctccgccgctgatgcgcatgagggcttcatgcctttctctctccacaatcttgccttccctgagcacagcaatcacgttggcccccttgatcgtggagaggcggtgcgccaccacgagggtggtccggctgaccatgacgcggtccagcgcgttctggacgacgcgctccgacttggcgttgagggcgctggtcgcctcgttgaggagcagtatcctcgggtccttcactatggccctggcgaacgccaccc

SEQ ID NO: 27679 - DNA, 487 bp, Zea mays
  Clone ID: cC-zmle189066e07d1
ggcagaggcccttgtcggagagagtggcagcggcaagtcgacgataatcgctttgctgtttcgtttctacgacccagattccggtagaagatccctggacggcgttgagatcaagagcctaagagtgagctggctaagggaccagatggggctggtagggcaggagccggtgctgttcaacgacacgatccgcgccaacataacgtacgggaagcacggcggcgccacagaggaagaggtggtggcggtagccaaggcggtcaacgcgcacgagttcatatcgggcctgccccaagggtacgacaccatggtgggcgagaaagggatccagctgtccggcgggcagaaacagcgggtggcgatcgccagggccatagtgaaggacccgaggatactgctcctcgacgaggcgaccagcgccctcgacgccgagttggagcgcgtcgtccaggacgcgctggaccgcgtcatggtcagccagaccacc

SEQ ID NO: 27680 - DNA, 386 bp, Zea mays
  Clone ID: cC-zmle189066e08a1
ggaaacttatttaactggggcgggaagcttacctgtaccaagtgcttgatgtgctttatgtacaagggcacacatttacatggagtacaggttagcacatccgttatgttatcttacaacagcacgagcccctcttatatgcatcaaatccgcatctgttggatacccgtatcagcagcaaacagctcacttgggcaatataaagctccctcttccgggaatggcagattggaggtttcttccttaccaaaacaaatcgtggaagccctaacatccccagttctacatgatcgatggaatagagtcatttttatctgaaaagaatgacaggttttgaaatgcgtcgaggctatttgccattagacggttccaactattttgactgt

SEQ ID NO: 27681 - DNA, 482 bp, Zea mays
  Clone ID: cC-zmle189066e08d1
gtgcgatcacactctaatggatcaaaaggaggactcactttctctcttttataagccgacgcttataagaggtatagaggataatcatgccaaatacaaaaacttttataccaaatcaccacctcaaacacatgcaactaatgaatcgaagagatcaatctttatctgacatatattgtcctcactcactcatgaccactgtacttgtacataccttctgtgacatacaaatccgatgacatacttataggggacagtcaaaatactgggaaccgcctaatggcaaatacccacaactcattcccaaacctgtcattcttctcatacaaaaatgactctattccatccatcatgtataacagaggatgttagggcttccacgactcgttttgttaaggaaggaacctccaatttgccattcccggaaaagggagctttatattgcccaattgaactgtttgctgctgataccggtattcaac

SEQ ID NO: 27682 - DNA, 408 bp, Zea mays
  Clone ID: cC-zmle189066e09a1
ggcggcgcggagttttttttttggggctgggattctgatttctggggaggaggcgggttcttggctacgaagtccttgaggccgacctcaccgccagggaagccgcctgtgaggcccatcatcttcttctcgaacgcgtccggatcaaccgcgggcggaggagaatctgtcgaaggaggaggagagggcgcgggcgaggaggtggtggagccggatgcgagttctttgcggacgccgacctcaccattgcagaggccccgaccgccgagtatttcggcgacgcggaaagaggcggagggaggtcgcaaaaggaggcgagggtgctggtggtgtggcagcggcggcgggcggaagaatgaggggctggtgggtggcggccccatctgaggagtggagatgagcgcccgc

SEQ ID NO: 27683 - DNA, 430 bp, Zea mays
  Clone ID: cC-zmle189066e09d1
ccacacgttctcggacgcgtgggcgggcgctcttctccacttttccgatggcgcctccacccacgagcccaggattcctccgtccgccgtctctgccacaccacccgcaccctcgcctccttttgcgacctccctccgcctctttccgcgtcgccgaaatactcggcggtcggggcctctgcaatggtgaggtcggcgtccgcaaagaactcgcatccggctccaccacctcctcgcccgcgccctctcctcctccttcgacagattcttctccgcccgcggttgatccggacgcgttcgaaaaggagatgatgggcctcacaggcggcttccctggcggtgaggtctgcctcaaggacttcgtagccaagaacccgcctccttccaaaaaatcagaattccagccccaagccacgctcttcgcgccgcc

SEQ ID NO: 27684 - DNA, 342 bp, Zea mays
  Clone ID: cC-zmle189066e10a1
cacgcaaacactttttttttttacaaagccacaaaaacaggtgcggagcagggttactattcctgcaacgacatggctcttacacactggcattaccgggaaaaaaaatagctatgcgatggcttgacacattttcagcacaaaagatggacccctatacaggaggaagactataagcacccaagcatttttgtaatgtccacgtcttgcatcatggggttcacgaggagcaggacaagcatgcacacttcaggtctgtatgcccaggctggtgggaaccgtgcatacttctccattcccggctggtcgtcttacggattctgcattaccctaagcacccgc

SEQ ID NO: 27685 - DNA, 265 bp, Zea mays
  Clone ID: cC-zmle189066e12a1
ttttattttttacattttctcttccactccgggggggggatattttaatcaaaataatgaaaattcctcaggaaacacctgggggaattgagggcactattgtcgtgtacatctcaaatgtaatttaaaagatggcacctccaaaaacaggattgttgcaagggagggttcataaaagagaactggttggatggcaacaaatgaaggggctgccgacggaagggaggcaccaatgggttagccactgccaaaggataaacaaact

SEQ ID NO: 27686 - DNA, 484 bp, Zea mays
  Clone ID: cC-zmle189066f01a1
ttttatttatgtttttattcgggagcgaaatacagtatatggacatgtgtagtggtacacactgctgatgcatatgggagcagcaggggcgttattttatgcattcatattcgttacaggcagctaggcaagcagcatactgcatatgcatgcatgcagatgatccgatccatcgttttagttattagttggggttcacgtagagcccgatcgcgtccaggcaatctccagagcggccaaagaagccagcgacgtggccgttgttcatcaccttgacacggaacggggtgccctcgtccctgccgtacggtccgtaagcgcgtttgttggtgacgaatttgagagacttgaccagattgtcaatgttgtaggctgggcccgtggtcccggagatcttcgttaagctctcgtcgaacctgcacagatcaatcttgtactccgtgccagcgtggccgaaaccccatggcccctcctcgtacgggtt

SEQ ID NO: 27687 - DNA, 209 bp, Zea mays
  Clone ID: cC-zmle189066f01d1
gcggagagtggggtggatacgccggcgatcgactttatcagttggctactccggaccggctgatcgaggtggggggtcactgcggacaacagcagctgcatccgctccatctccttcatctacatcgaagccgaatggcaaaccgtccgaggaggggccagggggtttcggccaccctggcacggagtacaagattgatctgggcaggt

SEQ ID NO: 27688 - DNA, 109 bp, Zea mays
  Clone ID: cC-zmle189066f02d1
acactcgccctgtatcggcccattaaacaccgctattgtgttggttactcgcaaagtgaccgtttcactttccatatccctaacacccggtccttttacttttttccct

SEQ ID NO: 27689 - DNA, 457 bp, Zea mays
  Clone ID: cC-zmle189066f03a1
tttctttcattttaacccctcctaattcactaatttgggggaggagtactgaacttttggatttgaaaaaagtttcagaagatatatctaaagtagatggtgattgatagagcaattcttgttcgtaagttccagtgtgagtactgcgccgaacataaagtttgtgacgggtagtaaaagatctatttttcttttgactttgacatagagttcgatcctcaattatttctcgcgctatcttcttacgaagttttgttagggcatctataacagcctctggtttaggcgggcaacccggcaggtagacgtccacaggaattaacttatcaactcctcgaacagtactataggaatctgtactgaacatgccccctgtaatagtacaggctcccatagcaatgacgtatttcggttcaggcatttgctcatataatcgcactaaagatggagccatttt

SEQ ID NO: 27690 - DNA, 337 bp, Zea mays
  Clone ID: cC-zmle189066f03d1
aaataaaaaaaaaggaaggacaccattccattgagacaattatgagtttgattgagttttctttactcaaccaaacaagttccaattccgttattttaactacactaaacgatctttcaaattggtcaagactctcaagtttatggccccttctatatggtacccagtcgtagtttcattgaatttgcttcattaataggctcacgattcgactttgatcgttatggattggtaccaatatcaagttctagacaagcggacctaattttaacacctggtacggtaacaatgaaaatggctccatctttagtgcgattatttgaacaaatgcctgaac

SEQ ID NO: 27691 - DNA, 508 bp, Zea mays
  Clone ID: cC-zmle189066f04a1
ctaaaacgcgagcggcgccggggggggtttatttattgatacgtctcagaggccaaacattaattagcaagctcaagctagaagctaggggcaggcaaaacagtctctgctcctgcgcaaaagctactaacttacatagcacagttgatcaaaaaaaaagtatgttcgtcttcagcgtaacatcttaagcggacttcacggtggccgccttgaagatgactatgaactctggcttcaaagaagctccaccgacaagaaaaccattgacattaggctgggctgaaagctcctttgcagatagtcatagttacagagcctcccgaaatgaaccctagttgattcagcaaacttaaggctgggaaatgttttttaacaaaatacctcagggaaggcttgcactttctgaacctgaactggggtggctaactttaccagttccaatagcccaaactgggcaataggcaaaaactacatgtgttaatcccttaactttataataaattgtttt

SEQ ID NO: 27692 - DNA, 490 bp, Zea mays
  Clone ID: cC-zmle189066f04d1
ggctccttgctcaatccgagcatatatatgggatctcctttttttacttcagtactcattagcagggaaagaggtggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcataactgctgggtgaagaagggaggtgctttcactggtgaagtcagtgctgagatgctcgtcaaccttggtgttccctgggtcattcttggacactctgaaaggagagctctgctgggagaattaaatgaatttgttggagacaaggttgcgtatgccctgtctcaaggactaaaggtcattgcatgtgttggtgagacccttgagcagagggaggctgggtctaccatggatgttgttgctgcacaaacaaaagccattgctg

SEQ ID NO: 27693 - DNA, 503 bp, Zea mays
  Clone ID: cC-zmle189066f05d1
cgttcgtccacacgtccgcggacgcgtggaacttaattctttattttttggagggacttatgtcaccacagacagaagctaaagcaagtgttggatttaaagctggcgttaaagattataaattgacttactacaccccggagtacgaaaccaaggatactgatatcttggcagcattccgagtaactcctcagctcggggttccgcctgaagaagcatgagctgcaatagctgcggaatcttctactggtacatggacaactgcttggactgatggacttaccagtcttgatcgttacaaaggacgatgctatcacatttagcccgttcctggggacccagatcaatatatctgttatgtagcttatccattagacctatttgaagagggttctgttactaacatgtttactttcattgtgggtaacgtatttggtttcaaagccctacgcgctctacgtttggaggatctacaaattccccctgctttttaaaaacttttc

SEQ ID NO: 27694 - DNA, 479 bp, Zea mays
  Clone ID: cC-zmle189066f06a1
aaacgataattgatgaggtagggaagaacagagttttgaaccatggagcagtttggaagttttacatgactggggaaaaaaaggacatgggattgtagcttttatgagcactgctactagtaatgttcacatagcatggctctgtaataatactgttgatcaccacatccaccagcagcaggcaatccggttgccaatgaggaggcagccttagacaagcacctgagctgcagctagcctagcaatcggaaccctgaaaggggagcaagaaacgtaatccagcccagcctttgcgaagaaggccacagaggaaggctttccaccgtgttctccacaaatgcccaccttcaagttaggcctagctttgcggcccctttttgtagcaagctttaccaggttgcccacttccctctggtccaggacctcgaaggggttatgttggaaaatgccctgagcaagatagacgggaatgaactttc

SEQ ID NO: 27695 - DNA, 527 bp, Zea mays
  Clone ID: cC-zmle189066f06d1
gttcggaacgacctgacgcagatgacctttgggtacagtttggattttgtgggaaagttcattcccgaggggcttggggagggcattctccaacatgaccccttcgaggtcctggaccagaggggagtgggcgagctggtgaagcttgctacagagaggggccgcaaagctaggcctaacttgaaggtgggcatttgtggagaacacggtggagagccttcctctgtggccttcttcgcgaaggctgggctggattacgtttcttgctcccctttcaaggttccgattgctaagctagctgcagctcaagtgcttgtctgaagctgcctcctcattggcaaccggattgcctgctgctggtggatgtggggatcaacagtattattacagagccatgctatgtgaacattactagtagcagtgctcataaaagctacaattccatgtcctttttttccccagtcatgtaaaactttcaaactgctcatggttcaaaactctgttctcaatacatcatccattatcga

SEQ ID NO: 27696 - DNA, 485 bp, Zea mays
  Clone ID: cC-zmle189066f07a1
gagaagccaaccataactccacaggatgggggaacaggatgtgtgcacgatctttaatattacaagctgcagatattctcaagctccagcttgactaaggttctcctttcctgaccaacaaagacaaaatgacgtcactcagcttcatgaagatctaatagccatcctcgttcctagcgcgtggagcagcgcgttggtcacctcgagtctcaccagggtacggaccactgcctgctctgtaagcatgcccacgcccacggccggcctccataccattgggtctccctcggctgccatatggatcagcagcatagtcgtcaggtcgacctcttccggtgaaggaaactcttcataggcctgttccgtgcaggagagcggcttctgtcacgcagatcattttcccagttaccacgaggagatcctgaacgacgccgacttctgtcaagataaccatcatatgggcgctccctctgaaccggacgcgt

SEQ ID NO: 27697 - DNA, 207 bp, Zea mays
  Clone ID: cC-zmle189066f07d1
cgctcaagatctcctggggagaagaggggaaatgatctgcgtgacacaatcctctctcctgcacggaacaagcctatgaagagttccttcaccggaagaagtcttcctgaccactatgctgctgatccatattgcagccgatggagacccaatggtattgaggccggccgtgggacgtgggcattgcttacagatgcatagcctctg

SEQ ID NO: 27698 - DNA, 462 bp, Zea mays
  Clone ID: cC-zmle189066f08a1
ttttatttaatgcagcctatatataaaatggggcagggcagtgtcttgcacagccatatacacgatctgctggccatatcctaagaggagctaatggctcaagtgccactcttacttgcacatatttgcgactaaataacaactatagcaagcagtgcacctcattctgaaatatcgctatactgttgataccaggagttgttttttgcttgctttgaaatgatgcctcagtatttttgagaaggaaatacagtggaagatacacaaaattacaatttggtggaacgaaacttaatgattttttgaagaccacgtagctctcagtttgctttcctattcactttgaggtagggcagtgcacccgtaacattgtcgtagtcactcttgttgacttgcaccatctttgagagcctttttttgcgcttggtggtttttctggcgagcaagtgctgctttccggcg

SEQ ID NO: 27699 - DNA, 494 bp, Zea mays
  Clone ID: cC-zmle189066f08d1
gtgcggtggaagcggggcacagacagagaagccaatggtttctgtccttctccctcgcgcgccccgcgcgcgtggccgggtcctccggcgcaggagccaggaagctacccgcagccagcctcgcattcccggcgaaatccttcttcggcgcgccgctggccgccaccgcggcctccgtcgcgtcgccgctcccgcgcaagccggccaccttcaccacctcgctcgaggtcgtcgcggcggggaagaagggctacaagatgaagacgcacaaggcgtcggcgaagcggttccgggtgacggggaggggcaagatcgtgcggcggtgcgccgggaagcagcacttgctcgccaagaaaaacaccaagcgcatgaagaggctctcgaagatggtgcaagtcaacaagagtgactacgacaatgtttcgggtgccctgccctacctcaaaaggaataggaaagctaactgagagctacctgggtcttaaaaaatcatt

SEQ ID NO: 27700 - DNA, 369 bp, Zea mays
  Clone ID: cC-zmle189066f09a1
aaaattctaatattttttttctttttctaaaaaaacaaagcaaaaaacataaatttttttggccccccccacaatttaacggaaaaaaaaaaaataaaaccccgaaacattttaaaaggaaaaatactggggaaaacaaaaaacccgggggaaaaaaaaaaaggaatggggaggaggttataaaaataaacggggcccccaaaataataattaaaaaaccctttaaaacaaagtacccttttcaccccaaaaaaaaaagggcccccccaaaacaaaaaacccccaacattctttgggggaaaaaaaaaaaaattcccccgtaaaaaaaaaaaatttttaccaccaacctggaccctaaaatatccaaaa

SEQ ID NO: 27701 - DNA, 536 bp, Zea mays
  Clone ID: cC-zmle189066f09d1
aagttttgggccgacccacgcgttcgcatgaacctcgccgtcgcagccgcactgccgttctttacgcttcgtaccggcgtcgtgctcccacggagcaggggccgacactgcccccgctgggtcgttccacgcgcggcctcgagctccgtttcctcctttacctccccctcagcagcggcggcgcccatctacacgcccacgccgtaagaccggtctctccggacgccgcatagcgggtaccactttgatggcacggctcgacctttctttgaaggatggtacttcaaggtgtcgattccagagtgcaggcagagtttctgctttatgtactctgttgagaaccctctcttccgtgatggtatgagtgatttggacaagttgttatatcgcccacgctttactggtgtgggagcacaaatccttggtgcggacgataagtacatatgccaggtctttgagaaatcaaacaatttttggggaagtaggcatgaactaatgctgggaaacactttcatttcaataaagagtcaacccca

SEQ ID NO: 27702 - DNA, 483 bp, Zea mays
  Clone ID: cC-zmle189066f10a1
ttgtttatgaacttctatttctgggaggacacagacatcacaaaaaaacttcattattgaattataactaataagcaatctagaagagggcaccaccaatgatgtgttgttggtaggaggctgatgggtttgtcaaagcaagttggacaaagtgcagcaactgttgcagttgtaagagggttgcggggttagccacaaactgctggtacaaaggcagcaactgttgcggtgtcaagaaggaagcagggcttgttgtagctagctagccaaatggtagtagtatttgttgctgcaaataagtagcagggttcagtgcggccaattggttaaatggaataaattggtgttgctgagagtatgcggtagctagctagttgaatggtagtagtttgttgttgctgcaaataagcagcagggtttcaatgtaaacaattggttgaatggaagaaactgttggtgcttagagtaaggagaaagggttgc

SEQ ID NO: 27703 - DNA, 375 bp, Zea mays
  Clone ID: cC-zmle189066f11a1
gggtggggtttttttttttttttttttaatggccaaaaatcattgtttaaaatcaaaccccaaacttggaagggtcgcatcccaacgtactaaactgactgcccaatggggggggggaagttttttctttttacccacacagcaaaggcttttgcatttcatcccccccagggataatgctttgttacaaattcccaattgggcctgttacaaaccaaatttttttattggccggctttccagtttgttatccggggcggccaacccccttttttttattgaattcacaagctttggagctccctgtttttaaaaggtggggggatgtcctcccaccttgggaatttagcccaaaggcgctcctttttttgttcc

SEQ ID NO: 27704 - DNA, 502 bp, Zea mays
  unsure at all n locations
  Clone ID: cC-zmle189066f12a1
cgtagctggatccttaacgccgccttttttttttttttttttnttttttttggaagaagaacgggagggctacagataacaatttgtcaaacgaacagcacatgaagcatttacaccatgctctcacatttgtgaaacagataattcatgtaaccaaacacaggcaaaactgttccctcaatcagcaggttcctgcctccacctgcggcttttatttcacactttatttatgggctgaatcgacaaagagacccctagatccatcacaaatgtcactacattgagaaccaggtcgctagccctgggaacatggagcctgccactgccattgtgggtcaaacggggtgtgaacttgcctcagttatgcgcagttgccaagttgcggatgacataagggaggaagcctccatggttgaagtacgccagctccccttagtgtcaagcgaacgatgcaggtgaaagatttccattgtcggtagaacagtcacattctggccgggac

SEQ ID NO: 27705 - DNA, 489 bp, Zea mays
  Clone ID: cC-zmle189066g01a1
ttttattttactttatctcattgaattgattgaacgcttggctaaggttccttcccctattcggtggggagaaggacgtaaatcaataatcatgttgttctgttgtgttcaaaaactttgtgaccttttttgggcccgcatggcatccgggcattgggacgagtacttaggaagaggagaatgtgtgaataatatttttgttgaacgggtccgaaaggtgtgtcaagagattgtcgatggggccggcatgagttacggatgcttgcaccatgaagccaagcatggctaccattgccaacctcccgttcttgatttctttgagcttctcgtcatgagcattctctatatcctttgcgagtcctagtggattgaacagtgggcccccggggtagcctggctgttgacctgcgagtgcagcctctaaccctatgaatgtccctttctctgcttgcgatcctggatttttgaagtccatgtacctcttgggtt

SEQ ID NO: 27706 - DNA, 543 bp, Zea mays
  Clone ID: cC-zmle189066g01d1
aaccacccgtgcggccacgcgtccgttcttcgtccagctcttcttgatttggttctctgaaaccaagaggtacatggacgggaaaggggcaggatcgcaagcagaggaagggacattcatagggttagaggctgcactcgcaggtcaacagccaggctaccccgggggcccactgttcaatccactaggactcgcaaaggatatagagaatgctcatgacgagaagctcaaagaaatcaagaacgggaggttggcaatggtagccatgcttggcttcatggtgcaagcatccgtaactcatgccggccccatcgacaatctcttgacacacctttcggacccgttcaacaaaaatattattcacacattctcctcttcctaagtactcgtcccaatgcccggatgccatggcggcacaaaaaggtcacaaagtttttgaacacaacagaacaacatgattattgatttacgtccttcttcccaccgaatatgggaaggaaggttaaggaagcgttcaatcaattcaatgagatagtgtaatct

SEQ ID NO: 27707 - DNA, 448 bp, Zea mays
  Clone ID: cC-zmle189066g02a1
tttttttttttatttttttattgaatttattttttttttgggggaggtgatcttttaccttataagcgtcgacccacccccctcaaaaaaaaaatataaaaacacgggtttataaaaaaacggacagctcgaaacaccacccgcccttcgggaaaaaaactaatattaaacacggggggaatgaatgaaaaaaattttgggggaaaaaaccccaagcccgtcaaaaaaaaataaaaaaacccccggaaacaaaaaaataaactctcactaggaagccaaacaaggcgacccacggcatcctcccttaatttatcgccccggaccagggggcagaacattctatcctataaatggagaggaaaaaggcttggacacaaaaaaccacagccacacccgggagaagacacttctcttccaaacaaaaacccaaaaaaaccccccgccatac

SEQ ID NO: 27708 - DNA, 385 bp, Zea mays
  Clone ID: cC-zmle189066g02d1
gtccgcccacgcgtccggtcaaggccaagctcatctccattgtcgtttttaagaacatcaaggcagcaggcggcgcgggcgtgctcaccgcctaagtttcagtccttgttcgcctcctggttttgaaatctatatctgaactgatagtgctttcctgtctcagcaatttgtgttaagaaaacctgtagttttaaaatatgtggttcctgcctgttgggcagtgcttatgcggttcgaaaaaataaaaataataaaacaatgatagaaataaaaaaaaaaaaaaatattaaattaataccaatcgggtcgtcttttttttgattacctgtttgcgacggtgagtaaaatatattttttttcttttttactgtggcggggtcttctt

SEQ ID NO: 27709 - DNA, 512 bp, Zea mays
  unsure at all n locations
  Clone ID: cC-zmle189066g03a1
agtggggtgcgccgccatcttctcttttggtcacgtcaacccggccgtcacctgcggcgcgctgctcgccggccggatctgcctcgtccgctccctcgtttactgggccgcgcagctgctcggcgccgtcgcccgcgcgctcgtgctcaggctcgccaccggagggatgcatctgccggagtacgcgctggcggggggcgtgagcggatggaacgcggcggtgctggaggcggccatggcgttcgggctcatgtacgcctactttgcgacggtgatggacaaagcgcggagggtccgcgccggcgccggagcgctggcggcgccgctcgccgtggggcttctggcgggggccaacgtgctggcctgcggcgcgctggagggcgccgtgatgaatacggcgcgcgcgttcgggcccgccgtcgtgggctcccgtcgctggagacaccaatgggtgtactgggtggngcccatggtcggcgccggcctctccggcgtcgtctactaacacctcg

SEQ ID NO: 27710 - DNA, 289 bp, Zea mays
  unsure at all n locations
  Clone ID: cC-zmle189066g04a1
cgtaagctggatccttaagcggcgccttntttatttttttttttttataaatattttttggggggggcagtgttcaaaaggtttattaaagagatgataaaccggtgttttgtttatacagggggttatatggagagagacaaagagcaggtgaatttgtaggaacaacccccacggagaacgaacgcaagcctatttccttataacagggaacgggggcatacataggtttcatgggggagcactgagcaccgttggttccggaacattctcatgcccggacgcgggg

SEQ ID NO: 27711 - DNA, 320 bp, Zea mays
  Clone ID: cC-zmle189066g06a1
tttttatattttcttctctcccatccccttttgggcggggtcttttttttttcactttattctcccccccccccccttctcacttactatcctcattccctatcacccaacaaacactaaaacaacacactaccccccccctcacatataacacacaaaaaacaaaaaaaaaataacatccacatcctccaccatcaaacaaaaaacaaaaataaaaacaaacaaacctacccaccacaccctcacaacccacctacaaaaaaccaacacacccaccccccccccccacaaaacaaacatcaataaaacatccccccacc

SEQ ID NO: 27712 - DNA, 382 bp, Zea mays
  Clone ID: cC-zmle189066g06d1
gggccgacccccgcgtccgcgcaaattgcaccaagaaatccatcgagaggccgttgactgtggaattaatggcgtcgtcgtctagcagcaggcaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctgga

SEQ ID NO: 27713 - DNA, 474 bp, Zea mays
  Clone ID: cC-zmle189066g07a1
ttttatttcaaggaatggtagaacaagctccggttgggcatttttacaagtacaatattgcagggtacatttgcttcacttgccacattttacattagctggaggatcattccacatttttacaaggaatggtagaacaagctagttatctggaggatcattagctgcacactccaattgcacgcggctacattttacataagcctgaacctgcatactagtcacagaggcggctccgacatgagtgtgaactgaagaaaagataagtggaggcaagttttgctccacaaatgcgagaggaccgctcatatatctggaatctggatggccttacttaaatttacactaaatggcactgctagcaatttcacttcgacatgtctggccaaagtagatgttgcaaaatcagtcaccaagcgaccgcagcctctgatacatcacaccaggccggagatcattaaggctataaacgtt

SEQ ID NO: 27714 - DNA, 524 bp, Zea mays
  unsure at all n locations
  Clone ID: cC-zmle189066g07d1
cgtgcgcctgtctcggcgtggctggacattnctcagggtttttggattctatagaaacgntgatagcctgggggatggggggcctggtgtgatgtatcaagggctgccgtcgcttggtgactgattttgcaacatctactttggccagacatgtcgaagtggaattgctagcagtgccatttagtgtaaatttaagtaaggccatccagattccagatatatgagcggtcctctcgcatttgtggagcaaaacttgcctccacttatcttttcttcagttcacactcatgtcggagccgcctctgtgactagtatgcacgttcaggcttatgtaaaatgtagccgcgtgcaattggagtgtgcagctaatgatcctccagataactagctcgttctaccattccttgtaaaaatgtggaatgatcctccagcttatgtaaaatgtggcaagtgaagcaaatgtaccctgcaatattgtacttgtaaaaatgtgccattggagcttgtttaccattccttgcagt

SEQ ID NO: 27715 - DNA, 473 bp, Zea mays
  Clone ID: cC-zmle189066g08a1
tttattttggaatttcagttctcatagcatgatcgggaatctcagaacataacaggtgaaacacgaatcaagcagaggcgccatggggttcacagatccacacctaaaccgctaaattaaactgcgagcgatacatgataaactaagaccaccactcagatcaccaccatcttattcagatccaaaggaacggacgcagggggagtcgacgatgacggagggagggcggccgaacagaccagatcagagagatctaggagagctgtccgcagtcagcgaccttgaccaccttggaggtggagccgttgcgggtgcccaccttctcgatggccttgacgacgtccatgccctcgacgacctggccgaagacgacgtgcttgccgtcgagccaaggggtcgcgacggtgcaaatgaagaactgggagccgttggtgttgggcccggcggtggccatggagagcacacccggggcg

SEQ ID NO: 27716 - DNA, 488 bp, Zea mays
  Clone ID: cC-zmle189066g08d1
gtgcgcactcgtagagagaaggaaaaatatccccaaaccttatctctttatctcgatggcgaaccctcgcggcttctgggacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcgaccccttggctcgacggcaagcacgtcgtcttcggccaagtcgtcgagggcatggacg

SEQ ID NO: 27717 - DNA, 446 bp, Zea mays
  unsure at all n locations
  Clone ID: cC-zmle189066g09a1
gggagccactagagcggccgcccaaccacacacnaacattttaattttccaccccacccaccgacacgcgggggggggtgaccaaaaccgatgaatnccacaggaccaatgcaatcacgtaacaccacccgcccaccagctagagactaccacgatggaacacacaactaaagttactgtaaccagtatacaataccacccatatatatcgtacgacataataaaaggtaactcagcatcatcaagtacatggaaaaaaaatactttagtcttcacgatatactgtaataataaaaggtagccctgccttaatagcatcagtcttagcagtagaacatgacccgcttcacgttttccttgaggccaggtaatgtccttacagtaacatttccaacaccggcagccttgggtgtgcgcccccctggtggagggccacggcttgccat

SEQ ID NO: 27718 - DNA, 195 bp, Zea mays
  Clone ID: cC-zmle189066g10a1
gggtgggggttctaaaccaaactaaacttaacccaaccaattctttttttttctgcccggaaagaaagtaaaggtcacaagccaaaccaaaacattaaacattaaaaaaaaaacaaaaccctaccctgcccggccacgccacaaaaaaaaaaaaaaaacataatttaccaaaccaaacggggggggggggggggg

SEQ ID NO: 27719 - DNA, 437 bp, Zea mays
  Clone ID: cC-zmle189066g11a1
tttatttcaaggacccattttattccggaaacaggggcccaggctttctccgggtcctctgatagaagcaaacataggttcacagttcagacttgacttacaaacagtcgcacaaaacatacagcactctgttctaactcgggacacgaaatcctctctttctctctccctctccctctccgctcactgcctcaatctaggaagactgccggagctccgggcgcacaaagtcggcgttggcaggcacagagatgtcgacggtgggcctcagctcggcgcagacctcaatggcaccatggacagggtccgacaagaagttgctgatgaggtcctggttgatcggggcgtccttgtccaccgtcacaaaggcctgctgcgtcaggatgtagtcgaagcgaggcgcccactttctggatcccaggcgagccgttgtggag

SEQ ID NO: 27720 - DNA, 427 bp, Zea mays
  Clone ID: cC-zmle189066h01a1
acttagaaatagtcgacccctggggaaaggtactgggttaaatatgacaaaacgctctgacagtcaatcatgtagagaaaaggcaactaccaagcaattacagaagttacacagggcaactacataacctcataacagacaatcatagctaagctgcggcagctacttcaagctatatttacattttacaacaccggaacagtcctgttagcgcatacagtgagaggatggccctgactagtcctcattgtcgtagtcctcatcttcatcaacctgcactgtcagatgtccaaaaccagatggcccaacaccgatgtttccagtggcatctggcataggccaatctgactgatgatcggtgcttgcttcttccaccttagaatttgtagcttgcgcaagggctgttagcggaggttgcgtgctttga

SEQ ID NO: 27721 - DNA, 486 bp, Zea mays
  Clone ID: cC-zmle189066h01d1
gaatttttgggccgacccacgcgtgcggcagaaaaaaacagagagtagtagactacgacagtttccgtttaaccggagggtcggaggcggaggggaaggggaggaataagctcggcacccggttccccgcggctcgaatcaaaaagataatgcaagcagatgaggatgttggaaagattgcattagcggtgcctgttttagtctcgagggctcttgaattgtttttacaagatttaattgaccggacttatgaaattactcttcaaagtggagcaaagacactgaattccttccacctgaagcaatgtgtgaagaggtacagttcttttgatttcctaactgaagttgtcagcaaggtaccacatcttggtggtgctgattcatgtggagatgaaagagtgttacctagaagaagaaagtcaaatggccgtgacccagagaatgatgaatcaagatctaagtaaatggccataagaaatgcaaata

SEQ ID NO: 27722 - DNA, 450 bp, Zea mays
  Clone ID: cC-zmle189066h02a1
aggttgcctccacgggtttggcggtaaaaagactatgtaataattaattaatggtacatgctttgcataagcctataacctatatacccccccaagcatggtagaccggcccggatacactgtactgttgttttgcaagctacatgaggtgtatacacaaaacacatgcatgaaacgtacgacgagtagcattctctaactatacacggggtgtgttgcattcttagacggagggcatgcttaatgccagtcggtacttttttttttccagtgcacaaatgaatttgcacaaggcctgaggctgagatgcttctaacctgggcaaaacgagcctgattttcctagtggtaaaagctatcatcttttgcgagcaaaatggtacaacttcatgtagtctatggcaggtctgttccatgaccaatcttgctacattaccctcttgcaaaggga

SEQ ID NO: 27723 - DNA, 464 bp, Zea mays
  Clone ID: cC-zmle189066h02d1
gccgacccacgcgtgcagaaatcctcacatacaaagtgactttacaaactttttcagttttctgcatggggaataccatgggggagtggggctatgtctaacctatgacgagccactgtcacatttgatatatgctggcgcagacttcattctcgtaccttacatctttgaaccttgtggtctaacacaacttattgctatgcgctatggatccatcccagttgttctgaaaactggaggcctgtacgacaccgtttttgatgtccacaatgataaagatcgggctcaagcacaaagtctcaagccaaacggattcaattattaatgagctgatagcaggggtgtggattatgctctcgacagagccatacccacattttatgatacacacgactggttcaatttcctttacaagaaggtaatggagcaagattggtcatggaacagacctgccctatactaca

SEQ ID NO: 27724 - DNA, 524 bp, Zea mays
  unsure at all n locations
  Clone ID: cC-zmle189066h03a1
ctgtatactnnagagcccttctttttttttttcaacaacctttaaattttctgncaaaaaacngggaagccacaagggtcaggcaaaaaacttcattattgaactataactcataagcaatctaaaagagggcaccaccaatgatgggttgttggtaaaaacgctgttgggtttgtcaaagcaagttggttgaatggcagcaattgttgcagttgtaagagggtgccagcgttaggcgcagcgtgcaggtagaacggcaacaactgttgctgtgtcaagaaggcaatagggctcacattagctatctgggtcaaaggaggctgctttttctgatggagacactcggcaacaacttgtgggtactcggcgacttgaaccttttgttgctcagtctttctgcgcttgagcgaacggaagtgacggcggcgttgaagacgttcggnggtgacgagacgttggatcttgggagccttggtgtagggcttggctccctccttcttggngacgacctcacgacggatgac

SEQ ID NO: 27725 - DNA, 445 bp, Zea mays
  Clone ID: cC-zmle189066h03d1
ggccgaaccacgcgttcgaaagaccattgagatcgatgacgagcgcaagacttttatcttttacgagaagcgcatggcccaaggggttggggccgactctctcggagacgagttcaagggctacgtcttgaggatcactggtggtaacgacaagcaaggtttccctcttaagcaaggtgtccttgttccccaccgtgtcaagctcctcctttccaagggtcactcttgctaccgccccctccgtaccggtgagcgcaagcgcaagtcggtccgtggttgcatcgtctgtcccgacgttcgcgccctccacctcgtcgttgtcaagcaaggtgagaacgacatccccggtttgaccgatgaggtccttcccaagcgtctcggtcccaagcgtgctaccaagattccgtccttctttaacctcgacaagtctgatgaccttcgcaag

SEQ ID NO: 27726 - DNA, 434 bp, Zea mays
  Clone ID: cC-zmle189066h04d1
ggccgaaccacgcgtgcggggacgcgtgggcaccgctctggtcgccggcaggttgacttttcaaggagccgcaggccaccggctccgggggcttctgcgcggccttcatcatgctccacccgaccaagtacgccgccatgctcgccgagaagatgcagaagtacggcgccaccgggtggctcgtcaacaccggctggtcgggtggcaggtacggcgtgggcaagaggatcaggcttccctacaccagaaagatcatcgacgccatccactccggcgagctcctcaccgccaactaccagaagaccgaggtgtttggcctggagatccccactgagatcaacggcgtgccgtcggaaatcctcgacccgatcaacacctggacggacaaggccgcgtacaaagagaatcttctgaggctcggcgggctctttaag

SEQ ID NO: 27727 - DNA, 542 bp, Zea mays
  Clone ID: cC-zmle189066h05a1
ttttatttcaattcgaggttttattgcgattttgtgggaactgatgagagttcaagtactggaactaagctttttacacgtaggaactgtgcattcttaacttacacatctgagtgtcttccctgacatcaagtggcaaaaagttgaccttagaagttagaaaggctgatgcaaatgttattcggaccaatgataacaccattttagtttcaccgtactgtaaattccagcacaaggatagtgactcgtggtagtattcgtgcccaactcgttacatccttagctactgtacaaacatttgcctgtgcaacgtttctagtaacctttgccaagccaaaactattcagctcttcaccaaatctctgcttaaaatttatgcaacctgcaaaatttcctgacgcttgatctcaaataccttctgaagagcatcctcaaaaccttatctggaggtgaggcacctgaagtaacaccaatggtaataggcccctcgggtaaccagttatttttttcaaccagttcaccatgatttaccttgtagctga

SEQ ID NO: 27728 - DNA, 437 bp, Zea mays
  Clone ID: cC-zmle189066h05d1
acgcgtgggctagtgctgaaaatgtccactgctctctttctctttagcataacctccacacgggggctggggctaatttgcaatactctgattcagaggcttatgtgcttagctgagttgaattcggatgattggtcatgcagaggttggatgagatgggtgtagaaatcattcctgttgacgcgggtatcaaagatttcaatgtcgtcgagcaaggtgaccttgtcgtgttgcctgcatttggagctgctgtggaggagatgtacacgctaaatgagaagaaggtgcagattgttgatacgacatgcccttgggtttcaaaggtctggaatatggtcgaaaaacacaagaagagtgaatatacttcaattattcatggaaagtattcccatgaagaaactggtgccactgcttcttttgcaaggaagtacatcatt

SEQ ID NO: 27729 - DNA, 452 bp, Zea mays
  Clone ID: cC-zmle189066h06a1
cacatcgaacatatgtggggtgtccaagtcacaaattaaaccagacatatatgcgaacacttattactcttagttcgtcaaacaaaacaagttggcagcacggatatcgaggttgagattacaggctttagcaggtaagcaagcaagctgatggtcgatccatgcacatgtatcagaacttggagatgaagtcgtagatgtgctggctgacctcgtcggccttctcctgctggacgaagtggccggcgccggggatgacgacgacgctctcgagccccgggacgtcggcctcgaacccgcccttgtggatgtagtcctggatgcccgggtagtgagtgtgaagggtctccgtctccgacgatgaacctggtgggcacccgcaccttggggttcggccacgccggcgccagcttccagttgcgggtcatgttgcggaagtagttgatgggccc

SEQ ID NO: 27730 - DNA, 439 bp, Zea mays
  Clone ID: cC-zmle189066h06d1
gtgcgagcggatcctgtgcaaccgcttcacctcctcggttttcggttttcgagaagccggcggcggcgaggggccgagggggaggatccgttgccgccgtggctgacggaagaggacgtgggccacttcgcgtcggagttcgagcggacgggcttcacggggcccatcaactactaccgcaacatggaccgcaactgggagctggcggcggcgtgggcggacgccaaggtgcgggtgcccaccaggttcatcgtcggcgacggcgacctcacctaccactacccgggcatccaggactacattcacaagggcgggttcgaggccgacgtcccggggctcgagagcgtcttcttcattcccggcgccggccactttcttcagcaagagaaggccgactaggtcagtcagcacatctacgacttcatctccaagttctgat

SEQ ID NO: 27731 - DNA, 432 bp, Zea mays
  unsure at all n locations
  Clone ID: cC-zmle189066h07a1
ggngattaacaacaagggcgggacatcaagtactatatatccatgatttattcgcacatacatgttttgcaacactcatcagtcatgcaaaagggagaaccaagagtgttttattcagtagcgagcttgaatctgaacattcacactgtcagactccacgcctgctccttcttttgagaaaccttgccgggctgaaaggttcgagatcaacgatcttggccttgccgtcaaggatgagctcggcgagggctgcgccggtggccggaccattgaggataccccagcagctgtggcccgtggccacatagcaccccttcacgcctggtatcttcccgatgaccggcagcccgtcggcggtgcacggcaggtagcacgcctgtttcgcgaccaccttagcgcccttcctctttttaactggctggacactttcct

SEQ ID NO: 27732 - DNA, 481 bp, Zea mays
  Clone ID: cC-zmle189066h07d1
ggactagaacccgccagatgacccagcaacgataatttgcgatttcagactcgattgcaatgctgcaggggagatgggatggtaagtgtccagccagctgaataatgaggagggcgctgaggtggtcgcggagcaagcgtgctacctgccgtgcaccgccgacgggctgccggtcatcggggagataccaggcgtgaaggggtgctatgtggccacgggccacagctgctggggtatcctcaatggtccggccaccggcgcagccctcgccgagctcatccttgacggctaggccaacatcgttgatcttgaaccttttagtccggcaaggtttctcaagagaaggaacaggcgtggagtctgacagcgtgaatgttcagattcaaactcgctactgaataaaacactcttggttctcccttttgcatgactgatgagtgttgcaaaacatgtatgtgcgaataaatcatggatatatagt

SEQ ID NO: 27733 - DNA, 358 bp, Zea mays
  Clone ID: cC-zmle189066h08a1
atcattgggggggggtttttttaaaaatattcaaaattcctacccctccaacccaaagccaaaaattcttacccaacccgaaaaaaacaaaccggtacctaaaaggaaaaaaaataaccccaaaggaaaaaaaaaaaaagcccggaaaaacaaaagaaaaaaactccccctcaaaaaaaaataaaaaccctcgaacattaaaaaaaaaaaacaaacccaaagattacaatgaaaaccccccccccacaaaaaaggggaaaaactataaagaaaattgaggaaaacaaaaagccctacttccagaaaaaaaaaacaatacgccaaaacccaaaaaaaaaggaaccacaccccacagaaa

SEQ ID NO: 27734 - DNA, 490 bp, Zea mays
  Clone ID: cC-zmle189066h09d1
cgggcgctgcgcacagacacaccaagcgtcggcaccaatggctttctacctttaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcttggtgcgcgagaccagggtcgaagaggacatcaacacctgcaccggcgaggtccactagcgcatggagagcttcctcgccagggctaactgagccgcccggtgggcggcatccacgccccgttcgtgcttgcctgcgtgccttatgtatgtctgtggttgactgcctgtgcaggggtcatcgacttggctatcgtacgtgcacccacttcagttctgtaccaattacgacaataagctcgtgacctgaataaaacttctttcg

SEQ ID NO: 27735 - DNA, 448 bp, Zea mays
  unsure at all n locations
  Clone ID: cC-zmle189066h10a1
ctcgccgcctcgttcgttttctcgggcgaggacgccgacgcgtgggcggggagcgccatctcgcggaggcgggcggcgaggtcggcgtgggcgggcggcggcggtagcggctcggcggcggtggctgccgtcctgagcccggcgagcaggcgcttccgcggcggcaggtgggtgttcagatccggcggcggctccatttctccaccagatcgcggggctcagatcatctcgcggagctgatgggggcgccgcgagatcgggcgcgagcagcgacgggatcagctaaattcgtgcgcccatcctggaccggcgggcgggcgaggcgaggccctagcacgggcacgcggataaaaacgggtcctttagcatccggaacatggaaacatgactctgaatttcgcgcggagcccgagacngagcaagagtgagggggaaagcggactccttg

SEQ ID NO: 27736 - DNA, 425 bp, Zea mays
  Clone ID: cC-zmle189067a02d1
ttttccgtgggtttactttgccggaagctccaacttttaggtttttttttttaggacaattcattggacaggcacgggcagcaggatccaagactgttgattgtctaaaaatggtgcatagtttgcatgcaatttttcttgttgctggagacaataacataccgataatatatcaagttcatcgggcacgtgatggatccagctttgccacaagaaaagtggaggcaaagcagaagggcctagttgtattcaccttgattgcttctttccagaaggaagaagtgggttttgagcattaggctgcaatcatgcctgatgttcctccgccagaacagctccttaatctggaggagatacttgaaagacggcttactgatccacgcttttcatcccaaataggaacttggcagctaaaaaaaaattta

SEQ ID NO: 27737 - DNA, 490 bp, Zea mays
  Clone ID: cC-zmle189067a03d1
ccacccgtccgatgcttgtctatcttcctgctccaactataggctttttgtcgtttctggcaagaaacgctggagctatggggagacggggtctataactgccctgataatactctccaaattgctatggctggaaggtcattctcacttctgcagaggattggagctttttgtgaggaatggtataaagcttttggcagtgggaactaactgcttctttgattggcactagtgtcacgaatgcagcgctcaaagcaaagagggctgatgataaggaccttgaggaccaagtcatggaaattccagtcgtctcaactagtgttgcctatggtgtatacatgtccatttctagtaacctcaggtatcaacttctggctggcgggatcgagcagaggatgctggaaccgttgctgcataacccaaagctcctgctgagtgcaatgtgccttatcgttcgtacgggcaacacaattccttggctctcttgctg

SEQ ID NO: 27738 - DNA, 409 bp, Zea mays
  unsure at all n locations
  Clone ID: cC-zmle189067a05d1
ggacaaaacacataactnngatgctacgcangactttctgttttaaaaccgggagancgcacgagggcccggggtgggcgtagacgcccgagaggcacccctcttgctgctagctctggctgtcagggccatgaacaaacctgctgagtatgacagtgatgacgaaattatagcaattggccgaagccctaccatccggcagccactgatccatacccaaaatgttcctgccactggtgtccctgtcccaacacttgatcaacgtgcaagtagaaatgatgcctggagccaaaggatgcgagagaagtatggtctggacacgagccactttacatacaacccttcagacccaagcaggtaccagcataatggcacgccaccggctgaagaaaggagtcgatgcactata

SEQ ID NO: 27739 - DNA, 71 bp, Zea mays
  Clone ID: cC-zmle189067a07a1
cctctagagggcccgcctacatcgcggtgctggacacagtgtttggaatttaccgcgcacggaaagcaacg

SEQ ID NO: 27740 - DNA, 331 bp, Zea mays
  Clone ID: cC-zmle189067a08a1
ttttatccattctcttttttttttcttacccacacacacattttgggggaatagggtttttttttttttttttttttcccccaaaaacaaatgaaaaaaaaaccaaaaaataatattataaatttcaaaaaaaaaaatccgggaagggggccccccttttggaccacccctatatattaaaaaaaaaaaggccccccccaacatgggtgttttcccccaaaaaaaaagggtataaaaaaaaaaaccgtttattataaaaaattatttttttcataaaaaaaaaaacacccacagggttcccccccccctatgtaaaaaaaaaaaccccccc

SEQ ID NO: 27741 - DNA, 381 bp, Zea mays
  unsure at all n locations
  Clone ID: cC-zmle189067a08d1
gggtgagagcgcaacaaaggcgaccaccatcccacaaagctcacttgctccaagttccattattacacaggtcctcccaccacgtacttcaatgggctacgaacacccagctgtgcaagcctataggctacaacaagcaattgcggcgagcgtcttacaacaaccaattgcccaggtgcaacaacaatccttggcacatctaacaatacaaaccatcgcaacgcaacagcaacaacaattcctaccagcactganccacctagccatggagaaccctgccggctacttgcaacagcagttgcttgcatcacacccacttgctctggcaaacgtagatgcaaaccagccacaacaacagctgcaacagcttctgccagcgct

SEQ ID NO: 27742 - DNA, 383 bp, Zea mays
  unsure at all n locations
  Clone ID: cC-zmle189067a09a1
ctctagagcggccgntcaagacggactggtcgcgggcttttttcgttttgcagtaccgcaacttcacggccgggccgccggccacggtggcggccggccagtaccggcagcagatggacgcggaggcgcagcaggccatgaagtgggcgcgggacaactacatggtctacgattactgcgccgacaccaagcgcttctcgcagggcgcgccgcctgagtgctccatggcgtagtcggcgtatagaggtgctgggctgaaccacggtgcacttcgattgcgatgtcgatcagtgcacactatatacgacgcacgggtcaattcattatttataccgatcgatcgattctttggtgtgaaagaatactctagtactataatttaa

SEQ ID NO: 27743 - DNA, 285 bp, Zea mays
  Clone ID: cC-zmle189067a10a1
tctttctcctttttttttttttttccccccccccccccctttgggggggggagggggcccattcaattctcttcacatctctctcaacaaaatgatctgttcaaaaaaccaacaaaaaatttatggtttttgaaattaaaggctactttcccctgaagttacctactttgaatctatgtccaccttacctgaaggaaatatttaagctgacattcaccacccaatccttttcgaaatataaaaacccctgaattgcccactaaaagagatggggcttcaaacata

SEQ ID NO: 27744 - DNA, 401 bp, Zea mays
  Clone ID: cC-zmle189067a12a1
ttttgctttttttttcaattcttccaatcgaacacaaacactccggggggagggggagaatgtgcttccccttttcctcttggttcacataacgaaagtcaaaacgaacacctgattacagactgtaatcccaatctctctctctttttttttgcatttattacactctcgatcatgagtccaagcaaatcataaactgtacagtactattcagcacccaaaaaaaaaaagaatgtgcagaaacgatggaggaaaaaaaaagaggatacccatctaaatcgcgtcaccgcgcgctctgaaaggaaaggatctctaccttgcaaattctatttcgctacccaatctacgccgacccctgggtcaacccgggatttccgaccggacctgaggcgtcccacttt

SEQ ID NO: 27745 - DNA, 155 bp, Zea mays
  Clone ID: cC-zmle189067a12d1
caaaaaaaaagagagagagaaggggaaaaacagacagcaaaaaggaggtccgcctgactaaacgaatgggaaccaagaggaaaaggggaagcacaaaatgatgctcaaatgggagcgaacgcatacaaaaggtcaggttgaaaaaaaaaaccaaa

SEQ ID NO: 27746 - DNA, 232 bp, Zea mays
  Clone ID: cC-zmle189067b01d1
aaaaaacccaagaaaaaaaaaaaaaaaaaacaaaaaaaagaaaaaattttaaattttaaaacaaaaaaaaaaaaacaaaagggagaaaggggggaaaaaaaaataaacaaaaataaacaaaaaccccaaacacaaaataaacaacaaacaaccaaaacaaaaaaaaaaaaaaaaaaaaacaaaaaaaaccaaaacaaaaaaaacacaaaaccaacaataacaacaacacaac

SEQ ID NO: 27747 - DNA, 240 bp, Zea mays
  Clone ID: cC-zmle189067b02d1
gctccggacacactcgtccacagctaacgcgattttgcgctttacacccggagacccacgatccctgggcgatggggactcctgctgattaaggcggtcacccagacgacgaccactacagataatgatacgcatccgcagacgaccccatgggctgagcgtatacactccgtgaaggacacaaacctgaccaactacacctaagcctgcacggtcccacacgtgcactggacagacctc

SEQ ID NO: 27748 - DNA, 462 bp, Zea mays
  Clone ID: cC-zmle189067b03d1
acgcgtgcgggtaactggaacattatatttttggagacaatatgttttgattttatcataattgaaagaaacatacgggggaagagggaacaaagtccatactatgctgaacagctacattatgaagctggactggaggacttcaaggaacgtttgattaattatgaaaaggtctacgagccagtaggggaaggttcttacatcaaaatgattgacatggtaaaggggcaagatggtcatttacaggtaaataatatcagcggttatctccctgggaggattgacttcttcttggtgaactctaatcttacaccacgacctatcttgcttaccaggcattggtgagagtttacataatgttatatgaagagtcggtggtgatacagttctaagtgaaactggcgaactttatgcaaagaaactagccaactttatagaaaagcggcttaaatgtgagaaaac

SEQ ID NO: 27749 - DNA, 516 bp, Zea mays
  Clone ID: cC-zmle189067b04d1
cgcgtgcgcccacgcgtccgcagtggaggagattgtggagttattttttatgtgcggaataataaaggaggagggagagggtaaaaagccacgagtgaagatttatactgatagagaaaccggcaggaagaagggtgatgccttggtgacatatttcaaggagccttctgtagctttagcggttcaattgttggatgggacaccattccgtcctggtggtaagactcatatgtctgtaagtccagcccaatttgagcagaaaggtgatgtcttccgtttaaagaaaactgacaagcaaatgaagaggaagataaagaaggttgaggacaaaatgcttggatggggtgggcatgacgataagaacctcatgattcctgctaccgtaattttaaggcacatgttcacttctgctgagctgagagctgatgaaaagcttctttctgagcttgaggctgatgttagagaggaatgcatcaagtttggtcccgtggataatgttaaggtttgtgaaaatta

SEQ ID NO: 27750 - DNA, 547 bp, Zea mays
  unsure at all n locations
  Clone ID: cC-zmle189067b06d1
gcccacttgtgctcacccagatcatctgccttggtgtatttggctttttatatttgccggnagctgcaggcttcacggggcggggtatcatccttactcttttgtttaaccagtactgcagaaaccggcttcttccattattcaagacttttccagcacaggatttaatcgacatggacagggaagatgaacgatcaggaagaatggatgaaattcaccacggacttcattctgcttattgccagttcgctgacactgtagatgtgcccttggataaaattgaaatcgttggtggggatgaggagcaaggctctagctcgggtcagtccagtgttaaagaaacgtgcgaggatcccaagaagcacctggctcaccctacactaaaaggactccctgttaaccgcctccggcatgccgtgaggtcggttactttcctgatcagattgcagaaaagaggtttatcagaacagaaaatcggataattagttagccgccaaccccctttgctttgtggctatataaatgtacagaggcatacatgcatata

SEQ ID NO: 27751 - DNA, 81 bp, Zea mays
  Clone ID: cC-zmle189067b07a1
taccacttattctcttttttttttggacccaaggccccacaccggggcggacggggggacttacacattgtaaaaccccca

SEQ ID NO: 27752 - DNA, 291 bp, Zea mays
  Clone ID: cC-zmle189067b08a1
aaactaaacataagcaaggatagcggatatgggtgtccttcaaagttcgaacctcccttttagtcatgcatcagcacatagcacaagcagactaaaaaaacagtgaatcaccggccaaatccagtagcattgagaccaagcagcatctttccgttttccccagaaggaatgtatgccacattcggtgagcgagccagctctgcggcaatctccttggccgcctcgatcctcctgagctcgatcagccctgttccagccatcgccgtggcctcagagatgaagcgcgcggac

SEQ ID NO: 27753 - DNA, 599 bp, Zea mays
  unsure at all n locations
  Clone ID: cC-zmle189067b08d1
acgcgtgcgcggacgcctgggcaaggccgncgncgcccattttttttttgtccagctcctcaccgaccgcccggggcggggggacctcaaccgcgacgctctcatccgccgcgcccgcgagttcaacatcatcctcgacgacgtcgccatcacccacctctcctatggtatcgagttctcgctggccgctgagaagaagcaggtcgcgcagcatgaggccgagcgctccaagttcctcgtcgccaaggcggagcaggagaggcgggcggccatcgtgcgcgctgagggagagagcgagtccgcgcgcctcatctctgaggccacggccatggctgggacagggctgatcgagctcaggaggatctaagcggccaaagagattgccgcagagctggctcgctcaccgaatgtggcatacattccttctggggaaaacggaaagatgctgcttggtctcaatgctactggatttggcccgtgattcactggtcttttagtctgcctgtgctatgtgctgatgcctgactaaaacggacgttcgaactttgaaggacggtgatatctgctatccttgctattgttaagctttcctggcctgg

SEQ ID NO: 27754 - DNA, 339 bp, Zea mays
  unsure at all n locations
  Clone ID: cC-zmle189067b09a1
tttttgcacgttttacatttttgatncaaggnncattggttcacgggggactgggctcattatagattttggaaatacccaatacatagtagacgttcagatatcctagagtacacacgagggtgctaacaaaaataatctgaaacatatatggttcagcataacagcgacaagatagtcatacagagccctgagatacctcactcgctaacagaaagagacccctgcctatgaggagacctgctaacaatggggcttgcactccttgatctgttgacagctggggaacgcgacaaacatctttcccgaagtcgaggagccggggaccttgaatagtgc

SEQ ID NO: 27755 - DNA, 506 bp, Zea mays
  unsure at all n locations
  Clone ID: cC-zmle189067b09d1
ggtggcgacagagccctcgcccgattatgctccgccgagtattcacatgttttgagaagctactaatcaccacnccggggggcggggggaggctacaggagaagaactcgcagtccacgtcctcgtggtcggtatggaggccgtgatactgatagggacctcccaactagtcttttggtgaggaatcttcgttgggattgtaggcctgatgaccttcgtagaccatttggaaaatttggccccgttaaagacatatatctgccaaaggattactacactcgggaacctagaggatttgggttcatccaattcttcgatcctgaggatgcttctgaatgcaaagtactatatggatgggaagatgctgcttggaagggaaattgctgttgtctttgcagaagaaaacaggaagaagccttctgacatgagggccagggaaaaaataagtggctgaggccgttcttatgatgggaggttgcgcctcaggtcacctgggttgaacggtt

SEQ ID NO: 27756 - DNA, 298 bp, Zea mays
  Clone ID: cC-zmle189067b10a1
ttttaacaatttttcatttgtacaatactatgacaaaaacggcgcccggttagccaccaacgtccgcgcggcgggtaatggtggcgatacaagaccgacctctctccatggtcatccttcttcgtatccaaataaaactccatatccaaagaaatacagcttcactaattacactcctccgttaacaatacatcaatctgatacatcaaccaactcatgccaaccatattgcaatgagtatgaccttagtccatctccccttaacggggttgctgtcgctctaagacggacgcgtggg

SEQ ID NO: 27757 - DNA, 318 bp, Zea mays
  Clone ID: cC-zmle189067b11a1
ttttagccaatgtttggctttgattgcaacaatggatacatcacggggagcagagaactgctggaaagcaaaggaaccatggccggggaaaagaagaaaaaaaaaggaaaaaaggaaagaagaaaccaagcaagcaaagggtacacggtgacccgaagcaaaaccgaacgacagagacgacgcatggcactagctactagctcacgcaggagctagctagctagctagccggcggggggcggccggcgggcgcggtctattcgctgcccgggggcttgtaggcgatgaagctgacgcactgcgtctgcttgatgttgt

SEQ ID NO: 27758 - DNA, 586 bp, Zea mays
  Clone ID: cC-zmle189067b11d1
caagcaagcaagcagcgagtacatacatactaggcagcctttcatttttggcgcccaccgcgatgatggcggggtgggggaccgccgtcgctccgttccaggggctcacgtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgtgagaactccaccttcccgtgctactacgacggccgctactggaccatgtggaagctgcccatgttcggctgcaacgacgccacccaggtgtacaaggagctgcaggaggccatcaaatcctacccggacgccttccaccgcgtcatcggctttgaccacatcaagccgacgcagtgcgttagcttcatcggctacaagcccccgggcagcgactagaccgggcacgctcgacgtcccccgcc

SEQ ID NO: 27759 - DNA, 277 bp, Zea mays
  Clone ID: cC-zmle189067b12a1
taatactggttttaatttttacggcgaccaagcgaaaagaaggggagaacggggactatttcaaaaggtcacttgcaccatatcaaattcagaagtgtgcataacacatggtaatggaacgattgagagccataactacaaaactctggtttcacatagaactaggacacaacacatgaactaggatgcctaatgcatcacttaaatgatgccgactttgttggcacatcaagagcatcatagccgggagttcaccttaccgtaagccttcttcttc

SEQ ID NO: 27760 - DNA, 405 bp, Zea mays
  Clone ID: cC-zmle189067b12d1
ggggaggcgagggcaaccccgcgcaccgcggaccaactttcatgttgtgcccccaccactccaccgccggggggggggggggcgctcgccagcagcgcctccaccacccgccggggctcccccccgcgctcgggactcctggtgcggagtaccctccgtgagctccgcacccgcatcgactccgtcaggaacacgcagaagatcacggaggccatgaagctggtggccgccgccaaggaccggcgcgcgcaggaggccgtcgtctactctcgccctttctcggaggcgctggtggaggtgctctacaacatgaaccatgagatccacacggaggacattgagctgaccctaacccgaacccgccccgccaagaaggaggccctcgtggtcctgaccggcgagcgc

SEQ ID NO: 27761 - DNA, 549 bp, Zea mays
  Clone ID: cC-zmle189067c01d1
ccacccgtccgcggacgcgtgggaaaaccttcggaaagaatccccttttctcgtttctacctcgaagccttcgaggcccgaggggctaggggctcggcctccccgccgcttccacccatggctccaggactgcagcgcttcactgacattgccgacgacggcacgccccaactcgacgccgcgtccggcgaggagctggtccgtgtggaccgcaccgtggctgtcgcccttggcccccgctcgccggagtccccggggactctgttcgtcaccaccaggagggtgatttggctcagcgaagcggagaagggcaagggctacgcggtggacttcctcgccatctcgcttcacgctgtgtcgcgcgacctcgaggcgtacccctcgccctgtatctacactcagattgaggcagccgttggtacagaagaggaggctggggaatcaaatcctgaagcaaatgaactagagctatctagagtatctgaaatgaggctcatactagcggaccccggcaactggatgcacttttgatgcctctgcattgtgctg

SEQ ID NO: 27762 - DNA, 412 bp, Zea mays
  Clone ID: cC-zmle189067c03d1
gaaagaaactactagctggtaccctaataataattctgttttttgtttttatcccaaaataaaagaggccgggggcgatgggggtcggacttttcgagtggtgtttgcgtcacacagccagccactgtggggctagcgttccaacatttgttagcctgcttgcgcgaggaaggggggtcactgactcaagagaagggcctggtcataggctgctgctttatgactttctgatgatgtcttatgtctgtactctgaatcaactatgtatgagagctcatctcctttctcctactgaatgaatgaatcattattggcttaaatcctccagagcaatagccgcaattccatttgtctcttcgagcagaaggacctccggattgagggtcacattatcggattccatgaatacatg

SEQ ID NO: 27763 - DNA, 553 bp, Zea mays
  Clone ID: cC-zmle189067c04d1
gctggagaacgtggtctttgatgagcatactcgtgaagtcgtttactcttacaactctgtcaccgagaacacgggggctgggtacccgatcgagtacatccccaacgccaagataccatgcgtcggcccgcaccccaagaacgtgatcctcctggcgtgcgacgccttcggcgtgctcccgccggtgagcaagctgaacctggcgcagaccatgtaccacttcatcagcggctacaccgctctggtcgccggcacggaggacggcatcaaggagccgcaggccaccttctccgcctgcttcggcgcggccttcatcatgctccacccgaccaagtacgccgccatgctcgccgagaagatgcataagtacggcgccaccgggtggctcgtcaacaccggctggtctggtggcaggtacggcgtgggcaagaggatcaggctttcctacaccagaaagatcatcgacgccatccactccggcgagctcctcaccgtcaactaccagaagaccgaagtgtttggcctggaaatccccactgagatcaacggcgtg

SEQ ID NO: 27764 - DNA, 519 bp, Zea mays
  Clone ID: cC-zmle189067c05d1
tccttatcgatctcctcgcacctcgtggcggcaccttttcccttttatccaccaagggtttaggatcgggggcgagggcggcgaggctggcacagctgcgccctcacgcggtgcaggcggcggagttcgcctcgaagcacggcggctcctactacaaggagctcatggagaagaacaagcagtacgtcgtgcagccccccaccatcgagaaatgccaggagctctccaagcagctcttctacacccgcctcgcaagcctaccaggtcggtatgagtcattctggaaggagcttgatggtgtcaagcaggtatggaagaacaggaaggacctcaaggttgaggaccttgggattgcgactttatttggagttgagctctatgcatggttctgcgtaggcgagattgttggcagaggtttcaccttaaccggctataaggtctagttgatttccagtgatttaagacctgctttataatcgacactttagctgatgcttgtcgaaacgaccatgatacctg

SEQ ID NO: 27765 - DNA, 540 bp, Zea mays
  unsure at all n locations
  Clone ID: cC-zmle189067c06d1
tggacagcaggaagagccgtacagttcgacgcgaggagcgagttattgtttagctcgtgcgngctgtgcaagggggggggggcagcacatcgatcggtcgaggcgcctaggacaggatctagaggtagctagccatggcggaggaagcgtctgcgcctgcggcggtgacggaagcgccgccggggaagatgacgatggtggtaggggtcgacgagagcgagcacagcttctacgcgctgcagtgggcactgcagcacttcttcccgccgggccagccgcagcagtaccgcctcgtcgtcgtcaccgtcaagcccaccgccgcctccgccgtcggcctcgccggcccaggcgccgcggatgtgctgccgtacgtggaggcggatctcaagcgctccgccctgcgcgtcgtcgaaaaagccaaaggcctctgcacacaggcgagcgacgctgtgtttgaggcgctggagggggacgctaggaacgttctctgcgaggctgtccagaggcacggggcccagatgctcgtcgtcggcagccatg

SEQ ID NO: 27766 - DNA, 327 bp, Zea mays
  Clone ID: cC-zmle189067c08a1
gtgcagcaagctttctcccaagggggctaggggtttatgcttacccaggctccaccccttatcaacaggagaggatggatcttaaatgcaaaaagccatgcttaaatttacaccgatgaccaccaccatgtttaccttcagatcattaacaggagaggaggtggatctaaaacgagaggccaccggactcctctttctcgtcaaggtcaaaagtgtatatggtgtagagggaccaaatgaggcccaagacccccaggaggatccaccccaacaggttgttgctgaaccccaggctcactcccgtgccctccgtggacatgcgcttgt

SEQ ID NO: 27767 - DNA, 246 bp, Zea mays
  Clone ID: cC-zmle189067c09a1
agcctgctgagcaggtactataggcgagttggtacgtattacaaactcccatgcgtctgcctcagtcaagccctctgcgactttagttctccagagcaaccactgatggggagactggcctggtatcactgggtgcagctgcagttcttgtaataaccaagactgttgggttggtgcaaggttgtatgagctgaatgcgtcgagagggttcatcgggatattcgagattggaaagggctatacgag

SEQ ID NO: 27768 - DNA, 256 bp, Zea mays
  unsure at all n locations
  Clone ID: cC-zmle189067c09d1
ccggtaggcctgtccaatctggaanatcccgacgaaccctcttttctcttttagcacacacaaccncgcaccaggggaaggggcttggttattacaagaaccgcacctgcacccagtgataccaggccagtctccccatcagtggttgctctggaaaactaaagtcgcatagggcttgactgaggcagacgcatgggagcttgtaatacgtaataactcgcatatagtacctgctcagcagactctgaacccaacg

SEQ ID NO: 27769 - DNA, 543 bp, Zea mays
  Clone ID: cC-zmle189067c11a1
ttttgttcattttttacttgtgctaataaagagctcttgtccagggggtcatgcgcgcgggcactacacaactacccatccccgatacccatctatctatatgcacgtttgcctagtctctcagtttcagttttctccccattgtctcacagtttcagaagcaaatcgtgctcttcttctgctgagaagacgacatctggtattgatgaggactggcgtggtgtaggatcccgtggaaacatcactccacgtccttgacttcagcctccacatccacgatcgtctcagaaggcgccgccgttcctctcatgttgcggttgaagaactcattgaacactggaccatttgtagcagtagcagctctcccagatgaaaatctagcacattctctaacaaatttgttgccctgaacggagaaaggttgagtgcaataaggacagagttgtgggccatccttcaaagctgacttcagtatttggaagctttttccacagtcggacaatcgccctgcagatatcttgtcctgcaagaagaaaaatgcac

SEQ ID NO: 27770 - DNA, 509 bp, Zea mays
  Clone ID: cC-zmle189067c11d1
tctcactcctcccccactctgctgctgctcgtttttccttttctacccaggggacccgaaacgggcgcgggaggctaaaatggggcctgctgttccaccgcgagggcgttggaccgcatcgagctggcggataaaagcgggggcttggcttggagagcggcggggagaaagcggcggctgcttggcgacaccggagctgggcgaggccccttctttggcggtggcgggaggcgtatggacaagggcactacccgggtagtggggaacctcgccttcgacgccgtcgagacgtacctcgccatgaccggccaactccggtgggttattgacgccagcgggtctgtctggctcctcacaatactgctgcctgtactggctctcggtgcatctttcttctttgcaggacaagatataactgagggcgattgtccgaactgcggaaaaagctttcagatacctgaagcagctattaaggatggcccacaactctgtccctaatgcactcaacc

SEQ ID NO: 27771 - DNA, 116 bp, Zea mays
  unsure at all n locations
  Clone ID: cC-zmle189067c12a1
ggagagcgggcgacccacccccccccaacaccaaaattttaacactaggaacaacacgcacaacacaaanggggccgggggcgaaccaacacccaaaaaacaacccacccgccccc

SEQ ID NO: 27772 - DNA, 349 bp, Zea mays
  Clone ID: cC-zmle189067d02d1
ctgatagaataacacccaaagagaagccacaaaaaacatttttgagtttttgaaaaaagcaaaaaggtggcctcggcaggagggtggatctggactttctcgtgctcccttcaatctttactgagtgatttagattaacattcatatcggcaactcggtgaggagcactgttattcaccaatctgaatgcctgaagaaaatgtgggattacataaaagggaacaacctgcaggatcctactgaccggaggaaaatactctgcgatgagaagctgaaggacctatttggagtggaaacactcaccggctttactgctttgaagctgcttggcccctcattttaccaagac

SEQ ID NO: 27773 - DNA, 294 bp, Zea mays
  Clone ID: cC-zmle189067d03d1
gaccacccgtgcgtccacgcgttcgcccacgcgtccgcggacgcgtgtgtgaggatttttaactgccacctgagaaacttgcggggcaagggtgggtcggcaagatgcaaaaaagcatttggaagagcatgtgtccaatttgatgtcatcaaacatagtttagaccctttggaaccatgctcgacacggttgtattttagtctctactaatattgttgttccaaactgaaacatagcccactctatcgaagcatggcacatgcaatgagctcgatgccggatacattttggttc

SEQ ID NO: 27774 - DNA, 478 bp, Zea mays
  Clone ID: cC-zmle189067d05d1
aacgcccacgcgtccggaagaagacaagtgtcacgtgaacctgaaactatcgtgttttactggctggtatagcctgagcgggagtgagtgatcgatctagctgagctccgatcctcgctagctagctaggataccgccataccacaagtcttcttcacaagtttaggagtgacagcaacaagagatctccatggcctctgccaccgtgctcaagtcctgcttccttaccaagaagtccgaatggggcgccaccaggcatgccgccgtgcccaggccgaccaccgtctacatggtcgttcgcgcctccgcctacgccgatgagctcgtgaagaccgcgaaaacgatcgcgtggccggggcggggcatcctgtcgatggacgaatcgaacgccacttgcgggaagcggttggcgtacatctggctggataacacggaggccaaccggcaggcgtaccccacgctgttggtcacagcgccg

SEQ ID NO: 27775 - DNA, 546 bp, Zea mays
  Clone ID: cC-zmle189067d06d1
ggagataagagatgtgctgaagctgaacggaggccatggccttttggactttcagaggaggccgccgggagcggggggacggcgtgcgtgacgggcgccggcgggtacatcgcctcgtggctcgtcaagctcctcctctcccgtggctacaccgtccacggcaccgtccgcgacctcagtgacaataaaaccgctcatctgaagcggttagagaatgcttccgaaaacctcaagcttttcaaggctgatgtccttgactacgacgctatggcgggtgcagtcgcagggtgccagggagtctttcatgtcgccactcctgtgccttcagggaagatcaccgatccagagcgagagatgctgggtcctgctgttaccggcaccataaacgcactcaaggctgcgtctgctgcaaatgctcgtcgagtggtcgtcgtttcatccatgggtgccgttgagatcaacccgaaagactggcccaaagacaagatcaaagatgagaactgctggtcagattaagagtctgcaggaacgaagagaactggtatt

SEQ ID NO: 27776 - DNA, 444 bp, Zea mays
  Clone ID: cC-zmle189067d07a1
tttttccctttttttttttttttttccctaggaacctcaaataaaggggtcaggggtttaccacatatttacagcataaagcacacaccggtttttattagtacaattggaaaagagtaagaacaccctaatctgcaattctgcatagatacaaatttaatcttaccacataccacaggccataaaaggagcctcagattaccatgctccaaaaactcccacaagggacactaggatggggggcaactcgattcaatcggtctcatgatcagggcgtggggtgtaccaaataggggaccttcccatccttctaaaaaaccttgtgtatggaaactccggcattaacgcctcttctttttcagcgagctctttttgcgttttcggtatcccatcaggcacggggaacggccttggctttgcggctctactaccctgggagcttga

SEQ ID NO: 27777 - DNA, 320 bp, Zea mays
  Clone ID: cC-zmle189067d07d1
gctactttcaaccacacggggacgaggggcattaactgcgccagggcacctcaacatctggttctcttcaacaacgtggcggccagcgccgacggcggcggcggtgcacccagcgcggaactactactccatcccgaagcgggagcccttcaggtgcaggcggatcatcctgcaggagttcttcaagcaggacaagcacctgatgcagtgcacctaggaccacatcacacattattggtcggtcatggaaggcgatgagtgcatgcacctgagcgacgacttacttagaactgaatagaacggacctagagctgcccaaa

SEQ ID NO: 27778 - DNA, 466 bp, Zea mays
  Clone ID: cC-zmle189067d08a1
tttttgaaacttttagccgtcaattgtgtgttttaagaaaaatgcgggaaattggtacacaaaccaatcaaacaagcatatcaactagtaatggctgctaaaagacgaactggaaacgtaattgtgacagtgtgtgcctgttcgcccgctgctctagacaaaagactatcgtgtcccttgttacacgccttatcttatggtcagcacgtctcggtaagacaagaccgcaagagtccagcatccagtttcagcaaagaaatttcacgcccgctgggaaggcagatgttgcagagatgtatgcttgtatttggatgatcaaaagattggagatcacttggttttcttgtcctccgtactcgtctcggacccggcctccgttagctggggtgctgcagctgaatcacttccttccacagccttctgggctgccggttcgttctcgcccccgaagccaaactcgttaaca

SEQ ID NO: 27779 - DNA, 437 bp, Zea mays
  Clone ID: cC-zmle189067d09a1
atcaagtatgtggggagttattggagccaaggggctaagcgtttttagattacagcaccaaccaacacaagagcatttggtttacagaacttttacaacatacaacctggggattggttgcacagcctcatacgtacacgtaagtaacttcagcctccaggaggagcaacaccttgaaaccatcaaagcacgccgacaacacccatcagtcacattcacaacagacgcacgccgtcaagtagcagcggcagcggcagagtcggcaggcttgtcctgctggttctcgccggcctcgtcgatggccatggcgtctgcttcccgctctgctgacgcgacacggccctcattggacgttcggtcctcactttccactggagccggcgggaccgtggccgtgctggagctgccacctccttgctcccccgccaggcttgtca

SEQ ID NO: 27780 - DNA, 544 bp, Zea mays
  Clone ID: cC-zmle189067d09d1
aagggcagttatggtctgaagctgaatgtcgctgaaatggttttctttttctttgacgccttgggcacggggggggtagggggtgaagtcgggaaccaaggtacggcttcagtcgcgacgaccacaaggcacccccggcatcgccccggctgcacatgcatcgtgtgcatccagccacccagtggcaagggcccgaagcacaaccctgcgtgcacctgcaacgtgtgcatgacggtgaggcgccggttcaagacactgatgatgaggaagaagcagcggcagtcggagcgagaggaggcggaggcaagcaagaagatcgcgtgggtgaacagagacgagcccgaggggagcagcctgtcgagatccccgcagacgctggacacgacccgagacagcggcgatgtcaccatgttcgacaaggtggccgccgacgtgaacaaggggcacattgacctcaactttcaccctgcagcccctgccgtccgtggcgctggcgaccagggacagaatggcgcgcaacagccccgggcggtgagcatgatgg

SEQ ID NO: 27781 - DNA, 449 bp, Zea mays
  Clone ID: cC-zmle189067d10a1
ttttagaaatgtttttattattattatcatattagctattactgggggataaaggaccggacaacgagatggaacggtccttcaacttcacatgacccaaaaaaggggcacgtcgctagtcaattatgtactagtattctcccaccttatgctccccaccctcatcttcagcagtcgcaagcttgctgacaccggagttgtagctgacgccgttgcgcgcctccgccgctgtctcgagggccatctgcagacgtcccaggccctggcaggccttcggtggagtgcccttgtaagccttgcagatgtaagcctcgaaattctcgtaatcctcaagcaggggctgcccgtcgacgaccacccagggcacgtaccggtgcggcggctcgagagcgtcggtctggttcgcgtacttgagctcgagcttgtggccatgctcccttttgagcatt

SEQ ID NO: 27782 - DNA, 480 bp, Zea mays
  Clone ID: cC-zmle189067d10d1
gacagccgcctcgccatcgccgcgctcctcctgctcgcttttgccttctccgctgccgctgccgcggacgggggggggggggccgtggcgctgtactacgagtcgctgtgcccctactcggcgcgcttcgtggtgaaccacctcgccaaggtcttcgcggacggcctccgcgaggtcgtggacctcacgctcgtcccctacggcaacgcccggatccatcccggcggagagatctcgtgccagcatggtccgtacgagtgtctgctcaacaccgtggaagcttgcgccatcgacgcctggccggatctggatgtgcatttcagcttcatctactgcgtggaggacctggtggtgaagcggcagtacaaggactgggagtcctgcttcgagaagctgggcctcgacgccaagcccgtaacagaatgctacaaaagcgagcatggccacaagctcgagctcaaatacgcgaaccagaccgac

SEQ ID NO: 27783 - DNA, 323 bp, Zea mays
  Clone ID: cC-zmle189067d11a1
cctacccctttttctcttttttttcaccaccccaaccaaaagggggtttggggggattttttttatactgggttcccaaagcccaaactaaaaccaaaaggaaaaccctttgggccctcaccaggcgaagcattcaaccctaaagaaaacatcctgggctataaaaaaggtccaaaaatgaggaatttaacaaaaaacccctaacaagggggaaaaacggccaccgaccgggaaaaaaccccgccgcctctaaataccctttaaaatacaaacccctggagaaaaacaaaaaagagggaacgccccaaaacttgggacccccc

SEQ ID NO: 27784 - DNA, 339 bp, Zea mays
  Clone ID: cC-zmle189067d12a1
cctctagagcgggcgcccttagttttttattcccccccttttcttctttttttaaaaaacccggaaacataccgggggtcaggggaagaaaacaatccccgaggatgcccttcacttcgatcgaacactgttgttcttcatcgttgtacaaagtttttcaaagaggacgaggacataggggttgaacaaaaaaaaaaagggcaaagacatgtatcactgatctggagtctaaacaagaggcaacttgttcccgaaagaatcgttcaaaaaaagttctacgagaacaacatgttttactttgttccagcaattttttttttgagcgatttctatgtcttc

SEQ ID NO: 27785 - DNA, 481 bp, Zea mays
  Clone ID: cC-zmle189067d12d1
gacgcgccagcgcgagcgagaaggcacactgacaaggccgtttaggtttactccaccgcgctccccggcggggagagggggccctctgacggagccgacgaaccgccctctgccctactccttccgcggcagaataaaactgtctccgctccctatccggctccaagatgcgccgaggctgacgatgctccggatgaaggcctcctacgacgactcctcggacgcgagcggggacgagctcatcgccgacttgaaagccaagcgggacgccgccgagaacaagagcactgtcctcacctacgccggcggcgctgacgaagctctctggctgacgtacgacaacggcggcgccaacaacaccgtgcctctgctccccaagatcatggagcttgacggcctcggctacaccggatgggtcgaataccgctaccctctctccaaggaaagcaggaaagaactcgcccacgacaacgagtcgctc

SEQ ID NO: 27786 - DNA, 311 bp, Zea mays
  Clone ID: cC-zmle189067e02d1
gcccacgcgtccgactgagcctattgatatatatagagaatttattttttttgtgagcccgtcaacactgttgagggcgagggggatgcttgagcttgccccatgcgatgaaactgttacctacaatcgtaatgtaatgtgctggtattctcgaatgccatagcccatagtcagccatggcttggaataacgtagtggctgactgatatgccagtaggcacctgtctagtacttacagaactacaaaaagtttgtactatacatatatggacaaccttataagataataatttttccttaataaaatgggc

SEQ ID NO: 27787 - DNA, 460 bp, Zea mays
  Clone ID: cC-zmle189067e03d1
gcgtggactgaaaaactgaggagcatcatcaccgacgcactttagaattttggggagactctgagctgcaatgcgggcgcggacagcctgcgtggaaggcccatatgggcatgaatcaccctaccacttgatgtacgagaatctcgtcttggtcgcaggaggcattggaatatcgccattcttggcgatcttgagcgacataatccacaggatcgaggagggcaagcaatgcatgcccaagaacgtgctggtcctttggtcagttaagaagtccaaggagctttctctgctgtccgccgttgatgcccagaccatcagctcatctgtctcggacaggttgcaactggatatccaggcctttgtgactcaagaaccccatcctccttttgaggatggcatcttcggggacgaccagaaagtccctggcatgttcgcaagaacgggacagccatgtttggct

SEQ ID NO: 27788 - DNA, 382 bp, Zea mays
  Clone ID: cC-zmle189067e07a1
caaaaacaaaatttttttatctctttaacaacaaaaaaaaacaaatagggtaaatggggtattattatttattatttaacaccccattccccctaataaaatataaaaaaatccaacaatctctaaaaaaaaaaaaaacaaaccctggttttataattatataattaataaaatattaccagccccccaaaaaataaattaaaaaaaaaaaatcattaaaaaaaaaaaaaaaacgaataaaaaaccccttctcaataaaaaaaaaaacttcacaaaaatattctaaaaaaaaaaaaaaaaaaaaaaaactttttttttttaatatccaaaaaaaaaaaaaaatatttattgtggaaccaccttactccattttttatttttt

SEQ ID NO: 27789 - DNA, 544 bp, Zea mays
  Clone ID: cC-zmle189067e07d1
acccgtgcgcggacgcgtgggtaagacgacttgtttcattgattctttatgagttctagcttcttttgcaccacaagggggagggggtcttgcaactgcggatcaagctgcggctgccgctcaagctgcaagtgcggcaagaagtaccctgacctggaggagacgagcaccgccgcgcaggccaccgtcgtcctcggcgtggccctggagaagaaggccgcgcccgagttcgtcgaggccgcggcggagtccggcgaggccgcccacggctgcagctgcggtggcaactgcaagtgcgacccctgcaactgctgatcacatccatcgacgaccatggatatgattattatctatctagcttgtggtggtggttgaacaataataagcgaggccgagctggctgccatacataagtattgcgtggcgtgtgtgagagagagagaaacagagttctttcagttgctatctctctttgcatgtttggcgtcagtctttgtgcttcatgtacgtacgtgtgtctacctgcatgttggttgatcccatt

SEQ ID NO: 27790 - DNA, 248 bp, Zea mays
  Clone ID: cC-zmle189067e08a1
ttttctcttttttgtaccagaacacacaccggcttggggataggggatataaaagagctccaggaaagggaggacatactgtatatgcaaaacatcaagtcaaactataataacccctcgcataactacacgacacgacttagaacctgatttctactgtcctcgtacatcagaagattcagacaaacatacatgggaaaattacatgatggctagcctacaactagctgctgtcatgctgctgatgc

SEQ ID NO: 27791 - DNA, 368 bp, Zea mays
  Clone ID: cC-zmle189067e08d1
gggaagcccttcctagactcaccctcctctctaaaaccttattttggcttataaaattgataggcctctcaggaatatggagaggattgcttcctataaaaacaggagcttggtgggcatacgtgacaatgatccttacatctgtagcattgcaagaaggcactctgcttgtgttcaggatgctctacaagaaaatggaagacatgctagatgctcttgctgatagaaaatctaagccacgtcttacattgactgacaagacgctgatttcttgagctggtggcctatgccatggagaggctcatgcaatctttctccgtctcaggcttttgactacagcgtttgggcgagccacattctatactgaa

SEQ ID NO: 27792 - DNA, 217 bp, Zea mays
  unsure at all n locations
  Clone ID: cC-zmle189067e09a1
aacatncaacttatgatccttggggatgcggggtgagatgtcgcgataccaaagtacctacaggacatacaatttacattgttatcaatattattatgggaccattcaacttaaagattcttgaagatgcacactcgtacatcacatgcagaatagcataagtacgtagtagctattgacaatcttattttgtggaaaccagcgaatattgtgagac

SEQ ID NO: 27793 - DNA, 450 bp, Zea mays
  Clone ID: cC-zmle189067e09d1
cagaagtgattgcagctggaagggaaaggatatcctttgtgttataaggtggaggtgcaattgacaggggagggggagcagctgtagctggcggaggcgcatcacctgctgaagaggcaaagaaggaagaaaaggttgaagagaaggaagagtctgatgaagatatgggtttcagcttgttcgattaaaacaccactgccagtttacagcttctctcgcgaatggtctcacaatattcgctggtttccacaaaataagattgtcaatagctactacgtacttatgctattctgcatgtgatgtacgagtgtgcatctccaagaatctttaagatgaatggtcccataataatattgataacaatgtaaattgtatgtcccgtacgtactttggtatcgcgacatctcaatgtgcatcttcaaggatcataagttgaatgttatcattaat

SEQ ID NO: 27794 - DNA, 271 bp, Zea mays
  unsure at all n locations
  Clone ID: cC-zmle189067e10a1
ctcccnccnccccctttttttatttttaacanncaacttatgacccttggggatgcgggctgagatgtcgcgataccaaagtacctacaggacatacaatttacattgttatcaatattattatgggaccattcaacttaaagattcttgaagatgcacactcgtacatcacatgcagaatagcataagtacgtagtaactattgacaatcttattttgtggaaaccagcgaatattgtgagaccattcgcgagagaaactgtaaactggc

SEQ ID NO: 27795 - DNA, 452 bp, Zea mays
  Clone ID: cC-zmle189067e10d1
gagcagaagtgattgcagctggaagggaaaggttatcctttgtgttatcaggcggaggagcaattgacaggggagggggatgcattgtatctggcggtggcgcaccacctgctgaagaggcaaagaaggaagaaaaggttgaagagaaggaagagtctgatgaagatatgggtttcagcttgttcgattaaaacaccactgccagtttacagtttctctcgcgaatggtctcacaatattcgctggtttccacaaaataagattgtcaatagctactacgtacttatgctattctgcatgtgatgtacgagtgtgcatcttcaagaatctttaacgtgaatggtcccataataatattgataacaatgtaaattgtatgttctgtacgtactttggtatcgcgacatctcactgtgcatcttcaaggatcataagtttgaatgttatcattt

SEQ ID NO: 27796 - DNA, 296 bp, Zea mays
  unsure at all n locations
  Clone ID: cC-zmle189067e11a1
ccccccccnccttttctttttttcaccgaaaatggattgaatgaatggggtcagggaaacagggattatactaaatgccaggcctatccgaacagcactactcgtttacacatcagagcagcttgtggaacgggcattctgcttcccagattcattcaatcgttcataatcataatgtgctgaatggcctatccaagctgtgtagtagccatgcgaaccgtttttgtcatccagccacacgggcccgtcgatctgaactaatgaagccactgcatggctgcatgttgatatgtaca

SEQ ID NO: 27797 - DNA, 548 bp, Zea mays
  unsure at all n locations
  Clone ID: cC-zmle189067e11d1
gcggagagagagagggagccaagggaagcncnctncnntctttctctttctcgacctctcgaattccgactgggggaggggtcctcctcgctcggcttccccggctcttgacaggggaaagcggaggagagggatggggagggacgagaggtccccagtgtgggaggccgcgctcggcgctggggtcgccgccgccttcgccgctgggctcgtcggggtttacctttccatgccggactccgactacagcttcctcaagctgccacgtaatctccaggaactccaaatcctcactggccatcttgagaactatactagtgactacaccatacangtgttggtaggctactgcgccgngtacatcttcatgcagaccttcatgatcccagggacaatattcatgtcactgcttgctggtgctctgcctgggcagctcggggcgtggccctggtagtcttcgccgccactgctggcgctccttcgggctatttcctgtcgaagaagattgggaaagccactggtggtcacgctgggggccagataaactc

SEQ ID NO: 27798 - DNA, 245 bp, Zea mays
  Clone ID: cC-zmle189067e12a1
ccctctccccttttttttttttttttccccccccccccctcctctggggggaaaggggcaccacaaaaactgagggctccccttttatctaaaattgatccatgtttcttaccgaaccagggctagtcttataaaaaaaacaaaaaaaatgggacccgtgccccatacatagccctttatcaaatcaaacaaagggggatagtttggtccgtccccccaccccttttattgtcccggacccctgg

SEQ ID NO: 27799 - DNA, 181 bp, Zea mays
  unsure at all n locations
  Clone ID: cC-zmle189067e12d1
gagacaataaaatggctggagggacagaccaaactatctttctttttttgatanganaaagggctatgggggagggaggcgtcccattatttttgtttttattataagactagacctcgttccgtaagatacatgtatcaatattatataaaaacaaaccatcacttcttgtgctgctcat

SEQ ID NO: 27800 - DNA, 361 bp, Zea mays
  Clone ID: cC-zmle189067f01d1
gcccacgcgtccgcggacgcgtgggtgaaagcatcaatcttttcagatatttttcaggcgaaggcgtgcaacaagggttgtggggaatgcttgaaggaacggttgttagtgttcctgagaaaggggccagaaggcacccaaggggtgacaatatccagattgataccaaaaacattctcttcatctgcggtggtgcttttgtggacttggagaaaactatttctgaaaggagacatgattctttaattggttttcgagcgcaggttcgttcaaatatgcgatctggtggtgtcataaatgctgagattacatcatcgctactgaaatcagttgaaagtggccatctcattgcgtatggact

SEQ ID NO: 27801 - DNA, 380 bp, Zea mays
  Clone ID: cC-zmle189067f02d1
cccgatccaccttggccctcccggagaaccagaaggctacccatttttccattttttgggaggggccatggacgacccgggggagggggggaatgactggttccacaagttcaagaccgacgtctatgacaagaagccggagctgttcgagcctctcaaggccggccaggcccccaagtacatggtgttcgcctgctccgactcccgcgtgtgcccgtcggggacactgggactgcagcccggcgaggcattcaccgtccgcaacatcgtcgccatggtcccagcctacgacaagaccaagtacaccggcatcgggtccgccatcgagtacgccgtgtgcgcgctcaaggaggaggacctcctggtcattggccacagct

SEQ ID NO: 27802 - DNA, 155 bp, Zea mays
  unsure at all n locations
  Clone ID: cC-zmle189067f03d1
caaaaaaaaaaaagggaaaanggaaaaaaaaaaaaaaaaaaacaccacccaacccaccaaaaaaacaaaaaaaaaaacaaaaaaaaacaaaacaaaaaaacaccacacaaaaaaacaaacaaaaaaaaaaaaaaaaaacacaaaaaaccacacac

SEQ ID NO: 27803 - DNA, 516 bp, Zea mays
  Clone ID: cC-zmle189067f04d1
tgcggggccgtcgtcggcaacagcggcatcctcctgcgcgcgttccattttgccctcatcgattcccacgcagggggggggggcctcaacaacgcccgcgtctcaggctacgccgcgcacgtcggcagcaagaccaacttctccttcatcaacagcaacgttcttcacctctgcgcgcgccggcccggctgcttctgccacccttacggccacggcgtccccatcctgctctacatctgccaggccgcccatttcatcgacgtcgccgcctgcaacgccacctcgtcctcccgccacggcttccccatctccgtcaccgacgcccgcctcgacgtcctctgcgcgcgcatcgtcaagtactactccctccgccgattcgtcgccgagaccggccgcgcgcccgaggagtgggaccgcgcgcacgacgccgtcatgttccattactcgtccgggatgcaagccatcatggtcgccgtgggagtgtgcgacagagtcaacgtgttcggctttggcaag

SEQ ID NO: 27804 - DNA, 435 bp, Zea mays
  unsure at all n locations
  Clone ID: cC-zmle189067f05d1
gggatccttctctcttgagtggcctcccatctcatcctttccattttcgccaccacaggcaaaggcaacggggaaggagccgccatgggctcccgctacgaggtggacgtgacggnggggtcggcgagcaacctgaagaacgtcaactggcgcaacggcgacctccagccctacgccgtgctgtgggtggacgacgggcccaagtgctccacccgcgtcgaccccgacaacggcgaggaccccgtgtgggacgagaaggtggtggtccccgtcctacccgcctccgccgcgcgcctgggcgacgccgtcctccacatcgacgtcgtccacgccgccggcgacgacgccgacgccggcgtcaagccgctcgtgggcttcgcgcgcctcccgcttcgcgacgttctcgatgacgccggcggcgttcggcggcgccag

SEQ ID NO: 27805 - DNA, 544 bp, Zea mays
  Clone ID: cC-zmle189067f06d1
gcggctgttcttgcgcccggccgagggcatccgcttcgtgtttgatttttaagagtgcttctcgcataacggggaatacgagggggatactgtccatgtatccttcgtcctcatcaaggctgacaccccgtggcattacagcgaggagggcgtccatcttgtggttaaggatcctaatggcgctcaagtccgtgattcccgagataagactagtgacaagtttgagttcatagttcagaagagaggcgtccatcgcttctgcttcacgaacaaatccccatatcacgaaacgatagacttcgatgttcatgttggccatttttcatatttcgagcagcatgccaaagatgagcattttgcaccactttttgagcaaataggcaagttggatgaggcactttacaatattcagttcgaacagcactggctagaggcccagactgaccgtcaagcaatattgaacgagaacatgagccggagggcagtccataaggcgctcttcgagtcagcggcgctgatcgccgccagcgtcatccaagtttac

SEQ ID NO: 27806 - DNA, 213 bp, Zea mays
  unsure at all n locations
  Clone ID: cC-zmle189067f07a1
cccctccttcttttttttttttttttccccccccccanncccngcccgcgacatggggtttggaaaaaattcaatacataaggattctccaaattaagcatccaagattcaccacaccataacatgggacatttgaaaaactacgggtacaggtatcaaaatgcaacgagttcaatactaaaaatataagcgtagggcaatttaatctttttc

SEQ ID NO: 27807 - DNA, 450 bp, Zea mays
  unsure at all n locations
  Clone ID: cC-zmle189067f07d1
cgggaaacccnagccgccagancncacgaaccacncgagcttccaatttagggaaggggaggagcgacggggggcgggggggagacggcgaagggcggcgcgccaacccccaagaagaaggggacagcaaccttcacgatcgacagcaccaagccagaggaggacaagatcacggagggcgcctcgctcgagaagagcctgcaggagcgcaacaaggacgccggcggcaaggctggcaacctcggcgactccgtcaccatctctcgcgagaagaccaagggcaccgccacctctgacggaccctactccaagaggaaccagaagtacctgaccaagaagaacttgaagaagcacaacgtgcgggaaaggcaacacgtggttgctgccaacaaggaccgcaacgactatgagctccgctacctcaacaaagccgagaaccagggcgaggaa

SEQ ID NO: 27808 - DNA, 168 bp, Zea mays
  unsure at all n locations
  Clone ID: cC-zmle189067f08d1
gggggctccatgaattgggaaaaaaaaaaaaaaaaaaaatataaaatataaaaaaaaaaaaaaaaaaaaaaggggagnggggaaaaaaaaaaaaaaaaaaaaggaccaaaccccaaaaaaagaaaaaacaaacncaaaaaaaaacaaaaaaagaacaaaacgcggacc

SEQ ID NO: 27809 - DNA, 387 bp, Zea mays
  Clone ID: cC-zmle189067f09a1
ccttcctcttttttttttatttctaggggagaatgtttctcaaaccgggctaaggtgtaaatgagttgaactgccaaaaattaggttgtccaattgtatgtacagtgccataaaaaatgcaaggaatgagcagcagaaacacctgggctaaaacaacgtcagcagggcggagtaaccaaccacatcgcatatttggcacaaaatcttcaacccacgtaacgaatcagttccatcagcacagtcgtccatcagcccagccacgattgacgtgctccgtggtagaagatttcacatgatgacatgatgaatagtagaatcactgcgattttgcaacccttcacaagtccaacaattgcaatggcttaactaacaaacatgccaaaagct

SEQ ID NO: 27810 - DNA, 555 bp, Zea mays
  unsure at all n locations
  Clone ID: cC-zmle189067f09d1
actttgcccagctgcggngaagnnaatagncctttaatttttgactcccataaactcagtgaagcgaggggggctgatgtcctaagtgaaattttacgtcgcacttaagatggcgctgcgtctttatttcgttgtatattttattttcaacaactccaatctgattatgtcgtggcatttcatttgtatttatcatgtcaattgggatatttggtccttgtaagcttttggcatgcttgttagttaagccattgcaattgttggacttgtggagggttgcaaaatcgcagtgattctactattcatcatgtcatcatgtgaaatcttctaccacggagcacgtcaatcgtggctgggctgatggacgactgtgctgatggaactgattccttacgtgggttgaagattttgtgccaaatatgccatctggttggttacttcgccctgctgacgttgttttagcccacgtgtttatgctgctcattccttgcattttttatgggcactgtacatacatatggacaacctaactttttggcagttcaactcatttat

SEQ ID NO: 27811 - DNA, 198 bp, Zea mays
  Clone ID: cC-zmle189067f10a1
ccccaaaacggaaccatgtacgggggctggggcgttccaaagaagtccttaatattataccaccacaatctttactgaactgaacggggatggaaaacatcgtggaatacacccccgaaacaccgagggcgaacgttgccttattattcgtatgttcctatacggagcaacaccgacaggcggggccggacccgtggt

SEQ ID NO: 27812 - DNA, 183 bp, Zea mays
  unsure at all n locations
  Clone ID: cC-zmle189067f10d1
cgggcccgcctgtcggtgttgctccgtataggaacatacttttaattttgcaacgntcgccctcggtgttggggggggggattccacgatgttttccatccccgttcacttcagtaaagattgtgatcgtataatattgaggacttctttggaacgatcgagctatagtacatggttccgtgt

SEQ ID NO: 27813 - DNA, 293 bp, Zea mays
  unsure at all n locations
  Clone ID: cC-zmle189067f11a1
ctccccccccccacttttttnttttttcaagagcaagctnngcttaatgggggcagggggcgagtacttattcaggcagatcactctgaggctgtgcctactgttgggcgctgccagcttgaccttgttggtagctgccactgccagcaggagtaagcacagccagctcatgcttcctaccgttcttgagctctgcagcttcctccatggagatggcatacgagctggcgatgacggcggccggcaagttgctcaagacggagttctttccggcgacgtggctgaccatggtg

SEQ ID NO: 27814 - DNA, 504 bp, Zea mays
  unsure at all n locations
  Clone ID: cC-zmle189067f11d1
acgcggccgctncaacgcccacagcgccacgnactttatcattttcagcgcaagggaccacgtcgcgggcggcgacgggaccacggtgttcgacgacgtgctccctgcggggcagctgctcatcgtaccccagggctacctcgtcgccaccaaggcgcagggagaaggcttccagtacatcgccttcgagacgaaccctgacaccatggtcagccacgtcgccgggaagaactccgtcctgagcgacttgccggccgccgtcatcgccagctcgtatgccatctccatggaggaagctgcagagctcaagaacggtaggaagcatgatctggctgtgcttactcctgctggcagtggcagctaccaacaaggtcaagctggcagcgcccaacagtaggcacaacctcagagtgatctgcctgaataagtactcgtagactggaataattaaacaaagcttgctcatggttaaaaaaaaaaaaaaaaaaaaaaagggcgggccgt

SEQ ID NO: 27815 - DNA, 287 bp, Zea mays
  Clone ID: cC-zmle189067f12a1
ggcatctctggatggaaattcgggtgtgtcgcaaggaacacagaactccgttgcgtttgtgctattatcaggaattacaggcagagtggagaaaatgaggaaaaagaattatatatagcaggagcaccgcaccaccaaggggactcaggctcagccagcgagggcgtcggcaccggcgacgatctcgaggatctccccggtgatcttggcctggcgctgtcggttgtaggcgatggagaagttcttgcggagctcgatggcgttggccgtggcgctgctcatggcgc

SEQ ID NO: 27816 - DNA, 488 bp, Zea mays
  Clone ID: cC-zmle189067f12d1
gacgcgtgggcgaccccgcgcgccgcggaccagcattcatgttttgctcccacctctccaccgcctggggctggggggcgctcgccagcagcgcctccaccacccgccggcgctcccccccgcgctcgggtctcctggtgcggcgttccctccgtgagctccgcacccgcatcgactccgtcaggaacacgcagaagatcacggaggccatgaagctggtggccgccgccaaggtccggcgcgcgcaggaggccgtcgtctcctctcgccctttctcggaggcgctggtggaggtgctctacaacatgaaccaggagatccagacggaggacatcgacctgcccctcacccgcacccgccccgtcaagaaggtggccctcgtggtcctgaccggcgagcgcggcctctgcgggagcttcacaacaacgtgctcaagaaggcggaaacccgcatcgaagagctcaagcagctgggccttcagtacaccg

SEQ ID NO: 27817 - DNA, 677 bp, Zea mays
  unsure at all n locations
  Clone ID: cC-zmle189067g01d1
aaaaaaaattttaaaattttaaaaaaaaaaaaaaaaaaaagggggaaaangggaaaaaaaaaaaaaaaaaaaaaanaaaaaaaaaaaaaanaaaaaaaaagaaaagaaaaaaaaaagaaaagaaaggaaaaaaaaaagaaaagaaaaaaaaaaaaaaaaagaaaaaaaaaaaaaaaaaaaaaaaaaaaaaaaaaaaagaaagaaaaaagaagaaaaagaaaaaaaaaggaaggaaaaaaaagggaggaaagaaaatgaagaagaaaaaaagaagaaaaaaaaaaatggaaaagaaaaaaaaaaaaaaaaattaaaagaaaaaaaaaaagaaggggaaaagaaggaaagaaatataaaataaaaaaagagaaaaaaaaaaaaaaaagaaagagaggggagaaaaaataagaagaaaaaaaaaagaaaaagagagaagaaagaaagaaagaaaaaagagaagaaaaaaagaaggaagagaagaaaaagaaaaaaggaaaaaaaaaaaaaaaaagaagaaaagagaaaagggtaaaaagaaaaaaaaaaaaaaaagaaggaaaaaaaaaaaaaggaaaaaaaaaaaaagaaaaaaaggaaaaggaaaaaaaaaggagtaaaaaagaaaaagaaaaaaagagaaaagaaaagaaaaaaaaaaaaaaaagagaaaaagaaaa

SEQ ID NO: 27818 - DNA, 367 bp, Zea mays
  unsure at all n locations
  Clone ID: cC-zmle189067g03d1
ccggtagctaggggtatggcctcgccgcgcacgccnccngttttttctttttttcgaagaagaagaggggaggctgccgccggggacgtctccgccgccgcagtcatggcgttcaccaaggtgcagcgtatcatgacccagcccatcgtaaggcaccttttcgccgatcgcccccctttcctctgggctcgtttgctcttctgtgttctttgcttttcattcacatcagtcgcgctgttcctaatcgggctcgccctacgtttcatgcctggggtggcgaatccctggtgggcgtgcgcggcggcagaacctcatcttccgctttctccagagcaaagcgcgcatccacatctggctcttctagcag

SEQ ID NO: 27819 - DNA, 211 bp, Zea mays
  Clone ID: cC-zmle189067g04d1
ggggacccccccgggaggggggacaaaagcccggcggctgaggtggaaacccccagggggaccgttacccttgccagggcccaaacgcccgcccccatcgccaaggccccccccgtatagcccaaggtgggcgggctatccccgacaagcacaaataagggggcccccctagggggcccaaaaaaggcttaacgggccccccaccccaaaa

SEQ ID NO: 27820 - DNA, 170 bp, Zea mays
  unsure at all n locations
  Clone ID: cC-zmle189067g05d1
gccacgcgtcgccacgcgtcgagcatcattggtttgcnagcgcacctggagcgaggcacactggcttcaagccagatccaaactgcatgccgtccaaaatgctattggacagatagaactggtcaaacgcaaactggccacgaaaacagaattcgtgacagctgaaacca

SEQ ID NO: 27821 - DNA, 514 bp, Zea mays
  Clone ID: cC-zmle189067g06d1
cgcccacgcgtccgcggacgcgtgggctttgcgaagacatttaccttttggatgggttagtcctgatgcaggggccgggggttcctggttcgttcctgcgagcaagagcaatcggccttatgcccatgattgaccagggtgaaaaggatgacaagataatagcagtctgtgctgatgatcctgaatatcgtcactacaacgacatcagtgagctgtctcctcatcgcctgcaagagatcaagcggttctttgaagattataagaagaatgagaataaagaggttgctgtcgatgcattcttgcctgcgaccacagctcgagaggccattcagtactccatggatctgtgtgcgcagtatattttgcaaagcttgaggcagtagattggaagcaactatttatctgggcgtcttggaatgagtgtgattttaataagtcaaaacacttgatattgtgtgcaaatcttggggttgagaacaatgtcactagctgggatttacttctgtgaactgca

SEQ ID NO: 27822 - DNA, 363 bp, Zea mays
  Clone ID: cC-zmle189067g07a1
cactcacaaacttttttattttttttacgaacaacaatataaaattggggaaaaggaaaaatttttatacttattatctccccattcccccaattatttattaatattataaaatttaaataataaattttatttaattctataaaaaaaaaaaaaaaaaaacacccctattttataataaaaaaaaaaaaaaaaacctttctcttttaccaataattgggcgcataaaaaataaaaaaacaaaacaatctttggcgaatataaaaacaaaacccccccaaaaggggataataataacaaaaaaaaaatctatttcgaaaaaaaaaaaaaccccgcgggggggggggggaaaaaacataattt

SEQ ID NO: 27823 - DNA, 583 bp, Zea mays
  Clone ID: cC-zmle189067g07d1
ggggcgccgcaaggccggctcgctggcgctccccaaccttttgttttatctcaacgggatcgcgctccgggggcgcggcccgaacgtcttcgtcgtcgacctcctcgcccaggtctccaagaagaccctctccgaggaggtgaaccaggcgttccgcgacgccgcggccaacgagctcacgggcatcctcgaggtctgcgacgtgccgctcgtgtccgtcgacttcaggtgctccgacgtctcctccaccatcgacgcctccctcaccatggtcatgggcgacgacatggtcaaggtcatctcctggtacgacaacgagtggggctactcgcagagggtcgtcgacctcgctgacatctgcgccaaccagtggaagtgaagcgttgcattgtaatagcactttgtaactcctcaccctccacagggctttgggattcaccccgaaatgactcactttcggtgaaattcaacccgttcggcgaggtccgccgaatataccggccaaatgtttccattggatttaaatatttatcaactctagaggtgaaacaaacatacaaggtcttcattcaataatcaatat

SEQ ID NO: 27824 - DNA, 350 bp, Zea mays
  Clone ID: cC-zmle189067g08a1
ccccccttttttttttttttttcccccctccccctttttttggggaaagggttaaaaaaataaaaaagcccttccctattttcgggaagccccaaaccttagcaaaaaaacttttttattgaactataacccataacccacctaaaagagggccccccccatgatgggttgttggtaaaacccccttgggcttgtcaaaacacgttgggtgaaaggcaacaattgttgccactttaaaaaggcgccccccttaagccccacccgcccggaaaacggcaacaaccgttgctctgttaaaaaagccgcagggctcacaacacctacctggctgaaaggtaataattgttttt

SEQ ID NO: 27825 - DNA, 523 bp, Zea mays
  unsure at all n locations
  Clone ID: cC-zmle189067g08d1
gagaaagcacaataacgtaccaacaatgggagccaaaattttttgtctccttaagcgccccggacacacggggagggggggtactacaaccattntaccgcactgctcacaagctcctatagcttctcttcttcccccatacctctcaccagcgttgtcttcagtatgtgaaaacccaattcttcaaccctacaggatccaacaggcaatcacagcaggcatcttacctttatcacccttgttcctccaacaatcatcagccctattacatcaattacctttggtgcatttattggcacaaaacatcagggcacaacaactacaacaactcgtgctagcaaaccttgctgcctacgctcagcaacagcagttacctttggtgcaattgttggcacaaaacatcagggcacaacaactacaacaactcgtgctagcaaaccttgctgcctactctcatcaacagccacttctgccattcaaccaactagctgcattgaactctgctgcttatttggcacaacaa

SEQ ID NO: 27826 - DNA, 385 bp, Zea mays
  unsure at all n locations
  Clone ID: cC-zmle189067g09a1
agggttgtctggncaagggcaacgttcttacaggtaaaggggctgtgcaattaaacacggagtaaatcaaacacaagaaactaaagaaaactatgtctgtgtgccgccagattctcaagactacaagcagagtcagatagcaaagccaagaacaggaagaatccactgcgtcatcaagaggaggaagaagcgccgggtagaaaagcgcatcctacggtgcctggatacatacatgacaccacgcagtagagggggtgtgacaacgcaggtgcgcagcagctaagcgccccacacggtgatcccctgcatcatgttcttgaactcgccgaagtcgacgcggccgtcgcaattgcggtcgacgttgcacatcatctcctgcacagtg

SEQ ID NO: 27827 - DNA, 488 bp, Zea mays
  unsure at all n locations
  Clone ID: cC-zmle189067g09d1
gggctcggcgctcgacgcgctcggcctcggcgccgacctttcctttttggaggccgcgganggcgggaaggggccggggggcgccccggggctccgcttcgacgacttctagtccctccaccgcgcgctcggggacgcgctgttcggccccatgccggtggctgtgaccgaggacgacgacgacgagggggacatgaaggaggcgttccgggtgttcgatgaggacagcgacggcttcatctcggtcgccaagctgcaggccgtgctcaagaagctcggcctgcccgaggctcggaacctggccactgggcaggagatgatctgcaacttccaccgcaactgggacggacgcgtctacttcggcgagttcaagaacaatgatgcaggggatcaccgtgtggggcgcctagctgatgcgcacctgcgttgtcacacccactttaatgtgggggggcatgtatgtttccaggcaccggaggatgcgcttt

SEQ ID NO: 27828 - DNA, 616 bp, Zea mays
  unsure at all n locations
  Clone ID: cC-zmle189067g10a1
tttttttaaaaaaaaaaaaaaaaaaaaggaaaaaaagagagggataaaaaaaattctttttttaaaagaaccccccccaaaccaaaaataaaaaaaaatgaaaacaaaaaaatggaaaacaaaaaagaaaatgcccccacgggtcgaaattttaaaaaaaaaaaaaatgggaaaaaaaaaaaaaaatcccaaacccctcaaaaaacaaaaaactggaaaaaaaaaaaaaacaaaacatcccaccccccaaaagggggaaaaaaaaaacacaaggaaaaaaaaaaaaaaaaaaaaccccaaaaaaataaaaaaaacccacaaaaaagaaggcccggggaggaaaaaaaaaaaaaaaccaattgtccccaaagggtccaaaaaaaacaaaaaaaaaaaaacaaaaagaaaatgtgggccaaaaaaaaaattaattattaccaacaaaaaaaaaaaaaaaaggcctggtaaaaacaaaaaagggcgaaaaaacgaaagaatcccataatacccgnaaaccgggagaaaacctggaaaaacaaaaaaacgaaaccggactgaagcgaaaaaacttcccaaaaaaaaaaaaaaaacagggaaaaaaaaaaaaactcccggg

SEQ ID NO: 27829 - DNA, 491 bp, Zea mays
  unsure at all n locations
  Clone ID: cC-zmle189067g10d1
acccgtgcgggcacgcgtccgcgacgataagaggatccatcacgngttttcagtttttcgccgaggctgaaccaggccatggcgngggggatggttgcggtaggaggcgcgtccgccagggccaacatattcttcggtggattctacgatggattctgacggaacactggggaacagatgggtgtagctagtatacactgccgcgtactactggtggacgatgtaaataattattgggggctcttattattattattagaccttggattaatgctacacagatacggacggacggatggatgggttataggcttattcaagttgatagtaactaangggcatatggaagtcttaattagttgacaagttattaataactaaaaaccgtgaaccatgcgtgcatgctcctcttggggttacatatatttggattcattatatattaatgaatgatctgggtgcatgccatataaaaaaagaaaaaaaagaga

SEQ ID NO: 27830 - DNA, 446 bp, Zea mays
  unsure at all n locations
  Clone ID: cC-zmle189067h01d1
cccgggccaaggtgctggacattgacctgcagaagcagctcattttctacttttagtccatggngccacttcccggggggtatgagccggacttcatcgccgctaaccagggctctcgtgccaacaatgtcatcaagggcaccaagaaagaacaggtggagcacatcaatcaaagatatcagggagtttaaggagaagaacaaagtggacaaggtagttgtgctgtggactgcaaacactgaaaggtacagcaatgtatgtgctggtctcaacgacacaatggagaatctgctggcatctgtggacaagaacgaggcggagatctcgccatcaacactatatgccattgcctgtgtcacggagggggtgccgttcatcaatgggagcccccagaacacttttgtgcctgggctgattgatcttgctatcaaaaacaactgcctgat

SEQ ID NO: 27831 - DNA, 311 bp, Zea mays
  unsure at all n locations
  Clone ID: cC-zmle189067h02d1
gacgaggtcctcgacgngcncgccgcactaaaccacacctttttccattttcatccgccagcctcactaggagaaggctgacgagggcgcctgtctggccaccacctccaccacggctgctgtgcctagtgtaaccccaagcaaggatagtctgtatctggggatacaatacgaacggagaaactacgagaggggggaatcggccaaggcggccggtgctctctcctctcctcgtagctagtttttcctcctgttccagctcacttcttgttcatccagccgcgttaggaaaacaaacccagacccctgcc

SEQ ID NO: 27832 - DNA, 220 bp, Zea mays
  Clone ID: cC-zmle189067h03d1
ggacgcctgggcagacccgggggaagccacaacctttggccattttgcggcggaaggccgaagataagcgcgcgtgggcggaggccaagcagggtaccaaggtggcgcgagtgcctggagctcgccaacttcatgagggccgtggggagggcgctcttcaccaagcgcttcttcttttgaacccaccgcccaccggcccttttctttaccaccagatcct

SEQ ID NO: 27833 - DNA, 618 bp, Zea mays
  Clone ID: cC-zmle189067h04d1
acccgtgcgaaaaaataacaggctcactaattacacatttagttttttcaatttctgagcgataagggaaatactgcggtgtggggtcagtatgcacatgctcgtatttgttccattattcggaaatccaacaagaacgtggaagagctgaagatgagtggagccatttctctcgaccatccggatgagcgcgtgttggggctgtatcttatccgatttgcagaggttgttgaagaggcatgcacgaatctacttccaaatgttgtgtgtgaatacttgtacaatctatctgaaatgttcacaaaattctataccaactgccaggtggttgggtcgccggaggagacgagccggttgttgctttgccaggcgactgctgttgtcatgcgacagtgcttcaacctgctcgggatcacgccagtatacaagctgtgattggctgcatgttcgattaatacattcaacatgtagaaaccccaattcatcatggttgcagttttggtcttgtaacctagttgaggcagttaacataatctactgtcctcgttgaaaacagaaggaactcaaaagggtgtatcaaaatgtgcttgcagagtttctgttactggtttaaaataa

SEQ ID NO: 27834 - DNA, 401 bp, Zea mays
  Clone ID: cC-zmle189067h05d1
cacgcgtccataggtccaactggcacttttatatttgctcatgccctggcggggggggtgtcgcacctttcccacatgctcacaagctctatagcttcttttccctccttaccaacggctcgatgtaaaacccaatcttaccctaaggaccacaggcaatccactgcatctaccttataccctgtctcacaatatacccatacagattaccttgggcttatgcacaaacatagcacaacactcacacttggctgcaaacttgtgctacttacaacgcagtcttcattaccactgctgatgacttgttttattgacaacacactccttagcgctttgtgctaccccacatttttcattaacatgacactggacttctgttattcagagcacaactctccatt

SEQ ID NO: 27835 - DNA, 170 bp, Zea mays
  Clone ID: cC-zmle189067h06d1
tgcgggtttacaataagatgctgtatagcagtcaacaggtttttcttgtctatacaagatacctttgtctacggggctgggctgaccatgttgtattcgactcaaacaatgttgcagtcatggacattgtccgtttcaaaaaaaaaatacataaataaaagaaccacacg

SEQ ID NO: 27836 - DNA, 361 bp, Zea mays
  unsure at all n locations
  Clone ID: cC-zmle189067h07a1
atcacgaaaaagctttattcagggggcgagggtattgttttaattcgtacaggagctgagtgcctgcacgtacgatagccaagtacgatgaccctgcacaaccagtcaaccacagacatacataaggcacgcaggcaagcacgaacgggcgtggatgccggacgccgggcggctcatttagccctggcgaggaagctctccctgcgctcgtggacctcgccggtgcaggtgttgatgtcctttttgaccctggtctcgcgcaccacaaagccgtggccgccgtggtgaccattgtggtggtggtggttggcgccggtgcgtgagaccctgttnacctttcttaacttttccttgacgacgt

SEQ ID NO: 27837 - DNA, 409 bp, Zea mays
  Clone ID: cC-zmle189067h09a1
ctcaacaaccaaaattttttattttttttgaacaacaaaccactataggggggcggggggggtttttttttttataatttcccccttcccccctcatgtaaaaaaaaaaaaattttttaaaaacctcgccgggaaagaaaaaacgcttaacttaaccctcggaggggggagcctgcaccgtataaatggggacttgcccccggcccaaaaaagattgggataagggaaacaccttggggttttaacaaaaacccacgcggggcccagggagaaaaaaataaatattataggtgttttggggggggaaaggagtggattcccttcatacccattatacggtcacccctttttttgtggggggggggggtatcccgggggggggcgcggcaaaaaaaaagaagggggggtc

SEQ ID NO: 27838 - DNA, 437 bp, Zea mays
  Clone ID: cC-zmle189067h09d1
ggaagacgagtgtcaagtgaacctgaaacttgcggtgtttttgttttttagcctgagtgtgagtgagtgagcgagggggctgagctccgatcctcgctagctaggataccgccataccacaagtcttcttcacaagtttaggagtgacagcaacaagagatcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaaccatcgcgtctcccgggcggggcatcctggcgatggaccagtctaacgcgacgtgcgggaagcggctggcgtccatcgggctggagaacacggaggccaaccggcaggcgtaccgcacgctgc

SEQ ID NO: 27839 - DNA, 354 bp, Zea mays
  unsure at all n locations
  Clone ID: cC-zmle189067h10a1
cacttccaattttttttttttttttacccccnaccttaccaatttggggattggggggtaaagtggatcgatttaaataactgcatatcatagtaatatacttcaaataaaataggaattcccaaaatggagaaaatcgttgccgtcattattaggaaagtatgggaagacttaaaccatatcctatttaaaggaggatgaaattcaaattcaggtaagggacccttccttctattgattggatcaaaattcttttttcttttcctgtctctctgattagcgtttcgatgaatgagcctatggtaatgcctaaatcgccagctataactatcggacccgtgggcggacccctgg

SEQ ID NO: 27840 - DNA, 309 bp, Zea mays
  Clone ID: cC-zmle189067h10d1
gcatttccattttctcattcatcgaaacgcaaatgggggagagaggaaaagaaaaaagaattttgatcaaatcaatagaaggaaggatcccttacctgatttgaatttcatcctcctttaaataggatatgctctaagtcttcccatactttcctataatgactgcaacgattttctccattttgcgaattcctattttatttgaagtatattactatcatatacattatctaaatcgatccactttaaataaaatagaaaaaatcgccggaaaaaaaaaaaaaaacaacataaaaaacaaaaaggtgg

SEQ ID NO: 27841 - DNA, 339 bp, Zea mays
  unsure at all n locations
  Clone ID: cC-zmle189067h11a1
gatcctctagagcggccgcccccccacacccccttttttnttttttacgaagaagccctattcacgggaggagctggggggcctaattcgtacaggagctgactgcctgcacctacgatagccaagtacgatgaccctgcacaaccagtcaaccacagacatacataaggcacgcaggcaggcactaacgggcgtggatgccggccgccgggcggttcaattagccctggcgaggaagctcttcctgcgctcgtggaccttgccggtgcacgtgttgatgtcctccttgaccctgggctcgcgcaccacgaagccttggcccccgtggtgaccattgtg

SEQ ID NO: 27842 - DNA, 532 bp, Zea mays
  Clone ID: cC-zmle189067h11d1
gcgggcacgcgtccgcacaggaatccacacaagcacttctttttcgcttttgcgctgcacacagacacaccaggggtggggaccaatggcttactaccaggaggcggactactgctcggaggaggtgaggtcggtggccccggccggcttcggccgccacggaggcggcgtccagcagcacgtcgtcaaggagaagttcgaggaggtcgacacggtctcacgcgccggcgccaaccaccaccaccaccaccatggtcaccacggcggccacggcttcgtggtgcgcgagaccagggtcgaggaggacatcaacacctgcaccggcgaggtccacgagcgcagggagagcttcctcgccagggctaactgagccgcccggcggccggcatccacgcccgttcgtgcctgcctgcgtgccttatgtatgtctgtggctgactggttgtgcagggtcatcgtacttggctatcgtacgtgcacgcactcagctcctgtacgaattaccacaataagctcgtgacctggataaaac

SEQ ID NO: 27843 - DNA, 465 bp, Zea mays
  unsure at all n locations
  Clone ID: cC-zmle189067h12a1
ctctctcctcctttttttctcgatttaacaaaacntattcataaacaaagggggttgagggatatttttccatacgtacatgctcattgtggtagacgcagctgaccacctagagctgcatacttacttattcagactgatccagcatgtggcaacgtcggaagttcacatgcttacagacgacaaattttcataacaatagcttggcttggctgcttcacagaataaccaaacgacaaccacgaaattgcgacgatataaaataaacaactcagaagcaaatcgaccccagaagcccgtcttactcatcaagcactcccgccttctccttcatggcatccgcttcctcctcccagcatagaagattagccagtttgtagtccttcttcataggaggaggagcactctccacgttctcgccgtcaagcagtggaaaacagatttgggcgaggtagcaacagcgtc

SEQ ID NO: 27844 - DNA, 505 bp, Zea mays
  Clone ID: cC-zmle189067h12d1
gggactaccaagctcctgctcaccattccaagaatcctttttctttttttagagctgtctatgccacttgcggctgggagtacttccgtgggacgttcatctttcctggcgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgaaatgtgcatgactggtctggacaagaagaaagcttctgtctttttcaagactaatgctgatgggaacacatcatgtgccaaggaaatgacaaagctctctggcatctctgaaatcatccccgagatggagatctgcgactttgactttgaaccctgtggctacttcatgaatgcgatccatggctttgcattcttcacattccatgtgacgccccgaga

SEQ ID NO: 27845 - DNA, 403 bp, Zea mays
  Clone ID: cC-zmle189068a01d1
gcatggctggagacaatgtcggactgctgctccgtggtatgcagatttatgacattgagagaggcatggtgctggcagggcccggctctatcacaccgcacaccaagtttgaggctgttgtgtatgtgcttaagaaggaagagggtggccggcactcacctttcttccctggttaccgcccgcagttctacatgaggacaaccgatgtgacagggaatgtgactgtgattatgaatgacaaagatgaggaggcgaagatgtgcatgcctggtgaccgtatcaagatggttgttcagctcatccagcctgttgcttgtgagcagggtatgaggtttgctatccgtgagggtggtaagactggtggtgctggtgtcatcaacaaaatcattgagtaaactggata

SEQ ID NO: 27846 - DNA, 536 bp, Zea mays
  Clone ID: cC-zmle189068a02d1
ccgcccagtccggcctcgctcgccactcggagtctcggagtcaaccgttctcgcctcgatccggcgaagccagcccagcggatggcctccggcgccgtaccaccgcagcgggtcgccctgctggcgctcgccgccgccctctccgtcgtctcattcccgcacctgtccctcctcgcctcgtcccatccgctcccgcaggaagctgctgctgctgctgcgggtgcggcggcgggaggcgaggcgtccgagcctcacggcaccgccgccgatggtgccgccgtggcgcggcgcgcgtgcacgtacacggtgcagatcaagacgagctgcgcgtccccgcggagctccgcggacgcggtgagcctcgcgttcggggacgcgtaccgcaacgaggtgtacgcggcgacggtgacgccgcggcgcgggttcgagcgctgcgccacggacacgttccgcgtcgccgggccctgcggctaccgcgtctgctacctctacctgcgccggtcgggccgcgcggccggtggacgcccgagtgggtc

SEQ ID NO: 27847 - DNA, 441 bp, Zea mays
  Clone ID: cC-zmle189068a03d1
gctgggtggttgcctttgtatacagggaggaatttcgcaaggagttctatgtttaagaaccctaagaacaagtctgggggtgcggtaagaaccctgagagctgctttatgaccggccccatattattactatctactttgacttttcccttaatgacgacttattatttgatttactcgtcacgattcccctctcctggtcgaacttttcaggtggggaaagctgctggcgacaggtggaaatccctgagcgagtcggtaagctccatcttctgtactaaagtagtagttgattggactagaaatctcgtgctgattaattgttttacgcgtgcgtttgtgtggattgtaggacaaggctccctatgtagccaaggctaacaagctcaagctcgagtacaacaaggccattgctgcctacaacaagggcgagagcactgca

SEQ ID NO: 27848 - DNA, 344 bp, Zea mays
  Clone ID: cC-zmle189068a04d1
cgcccacgcgtccggaaagaagttcagaagaaggggctgctcaacaatactcaatgccccaatctcagtcgctgccctgcgcaagctggtgcgcgctgctggcctgggttgctctgcggctgacgccgtgggagtggtgccgccggccgtggaatgaagatcttcagcctatgttccaagcgcacgttggaggtcggcgtccgtgcgtatgtggctgtcggccgtttttggttcgtctggtgggctggttcgctttttggtggtgggcgggtttgtggagccggtttctggcttttggtggttaaggctaaactttctgggggggttgcttaactttgtccctt

SEQ ID NO: 27849 - DNA, 449 bp, Zea mays
  Clone ID: cC-zmle189068a05d1
gccgacgcgtgggcggacgcgtgggcgtacgcctgggctggagctttctctttttgctgccagggacaacaagaaggcgcgcgtgattccgtgccacgtgcttctggcgatccggaacgacgaggagcttgggaagctgctgggcggcgtaactatcgctcacgggggtgtgctccccaatattaaccctgttctgctgcccaagaagacggtggagaaggcgtacagtgtggggagcaaggaggcaaaatcactccaagaaggccgccaagtcccccaagaaggcatagactgactgtatggagtgatctgatgtttgagaggaccttgataccattctgctgtgatgcgtagggtggagatgggtcaaatgttcttgagtgtgaatgtgccctggtgcaagtggccctttgctatttaaaatggaagaggaaaagcctggttttctg

SEQ ID NO: 27850 - DNA, 321 bp, Zea mays
  Clone ID: cC-zmle189068a06d1
acgcaaacgccagctcgtggacgaaaacggcggcctgcctctgcgcagcctgtttttccttttgaggagcgagaccccgagcgcggtcgagcgggtggtgcactacaacctccagcgggttcggtcgaggaaggtgctgggctgtgcttgcatgtgacatggcatgtgcgagtggtgtagtgtaaccgacactgacgcgggcccaccaacctcgaggagcatgcatctggcagagcaactctaatagctgtgtaaaaaataactccctaaatggatgcttagcacgctggtaaattaattttgacaggatggaatgaaatg

SEQ ID NO: 27851 - DNA, 407 bp, Zea mays
  Clone ID: cC-zmle189068a07d1
gcgtccggcatggtcatgggcgacgacatggtcaaggtcgttttctggtactacaacgagtgggggtacagccaaggggtggttgatctggcgcacctggtggcggccaagtggcccggcgccgtggcggccggcagcggcgaccctctggaggacttctgcaaggacaaccccgagaccgacgagtgcaaggtgtacgaagcatgaggccagggttttttccacgacgaaacgtacagcacgggcgcgagggttctttccatagagaataatatacagattattcgcccaaagagacgtatgttatattatatgagttgtatgcagtcaccgaactggtacaggcttccgctttccatttcctgttgggagtcgtgtagtgtaatcctggggtgtgtatttggttc

SEQ ID NO: 27852 - DNA, 200 bp, Zea mays
  Clone ID: cC-zmle189068a08d1
cggagaaccatgacaacacacgaactgccaagcggccgcgtacagccattttctgttttttgctggggcacccgactgctcggggtgcaccggacagtactacagtgcgccatacccccgcggagcccaccatccggtctgggaatatcttccggacacctgggctaaaaatcaccggactgtccaacgtgcaccgtact

SEQ ID NO: 27853 - DNA, 404 bp, Zea mays
  Clone ID: cC-zmle189068a10a1
aagcccccctctcgcagggttatcacgagcataaattttgtacatgattgtacagcacgctgactagctacgggtgtagctctgtcgcgcataccaggaatgaatattcttcttctctctggtaaagcacggaggcttcaacttcagtctatttactgcctatccaagaacatgcatgtagtcagcacagggggcctggaagccagctgtcgctgtcgccaactctttgaggaaggagacaacctcctccgacgagctcaaaaggtagcgggcgttggaccgctttctcccgacggggcaggagaagtagttctcgcccttgagatcaaggacggaggacccttcgcgccaaacgtgattgctgctcgtgctgctgtgacttgatgaggatgacctttcggatg

SEQ ID NO: 27854 - DNA, 531 bp, Zea mays
  Clone ID: cC-zmle189068a10d1
ggtggacctataagtatgctgatgttgagttcggaaggctacaagctttatatattcttcagcacttgtggacaggtccggggtcaaatgcggctgttgatgttgttcaagggagtcgatcatttgaagttcggtctgttggagttaccaagggtgctgcaattgatcgtattttaggggagatagttcacagcgaaaacatgattactccaattgactatgtcctgtgcatagggcatttccttgggaaggatgaggacatctacgttttctttgatcccgagtacccttttgaatccaaagtaaagccagagggcggctcagcatcacttgaccggaggccgaacggtaggccaccatcgaatggcaggagttactccatgaacccacagtccagtacacataatgcgcatcaggctgcatccgagaggtcattctcatcaagtcacagcagcacgagcagcattcaccactggcgcgaagggtccttcgtcttgatctcatggcgagaactacttctcctgcgccgtc

SEQ ID NO: 27855 - DNA, 348 bp, Zea mays
  unsure at all n locations
  Clone ID: cC-zmle189068a11a1
ttttattttttttttttttttatttcatttatattataaaagggttttggtttattttttttatttttttaatcctcttcataaaaaaaattaaattttataaaaaaaacttaacataattcactttcccaccaaaaaaaaaaaaaaaaattccttcaaaaaaaaaaaaaaaaaaaatagaaaaaaaaaaaaaatattacaacccaaaaaaaaaaaaaaaaatttccccttcctaactcgggcgaatcaaaaaaagggaaaaaaaaataattttgctctcccaacacaaacagaaaaaaacttttctcctccaaaatgggggaaaaaaaataaaacnaaacacctctt

SEQ ID NO: 27856 - DNA, 351 bp, Zea mays
  Clone ID: cC-zmle189068a11d1
cggaaatggtgtccatcacatgagcaaggtaaaaatttttgggtgctttgcagatccgacaagttcatggggggcaagtgacctctcatgataggaacttctccaggggaatatatctgaagcacaggacgacacgtacaagtaatgtaagccagtctcacgtaatggaaaatttctccatgcggatgtggtcaaagcataggattctttttctccaattgttaactgtacgcgaatggaagcgacagatcattcgtaggttgtgagggcttcaaagatcatctgctgctgtacatgttttgttgctgtcttgtgaacatacatgtcttgttgtttaaaaaaattaatatt

SEQ ID NO: 27857 - DNA, 284 bp, Zea mays
  Clone ID: cC-zmle189068a12a1
cccgtgaggcccaggccgagctttttgtatcatgaggtgcgccagcgcgacgtggggcgcgaacggggccacggagcaggcgacgagcgggagcacgacggactgcgtctgcaggtagcggagcaggcactgcacgaaggagaaggcgaagaggccaggcgcctgcgcgcggacgaacgccgccgcggcgcgggacgcctcgggctcctgccgcaggagcaggagcaccggctccgtgaaccaccacagcgcggagacgagcgccgacgcgggggccgacatga

SEQ ID NO: 27858 - DNA, 371 bp, Zea mays
  Clone ID: cC-zmle189068a12d1
ggggcttttggtggacgcagacgaagcgcgggcgcaagtggatgttcacgttgccgatggtgctgaccaacatggtctactacggcatcccgctggtgtcggtgatgttctctgcccatctcggagactttcatctctacagcgccacgctcggcaactcctgtgccaccgtcaccggctacgcgttcatgaacggtctgagcggctccctggagactctgtgcgggcatgcgtacggcgcggggctgcaccgcatgctgggcctctacctgcagtcgacgctcatcatgtctgccgcctttctgcgctcttctgcgcgctgtggtggttcacggaacccgtactcctgctcctgcggcatgagccctatg

SEQ ID NO: 27859 - DNA, 517 bp, Zea mays
  Clone ID: cC-zmle189068b01d1
gaccgataaggagccgaggccaccttctcgctgcttggcttttctttatagctccacccgaccaagtacgcgggctgctcgcgagaagatgcagaagtacggcgccaccgggtggctcgtcaacaccggctggtctggtggcaggtacggcgtgggcaagaggatcaggcttccctacaccagaaagatcatcgacgccatccactccggcgagctcctcaccgccaactaccagaagaccgaggtgtttggcctggagatccccactgagatcaacggcgtgccgtcggaaatcctcgacccgatcaacacctggacggacaaggccgcgtacaaggagaatctcctgaggctcggcgggctcttcaagaagaacttcgaggtgttcgccagctacaagatcggggacgacagcagcctgactgacgagatcctcgccgcaggccccaacttctgaactaaagcaatggatcccgatgaaatatacgatggtgtgtgtgcctgcgtgcgtgtgaag

SEQ ID NO: 27860 - DNA, 405 bp, Zea mays
  Clone ID: cC-zmle189068b02d1
acgcaaccgccgaggcgtgggcggacgcatggacacggtatctacaatgactcattttctgtttcttcatgccacgaggaataccgggggctggtggtggtattgatgcttgccatatgccaaccctgcaccgaaatctttggagataactaccgattacaatttgccggctgaacactaggacatccccgggaagatgcacctggagcagcaactaatcaagtggctatagaagcctgggtacaagctcataacgaagggcgcgagcctgctcatgaaggtaaggaaagcatcaaagcaactcgcacatggaggggtgaactagccacagctggtgaaatatcgaatgaaatcaaataagatggtatcaaagcgactgttaccatatcctctaacaaaaaatac

SEQ ID NO: 27861 - DNA, 141 bp, Zea mays
  Clone ID: cC-zmle189068b05d1
cacctcggtcttatttgcgcggctggaagtttctgtttgactgcctaggggtggggtgggaaatcactgtgtaatatcgtgtctgagctgacttaagacggcatcttacattaacatccctgatcatgattattgctcagc

SEQ ID NO: 27862 - DNA, 615 bp, Zea mays
  unsure at all n locations
  Clone ID: cC-zmle189068b06d1
cgcctccgcccacgcgtccggctctttattcttgcggcctgggctgggaaggactctggtgttgtagctggcctagtgggttgtgggttggtgaaatcactggtgtcaatatccgctgatctgatgcatgacttcaagactggacatcttacattaacatcacctagatcaatgattattgctcaggctattggcactgccatgggctgtgtcattggaccactgacatttttactgttctacaaggcttttgacattggaaaccctgatgggtactggaaggcaccatatgctctaatctaccgcaatatggcaattcttggtgtccagggcttctctgctctgcccctgcattgtttgcagctgtgctacggattctttggatttgcagtggcagccaatctgatgagggacctcttgccaccaaagtacggcaaatgggttccattaccaatggcaatgggggttcccttcctagttggtgcgagctttgccatcgacatgtgtgtggngagcttgatggtcttcatctggcacatcattgacagaagtaaagcaatcttaatggtgccagcagttgcatctgggttgatatgtggcgatgggctttggatc

SEQ ID NO: 27863 - DNA, 511 bp, Zea mays
  Clone ID: cC-zmle189068b07d1
gagtttgaactcgccgtcgccgtccatctgccatgggggcgacttttcgtctttgagtatggagaaggaagcaatgggacgtgatgcggttcgttcaacgcgtgcgctgttgggagtacaggcagcagccggccatcgtccgcctcacaaggcccacccgccccgacaaggcccgccgcctcggcttcaaggccaagcaggggtatgttgtttaccgcgtccgtgtgaggcgtggtggcaggaagaggcctgtgccgaagggtattgtctatggcaagcccaagcaccagggtatcacccagctcaagttccagaggaacaagagatctgttgctgaggaacgggctggacgaaagcttggtggactcagggttctcaactcctactgggtgaatgaggatagcacctacaagtactttgagatcatcctggttgatgtggcccacactgccattcgcaacgacccaagaatcaactggctatgcaatcctgtgcacaagcatcgtgagct

SEQ ID NO: 27864 - DNA, 314 bp, Zea mays
  Clone ID: cC-zmle189068b08d1
gtccgcccactcgtccggcatccccctcccgccgcgccgtttcaccgccttcggagaagatgggtcgcgtgatcggcgcgcagcgtaagggtgcggggtccgtgttcaagtcccacacccaccaccgtaagggccccgcccgcttccgctccctcgacttcggcgagcgcaacgggtacctcaagggcgtcgtcaccgacgtcatccacgaccccggccgtggcgcgccgctcgccaaggtcactttccgccacccattcatgtacaagcaccagaaggagctctttgtcgcatccgagggcatgtacacgggc

SEQ ID NO: 27865 - DNA, 92 bp, Zea mays
  Clone ID: cC-zmle189068b09d1
cacgcgtccgaaaaaaaaaaaaaaaaaaaaaaaaaaaaaaaaaaatttaaaaaatttaaaaaaaaaaaaaaaaaaaaaaggggggcgggggt

SEQ ID NO: 27866 - DNA, 432 bp, Zea mays
  Clone ID: cC-zmle189068b10a1
aaaaaaaaagggcaccaatgtgcaacggcaacgtccattgaaacatgatgttatgcctagccttacacaaacattaagtccacctacaaattaaaatcgtcactttagcaaatctcacaagcaaaagttttaagggggccagctattgcctgggtagcatttttcagttgcagcaaaaaaggatacattcccccgcttgcagagccaggggcgcatcagcttcctactttgtagctcagcgacagcaaaaccatagaaccatacagtccacaggcgcacttgcataattgaagagcaaccaaagggccttgaatcccattttggtagtctgcttactggtgagcgcactgcactctttgggctccgccaggcatttcgtcgtcctccttgtacgccttctgagcaacatgagcctgcttcctgcgcattttt

SEQ ID NO: 27867 - DNA, 605 bp, Zea mays
  unsure at all n locations
  Clone ID: cC-zmle189068b10d1
gcggacgcgtgggcaggcagcttctgatcaaatcaaaccccggcgaatttgttaaacctgaccaattcaaggcgataaatgaggaggggatgcctatttaccagaggcccttcatgaaggggaagctctacattcatttcacggtggagttccccgactcgctggcaccagagcagtgcaaggctctcgagtcggtacttccgccaaagccttcgtccaagctgacagacatggagatagatgaatgcgaggagacaaccatgcatgatgtgaacaacatcgaggaagagatgcgcaggaagcaggctcatgctgctcaggaggcgtacgaggaggacgacgagatgcctggcggagcccaaagagtgcagtgcgctcaacagtaagcagactaccaaaatgggattcaaggcactttggttgctcttcaattatgcgagtgcgcctgtggactgtatggttctatggttttgctgtcgctgagctacaaagtaggaagctgatgcgcccctggctctgcaagcggnggaatgtatncctttttgctgcaactgaaaaatgctacccaagccatagctggctaccttataacttttgcttgtgag

SEQ ID NO: 27868 - DNA, 278 bp, Zea mays
  Clone ID: cC-zmle189068b11a1
attgctatgggcacatatatatatagggacaggcctatattgcagagcaaaactgcaaaagcatgttcccatatgatatgacagtgtggagatagctagttaaatagcatgcagcatcttggtggtcatgggaagagctggatatacccagtgaggacaccgatagctagaatggcgagaggggggacaagcacaaacgcgccaacgggcgcaaaaaacaccgagtcgttccgcccgctgacctgggagagcagggcccgccttttgatgccccccct

SEQ ID NO: 27869 - DNA, 527 bp, Zea mays
  Clone ID: cC-zmle189068b11d1
cgccttcgcggcaacctgcgctcgcgccatcagcgcgtcgatccatcatttccatggcttgcagcttcccgccttcctccggggcgaggctccatgccttggacgccgcggcggcgggggtgaagaacggcagggtccccctcaaggcctccgtcgcccccgcgcagaggtcactcggttgctgcagggcgaccgcgcggcaggaaggcgctacacaggaacccagtgttgcagcttcttcggcccgtgcacagctggacctcctggagcaactgacgtccgccacacctgatgacgctgcggctggcctggagaacggcatgcctccaccagaaccgcgtcggcgtgctaccatccgcgagcagctgtcaacgctagccaacggtaaggtcgacgagttcaccctcccactgggcaagaggctgaaggaaggtctgaagaggctcaactccctcaccgtgtcgcagaggaggaacatcaagaggcaggccctgctcacccaggtcagcgggcggaacgactcggtg

SEQ ID NO: 27870 - DNA, 470 bp, Zea mays
  unsure at all n locations
  Clone ID: cC-zmle189068b12a1
gccggcgccaataggaccctgttttgcgtttttcgccggagttggtcatgatggccgtcatggaggtgagcaggcggccgtaggtgacaccctgcggctcgcgttccaccgccgtgatgaagctgtgcgtcatggcccccatggtcgcgcaggcctccggtttctgcgcactggccacgctggacttggctttgccgtcactgtagccgctgatgagcatcgccttgccgccgctcgtgcccctgtaggcgccggacggggggctctcgtccttccactgccagctcccgcttctggacatgttgcagcanaacgggaggtcgaggacggtggcgctgtggcaggcgtcgacgacggcgtgcagcttgacaccgtggaccagcgggcggaccatagtctcgttgatctcgtcgtccaagatggggcccttctggaacgagtccatcgggcagatggccttgtcgtacccg

SEQ ID NO: 27871 - DNA, 516 bp, Zea mays
  Clone ID: cC-zmle189068b12d1
accacccgtcctacctagcaacgcgcagtaagcagcgtgggcaaagtttcgagcgtctttgctagcttcgccatgaacatgggtggggtggccccgtcgacagtccggtgcaagcactgcatcacgcatctcaccgtgtgccccggcgagcgcgccatccagtgcacgcaatgctgcggcgtgactcgtatccggcggcggctggtccatcggccggcggcggcgccgcccaccactggctttccgcgcgcccgcggcaagaagcgggccctcctgatcggcattacgtacgccggcacgcgccggggctgcggccagctgaggggggcccttcaacgacttcaagtgcatgaggcaactcctctgccagcgctttgtcttccccagcgactgtatcatcatgctcactgatgaccagaaggacccgttcatgctgcccaccaaggacaacatccggttggggatgcactggctggtggaggggagcaacgagggcgactccctcgtgtttcactt

SEQ ID NO: 27872 - DNA, 420 bp, Zea mays
  unsure at all n locations
  Clone ID: cC-zmle189068c01d1
cgcaaccgcccacgcgtccgcgcaacccccaaacccaaaaccctaccacggcgttcatggtttcgccgccgccgccgcctcctccggctgcccggcaccccacctccgcagcaactgccgctgcggcgggcaatggccacgacacctccgcagcaaccgccgctgcggcgggcaatggccacgacacctccgcttcgccggtggacgccctcttcctccagaacctcatgacccgcgtccagctccgcccgcccttcctcgacaccaactcattcctcactcaggaccttgacgacttcctcctcaacgagttcgccgcgctatccgccgctgcaggggcgtcggatgatgacgaagacgtggaggatgaggatggtgggctcgctggcggggagggctccggngaggctaggcggcgga

SEQ ID NO: 27873 - DNA, 594 bp, Zea mays
  Clone ID: cC-zmle189068c02d1
cgcccacgcgtccggcttctcaaccggataggtagcaccggagcatgttgaacgctgcacaatccccttcgccgccgccgagatggtgaacgttcctaagaccaagaagacgtactgcaagaacaaagagtgcaagaagcacacactccacaaggtgactcagtataagaagggcaaggatagcctgtctgcccagggaaagcgccgttatgaccgcaagcagtcaggatatggtggtcagaccaagcctgtcttccacaagaaggccaagaccaccaagaagattgttctgaagctgcagtgccagagctgcaagcactactcacagcacgccatcaagagatgcaagcattttgagattggtggagacaagaagggcaagggcacatctcttttctaagcttctcgtccacctgtctggttgttgagttgaagctgtgggtctactactactgttataaaaacatgtcgccaaattttaatgttaatgtagcaatgaaagcagaccatgctatgtatccaaattccaatgcctgacatttgttctggggtgttggtcgacttttggctaaatgaaagttttgtggcttgaat

SEQ ID NO: 27874 - DNA, 585 bp, Zea mays
  unsure at all n locations
  Clone ID: cC-zmle189068c03d1
cgcaggatgcatttgctatccaaagcaacgagcgtggaattgctgcttttgactgtggtgcttttgcatgggagattatggcgggtcaagttcctgttggtagaggaaaacccccaacattaattgagagagatgaaagcctggataagtttgacccagtaaaactaaagaaacttcgcccaagtttcaaggagaatggtggtacagttacagctggaaatgcttctagtataagtgatggagctgctgcattagttttagtgagtgggcagaaggctcaagagcttggccttcaagtccttgcaaggatcaaaggttatgctgatgcagctcaagctccggagctttttacaaccactccagcacttgcaataccaaaggctatcgcaaatgctggattagagtcatcccgtgttgatttctatgagattaatgaagccttttcggctgttgcgcttgcaaatcaaaaacttcttggaattccttcagaaaagattaatgttcatggaggagctgtatccttatgacatcctctncggtgcagtggtgctcgcatcttggtacccttattggtttctcagggcg

SEQ ID NO: 27875 - DNA, 414 bp, Zea mays
  Clone ID: cC-zmle189068c04d1
cgcgtgaacgtgtccctggagaacctcaagacctaccccttcgtcatttaagggcttgcaaatgggaccctcaagctgaggggcgcccactacgactttgtctcaggagagttcctcacatggaaaaagtgaaaaactagggctacggcaattctaccggcccgccgactcctgcatcatcataaatatatatactatactatactactacgtacctaccgatatgcacccgagcaatgtgaatgcgtcgagtactatatatctgttttctgcatctacatatatataccggatcaatcgcccaatgtgaatgtaataagcaatatcattttctaccacttttcattcctaacgctgagctttttatgtactatatcttatatgatgaataataatatgaccgccttgtgatct

SEQ ID NO: 27876 - DNA, 346 bp, Zea mays
  Clone ID: cC-zmle189068c06d1
cgcagggttcaaggcagcagctgtcgcgaccgtcgcctctgcagttcccaccctggttagcgtcaggatgctgccatgggccaaggccaacatcaaccccgctggccaagccctcatcgtctccacagttgctggcatggcgtacttcatcgcggcggacaagaagatcctctcgctggcgaggcagcactcgtaccagaacgcgccggagcacctcaaggacacctgcttgcagggcaccggccgtccgcacccaaggtttttcaggctcttgagcgagaaaccattaaactaccgcccttactagctggacgcactatttctttaacggccgctttagaggatc

SEQ ID NO: 27877 - DNA, 450 bp, Zea mays
  Clone ID: cC-zmle189068c07d1
ggtgactccatgacaacaagggacatttttcatgttgtccaacctactatattcagtttttcaagccctggagctgctggtggggcacaggagctctggcttccctgtggttgaccatgactggaacttggttggggttgtatcagattatgatcctctagctttggattccatgtcaggaaatgaattggccgatacatgttcaaacatgtttcctgatgtggatagcacatggaagacattccacgagctacataggatattaagcaaaacttatgggaaggtcattggtgatgtaatgacctcttcacctttagcggtgcgtattaatactaatcttgatgctgctacaaggttgctacttgaaacttaataccggagactacctgtacttgatagcatggggaaactagttgggatgatctacaatgggaaatgtcgtcagtgctg

SEQ ID NO: 27878 - DNA, 463 bp, Zea mays
  Clone ID: cC-zmle189068c08d1
ccggagacactcggcgagcgttaaatgaagaaggccttccgatatgatattttcaaaatctaagagaagcaaaagccggtggatgaggagaagacaggggctactactgaaagctatgacgactctttggcctctgtcccagagaatgactgccgatatgcgctgtatgattctgattttgatactggggagaatgagcataaaagcgagattctcttcattgcctgctccccatcgacatcccgcatacgagctaagatgctgtactccacgtctaaggaccgcatcatgtacgagcttgacggtttccactacgaaatccatgcgaccgacccatctgaggtggacatcgaggctctccgggcgcgggctcactgaagctggtcctcctttcgacgggacccgtggagggccgtggaccttcaaccagatgcatattcaatcatcaacgatgaagctcccg

SEQ ID NO: 27879 - DNA, 372 bp, Zea mays
  Clone ID: cC-zmle189068c10a1
cattacggttcatttgttttttcatttccaacctgcaacacttcaaataaggggacgatagggcctatttaaccgtgcaacagcggtccacaggggtcaagatttcaccaaatgcactgacaccaactactaaaggtctagctgaggagttccacacgctatctggcccttgacccacatattctccggtaagcgggctggatcatgagaacgaactcatcgggcatcacctgcccggcaccggcggtgtgcgctcgcctgatcatatggttaacgtcctgggaggatatcttatcccggagactggtgattaccgtgctaaactgaacacggggagacgaagccgcactggattttggccaggaccttaaa

SEQ ID NO: 27880 - DNA, 584 bp, Zea mays
  Clone ID: cC-zmle189068c10d1
ggactaccaccccttcacctacccttctcctggcaactggcattggtcttttatactgtcttgctgtcagttgcatggacgggctgacggtggagcagaggctcgcgttccaggaggccttctcgctcttcgacaagaacggcgacggatgcatcaccatggaagagctggccgcagtcactcgctccctcggtctcgacccgagcgatcaggagctcaatgatatgatgagcgaggtcgatacggacggcaatgggatcatcgatttccaggagttcttaagcctcattgcccggaagatgaatgatggcgacggcgacgaagagctcaaggaagcctttgaggtcctggacaaagaccagaacggcttcatctccccggttgagctgaggacggtgatgaccagtctcggggagaagatgaccgacgaggaggttgagcagatgatcagggaagcagacaccgacggtgacgggcaggtgaactacgatgagttctgtctcatgatgaagaacgctgagcggaaaaaatcttggtgaagggcgcgatgtggtgtgaactactgaccagtactctagtagtcg

SEQ ID NO: 27881 - DNA, 361 bp, Zea mays
  Clone ID: cC-zmle189068c11a1
gaatcaaacataaaattttcagtacgatggggttgcagcacagctgcaaattaattagctatagcagttgataaactgtttaaatcgctaatatctaaacgacaaattcccacaaccttgtaacaccaaggtgtaccagaacgcaaagtctgtatctttggcaacagaaaagctgtggatacgctgatgtgcgtaagcagcctcacaaaaattcaccaagcaaaatggtgtccctcacccttggacccctacttcacagtaagaagcttgatgacggatgaaatccccatgcggtgcagggccacaacggattgaccggtgttgcataaccccatcgtcttcgcattttcaatggcaaaac

SEQ ID NO: 27882 - DNA, 469 bp, Zea mays
  Clone ID: cC-zmle189068c11d1
acctgcagtgacagggtccggaaggcacaacctcattgcgagggtcttcatctttatgctgagagccgccactgccggggcctttggcaactaatccactgactaagctattggttttgccattgaaaatgcgaagacgatggggctatgcaacaccggtcaatccgttgtggccctgcaccgcatcgggatttcatccgtcatcaagcttcttactgtgaagtatgggtccaagggtgagggacaccattttgcttggtgaatttttgtgaggctgtttacgcacatcagcgtatccacagcttttctgttgccaaagatacagactttgcgttctggtacaccttggtgttacaaggttgtgggaatttgtcgtttatatattaccgatttaaacagtttatcaactgctatagctaattaatttgcagctgtgctgcatctttatcggactgaaaaatttatgttt

SEQ ID NO: 27883 - DNA, 250 bp, Zea mays
  unsure at all n locations
  Clone ID: cC-zmle189068c12a1
aaacngaaccccaaccctgggaaaaaaaaaaaggtttggttcccccaacccccagccagcccccaagaaaaccccggcaaaccccccaaaaacccggggggcaaattgtgtttggacattaccaaagttaaaaaaaaccccccccaaaccccccggttgggcccccatttgcccccccccttttgtggggggtaaaagggcttaaaaacaaacccacacgtgtgtccccccttaacccatttttttgggg

SEQ ID NO: 27884 - DNA, 388 bp, Zea mays
  Clone ID: cC-zmle189068c12d1
cgaaggaccattagggatatcaacccaatgatcccaaacataacttattttttcagcgtttctctataacttcattgatggccgggccgacatgtgagtgcgctggtttatgatcactcgattcaggcattcctgccatatgatcgacagtggataaagcaaaagttgtttcaacacctgaagaaattggctcagcggtagcacaactgttgtttgttcttgatgccttttatccaacaaacaagcttgcgtgacaataggtgtccaatcagtggtattgggagttgtttcttgtaaactttgtaatgttacatgacagatttgctcccttgtattctggatgtttgactcggatttcattggtggcttgcttgtggttgtggaatgc

SEQ ID NO: 27885 - DNA, 507 bp, Zea mays
  unsure at all n locations
  Clone ID: cC-zmle189068d02d1
ccaggttcctcctaccagtaccagtgaggtctatggtgatcttttccattacccgcaggtggagacttactggggcaatggcaatcccatcggtgtcaggagctgttacgatgagggcaagcgtacagctgaaacgttgaccatggattaccaccgtggtgccaaccttgaggttaggatcgcacgtatcttcaacacatatggccctcgcatgtgcattgacgatggccgtgttgtcagtaactttgttgctcangcactgaggaaggagcccttgacggtttatggtgatggaaagcaaaccaggagtttccaatatgtttctgatctggttgagggtctgatgaagctgatggaaggcgatcatgtggggccattcaacctgggtaaccctggcgagttcaccatgcttgagcttgcgaaggttgtccaggacaccatcgaccccaacgcacggatcgagtttcgcaagaacacccaggacgacccgcacaagcgcaagcccga

SEQ ID NO: 27886 - DNA, 542 bp, Zea mays
  Clone ID: cC-zmle189068d03d1
acgccaacgcccacgcgtccgcggacgcgtgggagcctagctctatagctcgtgttttgcttgctctccacaagaaacaaggcagagcaccaacaatggccgccgcctcctcgtcctcggtcctcctgctgctcctggccgccgccttggctggcatgagcgccaacgccgccaccttcaccatcaccaacaactgcgggttcaccgtgtggcccgcggccaccccggtgggcgggggcacgcagctgaacccgggcgggacgtggaccgtcaacgtgccggctggcaccagctccggccgcgtgtggggccgcaccggctgctccttcaacggcaacagcgggagctgccagacaggcgactgcggcggcgcgctggcctgcacgctgtcggggcagccgccgctgacgctggccgagttcaccatcggcggcagccaggacttctacgacatctcggtcatcgacggctacaacctcgccatgggcttttcctgcagcacccgcgtgcggctggtgtgcacggaccctggatgccccgac

SEQ ID NO: 27887 - DNA, 436 bp, Zea mays
  Clone ID: cC-zmle189068d05d1
cgtggattgctagttagacattctgagttctagacatttccatttatggtttcttccttccagggataaattatggggtgcgctaactttatttttaagctgtctttaacctatatgccatcatacgatggtgcaggttcactattattcttgatttaagatctttaaaacaattggttcctagtaggatgttttacctgagcgtatgaccgtatgttcatattttatagtccaaaattctcgatttctctgatagggcccatactaatgttagtctagttcttggattgcttctgattgtactttggtataacccccttactcaatatggccattctttatcaaatgtatgatattggacaagttcctttcagtaatatattaggcattagatattattatcagcaaatgcttcttgctacccgattcctttttg

SEQ ID NO: 27888 - DNA, 406 bp, Zea mays
  Clone ID: cC-zmle189068d06d1
gaagagaccaggccgaaggaaaacaatcctgaaaccaagccatttttctttaggaggaatttgaggagcatgctgggaaggggaagaccttgcctgagagcacgagcaatgagaacaagctgatcctctacgggctctacaagcaagccacggttggagatgtgaataccgatcgtccgggcatattctaccaaaaggacagggccaagtgggatgcctggaaggctgttgaaggcaaatcgaaggatgaggcgatgaatgactacatcaccaaggtgaagcagcttcaggaggaggctgccgcctcttaaaagtctcttaataatgttgccaaacagctatttgtcagatgagctttgtgccatttcctcattagaagtatatcatttcgatccattggggatct

SEQ ID NO: 27889 - DNA, 75 bp, Zea mays
  Clone ID: cC-zmle189068d07d1
ttaagagactgcccttgcttgaatgaatataggtggtcaagcaattcctgtgataagaaactgcttatggagaga

SEQ ID NO: 27890 - DNA, 419 bp, Zea mays
  Clone ID: cC-zmle189068d08d1
ccgaccacgcgttcgttgacgcgtgggggttcaccagtctcgtcgtgtcctctcgcgatcgggcaaacctgcaaccctttcctggtcgtcccggcgctatctcgttgccccaagccggagtacggagtacggcagtcgcacccccgtcgttccgttccttgctcgccccaacttcgccgtcgcatccccctcggctgctcgctcctcgtctgcccctagtgatgtctggtggtaacgcgtggtcgccgctcccttcgcacggatttgacgacgactcctgcttgctcttttttattttgctcgtgtcgtcggatcgtggcttgattgatctccgcattccgcagatccgactcccgcggcatggggagccgcgcaagcgagcctgtggcgaggaccaacagcggcggcggcagcagcag

SEQ ID NO: 27891 - DNA, 335 bp, Zea mays
  Clone ID: cC-zmle189068d09d1
cacgcgtccgtaaaaaaaaaaaaaaaaaaaaaaaaaaaaaaaaatatctaaaaattttaaaaaaaaaaaaaaaaaaaaaagagggctgggggtataaaaaaatccaacatttctcaccccagagcctgcgactacttatctttccttttattgcccccttattttcattctttggccgtttttatacaacgcccttactggtaaacccctggcgttccccaccttttattcccttgtagcaaatccccctattcccctctggtttaatatctataaggccccccccgttccccctctccaacaattgcccatactgaatggccaatgggacttcc

SEQ ID NO: 27892 - DNA, 340 bp, Zea mays
  Clone ID: cC-zmle189068d10a1
gggggttgggtttttttttttttttttttttttctctttttttttttttttttttttttttaaaaaaaaaaaggttcccttttctctcaaggggaatgcctgaaaaactctttaccccccgtgttgggggggttttaaaaaaaagggggaaaccccccgcacccccccccccaaatttttttttccccgcccccctgttttttcttctccaaaaaccaaaaaacccccccctctttaaaaaaaaaaaaatccccccccccctttaacatttccctttgaaaggggccccccaaaagggtttttacccaccaaaaaaaccccccccccctttttttttttt

SEQ ID NO: 27893 - DNA, 676 bp, Zea mays
  Clone ID: cC-zmle189068d10d1
ccgggaacggaggctggaggatgctggttatgctgttggtgcaagggttctctaactatctctgtcacagggagaagggaaatagacgagagagacgacttctgggcattttatcattcatccacagtactgtttggaaagtgttgtttggaaaggtggctgactcacttgaaaagggaacagatcacgaggatgaatacatgatcagtgaaaaggagcttcttgttaaccgtttcatttctgtgccaaaagacatgggagcattcaactgtggagcttttgttgcgggcattgtaaagggtgtattagataatgccggctttcctgccgtagttactgcacattttgtgccaattgaaggccagcaaaggccaagaacgacaatcctgataaagtttgctgaagaggtattacacagagaagcaagactgggctgagtttttatgtatgtacacaaaacctttgactagcctatttgtaaggtgaatcgttactggagtttggtgatttcttgtatttgagtaggtcggcgatttcttgtatttgagtatggaatagcagtgtgactgagaataaagttatgtaggggaaacgcagtgctttataatcttatgaaatccaccaaactgctgtatatgctttccttgcttaccttgattaaagaatcttcattttt

SEQ ID NO: 27894 - DNA, 221 bp, Zea mays
  Clone ID: cC-zmle189068d11a1
gttgggggcggggttttttttaaaaacctttattttccaaccccacctaaaaaacaataaaaaaaagggcccccccaataattttctcttgcaaaaaacaccctggttatttcaaaacaaatggcccaaaggccaaacattgaaaaaaaagaaaaaaggttgcgggtctaccccaaaccggctggaaaaaaggcataaactgttgcagaaaaaaaaagaaa

SEQ ID NO: 27895 - DNA, 613 bp, Zea mays
  Clone ID: cC-zmle189068d11d1
agaccaacaagcaacatagaaagtggaatccagtagcaacaatattttaacaatttcgaccaagatattttccctccttgtgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacattgaaccgtgctgcttatttgcagcaacaactattaccattcagccagctagctactgcctactctcagcaacaacaacttctttcatttaaccaatttggcgcactgaaccccgctgcttatttgcagcagcaaatactactaccatttagccagctagctgcagcatgccgtgctttc

SEQ ID NO: 27896 - DNA, 294 bp, Zea mays
  Clone ID: cC-zmle189068d12a1
atattacatgcatcgtacaattacctatatgggccagaaatatgatatctggccaaccagccgagttcaaaccaaatgtctggaaggccagatcgtggtgtcgtcccttgtatcgctgcttatcccttgaatacgtatgcgtcctcgtgagctggggtgagcttgtcgtgtagcagatccgcgagcctctggtactctgggtccgactcgacgtagctgaaccgctggaggttccagttggtgccctccgccgcctggtcctttggtttttgtcgctgctcgttctcgatcctg

SEQ ID NO: 27897 - DNA, 568 bp, Zea mays
  Clone ID: cC-zmle189068d12d1
ccaacatgcctgagaaagaaccaggagccgacgtcccggccgagcagattttaggattttccagcttcatcaagtcactcgcggatatgaccggcgatctgtcaagtatgaccgcgccacccttcatcctctcccccgtctccctcacagaattccctgcatactggtgcgagcaccctgatttgttcgctgcgatctcggctggggccacaccacaggaccgagtggaacgggttctgaaatggttcattgcgacattgaagggacagtacaccaccagaaacgagaagatgggatctgagaagaagcccttgaacccagatctcggagagctattctacggaacttggccagacgccaacggtagaggcgagaccgttctggtcgtggagcaagtctcgcaccacccacctgtcacggcttacttcatcgagaacaaaactgccggcgtctctctgcagggacactcgggtcagaagacctcgttctctggaacatcgatcaacgtcaagcagtctggtcatgccccgctgacggtcaagccgagatcccgagggcaggagacata

SEQ ID NO: 27898 - DNA, 74 bp, Zea mays
  Clone ID: cC-zmle189068e01d1
cgcctccggccgccgcccaccgtgcccgcgattccgccccaatcacctctggttctcaagtatggggaggaacc

SEQ ID NO: 27899 - DNA, 568 bp, Zea mays
  Clone ID: cC-zmle189068e02d1
gcctccgggacgcgtgggcggacgctggtaagacgacttgttttttgtttcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgtgtggtgtgtgtgagagagagagaaacagagttcttcagtttgctattctctctctgcatgcttggcgtcagtctttgtgctcatgtacgtacgtgtgtctacctgcatgttggttgatccgattgcatctgcttgtaccatt

SEQ ID NO: 27900 - DNA, 467 bp, Zea mays
  Clone ID: cC-zmle189068e03d1
gaggtaacagagcaacgccagccacacacgacacgaaccatttaactctttgccgaggaaccctagcggaacgctgtgcgggtgacggcggcgcgctaccggtgacgggggatacggcggcatcgtccccctcggcccctcctccatccccggcgcggcggcgcaggcagccagccttcagggttttctgactcagattacttgttcactgtggggtgcaagcttaatcggccaccatggatgttgataagcaagaaacaatggaggagaccatccttgttggcgatgatctcatgcgtgggccgccatcccctgtcataccgaaagagatcgcatcacatgttcttgaagaagttgagctttgtgatggtatactcaagaaccttttcttatgcctacagatcaatgatattgagcccttctgccaagatgaaattgtgctatatcgacagtgtgctgagaaaagg

SEQ ID NO: 27901 - DNA, 447 bp, Zea mays
  Clone ID: cC-zmle189068e04d1
ggcgacacgatcgcgagcgcacgcacgtaagcacgttgttttaagtttatgttagaagaagcaccagtgactgggcgagggcggcccatgctctcctctccggccggcagctgctgggccgccccgtgcagtcggccgtctctaggtcgtcggcgaggaaggcgcccttcgacgtcagggccagctccagccctccagccaagcaaggtgccgacaggcagctgtggttcgcgtacaaacagtccctctcctacctcgatggcacgctgcccggcgactatggcttcgacccgctgggcctctcggacccggagggcaccgggggcttcatcgagcccaaatggctggcctacggcgaggtgatcaacggccgctacgccatgctaggcgcggtgggcgccatcgacccggagatctttggcaagatgggcatcatacccccggaga

SEQ ID NO: 27902 - DNA, 288 bp, Zea mays
  Clone ID: cC-zmle189068e05d1
gaggagcaggggcaggggcagcacgaccaggaccagtttcagttttatcaggaggagcaggggaacgcgggggcgggggcggaggatccggaacagcaggacgaacaacaggagggggcggcggaggacgcggacatgagagaagcgggggaggaacgcgccgacggcgaagcgaaaaaaggtcagggggaaagtgaaggtggacgacccaaacccggaggaggaggcgaggcacctggaaggaatcgacgacaagaacagaaaacataaagaacagctggacccccc

SEQ ID NO: 27903 - DNA, 582 bp, Zea mays
  unsure at all n locations
  Clone ID: cC-zmle189068e06d1
aaaaaaaaaaaaaaaaangaagaaaaaaaaaaagaaaaaaaaaatggaaaaaaaaatagaaaaaaaaaaaaaaaaaggaaaggagaatagaaaaaagaaaaaaggaagagtaaaaaataatggaaaaaaaagaagaaaaaaaagaagaaaaaaagaataaaaaaagaaataaaaaaaaagaaaagaaaaaaggaggaaagaaagaaaaagaaaaagaaataagaaaacagaaaaaagaaaaaaaataagaggaaaagaaaataaaaaaaaaatgaaatacaaaaagggggggggggggaaaagtaaaaaaaattaaaataaaaaagggaaaaaaaaattgaaaaaagggaaaatgaaataagaaaaagaatgaaaaaaaaagaggaaaataataaaaggaaatgggagaaaagggaaatagataaaagagaagaaaataaagggaaaaagaaaaggaggaaaaaaacaggaaaaaaattagaaaaagagagaaaaaaagaaagaacatggaaagaaaacaacaatggaaaaaaaaaaaaaggaggaaggggaaaagaaataaaaaaaaaaagttacaagagc

SEQ ID NO: 27904 - DNA, 442 bp, Zea mays
  Clone ID: cC-zmle189068e09d1
ccacgcgtccgcccacgcgtacgttttaacctttttgtcaggaggcttgaggtccggggggatgaggagtccccggcagagccggctccgactgcggaaggggagggcgccgtggccaccaagcccaaggccgataagccgtcgccgatcgggcccaagagaggcgccaaggtgaagatcctgtggcgggagtcctactggtacaacgggatcggcaacgtcgtcaccgtcgatcaggatcctaacacccgttacccggtggtggtgcggttcaacaaggtgaactacgccggcgtgtttaccaacaactactccttggacgatatcctctatgtgaaatgagtgaggccagtctgctcaaggaccccatgctcctgtgtgatttgtagttgtgaagtgaggctgctgcctatctgctacgctagctgctagcgtcacaaca

SEQ ID NO: 27905 - DNA, 276 bp, Zea mays
  Clone ID: cC-zmle189068e10a1
tttttttttttttttttttttttttctttttttttggggaaggggtaatattttatttttctataaacccacaacccacatataaaattataaatattaattttaaaacaccaaccaaaaaaataaacactcctcatcccttgtggtaaaaaccatttcctacaaaaatcataaaaaaaataaacaaaaaaaaaaaaacaattcaaacccacaaagaaaaagaaaaccaaataaacaatcacaacaaaaaatctaagaaaaacaactaactctcac

SEQ ID NO: 27906 - DNA, 311 bp, Zea mays
  unsure at all n locations
  Clone ID: cC-zmle189068e11a1
annncccaaaaaaacctctggggtcgggtttgatctattcaagctttagcatcacaatgttttaatcaggaaatctcttacaagggagccaaacaccacttgatactaaccgtcctatttttgctgttgttaagtaccaggaaaaccaggggtccaggtcaacttgcagaacagcacgaggcagctgtagatcctatgaagttgatttcacaagccttaaatctttattagccaccatgtctccttgataagtcgggaagcacccattaggccaaaattagcccacccaaaacacaagaatcttccaaaaa

SEQ ID NO: 27907 - DNA, 452 bp, Zea mays
  Clone ID: cC-zmle189068e11d1
cccgatgccgtaccactctagctgaactggtgcgtgaaaattttttacactttctgcatcagggcaagatctaaggggggcctgggggttatttttgaacaactggcgttcatcctgtcacgtctggctagaaaatctatgaagtaccatctttttgatgactcctgcgcccctgggcgtaccaattttggcctactggttgcttaccgacttatcaatgagacatggtggctaataaagatttaaggcttgtgaaatcaacttcataggatctacagccgccatcgtgctgttcttcaagttgacctggacacctgttcttcctgtgacttatcaacagctaaaataagactgttagtatcaagtggtgtatgtcctaccttgtaatatattactgattaaaacatagactgcttaagctagtatagatcatatttgcggaaagagaatta

SEQ ID NO: 27908 - DNA, 390 bp, Zea mays
  Clone ID: cC-zmle189068f02d1
tccgccttttctgcagcgacagggagtacataatcgcccggtttatattttagctggggggcgcctattattgggggacagagggcataccatgctcatccattccacggcgtagcagacctcggagagtcgatctgtattactcaagctggtgcatccgcgcagtggagtccaggagagggaacggaggaggaaggggggcgacggcctgtgaggttctgctgttccaccacgaggacatgggcatcccgtacgagatcgccaagctgggcattaggcaagggatgtgggggtgcgtgaagaggatcgagccggggctccgggcctaccaacacgcccgggccgcgggggcgccgccgtcccggagccccctgatggcccggatcaaca

SEQ ID NO: 27909 - DNA, 106 bp, Zea mays
  Clone ID: cC-zmle189068f03d1
gtgtagctaaaggaaaatagaaaaggaaaaactgaacatttttttttttttgcaagtataaccaaagctcatgggaagggatgatactattctttcgattctaaaa

SEQ ID NO: 27910 - DNA, 53 bp, Zea mays
  Clone ID: cC-zmle189068f04d1
gaaaaaaaaaaaaaaaaaaaaaaaaaaaaaaaaaaaaaaatttttttattttt

SEQ ID NO: 27911 - DNA, 114 bp, Zea mays
  Clone ID: cC-zmle189068f05d1
aaaaaaaaaaaaaaaaaaaaaaaaaaaaaaaaaaaaatttatattttaaaaaaacaaaacaaacaacaaacggggagggggaaaaaaaaaaaaaaaacaaaaccaaccaaaacc

SEQ ID NO: 27912 - DNA, 482 bp, Zea mays
  Clone ID: cC-zmle189068f06d1
cctccgacttggacggacacgggcgctgcgcacagacacaccttttgttttttccaatggcttactaccaggagggggactggtgctcggaggaggtgaggtcggtggcccccgccggcttcggccgtcacggcggcggcgtccagcagcacgtcgttaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcagggagagcttcctcgccagggctaactgagccgcccggcggccggcatccacgcccgttcgtgcttgcctgcgtgccttatgtatgtctgtgggtgactggttgtgcagggtcatcgtacttggctatcgtacgtgcacgcactcagctcctgtacgaattacgacaataagc

SEQ ID NO: 27913 - DNA, 551 bp, Zea mays
  Clone ID: cC-zmle189068f07d1
ccggtttttccccttcctgatctggatcggcgcattttttccgttttgctgctacggccatggcgggccgggccccttgtgcgcgcgcatccagttcgtccagtcgtcgtcgtatccgagcttcacgtgcacagatatcgggccgttcgtggagtctgagggaattgcaggaaaagaccctgagcagcagcagctttgtgaaggaccgagagatgatgatcgagccagtgatgtggtgccaaccacaagatgcagtggtggacgacctgaagaatgatggacataaccagtagatgcttgccaagcgagtacctcccccagcaaacactatctaagtgttaaattaaaggtacctccttgttctggttgatggagtgacttaaccttcatccctgccaccgggatagatggtcgagtgggttactactttcgcaggcgaggaccatgaggagttgcgtggccaggcttttccatgttactcggtttttctccgttagtatttcccttaatatttatagttattaattttgaaactcccgttattgaatcac

SEQ ID NO: 27914 - DNA, 569 bp, Zea mays
  Clone ID: cC-zmle189068f09d1
cgcccccgcccacgcgttctctgacgcttgggcacacaagcacttctttcgtcacttttgcgctgcgcacagacacaccaagggtcgggggcaatggcttactaccaggaggtggactactgctcggaggaggtgaggtcggtggccccggccggcttctgccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcatggagagcttcctcgccagggctaactgagccgcccggcggccggcatccacgcccgttcgtgcttgcctgcgtgccttatgtatgtctgtggatgactggttgtgcagggtcatcgtacttggctatcgtacgtgcacgcactcagctcctgtacgaattacgacaatatgctcgtgacctgaataaacttcttcgtaatactaatacctacatcaccatgc

SEQ ID NO: 27915 - DNA, 296 bp, Zea mays
  Clone ID: cC-zmle189068f10a1
aacaggccgcaaagcaaactgggggggggggaattactgccgtcggtcggacacccccaaacagaattacaaactttaggtgggtcaaaataccgcccccccatgagcatatgcctaagctagaggtatatatacacaggaaacatgaggagggccacaagtgccaactttggtttggaacaaatcaaccaccggcagatttatttcatccaccaccaggagcagcagcagccgctcaaaatccatccaactactgtaataaatgaagaagaatctcaaagttttttcccctctcc

SEQ ID NO: 27916 - DNA, 399 bp, Zea mays
  Clone ID: cC-zmle189068f10d1
cccgattaaaactagataaaacagcataacttatcccatattttttctttttttgtagcactcggaccctctttgggggcaccaggggatgatttaaaatttgttgcgcctgattagcacctgtttaatcgaaatatccatgaatcgaatggctactcaccaagtgagttcctagcttttctttttttctttttgcacttaacagcatgcgagtcttgtttgacaccatttttcttttttatggtgctttatattattagactactgatgctgctgtacagacaaccttgatatgtggtctacaaagttgccgataccagcacttcccaacaatcgtttggagaatggcacagcatctcatgtggccgtgccactctcttttgttattctcgaagccat

SEQ ID NO: 27917 - DNA, 403 bp, Zea mays
  Clone ID: cC-zmle189068f12d1
ccccgagcaagcgtttcatcaatcgctacctcaagagcaaccattttacctttttctccacatgcaactaattaaggggggagatggtggatggcaacttataatccaaccaacgatccaggaaactgctaatgagcctgccaaaatggaaaccattagtcaacaagttttgaagcaaggtccacaacatggtcgacgcaaagtccgatacaaatgtcagtactcatattgacgcgcaactggatataaacctgaacaaacgctaagactcacccgactaatatggtgagatctatgaagggacccccgaatgcgccctaaaagaagcataagttgatgcactgagggatccactgaaggagcagaagaggggctacttcaatgaccatttcaaggaccatgc

SEQ ID NO: 27918 - DNA, 608 bp, Zea mays
  Clone ID: cC-zmle189068g02d1
gcaacaagcaacatagaaagtggaatacagtagcaacaatttagcttttatggcggccaagatattttccatgcttaggctccttgctctttctgcatgtgttgctaacgcgaccatttttcctcaatactcacaagctcctatagctgcccttcttcccccataccttccatcaatgaccgcttcagtatgtgaaaacccagcccttcaaccctacaggctccaacaagcaatcgcaacaagcaacttacctttatcacccctgttctttcaacaatcgccagccctatctttggtgcagtcattggtacaaaccatcagggcacaacagctgcagcaactcgtgctaccagtgatcagccaagtagctctggcaaacctttctccctactctcagcaacaacaatttcttccattcaaccaactgtctacactgaaccctgctgcttatttgcagcaacaacaactactaccattcagccagctagctactgcctactctcagcagcaacaatatcttccatttaaccaattcgccgcactgaaccctttgcttatttccacagcaaatactactaccatttgccagctagctacaacaagccccg

SEQ ID NO: 27919 - DNA, 304 bp, Zea mays
  unsure at all n locations
  Clone ID: cC-zmle189068g03d1
cgcctccgcggacgcgtgggcggacgcgtgggcggacgcgtgggcgttcgcgtgtgtgggagcggttggcatcggtgttggagtggctgtgtatgcagtcatattccagcagaagaagactgcctctggctgagatgatgcctctcgctgcctgcatatggagacttattttgagcgacatttttttgaagttaaaagcttggacttcatcctatcttggttggtgcctgatactgcattttcttaccataagttgtaacctcgtttcttgcggtttggtgtaggacacgacttttctgttnnt

SEQ ID NO: 27920 - DNA, 543 bp, Zea mays
  Clone ID: cC-zmle189068g04d1
cgcctccgacttgaggtcttttatcacaagatatacaaggtatttgcttcaattttaaagattgaaaacatcaatgatcagtactggacactgcgtgcagaggaggttccagaggaggagaaaaatcttggccccttcgatcgtttgattcatgtatatcattttacaaaagacactcaaaaccaaacgcaagttcagaactttggagaacctttttttatggttattcgtgaggatgagaccctatcttctatcaaagaacgtatacagaaaaagcttaaggttccagatgaggatttctcaaagtggaagtttgcatacatttcactcggtcgtcctgactattttgaagattcagatactgtagccctaaaattccagagaaacatgtatggagcttgggagcagtatcttggactggaacatccggacacggctcctaggaaggcacacacggctaatcagaaccggcattcattcgagagacctgtagaaatttataactaggcatgttagaaatgagcgatgagctgccgctcaata

SEQ ID NO: 27921 - DNA, 330 bp, Zea mays
  Clone ID: cC-zmle189068g05d1
cagacctatgctaatcgttttccaccggctgatcgcggtaggaccttgagcaccggtcaactgcgctcaactgaccgctcaaggccctggacccatacccactgcggagcccttttccggctgtgcacatggctcggcccattcccaggctggagggcggaccgaagaccggcggtctctgcccacacccctgcttgccggccatcggggattccttacgcggcgacgctgcacgtcacccgcagctgccaaagagacgttctgtcagccgagactcaactgagcagctcacacgggtcaaagaattttgaaggcgcatttatccactct

SEQ ID NO: 27922 - DNA, 402 bp, Zea mays
  Clone ID: cC-zmle189068g06d1
gccccgaaacgggttcgcaacacaccagaccttacgcgcgggaaatttaaattttgtccaaacgcggcctgaactgtcgggataggggagcgctatgagcagcgcggctacaaaactcgccgccatcaagctcgtgaccgcctccaaagagcaccctctagacccactacgaagaccttgtcggtgagcccttctttcccgggctcggtgcctacaaggcctccggtcccatatgtgacatggcctgggagggccctgacttcgtcaagaccgggcgtgtcctacttggcgccaccaaccccctcgtctctgacccggcacaatccgaggtgacaacgacattcacctcggccggaacgtaggacacggcttctactccgttcaaatctgcccagaaggaga

SEQ ID NO: 27923 - DNA, 546 bp, Zea mays
  Clone ID: cC-zmle189068g07d1
gcccccgggcaatttggtggctaacacggctgcaggtattgttgtgttggacggttatcatgcctggaggcaatgtgggtgaggactaggccatctttgagcaaggcgcttctgcaggaaatgttgggaatgagaaccttgtggagcagaagaaagcaaaccctgtcgcgctgcttctgtcatctgctatgatgttgaggcatttgcagttcccgtcatttgcggaccggctcgagacggcagtgaagcgtgtcgttgctgaaggcacgtacagaacaaaggatctgggcggtagcagcaccacccatgaagttaccgatgctgtggttgccaatctggattagattccaggtgtacacggctaaaaaaggctaattctttggggtgactagttgtctagtcttgactcctgagtgttatttatcttcttacatagattttagattgcttcacatcttcaagagggattacaaggtatcccttgtttcagattttcttagaaaaaatattgaggaacccacgacgattcttgttcacgtgatactt

SEQ ID NO: 27924 - DNA, 192 bp, Zea mays
  Clone ID: cC-zmle189068g09d1
cccgaccacgcgttcgcgcatctgtatgtacgcgcgtatactttcctacttttttggatttgcgagcgtgcttcgtgccaaatatgaataagaataaacaaatatgactcgtgtcatatacacgaaaaaaaaaaaaaattataaaataataaataaatcaataatatttataatcttataatatcttcattg

SEQ ID NO: 27925 - DNA, 503 bp, Zea mays
  Clone ID: cC-zmle189068g10a1
tttttaaatgattgactgctttcaaggttcaacgtgaccatggactcatttacaaatcaatctgcaatgcaatcggatcgagcagaaagagaatgtacaggccctgcagaaaactgctaataaaaagaatattcacgagtaccatttgtgcatcacctaaaggaccggtaatcacaactcaggatcgcaaatgtggtagcggtagtactgaagaacacagcagagacatgacgaaaagttttgcggcgttttttccttagtgacctagacctcttctatgtcacggttgctcttgatgatgtcgaacttgcacaatgggcatgtagcatttatgtgaagccacttgtcaatgcagctgcagtgaaaatggtggttgcaaggaagctcacgtagttccacgccatcttcatacgggcataagcagatacagcactcctgtattaaaaaagggatgatcaaaccgagtaactcaaatgtatgtaatactatgtatttactcgggt

SEQ ID NO: 27926 - DNA, 601 bp, Zea mays
  Clone ID: cC-zmle189068g10d1
cgctcctgtcgaacatattctctcagctgaggatgcagtttttttttcttttttattaagttttaatgacatcattgtgttatgattctccttctgtagatacatttggctggcgctgaatgtgttagaaataccatttcatttgaacaattgtggaacattagaataatcgcagcagaaccgtttacaccatgccaccatgttaatttttacattccttgaggtctaaagtctagaatagttaacaatttcctacactggagcttgcattacaaatttgaaattgttgataggatattccctagatttgcaaaaggttagtttgcatggacattggaggagttttattttggaagttgtttccttctttagccagagttcttccttggttcagttgtgtttacatggcgatacattactccctctgtttcggtatggagtagaattatggcattattttgtcccttaattccataaatggacatacatggtagaacggtttctcccaaggcctacacaatagtgaaacggagggactagtatctttaagtttttgtataatgccaatttgcttattctttttatttgccttatgggatgt

SEQ ID NO: 27927 - DNA, 450 bp, Zea mays
  Clone ID: cC-zmle189068g11a1
agttgaagtggcaaatccatattggtgggggattttgccagccagaacaggttcataagacacctatactatccgatcctttagttccaacattttcatttgatacacaaaatagtagttagatatcaactatcagtacaattaacttatcgcggacccaaatgatagccgcagcacctcagctccgacctttacaaacacaggagcattggcgcatgcggcaactgcacatgacataagctcctccagctctgctgccctggcatagaaaaactcaaaaggcatggctgaccacatcaagcaatatacatccaaagccatggctgccaatcttcgcttcacccactgactggtatattaacaaattggtggattttttttttactaggatgattgatacacatctctattgtgcccttgcaaaatactcctccgtaccagaattagggg

SEQ ID NO: 27928 - DNA, 592 bp, Zea mays
  Clone ID: cC-zmle189068g11d1
ccccggtacctgtttaatgacaacagtgttatcagagtcgtttttggattttttgcactatcaggaactttggtggggcatctgggccatctcaaaaacttgcagaacctggagctctacagttataatattagaggcactattcctagtgaactcgggaatcttacaaactaggacagtttggattttgacttgatcaacttcaactggtcccataccagattcattgtggaagctattgaaactgaggatcttgcgttttaacaacaacagcctttttggttcaatttcaaaatcgttaactgctatcactgcactccaagtcctgtatctgtcaaataacaatttgtcttgagaagttccatcaactggttccttttcgttattcacccctatcagttttgggaacaaccctaatgtatgtggtcctggcaccacaaaaccttgtcctggtgcatctttctttttttcaacctctccatacaacccttcaacccctgtgcaatcaccatgaattagctcttccaatactggagcaattgcttgtggcatggctgttggtgcagccttgctatttggatattcctgcaat

SEQ ID NO: 27929 - DNA, 241 bp, Zea mays
  Clone ID: cC-zmle189068g12a1
tttttttttttattttctctttttttttataaaaaggggagggtgtttttttttttttttatttttacccccacaaacacaaaatatttaagattaaagaaaaattaccgcacacaactaattataatccccaaaacaaatacaataccctcattttataataataaaactatacccccaaaataaaacaaattacaaagaaagattgcccacaacaaaaaaaaacatactcttggcgtcc

SEQ ID NO: 27930 - DNA, 490 bp, Zea mays
  Clone ID: cC-zmle189068g12d1
cccgggcagtaggcgattacaagggtggaagaaacatctatctttaacattctcaggctacagcctaacccctctgggggataggggcagtggtagccaggacaagaaattcagagacaatgatcgccctgaagcaaaagaagctaatagcaccgcacagcatcttgttgacttcacggaagcagaggaagatcttgtttccagaatgcacaggcttgtggggaacaggtgggagattatagcaggaagaatcccaggaaggacagcagaagaggtagagatgttctggtccaaaaaataccatgaaagatgaaaccgaggccttagatttatatagatgatatatgcaagcatgtgctgataaataatgttaaactgggcctacaatgttaccggtttttcagcctgtgcacatcttgttatgacatgatgctaattttgcaaaagctcagttagataatttacagaacgtatgaaaaatcaatcatgt

SEQ ID NO: 27931 - DNA, 544 bp, Zea mays
  Clone ID: cC-zmle189068h02d1
cgcctgcggcagtgcgtagagaggatcgtcgaacagaacagcatgaatatggttttcgttctcgtcgtgtgcctggctgggtcaggtgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagacgagcgccatgtaccagccgctccggcaacagtgctgccagcagcagatgaggatgatggacgtgcagtccgtcgcgcagcagctgcagatgatgatgcagcttgagcgtgccgctgccgccagcagcagcctgtacgagccagctctgatgcagcagcagcagcagctgttggcagctcagggtctcaaccccatggccatgatgatggcccagaacatgcccgccatgggtggactctaccagtaccagctgtccagctaccgcaccacctcct

SEQ ID NO: 27932 - DNA, 325 bp, Zea mays
  Clone ID: cC-zmle189068h03d1
ggacccacgcgtccgcggacgcgtgggcggacgcgtgggcggacgcgtgggtttttcgtgttttagttcaaaaatgaactagacgacgaatagttgagaacgaagttagtattacacatatattgtgtaggtcatacgtaggactataggcattgtacacgattctttcgacgctagtaaagactggaagaaagctttagcaaatggattagcacacaactgctgctacagactcttatttatttgtaattcaagccagtctataagttgcaacaaactcctgtgcaattttgaactgaagattatagggaagaacctaccattt

SEQ ID NO: 27933 - DNA, 533 bp, Zea mays
  Clone ID: cC-zmle189068h04d1
cttgaccgatccatcgcgcatcgggacctgtttcgttctcactgagctaggagcagacgaggctggagagcgagcgacggagacctagccgaagcaggagctccccatggcgaccggcaacctggcgagcgtggtggtggctgtagacggcagcgaggagagcatgaacgcgctgcagtgggcgctcgacaacctccgcctgcgccccgacggcgagctcgtcgtgctgcacgtccagccgccgcccaacatcgccgcgggactcaacccggcgcccatccccttcggcggccccagcgggttggaggtgccggcgttcacgcaggccatcgaggcgcaccagcggcgcataacgcaggcgatcctggagcacgccctgaagatttgttccgataagaatgtggaggtgaagaccgaggtggtggtcggggaccccaaggagaaaatctgcgagattgcggccaaccgcaaggccgatctgctcgtcatgggctgccgtgccattgggccgctaaagagggtgttcttgggca

SEQ ID NO: 27934 - DNA, 370 bp, Zea mays
  Clone ID: cC-zmle189068h05d1
cctttttgaagtcctcgcttccttgaacttctagtagttttctttttttagatctatctcttccagcggggggttgggcccaatttatttggaagggtccccaatttacatgtggagtgaataagaatgaggaatcattcatggagttatgtgtgcttcaaaatgtgtaaaaaaatagctcttctcaaagaacatgtccaggcagtccagatgtacaaatatccaaagtggtttatatgataggtgctattgttctcaaacaaaattataactgtcaataattaaaaataatattttgaaatggcttacctttaatctaataccttttcttttaccttatttacaatggggggggggccgctttaaagaa

SEQ ID NO: 27935 - DNA, 448 bp, Zea mays
  Clone ID: cC-zmle189068h06d1
acgcctccgcccacgcgtacgcccacgcgtccgcccacgcgtccgcccattcgtttttccacgcgtccgcccacgcgtccggacgagggggaaggagggacagaacgacatctactatatcactggtgagagcaagaaggcagtggagaactcccctttcctggagaagctgaagaagaggggctacgaggtcctgtacatggttgatgccattgatgagtatgctgttggtcagctcaaggagtttgagggcaagaagcttgtctcggccaccaaggagggtctgaagcttgatgagaccgaggatgagaagaagaggaaggaggagctgaacgagaagtttgagggtctgtgcaagatcatcaaggaggttctgggcgacaaggttgaaaaagttgtggtgtctgaccgtgttggggactcaccgtgctgccttgtcactggggag

SEQ ID NO: 27936 - DNA, 543 bp, Zea mays
  Clone ID: cC-zmle189068h07d1
gatctctgatcttagaaacaactcgaagatgctcggtttaaaggcttttatgttagggccttggtggttatgaatccaggggatccgactgggcaggttcttgctgaagacaaccaatatgatatagtgaaattctgtaaaaatgagggccttgttcttctagctgatgaggtatatcaagagaacatctatgttgacaacaagaaatttaactctttcaagaagattgcaagatccatgggatacggcgaggatgatctccctctagtatcatttcagtctgtctccaaaggatactatggagagtgtggtaaaagaggaggttacatggagattactggcttcagtgctccggtaagagagcagatctacaaggtagcttcagtgaacctgtgctccaatatcactggtcaaatccttgcgagcctcgtcatgaatccaccaaaggttggggacgaatcatatgctttctacaaggcagagaaagatggaatccttcagtctttagctcgccgtgcaaggcactggaagatgcattcaaca

SEQ ID NO: 27937 - DNA, 388 bp, Zea mays
  Clone ID: cC-zmle189068h09d1
cggcggagtccggctaggccgcccacggctgcagctgttttggcatctgtaagtgcgacccctgcaactgctgatcacatggatcgacgaccatggatatgattattatctatctagcttgtggtggtggttgaacaataataagcgaggccgagctggctgccatacataggtattgtgtggtgtgtgtgagagagagagaaacagagttcttcagtttgctatctctctctgcatgtttggcgtcagtctttgtgctcatgtacgtacgtgtgtctacctgcatgttggttgatccgattgcatctgctgtaaccatatattaattggtccacgatgatatgatttgatactatatatattcttttaaatataaatattttttatt

SEQ ID NO: 27938 - DNA, 334 bp, Zea mays
  Clone ID: cC-zmle189068h10a1
ggggcaggggcattttgatgaataaaaaaacaatgggaccagaaaccaccaattaatctacaggggctgaaaaaatccttacattcaggtttacaggctccaggagcccccaaaatgggggacgcgggaaaacaacctgccaggcaattattgttccatatcccgaacgccaaactataacacatgtcaattccatgtcaattcctgggggcccactacattcaccaacttgttggatgcgcggccatgggggggggaactaccccaccatcaaaatgggggactggacccccttattctttccccacctaagtagtgggccccagaacctttg

SEQ ID NO: 27939 - DNA, 412 bp, Zea mays
  Clone ID: cC-zmle189068h10d1
ccccgcttgcaattcaattatgaataacaagaggattccttctttatggatttttcttgggatccctgaccaccaaaggagcccaggggtgctgtttccaactacttatgtgtggaaccaatcatcgcatacattaccacatcttgatggtgaggcagttccccaccccatggccgcacagtcagcaagttggtgaatgtagtgtacctccacgaattgacatggaattgacatgtgttatatttggcgatctgtatatgtaacaataattgcctggcatgtcgtcttcccgcgtcccacattttgggagctgttgtaacctgtaaacctgaatgttaggatatttaccagccgctgtagatcgattgctggttactgatcacattgatcatctatacatcaaaacggcagt

SEQ ID NO: 27940 - DNA, 224 bp, Zea mays
  Clone ID: cC-zmle189068h11a1
ctatcatatttaaagtggagggatggggataatgtatatcatagtaatatactcccaacaaaataggaactcgcaaaaagcagaaaatcgttgcagtcatcataggaaagtatgggaagacttacagcatattctatttaaaggaggccgaaatccaaatcaggtaagggatccttccttctattgatttgatcaaaacactttttacttttactgcccctctg

SEQ ID NO: 27941 - DNA, 399 bp, Zea mays
  Clone ID: cC-zmle189069a01a1
ttttgagaaaatttcagaattttgacttagggagacgaataacagggaaccaggtctcgaacatattcaatattatccaacgattacttgattctggaacactccataagaaacaaaaaggaacataaaaggccagatggccgctaacatacattgggcacacgtgccttctctaacggacagttagttccaacctacagggggatcagctaaaaccagaagaaaaaattttgactgatttagtggaccattacggtgactggggtatttttgtgaacaacccatgaatatggcaccactatagaaattggtgcctcgtgaggaccacaacaattgtaggggtccctggcgtctttggaaaaacgagcatgctcctgaatcccaacgcccggaaaaaga

SEQ ID NO: 27942 - DNA, 378 bp, Zea mays
  Clone ID: cC-zmle189069a01d1
ccggccacacgtgctctagagacatacacgctcgctggcccaccagttttatcaatatgggcaccactggctgcagcggggtacggtgccatagagcagaccctaataggaccacttcaacagcttcggccaggactattagcacttgctgagcctgcatgtcagctctgagggacaccgacgatgaccgtgacacactcccgttagctcttggatgccagccttaagcatcttaggcttgcgtgagtgtgcacgttcttgtgatatggataaaccacagtgcaccacacttaaactaatgggctaatgaccacattgcgtcgatgacatgattgacattcctggaagctcgtgcccgtccatacatgacacacttgg

SEQ ID NO: 27943 - DNA, 472 bp, Zea mays
  Clone ID: cC-zmle189069a03a1
acctcggtcgccctttttttttttttttttttttgtcaagaacttgggatataaaacgagcaggaaacggtacatttgccggctccatatgaacaaacacaagtccgaaattacgtggccatcggtaacccatctattagcttgcatctaggctagcttggcaaggacgtcgccaaacgcatctttggttgctgcgaagaatttctaggcctccggggtgctcttgatctttggggactggccaagaacgcccatggtgctgaagaactcgccggagagctccttgaggctctgcttctcctccctgggcttggaagcgaggacggtcctgaggtcttatcgccagtaggaggccccgaggcggaggtctttcttgacgtacggacacccctttttgtagatgaatggcttgaggttgatgatgtactgcgccgacattttcaccctgggcaccgactttcgcggcggaaac

SEQ ID NO: 27944 - DNA, 475 bp, Zea mays
  Clone ID: cC-zmle189069a03d1
aagcgcgcgcgcgcacgcggagaggctcggagagctgagtttgatggtttcaagccatggcgtccatgaccggcctctcgcagggcgttctgcccagcaggcgcgccgccaacagggccaggacggccgccgtcgtcagggcgtccgccgaggcgcaggcgcaggcgcaggcgggccgccgcgccgtgctcgggctggtggccactggcatcgtcggcggcgccttgtcgcaggcggtgcacgccgagaccgtcaagaccatcaagatcggagccccgccgccgccctccggtggactccccgggactctgaactctgaccaggcgagggacttcgacctccccttgaaggagcggttctacctgcagccgctgccgccggcggaagcggtggcgagggtgaagacgtcggcgcaggacatcatcaacctcaagccactcattgacaagaaagcgtggccgtacgttcagaacga

SEQ ID NO: 27945 - DNA, 326 bp, Zea mays
  Clone ID: cC-zmle189069a04a1
gacacagtgaaagaagcccacatgcccactcttgtttccccccctcacctcaaccgtatagtagatgggtttggggggcctcggtttcctatgcctacaccagtgaatttctttacctcttggtacgctcccaatcgcagatttgaataatcaagtcggtatggggctgctgccttttgttactccggaaatattggcttcgcctgtacagattttctagggcctgggcgatttttacccgcttctcggcgctcgccgtttcaaggtgaagatcctcgtaagtagagcgtaatgtgctctccctagggttcctatctcgacaggac

SEQ ID NO: 27946 - DNA, 286 bp, Zea mays
  unsure at all n locations
  Clone ID: cC-zmle189069a04d1
ggccctgtcgagataggaaccctagggagagcacattacgctctttttacgattatcttcaccttgaaacggcgagcgccgagaagcgggtaaaaatcgcccaggccctagaaaatctgtacaggcgaagccaatatttccggagtaacaaaaggcagcagccccataccgacttgattattcaaatctgcgattgggagcgtacgaagaggtaaagaaattcactggtgtaggcataggaaaccgaggccccccaaacccatctactatacggtgagnggtgagg

SEQ ID NO: 27947 - DNA, 581 bp, Zea mays
  Clone ID: cC-zmle189069a05a1
gggtaccttgtccaaaattaaaaaataatccaccccaaccaccccaaatttcttttcttacactaaacccccttaaactttgccccgaaccacacccccaccccccaccaacacctgtcacccacacaaaaaaaatacaccgcccccacaaactcgtaacaccaaccaaacacccccatctcttaaaaaaaaaaaacccgcccccccccccacaaaaaacccctttttaaaacaaaccctcttacccaccccaaacactttttcaaaaaacacaacccccaaccccccccctgtcatatttcttttccccccccccaaaagtctgtggaacccccccacccttccccccgaaaaaacccccccctatgcccccccccccacaaaaatcccggaaaaaacataaccccctgaaaaaccaaaaaaaccaccccctccaaaaaatccaaaaattccccccccgtaccccaaacccaaggggaaccgtcccccccctcctatataaaaaaacccacaggggccccccctcccccattttttccacaaaacaaaaaccccaagtccccccaaaccccccccccccc

SEQ ID NO: 27948 - DNA, 488 bp, Zea mays
  Clone ID: cC-zmle189069a05d1
cggcagaagccgccgtcgcagcaatcacagcagcccggagaacggttttgtcttacaagatgcagatctttgtgaagaggctgacagggaagaccatcaccctcgaggtcgagagcagcgacaccatcgacaatgtcaaggccaagatccaggacaaggaagggatcccgccggaccagcagcggctgatctttgccgggaagcagctggaggatggccgcacccttgcggactataacatccaaaaggagtctacgctccacctcgtgctcaggctccgcggtggcatcattgagccctcgctgcaggcgctcgctcgcaagtacaaccaggacaagatgatctgccgcaaatgctatgcacggctgcaccctaaggctgtcaactgccgcaagaagaagtgtggtcacagcaaccagctgagggccatgaagaagatcaagaactgaggtgttgctgctagtcagtttcatggacaatgttgttgg

SEQ ID NO: 27949 - DNA, 103 bp, Zea mays
  Clone ID: cC-zmle189069a06d1
tgcatggggccgctgaccgaatcagggaataagccggaacagactgacggtgctatcatttgccaacattgaacgggaaatgggacactccctgacgcggccc

SEQ ID NO: 27950 - DNA, 489 bp, Zea mays
  Clone ID: cC-zmle189069a07a1
tttttcaaaatttattgattggccggggggtgctttacaaatatagagggaaggaaggtgggaggaggaggaaggaatgcaagaaaaaaattgcttgcgaagaagaattaatccatcatatctaccacctaatctaatcagataagctaggcagcatattgtccgagtcgtactcgacgctccagtaggtttctatgtgcttttcaaggaacatgaagtcctccggacgtggggattcaggccatgggagacccgccaccacggcttgtccgccttcgtcgacccagtgatcttctactaagctgggagcacccgcatccaaagcaacttggcaaagcagcgagtcctggtccagtgcttcggcaatggcttcaagcgcttcttttagttccttcacttcaaacacgctgggtggcttccccaggtggagcttcttcttgcacgtaaccaggacctgcttcgcggcgtgctgcattatgccaatggcct

SEQ ID NO: 27951 - DNA, 568 bp, Zea mays
  Clone ID: cC-zmle189069a07d1
gccacgcgtccgctttgcttcagagttctccgtcgtgcagatatatgcattgaacgaggtcgccgacaagggggttgcataatgcagcacgccgcgaagcaggtcctggttacgtgcaaggagaagctccacctggggaagccactcagcgtgtttgaagtgaaggaactaaaagaagcgcttgaagccattgccgaagcactggaccaggactcgctgctttgccaagttgctttggatgcgggtgctcccagcttagtagaagatcactgggtcgacgaaggcggagaagccgtggtggcgggtctcccatggcctgaatccccacgttcggaggactttatgttccttgaaaagcacatagaaacctactggagcgtcgagtacgactcggacaatatgctgcctagcttatctgattagattaaggtggtagatatgatggattaattcttttttgcaagcaatttttttcctgcattccttccttcttctgccaccttcctttcctctatattgtgaaaagcaacccccggccaatcaatctctcttggaaaaaaaaataaaa

SEQ ID NO: 27952 - DNA, 556 bp, Zea mays
  unsure at all n locations
  Clone ID: cC-zmle189069a08a1
ttttgcttcacttcgacatgaagaatcgaagacagtttaactgcgttgtactagtgcgtagtgacggttgccaccacaaatttacagtttacatgatttttttttatgaaacaggagggggcgaaaagcccctactggatacatttgacatgaatcaattcaagaagagtctctctctctcactcacacacatcaaacgagacattcgaaaaggcggcctcacacgaggtggctgcaaagctacaatgcacctcgtgaaatgcttcaacatcgagcaaattggggcgacaaacatagccatcatcttgtttgccacgctgcccttcacgccattgccaggcgccttcgactaagatccctaccttgcaagattaaaaacactagcctatatgggtacttcgcaaccctcctgatatgtgcatcggtccatgccagtatgccacgaccaatgcttctgctcatttcanccgagaaagtcgaggaacaataactgatgcgccacgaactcttgcagggcaaaacttattcgcaatggccgcctagcataccttccatc

SEQ ID NO: 27953 - DNA, 536 bp, Zea mays
  unsure at all n locations
  Clone ID: cC-zmle189069a08d1
gtccgcccacgcgtccggacgagcgctccctcacggacgccttctcctttttcggcaccgtcaccgaagatggtgcacagggtaggtcttcggctaaatgccgtggaggccgtgagccactccatcgcccccaggcctgcagcctgttcgacgaaattcctgttagggacgtggtcacctgctcagctgcaatttaccgacatgcgaggagcgggctgttccatgagtcagctgagctgtttgttggcatgatgagggcagttagaataatgtatgacaaaaactctggaaggtcaagaggctttggatttgttcatttctcaaatgataatgaagctaagtgtgccaaggatgctatggatgggaaggtaatgctagggcggccattgcgaataagttttgcccttggaagagttcgtggcgcatcagttattgttcctcgactttctacggtgaaatgagcagaagcattggtcgtggcatactggcatggaccgatggacatatcangagggttgcgaagtacccatataggc

SEQ ID NO: 27954 - DNA, 436 bp, Zea mays
  Clone ID: cC-zmle189069a09a1
gggggtggaaccatcatcgtttcatcatttatcaaaccccccatgtcattcattcgtataacaaaatatttaggggttcgggcaaactgttaactggcacacacagggggggcgtgagcccattgcaaatagcaaattttattcgggggtactaggagttgtggggggtaaaacacaagaggcttaaaccggggggggacatgttgaggggacaccctcaacgagctttgacgggttggtttccacctcgggtgatgatttttttgacgtactccttcctaaccgggagatgggcatgccgaccattgtttggtgttccaaacaggctcacccacaaatagacccattgccttggtgtagttggcactatccaacgtaaagggatgatacatttctgcaggcaaaaagatcatgcccccttttttttcccggtccc

SEQ ID NO: 27955 - DNA, 465 bp, Zea mays
  Clone ID: cC-zmle189069a09d1
acgccttgagggtagcggctactttgatgtgagggaccaagatgatctttggatttgtgtagcggtaaagaaagggggcgtgatcgttttgcctgcaggaatgtatcatcgctttacgttggatagtgacaactacattaaggcaatgcgtctattcgtgggtgagcctgtctggacaccatacaatcgtccgcatgaccatctcccggctaggaaggagtacgtcgagaaaatcatcaaccgaggtggaaaccaagccgtctaagctcgttgagcgtgttcactctacatgtcctcctgccgtctcagcctcttgtgttttacaccctacaactcctaataccgccgaataagatttgctatctgcaatgtgctcatgccaccgctgtgtgtgccagttaacagtgtgcacgaaaccctaaatattttgttatacgaatgaatgacatgtggtgtttgataaat

SEQ ID NO: 27956 - DNA, 305 bp, Zea mays
  Clone ID: cC-zmle189069a10a1
gaaaaaaaagcaaaaagctttatttgacaccccttttttgtccttcagaccccatgcccattcaacctaaaagaccctgtgaggggatatgaactaaataaaacctttatctggcataataatttggaccgagaacccctcctggtggtgaaagcacactaaagtgggggccggttaacacccatcgcaaggaaaagcctggtcgtggcccgtccattaaaatccacaattctgctgccaatgggggcggggatacaaaaacctggtcccgtttttgtgccccatggcccccaagctttgggggg

SEQ ID NO: 27957 - DNA, 503 bp, Zea mays
  Clone ID: cC-zmle189069a10d1
ggacgcgtggggtgactcggatggctccggctatgtcggcgcagtactcatgatttaccttgagcaacctgtttgtccggggtgctgggccatgcagtacggagctgaccgtggagggaaggccatccgaccagctgggcaggagaaaccttactgactactcatactttagcggccgtgccctgaccccagcctcgggctcgcgtacagggagtcgctacccagatgggcgacgtgcgccagttgtacaccgtcgtgttccaggagaggccgctcaagggcttcacgctcgtcaccgaaagcgcgatgacggaagggtcagacgagtgggcgatctacggtggaactggagcgttcgctatggcgagaggcgtcataaggagaacgtttcttgccgacacgagcggcggtaactccgacgaacttgccgtggaggttctttgtcccgtgttccgcccggcgggtttggttcattgtcgtctcagtcagcatcaaaagacatt

SEQ ID NO: 27958 - DNA, 475 bp, Zea mays
  Clone ID: cC-zmle189069a11a1
agaggccaaagtgtttggtaggtattgccaccgggagtaggtaaaccattccaggttctcaaaagtgtttctgaagtcctgtcattttttttctataatggaaacaagttccagtcttttgcacttccatgcatacagccttagtaaggacgttacaacttctaaaacagctaagaaaagataaaacgttcaatgttggagccataaacaatgaagtcctggcatttgggaagcactcttgcgtacaagtgctacacatttcacatgaagcttattagtgagtccacagtagatcagaaggctagctcaggcacagaactaaacagcccgtgacgttacgccccccaccacgttgtacaacaacacaaccgtttgaagacccaaacaaccattctcccagtatgaagaaactctcgtacaccgtgtacattactgtaataacatcacaaagccctgagatcagccaccgagcaca

SEQ ID NO: 27959 - DNA, 544 bp, Zea mays
  Clone ID: cC-zmle189069a11d1
agacgagtcaccattgccgttctctaaggatcaaggagacacagattttaagatgttttcaaggtgttcaagggagaagcagggctacggttattcatcgagttcttctgagagaggcaggcggcgttcgagggagaaacgtcactacagttattcaccaaggttcttctgagagaggcaggcattctttacggcacaaggagaaacaatattacagtgactcaagttctgatcggagccatcgacactcgagaagatcgagggagaagagacatgatagagactcaagttctcctgatgccatcaggcgctcaagtagatcgacggagaaacagcgccgtcctgatacaagcccacgtcatgccaacgggcattcaaagaaatcaagtggcaagcaagactatactgagcgtagccgttacgaaaccagtagacattcaaggagatctcaggagaaaccgcactaccctgattctagcgcccttgattactcggactctgatcagcacaaaaacatcgccaccatcataggaaaaaatgaact

SEQ ID NO: 27960 - DNA, 237 bp, Zea mays
  Clone ID: cC-zmle189069a12a1
ggggcacctggggaattttaactcatcacagaaaaccaaccaccccctaattccatgattcccccaagagcacggacacaacccctacattgtaatgccctggggaaagaggaaatgacttatcaatgtcccacataattacagcccgtagcataaaaaaccaaacccccggtccctaacgaaagagcctactcccattaaagggggggcgctcaatgcccacaatacaaacccaaa

SEQ ID NO: 27961 - DNA, 572 bp, Zea mays
  Clone ID: cC-zmle189069b01a1
tttttctagaattgtactttcttatttctgggaagccacaaacatgatccaaaaaacttcattattgaactataactcataagcaatctaaaagagggcaccgccaatgatgggttgttggtagaacgttgttgggtttgtcaaagcaagttggttgaatggcagcaattgttgcagttgtaagagggtgccagcgttaggcgcagcgtgcaggtagaacggcaacaactgttgttgtgtcaagaaggcaacagggctcacatcagctagctggctgaatggtggtagctgttgctgttgtaaataagcagcagagttcaatgctgccagttggttgaatggaagaaattgctgggggtaggcagcagctagctgactgaatggtagttgttgttgcaaataagcagcagagttcaatgcagccagttggttgaatggaagaaactgctgttgctgagagtaggcagcaaggtttcctagcacaagttgttgtagttgttgtgccttgatgttttgtgccaacatatgcaccaaaggtaactgctgtaatagggctgacggttgttggagga

SEQ ID NO: 27962 - DNA, 466 bp, Zea mays
  Clone ID: cC-zmle189069b01d1
gatcgaaagcacaatagtgtaccaacaatggcagccaaaatattttttttccttatgctccttggtctttctgcaagggctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggctgcattgaactctgctgcttatttgcaacaacaactaccattcagtcagctagctgctgcctacccccagc

SEQ ID NO: 27963 - DNA, 353 bp, Zea mays
  Clone ID: cC-zmle189069b02a1
aaaaaggggtgaacaaggtaccacattatcgatctgcatcgctgtgttattaccgttttataactggctgggggggaccggaggggacattccagcgcctgaaataattggcattcagggttttggttgcctaaacagggggccgaccctcttaacccaaatgggcaaaaattttgagctgggcccaatttggcaccattatattggtctgcagggccccagccttggggtggcccactaaactcggttctcttaaccacaatccccaattatatccaccaaattttttgccccctttcgacactttggggaggatgttcatttccctttcctccaattgaagtgaaaatatg

SEQ ID NO: 27964 - DNA, 542 bp, Zea mays
  Clone ID: cC-zmle189069b02d1
gtacgaccacacgtccagacacgcagactgagagacactgtggacaactttttcccttttgcgaccagccaaggacaagagggcctcgaggatataccccgttgggatatactgtgggcgaaccgcgagctaacaggagtcggagctgtcccagctggcgcagggaggggaggtcgagtgtctgataagctgctaccaacctgagccacaaggcctttggctggtcctaacctatggaccccggactggggaagaaatacgaggatggtggacgcacggggtggttggagccggctccagacttagctgggaaccgtagagagcagagactattgaacacgcgatactacccgacagatgcctgagatacaatacagaaccacagcgatgtggcatgtgccatggtcggtgtgagagtgtgactctctgaacacaataaagacaccaacgccatattctcacttgaaatggatgaaaaggacatgaacatcatcactgaagtgtcgaagaggggcagaatatctgatcgatattattgggga

SEQ ID NO: 27965 - DNA, 492 bp, Zea mays
  Clone ID: cC-zmle189069b03a1
ttttacatgctgtagcttacctcgcctcttccaggcggcatatctgatagatctactaataattatcgaaattgatccaataattatcagcgcagagacatcatccatcgaggtggagcaggactgcagaccgagagatcccgccgcctccatctatcgtcgcctcagatccgctccgaaccgaacgacgacgacttcgcgatttctccagatctggatccagaagcagaacatgcgatgctcgaccaccaaaacaaaacaacaagaaccttgcaggcaaggactaaccgatacaggatccaacgcgggtttgccgaatccagcaatcagatatgagcctgcacaacatgaagcaaacggatttcctgataaatcgaaacaaagtagctcaccgagagcactcggggaggcaaggtctcaaggaggacggccatcctggatctggaggacgagatgaggttgcgtgcaggaggggaacgcgtccatcaatgg

SEQ ID NO: 27966 - DNA, 491 bp, Zea mays
  Clone ID: cC-zmle189069b03d1
acgccattgttggacgcgttcccctcctgcacgcaacctcatctcgttttccacattcaggatggccgtcctccttgagaccttgcctccccgagtgctctcggtgagctactttgtttcgatttatcaggaaatccgtttgcttcatgttgtgcaggctcatatctgattgctggattcggcaaacccgcgttggatcctgtatcggttagtccttgcctgcaaggttcttgttgttttgttttggtggtcgagcatcgcatgttctgcttctggatccacatctggagaaatcgcgaagtcgtcgtcgttcggttcggagcggatctgaggcgactatagatggaggcggcgggatctctcggtctgcagtcctgctccacctcgatggatgatgtctctgcgctgataattattggatcaatttcgataattattagtagatctatgagatatgccgcctggaagaggcgaggtaagctgcagcatgt

SEQ ID NO: 27967 - DNA, 249 bp, Zea mays
  Clone ID: cC-zmle189069b05a1
gggtaaaaaaaaacaaaggggccaaaaaaaaaacccaacaatataccaaaaagcttaataccaagcgcgaggctcccaaaaaaaaagaaaaaaaatgtgggcgcctaaaatcctccccccccccaaaaaaccacctgggagaccccgcccaaatccaaacaaacccccctgggggggggggctgaaaaacctcccgggcccctcccggggggggggggggaaccctgggacaaaccaaagacccacccg

SEQ ID NO: 27968 - DNA, 422 bp, Zea mays
  Clone ID: cC-zmle189069b05d1
gcccacgcgtccgcacacccccacaggagaagaacatgaggttcttgaggagtctcacaccacgaggagttcgattcgatctaggtggcgtctcccagttgactttctggcgccaaggatgaattttagatccttttatatttatcttttattttgtaagacttccgctatgtaataagtactctgatgatattgtgacatttatctctatacactctgttattatataaaaaaaaaaaaaaaaaaaaaaaaaaaaaaaaaaaaaaaaaaaaaattaaaataataataaattataatgggcggccgttttaaaggtcccaatcttacttacccgtgcttgcaatttcatgggtgggtgataggggcacctaaattgcgttcattgtccgggtgtttacacatattttgcctgggaaaaccct

SEQ ID NO: 27969 - DNA, 364 bp, Zea mays
  Clone ID: cC-zmle189069b06a1
gaaaaccgggcggggaattatatatttttggtgcaacccccggaccctcccctattttatatatatatatatatatatatatatatacagcccgcaggggggggccattggggggaaacatctaacaaactttttcccccctttaaaaaatcccaacaatattcgttttccctttttatttacccctgggaaaaaaaattgggcccccccttttgggcgtgataaaacctagttcccttggggggaaacttttgtttgacgcacccctctattttatcccccaaaaatcgctgggaataccccccaccctgggttgttccccccctccccccaaaaaagggggctttatcgggggttgttaaaa

SEQ ID NO: 27970 - DNA, 501 bp, Zea mays
  Clone ID: cC-zmle189069b06d1
gtccgcccacgcgtccgcttcgatcaattcccaagtcaaataataatatttcagcaatggtggttcccgtgatcgacttctgcaagctggacggcgctgagagggctgaaaccctggcgcagatcgccaatggctgcgaggagtggggattcttccagctcgtgaaccacggcatcccgctggagctgctcgagcgcgtcaagaaggtgtgctccgactgctaccgcctccgggaggccgggttcaaggcgtcggagccggtgcgcacgctggaggcgctcgtcgacgcggagcggcgcggtgaggtggtggcgccggtggacgacctggactgggaggacatcttctacatccacgacggatgccagtggccgttcgacccgccggcgttcaaggagaccatgcgcgagtaccgcgccgagctgaggaagctcgccgagcgagtcatggaggccatggacgagaaccttggcctcgccaggggcaccatcaaggacgcct

SEQ ID NO: 27971 - DNA, 479 bp, Zea mays
  Clone ID: cC-zmle189069b07a1
gagcacttatgtcctgtttcattgtatataaaataaaggtctgactgaaaacagctcagtgctccagtccagaaggaactttcccattaaagaaaactcggtgccacttttagcaaggtaatgaacataacagacagacggtgccgaggtaaaataacatggtacctggtatctaagttatgatatatcgtttatacttattcatcaggtagttgagcaaaatatggaaaatgggagaacacagtatatcaaccacaatgaaagacagattcagcgataaaggctctcagatctcaagttctcagcaatctcagtttcccagcggtcaccattctcgagcaatttctccttgtcgtacagtagttcctcgtgtgtctcagtagcaaactcaaagttaggcccctcaacaatagcatcgactgggcaagcctcttggcagaacccacagtaaatgcatttggtcatgtcaatatcatacc

SEQ ID NO: 27972 - DNA, 553 bp, Zea mays
  Clone ID: cC-zmle189069b07d1
tccgtccgttccgagcccatcgcctccgcctcttcgtcaccgtcgagttttcaccttatggcggcgctcctagcccggcgggcagcgcaggcgctccgcgcgagacagtcggcgcagctcgggccgacaacgtcggcgatgcaggggcacctccgtacctacatgaacgcggggattcccaagcggttcaaagaggaagaggagaaagaacagcttgcaaaagatatcgcaaaagattggaatgctgtgtttgaaaggagcatcaatacattgcttttgactgaaatggtccgtggcttgatgctaactctcaagtacttcttcgagagaaacgttacaattaactatccgtttgagaagggtcctctgagtccccgcttccgtggtgagcacgctctcagacgttacgaatctggggaagagcgttgcattgcttgtaaactatgcgaagctatatgcccagctcaggcaattacaattgaggctgaagaacgtgaaaacggcagcccgccgaccacaaggtatgatattgacatgaccaaatgcatttact

SEQ ID NO: 27973 - DNA, 313 bp, Zea mays
  Clone ID: cC-zmle189069b08a1
gtggagggaaaacaaccaatcgacaaccgttaaattgaccgtttaccaatcttttaaaaaaccccctaggtggggtttacacaaaaatactatactaccctcggacattcttttgccccgcaaaggtcccccgggagaaaaaccctctttactgtcaacaatggtgggggcaacagttgctgacataacaaaagcacacatgggacggcactaaactttgattccgggggaccatgcccccccaaaaacttggatctttagtaaaactcgttcccaaaatccacattgactggaggttcacccggacccgtgg

SEQ ID NO: 27974 - DNA, 447 bp, Zea mays
  Clone ID: cC-zmle189069b08d1
gggcgaagctacagtcgatgtggattctgggaacgagtctgacttttgatccttgctcttgggctggcatggtgacgcgggatgaaagtctagtgccatgccatgtgtgctattgttatgtcagcaactgttgccaacaacattgctgacagtaaagagagtttctctcgcagcgtacctctgcagggcaaaagaatgtacgagtgtagtctagtgattttgtgtaaaaccaacatacgtggttttctgagagatggtaagacgtcaatttaactgttgtcgattggctgttttgcctaataaataatctgtgacaataaaaaaaattataaaataaatcaaatatagggaagggaaataatttaggggcgtccttttttaaggatccaatcttacctcactcttgcatgcaacgttatagcttcttttataggggctcctaatttt

SEQ ID NO: 27975 - DNA, 445 bp, Zea mays
  Clone ID: cC-zmle189069b09a1
gtacgaacatgcgtttggtcttgctcctctgactgaaacgaacttatcaccaaccccaccgaaatcacactcgacgacagatgatgatgatgatgctacactactcgcatttgtacgcatacaccgtggcgtggaaaagtcgaaaacgcacgcgcgcgcacagagtggtgtggctgtggatggacagtggtgggtgggactactagagcacctgcagcttgctgaggtgctccaggagcgaggttgccttgcgcttggctcggtccgtgccggtcttcgccagctcggcgagcgggatctgggcgcccagcctccctacgcaggcgaggttctcggcgtctctcttgcacagcgcgagtatgatggcggcagcgttctccctgttgcgggcctggcctgaccgcagcaagtccatcaggaaaggtatggcgtgggccttggatat

SEQ ID NO: 27976 - DNA, 640 bp, Zea mays
  unsure at all n locations
  Clone ID: cC-zmle189069b09d1
gtccgtgaaacaaaaggctcatctgaggaagttaagaagtcggactctgtttctatttctgaagatttccgttgcccaatatgtctcgagctgatgagagatccagtaattgtttcaacgggacagacctatgagcgcgctttcattcagaggtggattgactgtggaaaccgaacctgcccaaaaactcagcagaagctccagaacctttcgttgaccccaaactacgtgcttagaagcttaatactgcagtggtgcgaggaaaaggggatggaaccacctagcaggtctaaaagcgacggttctcctcttgaggttgctggcaacagattagcacttgaagcgttagtccgcaacctctcgagcagttcattagatgatcggaaatctgctgcggctgaaataagatccttggccaagaaaagcacagacaaccgtatacttctagcggaatctagcgctataccggctctggtgaaactcctgtcgtccaaggacccgaaaacccaagagcacgcagtgacagctctcctgaacctctccatatacgatcagaacaaggagctggtagtggttgccggtgccatcgttccaatcacacangtgctgaggacgggtagcatggaagcaagagagacgc

SEQ ID NO: 27977 - DNA, 537 bp, Zea mays
  Clone ID: cC-zmle189069b10a1
tttttaggggctttatgaggtaggcaacagcgaacctaaccaactgaggaaaaacctgtacaaatccacctacacccgcagggctttctcaacttcatagattagggagggtacacattcatcacccatgttttatttccgacaatcaaatcccaacgagcatagcaccgaccgaactgacacatcgcatgcataatgtgttcatccctctctaggagggcaacaccgttctacaactaaaaaacccaaaccaactacaaatgcaccgacccagagttgtgagtggacccattattattcctccgcctgatcaacattacacacttgtttccttcattcatctgtccgttcttctttttaggcctcttcctcaagcagcatctgatcgaagtgccacaccccgtgccccttgcccactctcctcagctgggcgacatacttggagagtcttgttatggcttccacctgctcctcgaggaactcactctcgatgaagtctgtcagctgaggatcattgcaccttgttgccacaccatg

SEQ ID NO: 27978 - DNA, 585 bp, Zea mays
  unsure at all n locations
  Clone ID: cC-zmle189069b10d1
tctccgtccacccattccattccactacccacgcgcagaaatcacgncttcgcacacgcacccacacgacacatggggatgatgcttagggtttccccgtccccggccgccgcggtgccaacccagctctccggtgcgcccgcgaccccttgttcccgtcgtaagggtggcggcgccgcgcggcgtcgcctcgccggccgctggcgccgcgtgcagggccgcgggcaaggggaaggaggtgctcagcggggtcgtgttccagcccttcgaggagatcaagggggagctcgccctcgtgccccagtccccagacaagtcgctcgcgcgccacaagttcgtcgatgactgcgaggccgccctcaacgagcagatcaacgtggagtacaacgcctcgtatgcataccactccctcttcgcctacttcgaccgcgacaacgtggctctcaaaggatttgccacgttcttcaaggaatccagcgacgaggagagggagcacgctgaaaagctcatggagtaccagaacanacgtggaggcagggtgaggcttccatcgattgtgacgcctttaaccgagtttgaccaccc

SEQ ID NO: 27979 - DNA, 468 bp, Zea mays
  Clone ID: cC-zmle189069b11a1
caagtaaaatgtaatcattgccctgtcatgacagaagaaagtaaaaaaagcaagagcagatttatcttaatagaacacaagtgcagactgtacaccacccacaatcccatgcactccctgtaatttccacgtccaagatcacaaaacaggaaatccacagctgacctgcaatcactcagtctttcttcttgttggccggggagcagaacctctcaaacagcatggcgaagaacccggcgaaatcgagccgcttctttgggtcatctttctccacatccctgtttgtttcttcaggcttgtctccttcagccgaagtttcaggagcacgagcagcagcagcagtctcaactggaatttcagtttcagtttcaggtgctgtctgctgcaaagctgcggcgacagcctgaatctcctgtacggcctgctccaacacattaggttctgcagtcttgtcagcagaggtaccct

SEQ ID NO: 27980 - DNA, 570 bp, Zea mays
  unsure at all n locations
  Clone ID: cC-zmle189069b11d1
gggacacggtgaagaagagccacccagaagcggtggaaaaggtcaaggtttaggtgaagagccttgctgacgctctccacctggggagacatggatccaaagataaagaacctgagtctgaagagaaggccgaagaaggcgaggcagcgcagagcgtcnaaaaaggaggagggtacctctgctgacaagactgcagaacctaatgtgttggagcaggccgtacaggagattcaggctgtcgccgcagctttgcagcagacagcacctgaaactgaaactgaaattccagttgagactgctgctgctgctcgtgctcctgaaacttcggctgaaggagacaagcctgaagaaacaaacagggatgtggagaaagatgacccaaagaagcggctcgatttcgccgggttcttcgccatgctgtttgagaggttctgctccccggccaacaagaagaaagactgagtgattgcaggtcagctgtggatttcttgctttgtgatcttggacgtggaaattacagggagtgcatgggattgtgggtggtgtacagtctgcacttgtgttctatta

SEQ ID NO: 27981 - DNA, 179 bp, Zea mays
  Clone ID: cC-zmle189069b12a1
cctctagagggccgccctttgttattcttttattattttttttttttttttttttctttttaaatcataattaaggggcttgggtgataaaaatacaaaaaatacaatccctgtccacacaacaatgcaaattaattatcttcatatacacaccataaagtccaataatccaattcaaa

SEQ ID NO: 27982 - DNA, 491 bp, Zea mays
  Clone ID: cC-zmle189069b12d1
gacaacttggacagaaaagctatatttttcatcagctgctgccttttcttggtactttctcattttggcgatactgcggactggaagttggagagacgaagcttctagagtcatggctgccgctcctattctggcgtttgtgacaacccacattctgtaccctaactttctatggaccttggcaaaggcctaaacatgaaggcttgtactgtgataagcattgctcagtgtctcctgtgggcactgtgggctgtcatgagtgggcatcgttcgcggctcaagatcatatctgttgccgtcggaggtgcggttgcagtacttgtggaagcctacgacattccaccgtgatggggatacgcagatggccgtgctatctgcctcgctgtggctatccccctgtcgtacctttggtggagctttgcccaggaggatgctgagatgcgaacattagcagtcctaaagaagacacgataacgaggaaatgccacatg

SEQ ID NO: 27983 - DNA, 513 bp, Zea mays
  Clone ID: cC-zmle189069c01a1
ttttgttttttgtttcaagctacaaaactttcatttagccaaaagtggaccaacaccccagaacaaatgtcaggcattggaatttggatacatagcatggtctgctttcattgctacattaacattgaaatttggcgacatgtttttataacagtagtagtagacccacagcttcaactcaacaaccagacaggtggacgagaagcttagaaaagagatgtgcccttgcccttcttgtctccaccaatctcaaaatgcttgcatctcttgatggcgtgctgtgagtagtgcttgcagctctggcactgcagcttcagaacaatcttcttggtggtcttggccttcttgtggaagacaggcttggtctgaccaccatatcctgactgcttgcggtcataacggcgctttccctgggcagacaggctatccttgcccttcttatactgagtcaccttgtggagtgtgtgcttcttgcactctttgttcttgcagtacgtcttcttggtcttagga

SEQ ID NO: 27984 - DNA, 563 bp, Zea mays
  Clone ID: cC-zmle189069c01d1
gtccgccggagcaggtagaacgctgcacaatccccttcgccgccgccattatggtgaacgttcctaagaccaagaagacgtgctgcaagaacaaagagtgcaagaagcacacactccacaaggtgactcagtataagaagggcaaggatagcctgtctgcccagggaaagcgccgttatgaccgcaagcagtcaggatatggtggtcagaccaagcctgtcttccacaagaaggccaagaccaccaagaagattgttctgaagctgcagtgccagagctgcaagcactactcacagcacgccatcaagagatgcaagcattttgagattggtggagacaagaagggcaagggcacatctcttttctaagcttctcgtccacctgtctggttgttgagttgaagctgtgggtctactactactgttataaaaacatgtcgccaaatttcaatgttaatgtagcaatgaaagcagaccatgctatgtatccaaattccaatgcctgacattcgttctggggtgttggtcgacttttggctaaatgaaagttttgtagcttggatc

SEQ ID NO: 27985 - DNA, 493 bp, Zea mays
  unsure at all n locations
  Clone ID: cC-zmle189069c02a1
aaacacggaatatcaccatcagtaccatttcagcttggtttaaactatacatacagtcgcagctgacacaacccaaggcatgcctattatatacacacccttggctttgcttggctgctgttattctgtaagcacgctagctagcttctccagctctccgggctctaacacgtagatgtaaaccatctgctacacatacgtacatagcgtggtggacagaaatggatggatcagggtcttcaggcgtgcgccagctccttggagacgccgtcctggtacggcgcctcgcagaactcgccgccaaggtcatcgcacgcctcgcccgggaacaccgtctttggctcgtcgtaggacaggtagtccctgtccaccccgaccacacttctgctcgtcgtcgncgtcgacgaggcgggcttggcctccgggaacatgggcccgttgcacgcgtcgccaccaagcaggtcgcaggcctccatcgtgaacaccgagacgc

SEQ ID NO: 27986 - DNA, 506 bp, Zea mays
  Clone ID: cC-zmle189069c02d1
gtccggcgtctcggtgttcccgatggaggcctgcgacctgcttggtgttttcgcgtgcaacgggcccatgttcccggaggccaagcccgcctcggcggcggcggcggcgagcaggagtgtggtcggggtggacagggactacctgtcctacgacgagccaaagacggtgttcccgggcgaggcgtgcgatgaccttggcggcgagttctgcgaggcgccgtaccaggacggcgtctccaaggagctggcgcacgcctgaagaccctgatccatccatttctgtccaccacgctatgtacgtatgtgtagcagatggtttacatctacgtgttagagcccggagagctggagaagctagctagcgtgcttacagaataacagcagccaagcaaagccaagggtgtgtatataataggcatgccttgcgctgtgtcagctgcgactgtatgtatagtttaaaccaagatgaaatggtactgatggtgatattccgtgttttacgatac

SEQ ID NO: 27987 - DNA, 385 bp, Zea mays
  Clone ID: cC-zmle189069c03a1
ggggggggggcaaaagggttttttaaaagagatgattaaccggggttcttgttttatacaggggggtttttttgggggggacaaagagcccgggaatttgtgggaaccacgcccccggggaacgaacgccagccttttttcttattacaaggaacggggggctacatagggctcatgtgggagccccgggccccgctggttccggatcatccctatgccttccaccatgggtccccgccggtcctgaagttgggctccaccccccggaccaaaaggaccttggcggcgttgacgttggggtgaaccaaggccatctacaaaggggccggtccacggaccaccttgccctggttgttgtactgggatccccggcaggggcaaataa

SEQ ID NO: 27988 - DNA, 594 bp, Zea mays
  unsure at all n locations
  Clone ID: cC-zmle189069c03d1
gggatcacccgtccggcgagtgagtgaacaccagccgtattgtcccgactcctgaccctttccgatcctcgcctgctgcagccatggcgacctccgcggcgctctccaccgccgccaatcccacccagctctaccggtcccgcgcttcgctgggcaagccggtgaaggggcttggcctgagcatgggccgcgagcgcgcccagcggagcattgtgtgccaggcggcgagcagcatctccgccgaccgcgtccccgacatggagaagcggaagctgatgaacctcctcctcctcggcgccatctcgttgcccaccgtcggcatggtcgtcccctacggcgccttcttcgtccctgccggctccgggaacgccggcggcgggacctacgcgaaggacaagctgggcaacgacatcacggtggaggcgtggctcaacacgcacggtcccaacgaccgcacgctcgcgcaggggctcaagggtgaccccacgtacctggtggtggagcaagacaagacgctggccacctacnggatcaacgccgggtgcactcacctcggctgcgtcgtgccgtggaacggcgctgagaacaagttca

SEQ ID NO: 27989 - DNA, 532 bp, Zea mays
  Clone ID: cC-zmle189069c04a1
gcaattaaatatgaagcgttttttctaattataacactgcacgccagtaaaagaatgtacgtattctcatccttgcaacattcaaactcgaatagcatggtccacaggaaatcgatggcttttgtcagcagtgatgacatgagaactgcaagtcgatgtaaaacgcaatgtaaatggatttttggatttgtatcccacacttcaaagctacataactcactagaactgaatccagaaataatcccagcacaggcaatcagtagctgcggccccagaacgaccacttcttcgctggctttccagatgcaaagcacagggtaccttctggaagttctggctgctcaaatggagtacacaatgttttcgcagctccaagttccccttttgtgcgagtttttacatctttctcaatttcctcctcatcacaccatggagccaagatcaactttttgttattcagagcagttgtgaattcatcccaagtgtttacgacatgaacacaggcatctttcttttcttgggctgttttgac

SEQ ID NO: 27990 - DNA, 604 bp, Zea mays
  Clone ID: cC-zmle189069c04d1
gtccgtacttctccaaatggataagaagccaccgagacttacccttgatttgtaatcaatggtgtaatgttgttagatgggagtttagcaatccaactcctttcataaggagccgtgaatttctgtggcaagaggggcatactgcttttgcgactaaagaagaggcagatgaagaggttctccaaatattggaactgtaccgaaggatatacgaagaatttttagcagttccagtttccaaagggagaaaaagcgagatggaaaaatttgcaggtggcctttataccaccagcgttgaggccttcattccaaacactggtcgtggcatacaaggcgcaacctcacactgtcttggtcaaaactttgccaagatgtttgatatcacttttgagaatgagaaaggtgttagggaaatggtttggcaaaactcttgggcctacacaacccgctcgattggagtgatggtgatgacacatggtgatgacaaaggcttagtattaccaccaaaggtggcgccaatccaggtaattgtgattccagtgccttataaggatgctgacacaactgccataaagggagcctgcgaatcaactgtttacacact

SEQ ID NO: 27991 - DNA, 543 bp, Zea mays
  Clone ID: cC-zmle189069c05a1
tttttaatttacagcatatttcattgataatgtccacaaggaccaaagcatgcatgcaaatacgtacactactggtacaatctctgagcccatgctcccttcttcacaaatactggtacatctcctgcagtacatatacgaatacgtatgtctacggtacacgcatacaagtatgtatatgccctcgctcacttgccggggacgaagttggtagcgtaggcccaggcgttgttgttgacagggtcagcgaggtggtcggcgaggttctcaacgggacccttgccggtgacgatggcctgcacgaagaagccgaacatggagaacatggcgaggcggccgttcttgatctccttgaccttgagctccgcgaacgcctccgggtcgtcggcgagcccgagcgggtcgaagctgccgccggggtacagcgggtcgaccacctccccgagcgggccaccggcgatgcggtacccctcgacggcgcccatgagcaccacctggcacgcccagatggccaagatgctctgcgcgtggatcaggctcggg

SEQ ID NO: 27992 - DNA, 544 bp, Zea mays
  Clone ID: cC-zmle189069c05d1
gcggacgcgtgggctcgggtgcgtgttcccggagctgctcgcccttttcggcgtcaagttcggcgaggccgtgtgggtcaaggccgggtcccagatcttcagcgagggcgggcttgactacctcggcaacccgagcctgatccacgcgcagagcatcctggccatctgggcgtgccaggtggtgctcatgggcgccgtcgaggggtaccgcatcgccggtggcccgctcggggaggtggtcgacccgctgtaccccggcggcagcttcgacccgctcgggctcgccgacgacccggaggcgttcgcggagctcaaggtcaaggagatcaagaacggccgcctcgccatgttctccatgttcggcttcttcgtgcaggccatcgtcaccggcaagggtcccgttgagaacctcgccgaccacctcgctgaccctgtcaacaacaacgcctgggcctacgctaccaacttcgtccccggcaagtgagcgagggcatatacatacttgtatgcgtgtcccgtagacatacgtattcgtatatgtact

SEQ ID NO: 27993 - DNA, 136 bp, Zea mays
  Clone ID: cC-zmle189069c06d1
gggggatccacgcgtccgcggacgcgtgggaaaaaaaaaaaaaaaaaaaaaaaaaaaaaaaaaataaaaattaagggcggccgaaactaaaaggagccaacagggagaacccaagcaagcaacaacacaactctaa

SEQ ID NO: 27994 - DNA, 326 bp, Zea mays
  Clone ID: cC-zmle189069c07a1
atcaaaaattaggagactcaagtcttcacagatagatagatagatggataacactggtaaccagttacataaacagggacatggttcacagatccccaatggatcgaatgatttacttctaatgaggaaatggcacaaagctcatctgacaaatagctgtttggcaacactattaagagacttttaagaggggggagcctcctcctggagctgcttcaccttggggatggaggcattcatcgcctcatcctttgatttgccttcaacagcctttcaggcattccacttggccctttccttttggtagaatatgccccgaccatcgg

SEQ ID NO: 27995 - DNA, 435 bp, Zea mays
  unsure at all n locations
  Clone ID: cC-zmle189069c07d1
ccttgcncnntgagaaccacggagcatatggagaacatagctcgatctctatatcgggtctctacaatgcatagccatcggttggagaatgtgatatacccgatcgttccgggcattattctaccaataagggacagggccacagtgggatgccatggaagggctgttgaaggcaatatcgaaggatgaggcgatgaatgactacatcaccaaggtgaagcagctccaggaggaggctgccgcctcttaaaagtctcttaatagtgttgccaaacagctatttgtcagatgagctttgtgccatttcctcattagaagtatatcattccatccattggggatctgtgaaccatgtacctgtttatgtaactggttaccagtgttatccatctatctatctatctgtgaagacttgagtcttctaaattatgatat

SEQ ID NO: 27996 - DNA, 311 bp, Zea mays
  unsure at all n locations
  Clone ID: cC-zmle189069c08a1
gggttncccgaacaacccacagccgggaatccagttttatcaatcccccaatataacaagtttgcaaattttgttttgtttacaggcttgggaacacgggaaccaaacctcataccaatagagcttaaatagcgctttagctaggggcatgcatagggactaaatgatttgcttacaggaacttattaacaaacaccccggggggagcttcatcggggaaaattgaatttgcatttgggtgaaggttcacggccctccacagggccctttaaaaggggaaccagtttgggggggccccttcccggaaaacc

SEQ ID NO: 27997 - DNA, 135 bp, Zea mays
  Clone ID: cC-zmle189069c08d1
gacctggagggcggaccttacagcaattatttacagactcgcggggtgtatagtcgtagcttatagcgttctgactctggcctttactttgtatgagtggtgcggtgcaccgaacacagatgaactgattgggat

SEQ ID NO: 27998 - DNA, 431 bp, Zea mays
  Clone ID: cC-zmle189069c09a1
ttttaacgtgctcttgacatttattttattccatctcgagtgggaagggacacccaatcaaacatgcaaaacaacaagagctagcttattgatggctgcctgcttgtagcaaggcggacggacggaggagcatggaaggatccatcggctgtgccgctgtggatgagtctagtggatcttgcagccgcagttttcggggaggaagtcgcggcacctgtacttggtggcgcccttgtccgtggacacggggacgcagttcttgcaggtggcggcgcacttggtgaggaggtcgtcgcaggtccacacgcccgaccagctggtgcactcgccgcaccagcactgcttcttcgtcgtcggccctgcaggtcctttggccacggccgcagagaccagaagggcctggagaactaggatcgccaacagagtgctgt

SEQ ID NO: 27999 - DNA, 425 bp, Zea mays
  Clone ID: cC-zmle189069c09d1
agcactctgttgtttttcctatttctccaggcccttctggtctctgcggccgtggccaaaggacctgcagggccgacgacgaagaagcagtgctggtgcggcgagtgcaccagctggtcgggcgtgtggacctgcgacgacctcctcaccaagtgcgccgccacctgcaagaactgcgtccccgtgtccacggacaagggcgccaccaagtacaggtgccgcgacttcctccccgaaaactgcggctgcaagatccactagactcatccacagcggcacagccgatggatccttccatgctcctccgtccgtccgccttgctacaagcaggcagccatcaataagctagctcttgttgttttgcatgtttgattgggtgtccctttccactcgagatggaataaaataaatgtcaagcgcacgtt

SEQ ID NO: 28000 - DNA, 369 bp, Zea mays
  Clone ID: cC-zmle189069c10a1
aagcagatgatatattagagttgatgcagggaggggcagttatgtacagcgcttagtgggacttcgtttgctaagcatacattaggtaggtgcgaccagctaaaacttgccacatcagaaggagaaaccaaaactgcaggaaggtccaaccaactcagaacaccagctttagatactactacggtgcgctacgggctcatccaatgcatattagaaaggggaaaaaaaggcattaagctccgctacaaggagatctatggatacatttgccttgttctctactacttgggacgaccagctagctgccaaggcatcagcagttgtcggagttaagcgacgaggcggactggtagccggcggacgcgtggg

SEQ ID NO: 28001 - DNA, 386 bp, Zea mays
  Clone ID: cC-zmle189069c10d1
acgcgcccgcccacgcgtccgccggctaccagtccgcctcgtcgcttaactccgacttctgctgatgccttggcagctagctggtcgtcccaagtagtagagaacaaggcaaatgtatccatacatctccttgtagcggagcttaatgcctttttttcccctttctaatatggcattggatgagcccgtagcgcaccgtagtagtatctaaagctggtgttctgagttggttggaccttcctgcagttttggtttctccttctgatgtggcaagttttagctggtcgcacctacctaatgtatgcttagcaaacgaagtcccactaagcgctgtacataactgcccctccctgcatcaactctaatatatcatctgcttaatcgtc

SEQ ID NO: 28002 - DNA, 390 bp, Zea mays
  Clone ID: cC-zmle189069c11a1
aaacgttacgacagcctcatccatgcacacatgaacggatcacaattccaaaattcattcaccatgacagcataggcatgagggggaggaagtatgcccaaaaacagcttcttttactggtggtacacttttgttgatacattgtgaggtggtgcctacacggggtgctcatcaaatggccaaactgtggtccccaaaaccttgcttaaatcacgtatgaagaaattttggcagatcgcagccacagtgtttgtgccatgctaatgtcaccagggctgactggacttctctatgactcaagccctaacaaagagataatgcagcaaaggacccacaactgctatactcagactgttacccagcatagcatactgttgcctaaagcttatg

SEQ ID NO: 28003 - DNA, 611 bp, Zea mays
  Clone ID: cC-zmle189069c11d1
gcgcccaagaagcattcagctgatgctcgtgcattttcgttcatcaagattcttttcctcattcaagacatgagctatcctccacaaatgttatttgtggaaaacgtagttggatttgaggtgtctgatacacatgaccagttgctggaggtcctttcaagtctcaatttttacacgcaagacttcatcctaagccccttacagtttggtgtcccatattctagacctcgctacttctgtttggcgaaacgtgaacctgtgcggtttcgacatgcattcgtcaacaataagttgctccagacacctatgtgcctgagcctgacactgagcagtacatcacagggtagcgaccaccagactgaagaagagctagagccagtttgtaagccaataaaagatttccttgtcaaggaggctgatggaggcactccagatgagacagttttgcaggattatatggtcccagtaaacttgattgagcggtggggcaatgctatggatattgtataccctgaatttaagcggtgctgcttgttcactaaaagctactatcgttatgtgaaggggacaggctcttttgtggctacatctaaaaaccctcatgttcctga

SEQ ID NO: 28004 - DNA, 108 bp, Zea mays
  Clone ID: cC-zmle189069c12a1
gatcctctagagcggaacgccctttttttttttttttctttattttttaatttttttatttttttttatttttttatttatgtgtatttgtttttttttttttttatt

SEQ ID NO: 28005 - DNA, 432 bp, Zea mays
  Clone ID: cC-zmle189069c12d1
ggacgcgtgggcctggaagctctactccgagaggctgatgaccctgtccggcgtttacgggttctggaagtacgtgagcgggctggagaggcgcgagacccgccgctacatcgagatgttctacgccctgaagtaccgtagcctggcaagccaggttcccgttgtccttcgattagtacggtgaaagaagaagaagaagaagcccaggccggagaaccatcgcctgcatttcgatctgtttcaccgcacttcgcattgttagtcgtgtattggagttatgtgtacttggcttccaagaactttggttccttctcgttttttttccttgtttgagcgtttctgggcagcgctggcctggatcctagtatggtgggaattggctgcaccttttgcttcgaataaaaatgcctgctcgttcacctgtcacaaaat

SEQ ID NO: 28006 - DNA, 408 bp, Zea mays
  Clone ID: cC-zmle189069d01a1
gggggggaacaaacccttaagggggggcgcaacattgttcttttccaaaaggccctgaatggggccccctgaacagggaccaggcccttattgggagacctcaaatggtgtggccaaaccgggggaaagggaccaccacctccctggggggcccgcttcacccttctatggggttggcccgggaggtaaaccgttttacccttggagcccaatgttcccacaggcaacacgtccgccagaatttcgggggcttttgctaagctaatgcccccctttgccaaggtcatccggatcaacatggacaaaaacagctgggccaatgatcgaggggggcccaacaagaggaatttggctgtcagaaattttgacattaacaacacctttttttcccgttgttacattcccaaa

SEQ ID NO: 28007 - DNA, 570 bp, Zea mays
  Clone ID: cC-zmle189069d01d1
gtacgcggacgcgtgggtccacagagaggcagacggcaggactcgctttttgctccttatctcgcgcagggggggtcgccggagatcacagcgacaatggtgaaggcagttgctgtcctcgccggcactgatgtcaagggcaccatcttcttttcacaggagggggatggtccgaccaccgtgactggaagtatctctggcctcaagccagggctccatgggttccatgtgcacgcgcttggcgacaccaccaacggctgcatgtcgactgggccacacttcaatcctgttggcaaggagcatggcgcaccggaagatgaggaccgccatgccggtgatcttgggaatgtgacagcgggagaagatggtgttgttaatgtcaatattactgacagccagatacctcttgctggaccccactcgatcattggccgagctgttgttgtccatgctgattccgatgaccttggcaaaggtggacatgagcttagcaagagcaccggaaatgctggcggacgtgttgcctgtggtatcattgggcttccaagctataagcggttaaccctccga

SEQ ID NO: 28008 - DNA, 545 bp, Zea mays
  unsure at all n locations
  Clone ID: cC-zmle189069d02a1
ttttggagtaaataagcgacagcccgaatttgcattaacaagtacattacatacacgattcctcctctgctctccaaagttttccatggtatacatacaccttcccaagatccatgacggcggtcggacacctagcagttagacactcgaatcactcgagctgagcgtaccagaccccctggatcttgacatccttgggcgccttggccccgaggtcggtgtcggacggctgcacgctctcgaagacgccgatgacctcgccggtctccgggttgctcttggtgacgctcaacgtgatgttgccggtggaggaggcggcgttcttgatgttctccttctggagctcctcctcgtcacctctgcccccggcggggagcgcgacggcgttgtcgtagccggtggagccgccgcggcccttggggtcgaggaaagaggagccacggtagctgggcacgaggaatggcccgccgaagctctcgggctttgccgtggcgacnagctgcttgacggtgaagaggaacggcacgcgctcgcccccgggagct

SEQ ID NO: 28009 - DNA, 581 bp, Zea mays
  Clone ID: cC-zmle189069d02d1
gggcataacccccgcgacgacgatggcagcctcgctccaagccgcggccaccctgatgcattcggccaatatcggcggccgggcgccctttgcctcgctgccgtcccgcccgtcgtcgcaactcgcctgcagggcgttcggcgtcgacgccggcgccgccaggatcacgtgctccctgcaggacgtcgccagcaggtgcgtcgacgccgcgaagctcgccggcttcgcgctcgccacctcggcgctcctcgtctcgggcgcgagcgcggagggcacgcccaagaggctgacctacgacgagatccagagcaaaacgtacatggaggtgaagggcacgggcacggcgaaccagtgcccgaccatcgacggcggcgtggagtcgttcccgttcaaggccggcaagtaccagatgaagaagctgtgcctggagccgacgtccttcaccgtcaaggcggagggcatcgccaagaacgccccgcccgagttccagaagaccaagctcatgacccgcctcacgtacacgctggacgagatcgagggcccgctcgaggtcggctccgacggcacgctcaagttcgagg

SEQ ID NO: 28010 - DNA, 531 bp, Zea mays
  Clone ID: cC-zmle189069d03a1
aatctataattgatgatgtattgaagaacagagttttgaaccatggagcagtttggaagttttacatgactggggaaaaaaaggacatgggattgtagcttttatgagcactgctactagtaatgttcacatagcatggctctgtaataatactgttgatcaccacatccaccagcagcaggcaatccggttgccaatgaggaggcagcctcagacaagcacctgagctgcagctagcctagcaatcggaaccctgaaaggggagcaagaaacgtaatccagcccagccttcgcgaagaaggccacagaggaaggctctccaccgtgttctccacaaatgcccaccttcaagttaggcctagctttgcggcccctctctgtagcaagctttaccagctcgcccactcccctctggtccaggacctcgaaggggtcatgttggagaatgccctgagcaagatagacgggaatgaacttttccacatcatccctgctgtacccaaaggtcatctgcgtcaggtcgttcgttcc

SEQ ID NO: 28011 - DNA, 547 bp, Zea mays
  Clone ID: cC-zmle189069d03d1
gtccgtcttctccttcggaacgaacgacctgacgcagatgacctttgtgttcagcatggatgatgtgggaaagttcattcccgtctatcttgctcagggcattctccaacatgaccccttcgaggtcctggaccagaggggagtgggcgagctggtgaagcttgctacagagaggggccgcaaagctaggcctaacttgaaggtgggcatttgtggagaacacggtggagagccttcctctgtggccttcttcgcgaaggctgggctggattacgtttcttgctcccctttcagggttccgattgctaggctagctgcagctcacgtgcttgtctgaggctgcctcctcattggcaaccggattgcctgctgctggtggatgtggtgatcaacagtattattacagagccatgctatgtgaacattactagtagcagtgctcataaaagctacaatcccatgtcctttttttccccagtcatgttaaacttccaaactgctccatggttcaaaactctggtcttcaatacatcatcaattatcgatt

SEQ ID NO: 28012 - DNA, 301 bp, Zea mays
  Clone ID: cC-zmle189069d05a1
ggggtaaggttaattttacaaactcaattcttccaccctacccccttaccttacaatataacctaataagaatacgataaaaaacttcacaatataaaaccctaacacaaaacctcaaatcaaaaaaaacccccaaaccaaccaaacctaaacacaaactggaatacacaaagggtcaaacaaagggagccaaataaaaaaaataacttataaaaaaaaggggcacttcaacagccccaaaatcctatttacaaaccttctataccaattcacaaaaaaaactcaaaaaaccccgatgaaa

SEQ ID NO: 28013 - DNA, 283 bp, Zea mays
  Clone ID: cC-zmle189069d06a1
aacccaaactcaatacttgtacatccggggctgctgaaacaacaaatcaaagaatgcgacacgactggagctacatttacatgacaccattcttttatcgcccactggaaaataagtagctactactaagaccgtcgacgacaatcgaatcgatgcctggtttctactttccaccactagggatcgtgcttggttttgatgccccacggacgtgccaacaaaactcgctcccttaccggagcttgcactcggcgggcacgccctgcgggaagcgcttggcgtc

SEQ ID NO: 28014 - DNA, 552 bp, Zea mays
  unsure at all n locations
  Clone ID: cC-zmle189069d06d1
gtccgacacacacagcaacgctcgctcgacactgtcactagctagttgttttactagagggcgggtatagagctgcctgcaatccgccgctgagaagggaggatcggaagcgacgatgaggtcgtttgctcctgtctttctgtcggcggtcgtggcctggctggagctggcgggcaccgcgcagggcggcaacttctaccaggacacagagatgacctggggcgatggccgcggcaaggtagtggacggcgggcgcgggctggacctgacgctggaccgcacgtccggctccgggttccagtccaagagcgagtacctgttcggcaagatcgacatgcagatcaagctggtgccaggcaactccgtggcacggtcaccaccttctacctgtcgtcccagggcgacgcgcacgacgagatcgacttcgagttcctgggcaacgtgagcggngagccctacacgctgcacaccaacgtgttcacgcgcggacagggccagcggngagcagcagttccgctctggttcgaccctaccactgccttccacacctac

SEQ ID NO: 28015 - DNA, 479 bp, Zea mays
  Clone ID: cC-zmle189069d07a1
attcaccagtatagttagcagtgtcctgttttatttgtcactgcaatatatatatacacacccgcggtactgttcacaacttattttatatagcagtgaagaaaaggacaaaatgtaaaagaagcatcaaattcacatgccgctggaagtcttggagacttgcttcagagcccgcatgatctcgtgggccttcagctcaccagtcgtgtacgcagccaagggggtctcagacgggacgacatcgtccctcttgtagcttcctgggctcctcaccagtgcttccgaacccttctgggtgacgccacggacgatcacggtcttgtgtagcccggatagcatctcctctagatcggtgtcgccatgttccccggtgatcagatacatgttgcccacagatacgccccagcgcacggaaagatacctgagtgcctgtgaccttgatgctagcagagggacaacctgaagccttgtcgagcgga

SEQ ID NO: 28016 - DNA, 512 bp, Zea mays
  Clone ID: cC-zmle189069d07d1
ggcagatggagcgggttcaaaaatgtagagctgtctttgaaagggtttttgattacttcagaaccagtgccccagagttgaaggaggaaagagctatgcttcttgaagaatggcttaataaggaggtgaactttggtgatcttggagatgtcagcttagtgcaaaagaaggcaccaagaaaagtcaagcggaagagaccaatccctacagaagatggctccactatagcatatgaggagtatatagattacattttccctgatgaagttgctctagcaccaaacctgaagatcctagaagctgcttacaaatggaagaagcaaaaaactggagatggcgatgagtgatcctggcatcttagtatggcattgtcgtggttcgtgagcattttgccacagccaaaatcagatgccctgcaacactctggccagagctatcggaatgagaatagtcatttttttatgtcacaaaggatgttggtgctcgtgaaaggaattctgcgaattacattt

SEQ ID NO: 28017 - DNA, 489 bp, Zea mays
  Clone ID: cC-zmle189069d08a1
ttttcccagccttcaatactccacacacatagctgagcatcagcacctgatgatactagcacgttcattgattgagaaaaggccagccccgtaatcttcttctgatgtcccttgagcttacttttgacatcatcaatgcggacattgtagatttggatggtagagtcctccattccaatggcgatgatattattatcttgtgggtggaatgcaaggaaagttgcagcaggtggaggtgccatgaaagtagtcatgaccttgaatgtcatcatattgaacaacgagactttgccaccagatgcagacataacataggagtcattttttgacaatgcaatgcaggcggttgcttcttctgggttgccatcattcgtgtcatttgtcatcagaatcccatttgcaggttgccacaggtgaggtgcaacagatgcagtagacttgccgctaggatttctgtcgctcccgtgccatttccacaacttatgaaca

SEQ ID NO: 28018 - DNA, 441 bp, Zea mays
  Clone ID: cC-zmle189069d09a1
acagcttatatactttatttatatataataacattattacaagtgtatatgcactgtagaaaggtaaacagctcgaaccaacatggtggggtcatcggagtagccctagcggaccctagttattactatcatcggccacaacgatgccgctgacatccggttgggcctgtggcttcggtagtatagcagcctccttcttggccttctccaacgcggtgaccagcctcgcgaggcacggtccagcgtcttcgaattcgtcggggctcctgggcgtgaggtgctcgccgacgtcgacgggcaccatgttcactttctggagcaaagccctaacacggtcgcactgcgccccgtgtgcctcgacgacgtcgtcgcggaggtgcatccgggccaggaacttgaaggactcgaagtcgcagtaggacatctcgatctttttgtcca

SEQ ID NO: 28019 - DNA, 543 bp, Zea mays
  Clone ID: cC-zmle189069d09d1
gtccgtggcattaatcacacgatgcctgcttggaatcatgtgttgttatttcgggccaattaaggcttatgctacagaagtgtgccgaaaagaatacaatcatctggctttggcagttgtttcttcctcacgaggcattggtctcattattggtccagctcttggtggttatcttgcgcagcctgcagataaatatccaagtatattctctcagacgtccatatttgggaggtttccatactttcttccgtgcctgtgtatatcaatccttgcagttattgctctaattgcctgcatctggtttccggaaactttgcataaacacaatggggatgccgttgataattccgttgaaacagtagaagaatctcttgctggcaccgacactgaagaaaatggaggtggcggatgtctaaaattatttacaaactggccgttgatgtcagctattactttatcattgatcttctctcttaggatgtggcttatgcagagacattctctctttgggctgtcagtgacagatccgtttggtggattaag

SEQ ID NO: 28020 - DNA, 529 bp, Zea mays
  Clone ID: cC-zmle189069d10d1
tgggcggacgcgtgggcggacgcgtgggcggacgcgtggttcatgcttttaaaaaaaaaaaaaaaaaaaaaaggggaaaaggaaaaaaaaaataaaaaaaaaaatccttcatcccccacctttcactgtacatagcttcattttctagtgtgcctccttttctaccctttctcattgatccctccctatctcccctgctgtctcctttttcttatgggtcctcccctttttaatccccctggtctccccccccttttttgccccttttaccatcctttttttccccccctcttttccctcttagtgcccctcttttttcctccctttacctataaacccccttgcccctcccccttttctcctcttgtgggggggccccctttccccacctttttttcttttataggaccccccccctctccccctttcatatgtctctcccctcttttcatattttcccccccttttctgttcctttctctggtggttctctttttttctccccttgacccccccccctttttccctc

SEQ ID NO: 28021 - DNA, 457 bp, Zea mays
  Clone ID: cC-zmle189069d12a1
accccccaaaaacatcattttcaaaccaaacactttttattgggggagaaaaaaaaaaacggggggtataaacccccccctttttttaaaaaaccaaaaacttttttaaaaaaaaaaaagggggtgccttaaaaacccaacccacaaaaaggtttaaaaattcccccaaaaaaaaaaaaatttttttcccaaaaaatataattttccgagaaaaaaaaaacgcgaaaatcctcctggaaaaaccctggcggaaaatattaaaatattcttttaaaaaattccccccttcttaagagaggccctttgggcttggaacaccaaaaagggggattctctcccaaaaaaatattttctccccccccaaaaacttctttaagcccctcccctctttcaaaaaaaaaacttttaaagcccccaaaaccccaaccccttaaaaaattggcgggggggggccccc

SEQ ID NO: 28022 - DNA, 596 bp, Zea mays
  unsure at all n locations
  Clone ID: cC-zmle189069d12d1
cgcgcccgtagggatgaaaggattaacgacaatctgaggttatcccgtaggattgtttgaagattagggtagcattgaatccatcgctagtggtgttgcaatggtggcgatgccgcagtgggcggaccagccgacgacggccaagtatgtggagagcgcgtgggggattgggggtgcgcatgccggaagggttccttggtgaggaaggaggtggagaggtgcataagggaggtgatgggcggggagaggaagcatgtgtacgggaggaatgccgctcgttggatgcacaaggccaaggaggccatgcaggaaggaggaagctctgacaagaacattgcagaattcgcagccaagtatttaccaaagtagatttccgattatgttctcctcggataatgagttttttgggcaataaagtttcttgtctttagggctaatttcgaaacttatcgtgtgcttggtttgtagaagtcaccctatttctcattatatactagttattagtttatgagaaataaggtggtgatgaatcaacccgtcttatcttacaaaccanataaaaaagtaatgaatgagaataagatgtattggtggaa

SEQ ID NO: 28023 - DNA, 469 bp, Zea mays
  Clone ID: cC-zmle189069e01a1
accgggaaaagcacatgagttccggagaatcatgttattacataaaatgtatgccagatgggccaatattttcagagttacaactacatgagataagttctgaacaaatcccgacaactttaaccagcaggagccctagatcaggccttgacgctgcaggtcagtgtaggtcttcttgttgtagatgttgccttcctgatcttcatactcttcctctaggtctggccgccacttattcaccccttgtcgtgcttgaattttctcccagagcgctttcgcctcctcgatggatgtaatttcattgaaattcttagtattgggaatgccaaggcatcgcatcccatgctgatgacgccattccttgaaatgacgctcataagccctttgcccccaatagctatggtttccacatatctcacacttgaattcctgcccaaagccatgtagcttgtacagccagtaggggata

SEQ ID NO: 28024 - DNA, 496 bp, Zea mays
  Clone ID: cC-zmle189069e01d1
acccgtccgcacagagccattgcaagacattgataagatttttttttttgctggttagtgaattcgaggaacaatgggccaatgaaggaatacttggatgggggaataaagggacagaaaaagagtctgaaatagatctcgattactacagcacagttgaagaacttgttgagcttggcccagaaaaattaaaacaggctttagctgctcgaggtttgaagagtggcggtactgttcaacagcgtgcagatcgtcttttcttgttgaaggttacaccgttggaacaactagataggaagcattttgccaaagttccacatactaaagatggctcaaacacagctcctaatggtaatgctttcaaggaggatatgaagaaagaaattgcattgatggaagtgaagatgaaacgtctttgtgagctgctagatgaggcctttgttaggacaaaggaaaatgcggagaagaagcttactttgacatatgaagagatgga

SEQ ID NO: 28025 - DNA, 375 bp, Zea mays
  Clone ID: cC-zmle189069e02a1
agaaaccaaaggcgggaatgggatgcaccatattctgagttacacactgtccgatccatgcaccacatttattaaataaaattaatcgaccagtcgaagtgtaacgacgcagtcctacattgtccattaccgaactaaagctaagagtggcaggtatagacgagaggcgtgagcaaatttataatctcctgcttcgatttccttggaccgaagcaattgcagacgatattagcttcaataagaagccaaccagcagcagttaaagctgaatttgagaaatggaaaagggaagcaaaacaaataaggccttgttcgcttattcccaatacacatggattgaatgggtttggaaaaaaatatgaaaaagtttgactt

SEQ ID NO: 28026 - DNA, 531 bp, Zea mays
  Clone ID: cC-zmle189069e02d1
accacccgtccgcccacgcgtccgatgaagaaggcctcagacattgctttaattcttttgttggcaaatgaacctatgtagagatccggtgtcaggaggatctgcttagggcttgttcggttagccttcaatccatgtggattgagtgggattggatgggtttgaatcccacgcaagtcaaacttcttcataattttttccaaacccattcaatccatgtgtattgggaataagcgaacaaggccttatttgttttgcttcccttttccatttctacaattcagctttaactgctgctggttggcttcttattgaagctaatatcgtctgcaattgcttcggtccaaggaaatcgaagcaggagattataaatttgctcacgcctctcgtctatacctgccactcttagctttagttcggtaatggtacatgtaggactgcgtcgttacacttcgactggtcgattaattttatttaataaatggtggtgcattgcatcggacagtgtgtaactcagaatatggtgcatgc

SEQ ID NO: 28027 - DNA, 262 bp, Zea mays
  Clone ID: cC-zmle189069e03a1
aaaacatgcttttttattacttttttcacaccagaggccgaaccgggccattttattttaatcaagcagagtggtgcgccctttgacaacggtattccattcagcaacaggggaattaataccgctgtgcaccgggaaccggatttacttaaagaagccaaatttggatcggtgccaattccacaaacagaatttgcagaattttaatcaccagactgggaacaaacaaaggatcgactgacttacaatgaaaacaaaacac

SEQ ID NO: 28028 - DNA, 554 bp, Zea mays
  unsure at all n locations
  Clone ID: cC-zmle189069e03d1
gtccgcttgtggctttctcttgcccctgtggtcattggtgtttcaattttatcccttactgagctttcattcaactggactggcttcatcaatgccatgatatcaaacatctcattcacttacaggagcatttattccaagaaagctatgactgacatggatagcaccaacgtgtatgcttacatctcaataatcgctctaattgtttgcattccacctgcattgatctttgaagggcccaagctaatgcagcatggatttagtgatgccattgcaaaagtaggtttgacaaagtttgtcagtgacctattcttggttggactgttctaccatctgtataaccagatggctacaaacaccttggagcgagtggctcctctgacacatgctgtcggcaatgtgttgaaacgtgtttttgtcattggcttctcaatcatcgcttttggcaacaaaattagcacacaaacctggaattggcacgtccattgccatagctgggtgttgctatgtactcttaccattaaggctaacatntgaagaagaggaaaaggaaa

SEQ ID NO: 28029 - DNA, 129 bp, Zea mays
  Clone ID: cC-zmle189069e04d1
gtccgcggacgcgtgggcggacgcgtgggaaaaaaaaaaaatttaaaaattttaaaaaaagggcgaaaaaaaaaggggaacgaggaaaaaaaacacaagaaggcaaccccaaaaccactatatagggaa

SEQ ID NO: 28030 - DNA, 543 bp, Zea mays
  Clone ID: cC-zmle189069e05a1
ttttacaaaattcattttttgcactatcaattggcaagtgatcttgcaatacaatataagcatattcgagtggaacaaccagattcagttccttagatttcacgcgcttgtgctttgagccgtaggcaactgcaatcggtttcttgaacagcgaagcatcggaggtctggtaactggccagaaaataggtatgccggagcagaactattgtgtatgtgtatcttgtttagaatggcttccctgcagcttccatcatctcctttgcacggatcagcttctcgatttgcctcacgatttcaaggaccatgtcctcaagcgtcaccaagtcaatgctactgtacccccgctgagaagccacattttgtactgaaacagtaatatcagaaaccccatagcgctctttcagttcatcataccgctgacggagcttgctcatcgcctgaaaaaaagagtctggatctgtagtagcttgggttcccgtgctcttcaacatgtcatttgctgccatttcaagagaacatcaatccaaatggagacaccatg

SEQ ID NO: 28031 - DNA, 589 bp, Zea mays
  Clone ID: cC-zmle189069e05d1
acccgtccgggtacggattgcacagccaagcgcaacatcgccaagttgcttgtttattccataatataccgctacctgagcagtgaggaactgcttgaggatgttcttggtggcaaggacgccctcagagccttcaaggaatctgatgagaagggttatcttgaagtcgagaccgaagggttaaagcagctcacgtccatgggtagccttgtactgtgctgtggagatggcgccgttatgaactcaaccaatctagggctgctgaggcatggtgtctccatttggattgatgttcctcttgaaatggcagcaaatgacatgttgaagagcacgggaacacaagctactacagatccagactctttttctcaggcgatgagcaagctccgtcagcggtatgatgaactgaaagagcgctatggggtttctgatattactgtttcagtacaaaatgtggcttctcagcgggggtacagtagcattgacttggggacgcttgaggacatggtccttgaaaacgggaggcaaatcgagaagctgatccgtgcaaaggagatgatggaagctgcagggaagccattttaacaag

SEQ ID NO: 28032 - DNA, 338 bp, Zea mays
  Clone ID: cC-zmle189069e06a1
gtgagaataggattattgacaaggggaacaggggtgcagtttatttcctttaaggaagagtactgtaaacacattttgtaaaaaataataattattcttttcgcactgagttacttctcatcttcctgtgaaggcaaggcatcttcaacagcgtagacatacacaggacaagactctgacagactttatgcatgtccttttgggagctttgacaattcacccatcagtcccgcgtcccggactggaagatgaggaaggccgtgaggacgcccaccgcgccggtgagcgccagcgccagcgttggtaccggcgcggtcaatcccacattttgaagcacg

SEQ ID NO: 28033 - DNA, 466 bp, Zea mays
  Clone ID: cC-zmle189069e06d1
gaaccacccgtccgctatctggaagtgtctctacttagcactgcaacaatttataattttctgcaatggcgagcactagcatggtcctgtgttccacgggcttggaaggcaaggacccgaacctgcctgcgcctggcgtctgcacgcaggcccgcctgaagattcacgctactgaggctaaggccaaaccagggggcgcatgccggagcccgtggtaccgtcccgatcgcctgctgtaccagggcccactgtccggggagccggcgagctacctgacagaccagttaaacggccgactacagaatgggacactcgagcgctgtcggccgaccctgagacgttgcgcaagaaccgggagctggaggcgatccactctcgctgggccatgctgggcgcgctcggatgcgtctttcaagagctaatggtccgcaacggagttacattaagtcaggccgtgtggtttaag

SEQ ID NO: 28034 - DNA, 427 bp, Zea mays
  Clone ID: cC-zmle189069e07a1
tttttgatccatccgcatgcaaatcgaagcacaaaaccatttatttgcactactgactgaccgaataaaccataacaattatgtcattggatatctggatcgcaatgaagcaaacaattggaacaaacagtactaggccatcaatcaacatgatatcgaaccagattgatgtaactacgagcctctcaatcacagtacagttgtagcacagcgatccatggcatactttgtagcaatgattgacacactacagaagctgaacacacatactaacatttagctcctcatgacgcgcaccaaacaaatcaataacagtagcatcggcctagcaaaccgtgggagcaataacgagaggatgaattcatctcaccttcaagcggacgggatctcgacctcgccgtcatcaatctcctgctgcaggtccttg

SEQ ID NO: 28035 - DNA, 542 bp, Zea mays
  Clone ID: cC-zmle189069e07d1
cacccgtccgcctcactcctcaccatttcccaaaccctacccatactttcgccttttgccgccgccatgccgcccaagctggacccgtcgcaggtggtggaggtcttcgtccgggtgacgggcggtgaggtcggcgcggcgtcgtccctggcgcccaagatcggcccgctcggtctctccccgaagaagatcggcgaggacattgccaaggagacggccaaggactggaagggcctgcgcgtcaccgtcaagctcactgtccagaaccgccaggccaaggtctccgtcgtcccctccgccgccgcgctcgtcatcaaggcgctcaaggagcccgagagggacaggaagaaggtcaagaacatcaagcacagcggcaacatcggcctcgacgacgtcgtcgagatcgccaggaccatgaggaacaggtccatggccaaggagttggccggcaccgtcaaggagatcctcggcacctgcgtcagcgtcgggtgcaccgtcgacgggcaggaccccaaggacctgcaacaggagattgatgacgg

SEQ ID NO: 28036 - DNA, 318 bp, Zea mays
  Clone ID: cC-zmle189069e08a1
gggttggaaacaaaaaaagatatgcccaagctcgtctttgactagtttacaatggaactggggaaggggaaatgaacagggaggctttttcttccattggcctggagttcgatgggcccccccgacttcttttttttgcaagcccaagatctgggctttaaacttccctgaaacagaccccctgggataaacaaaattgcgggccaaccttaaaaatggggaacaattgggtctttcccattaaaagatccaaacttttgatatataccatgggccccacatgcggacccgtgggcggacgcttgggcggacccctgg

SEQ ID NO: 28037 - DNA, 373 bp, Zea mays
  Clone ID: cC-zmle189069e08d1
cacccgtccgcccacgcgtccgcccacgcgtccgcatgtggggtccttggtatttttctaaagtttggatcttttaatggtatagatccaattgttccacatttttaaggttggcttgcaattttgtttatcctagtgtgtctgtttcatgtatgtttgaagtccacatcttgtgcttgcaaaatagaggagtcgaggtggcacatcgaactccaggccaatggaacgaaatgcctacctgttcatttccacttcaacagttccattgtatactagtcaaagacgagcttgggcatatctttttctgcttcaaaaaaaaaaaaattaaaaaataataaatataacaaaagggggggggagttaatatttttgg

SEQ ID NO: 28038 - DNA, 524 bp, Zea mays
  Clone ID: cC-zmle189069e09a1
ttttgaaccaatttaaacttttttatttcttctttttgcatagaattcatgcaaccatccttttttggaaagtcacaattataaattacctgtgtcgacaaggtgtggtgatcagctcaaagcagatgtgcaggcaaattgagcaagagccgatccatgcacgccatgatttgcatgagttagtttctaatatacaatcaatagattaaactgggatcgagaacaaattaaacacaccatttaataacagagataggatttcctcaatgatactctgtgacgcctgcctgtgtccttccttgcgttagaggcattgttgtgtataccatgttgttgtttttgcaccacaccattggtggaaggtggctccttggtgggttgctttttttcaaaaataaaataattcacactcaggccacaacaaagattagtatgcaatgtattcttacatggcatgtgtcactgaacctgaactgaaagaaaaaagatgtcattctatactgactgaaaagggttctcatttg

SEQ ID NO: 28039 - DNA, 384 bp, Zea mays
  Clone ID: cC-zmle189069e10a1
gggggcccccacttggcaaacaatttgctggggggggggccccccttctcttttttttaaaacaaaaaaaaaaccaaaggggcacctttaaaaccaaaaacctggggggaccaaaacctcccaaaaaaaattttctaggaaaaaaaacccttattcaatttttgatttcccaaaacctggcgacccgtcccccccttttttagggtttccgcaaattgggcttgtaccatgggccccccaaaaacctttgggcccaaagggaagttctggtgccccccccgggggggggggacccctctctgtgtttattggggggtccaaaaaaccctccccggcgggggggaaaaccctcgtttctttcttttgttaaaaaaactttttttt

SEQ ID NO: 28040 - DNA, 658 bp, Zea mays
  unsure at all n locations
  Clone ID: cC-zmle189069e10d1
gcctgtctcctctgttctccctacacttcgctcgactagctcttatcattttcaatccgaatcaacgctaaccaagggcatcgaagctcaaaaaatgtcgtcctttaccgaaaaacttaccgctctcgctgaacatgtcgcgtaccccaacaaatctgaaaaccctgggacacctggaacacgatgcgtcccatggggctcgtctagtagaccacgaaccatcaacagggatctgggaccgcctgcacggagagaacaccgctcgtcaaatcaggagtcagggagattgcggagttggaatggaagatggtcttcaacgaaaagcacttcgtcaacaagagcaagtagccgagcgttctcgcctcgctcgtgaaggtcttttctagcctcacatgaaacacgaagagctcaccaacctcacggaggagcaccgagacgtcgcctctggctcaaaggtcttttgaggacccgacgtacaagcccaaattgccgaaaccctcaaagatggaggaatcggtcgtcaagcgttggagaatcaaaagatgaactaagctcatttttcttgaagattgctttcgcatgttttgttcccntccttcttggtttactgttccccttcgtctcttttcatttatacatgcttagcagtccccaacca

SEQ ID NO: 28041 - DNA, 423 bp, Zea mays
  Clone ID: cC-zmle189069e11a1
gggttatattaatttatttataaaaactaaaccaccacacaccaagaaacaaacaacataaaaaaaacccaaaacatcttcctcaacaaatcacctcaaccacaaataataatcaatcaaccaaaggtaaaaaccccaacaaaccaaacaaacttccaaccaaaactcgtaaaaaaaaaaaaaaccaaagataaaaaaacactaaaaaaccaaccccttacaagctcaattaaccaccaatcccactctaactccattactccaatctttcttttaacctaccacataaaaaccagtacaacaccaccaataaaacccttgtaattacaaacaagactcaataaaaaagaccacaaaaacaccttagaaaataagtaaaacctctcaaaacctcaattaccaaacaaatacacacatcatcaa

SEQ ID NO: 28042 - DNA, 291 bp, Zea mays
  Clone ID: cC-zmle189069e11d1
ccgcggacgcgtgggcggacgcgtgggcggacgcgtgggcgtgatgcgtggtcggacgcgtgggtggctccagatctgtgtaggggagttatgttcgactcaagatttagttgttgagattcttagtctgggagggtcagaaccagattttggataggtttaccatggcctggtctagtttctgtggaagaaaaatcatgcgaacgtcatgaactatgtggctactacaattggagatctttaccccatatgctatagctgtgtgtttggtggcttcaaaaatacaaataa

SEQ ID NO: 28043 - DNA, 381 bp, Zea mays
  Clone ID: cC-zmle189069f01a1
attattttttctttttttttatatttattttttaatacagggtctccagggattcattatttaaataccactccccatcaacccaaacacagaaaacccccccccccaccccctatttaccaccccatctccccatacaaaacccaataccactaaaaagcatatccatatacctaactcaaaagaaaaaaatataaatctccccctcataaaaccaacctccacaaccaaagcccaaacacaaaacccccaacgaccaaaataaaaaaccccccaaccacaaaaataaatgccccctcaaataaacatcaaacccccaaccccccagttcaaaaaaaaaaacaaattcccccaaaaaaacaaaaaaaaaacccccccccc

SEQ ID NO: 28044 - DNA, 430 bp, Zea mays
  Clone ID: cC-zmle189069f03a1
aaagggaaaaaaacatggactgctggtcattgttctgctgcatcatcaagcttacactaggaacacttttaccaaccaaaagaaacctaaagttcatcggctgcttaactcgagccccatcttttgttgttgcgttgctaaaaaagtcagaagaatctcatcttgcttctctccacctacagatctcctattgaccatgtcaagggctgctgtccgccgccgccttttgttttcgctcgcaaccaaacaggatcaactgccacatctttaccgcgacaatctgatcctacgctgctctgctcaactgctcatcgcacgagacatcgccgctatcaccttctccctcgtttgctgctcagtgccgggacacttgatgatgaaagaatgcaccactgtcccgttgttgttgttgcccgtcacctttgactcg

SEQ ID NO: 28045 - DNA, 492 bp, Zea mays
  Clone ID: cC-zmle189069f03d1
acccgttcggctcctggagtctggtatggtggacccaagggagctttcgccttttccggaggtggacatacaggtggggcaggacgaggtccttgtacgagtgatgtctccaatggagaaccatccagtcaagaaggtcttccaagcgttcgaagaggcagaagtccgcctgggcgagtcaaaggtgacgggcaacaacaacaacgggacagtggtgcattctttcatcatcaagtgtcccggcactgagcagcaaacgagggagaaggtgatagcggcgatgtctcgtgcgatgagcagttgagcagagcagcgtatgatcagattgtcgcggtagagatgtggcagttgatcctgtttggttgccagcgaaaacaagaggcggcggcggacagcagcccttgacatggtcgattggagatctgttcgtggagagaagcaagatgagatccttttgacttctttaggcaccgcaacaacaaaaagatgggg

SEQ ID NO: 28046 - DNA, 415 bp, Zea mays
  Clone ID: cC-zmle189069f04a1
aaaaaaagggagagccatctggaaacatgcatatatagaaattatttttcctcagatctcgccgtcaagcatacatgcattatctcagacttcgcaggggcgagctcgatcgatatatatgatgactagcatcagtactaaaatagtattgtatcagggacacacgtacggtatcgaccagagcaccatgcatggtccatggatcatatcatcattatcatggcttcatgggatgggaatggatcggagtacctgcttaaccatgatcagtacacacgtatctctcggaggggcggcggtatcccgggtgatggccgggcgattaattagtagctggagttcttgacgaacattccctccttggcctcggcggcctcgccggcggaggtgtacttgccgagctgcgccagggagt

SEQ ID NO: 28047 - DNA, 520 bp, Zea mays
  Clone ID: cC-zmle189069f04d1
ggtcgacccacccgtccgcccacgcgtgcgtgctagctaggataccgccatactttaagtctttttcacaagtttaggagtgacaggaacaagagatcgatggcctttgccaccgtgctcaagtcctccttccttcccaagaagtccgaatggggcgccaccaggcaggccgccgcgcccaggccgaccaccgtctgcatggtcgtccgcgcctacgactacgccgatgagctcgtgaagaccgcgaaaacgatcgcgtcgacggggcggggcatcctggcgatggacgagtcgaacgcgacgtgcgggaagcggctggcgtacatcgggctggagaacacggaggccaaccggcaggcgtaccgcacgctgctggtcacggcgccgggcctgggccagtacatcttcggcgccgtcacttttgaggagacgctgtaccagtgccgcgtcgacggccgcatgatcgtggacatactggcggagcagggcatcctgccggacatcaacgtggacaagggcc

SEQ ID NO: 28048 - DNA, 401 bp, Zea mays
  Clone ID: cC-zmle189069f05a1
gggaagcccaaaaaagcaaaaatttttttttaaagggaaaccatcgatccccgcgaatacctgcctacccattatttgatttttcccctataaaccaaggcgcaggttaatttatttatctggctgggtggggaaacctgctacccccacaatttcttttcgggggggggacaaaaaccttattccccccggggggggcccaacaaacttttgacgttgtcccaccccctgggcaaaatgggccccccgcacaaagggcaggggggcgccccctcgcccctgggggcccaaacttttttgcagggggggggaaaaccgtgggaacagccctacaatttccccaccgcctggaaattttcctgtttcaaaccccccaaaaaaattgggcaaaagggcccccc

SEQ ID NO: 28049 - DNA, 594 bp, Zea mays
  Clone ID: cC-zmle189069f05d1
cccacgcgtccggcacgcggctgcgctcgatcaggcttcagtgatgtgctaccacagcctaccgcgtatgtatcgccgatgagcaaccccagcttcgaccacagctacgagctccctctgcggcgaaacctcctgcttctgcgcgacctcctcgacctcctccgcttcatcgccggggtgatcctggaccgcctcggcgtcgcgccgtgccagggcgaggtgcatctgccaggacaggctttaggcggcgtcggcgagcatgtcaacgatgttgacttggaacgcctcctggaggcgatgctgtgggagaccgtgacgcggtcgctcacggctccacggtacaggcggcggcgggttgcgcagccggcggacgtccagctggacgcagaaggcgacgccgagggcgcggccgtctgcgcgatttgcttggcgggtctggaacagggagatttccaggcggtcgtggagctgtgcggctgctcgcacgcgtttcacgccgcctgcatcgatgcttggggtccgcagtggcgacggtgcggccacctgcccgctgtgcccggcgcccatgtttgtccacggcgtgggacgacgtgc

SEQ ID NO: 28050 - DNA, 505 bp, Zea mays
  Clone ID: cC-zmle189069f06a1
tttttaagtttgtatgtcctggcatggaattgatacaagtatagtgcaacatacacaatactgtgtcaatttatcagtatcaacagtgcagaatttccttagagttgcaataattatatccccaatagctcaattgaagcaatttaagcaacaaggacaatggggagccggacgtttccataaccataataacaaggttaaccttgtatagtaagaattgaacctttggatctaacaacaaacaacacatccacaggatgaggaaggatttcacctttgaggccaatcctcacaccgcggaaggttgctggacgtgcctcccccgtgcgccgccaacgccaccgagcctgggcacatcgaggcctccaccgattccgtcgggcatgaacgaggcaggtcgattctcgatgacctcgtcgatgaggccccagtcgcgcgcctcttcagggtccatgaagaggtgcctctccatgcactgctcaatcttatcgatgggctggcgcgt

SEQ ID NO: 28051 - DNA, 485 bp, Zea mays
  Clone ID: cC-zmle189069f07a1
acatactgcagtgtacaattttcgggcaaattgttcgacagttttacaggcacgcacttactgccaggaaaaaatctctagcatgatttcatgaatcaacagcacgggcagctacatcacagagcttaatggatgaaaggggaaagaagaaagaaaaaaggaccatactgtaacaacaacaccagccccagtcgtcattctacggcagcgttcccgtcgaggcggccagcgagccagccagccaggagcatgaacggcggtcgggggagtcagtttccttgcggagcagcagccagcgtctactctgagcatcaggtacaacagccagaagaacacacagcacgatggatccctacacgagacagctaagagtgttggtcgttggtggtctctttgtcgtcgcctgatttctcaccggtagttccgtctatgaagcggaccatgataactgtgatgttatcggagcttccccttcgggaagcttc

SEQ ID NO: 28052 - DNA, 259 bp, Zea mays
  Clone ID: cC-zmle189069f07d1
gcatgggtactgaagccgagtgtttgtttgaaaaagagaggggcgtctgaatctactgtgcacgcttgagtgtactagagacggctgcaccttcgacccgagccacacttaaaactccaagggactcatacatacagatatgcgtataacgctccggagaaatagcaacaagaccccacccacttctgtggagatctcggcgggtctcggctgtgccgactaagaacctgtgtgtcgaagaactgatcccacgcgtatg

SEQ ID NO: 28053 - DNA, 369 bp, Zea mays
  Clone ID: cC-zmle189069f08a1
acacttccccttttttttttttttttttttttttttcccaaaaaacccccttaaaaaaaaaaaaaaaaagccccccggaaaaaaaaaaaaaaaaaaaaacccccaaaaacaaaaacccgcaaaaaaaaatccccccaaaaaaaaaggggccccccccaaaaaaaaaaaatttaaaaaggaaaaaccccctttttttcttttccataatttaacccccccccatataaacttttataatttccccccccttacccccatttttttttccccctttttttttcttgggggggcccaaaaaaaaaaaaagaaaatttcccaaaacttttttaaacttttggaaaaccccccaccccggggtcccccccaaaa

SEQ ID NO: 28054 - DNA, 436 bp, Zea mays
  Clone ID: cC-zmle189069f08d1
gcgattgccaagaagttaaagaagattggaaagattgttcattgtgtctgttggacctgcaaaagaagaaaagaaggaagaaaagaaagaggagaaaaaggaggaaaagaaagaagagaagaaagaggagaagaaagaagagaagaaagaagaaaagaagtgataaacctataaaacatatatatcatcgcatggcctcacttatcttcagttgcattgactttgcactgttgttgctatgtggagttactatgtaatacttatactacagagtacatattagttaataataaaagtgcaatttgtgctttataaaaaaaaaaaataaataaaataatatgaaaggaggatgaaaattaaaaaataaaaaatataaaatatcatattgataatttatgtatttgccttaaacaaaattactaatttttctttttgg

SEQ ID NO: 28055 - DNA, 396 bp, Zea mays
  Clone ID: cC-zmle189069f09a1
aaccactagcagttcttggactaatgatacatgtgcttccacaatgaatcgggaaaagcacaaaacaaaacccatcgggacagatgatatacactgatgaaacaatgtctacaccctttatagcctccgctttaactaatgtacatataccagtgcgtgacattccttagccctcagtcgattaagaacgcatcacacgaactggcttcgagtcttggcctttcagctcggaccacatgacctgatggaccggcgactcaaccccacagggtctggatgatggtgttgtgccatgggtcggacaggtgctgcagcaggttgtcgaagggccccttgccggtgacgttgtgctggatcaggaaggccaggaacgccagcatggccagcctcccgttg

SEQ ID NO: 28056 - DNA, 554 bp, Zea mays
  unsure at all n locations
  Clone ID: cC-zmle189069f09d1
cacccgtccgcgtcgtcgtcgacgctgttcgtgatcgagttcatcctttttcatttcgtggagatccggcggtggcaggacatcaagaaccccggcagcgtcaaccaggaccccatcttcaagagctacagcctgccgccgcacgagtgcggctaccccggcagcgtcttcaacccgctcaacttcgcgcccacgctcgaggccaaggagaaggagctcgccaacgggaggctggccatgctggcgttcctggccttcctgatccagcacaacgtcaccggcaaggggcccttcgacaacctgctgcagcacctgtccgacccatggcacaacaccatcatccagaccctgtcgggttgagtcgacggtccatcaggtcatgtggtccgagctgaaaggccgagactcgaagacagttcgtgtgatgcgttcttaatcgactgagggctaaagaatgtgacgtactggtatatgtacattacttgaagcggaggctatatagggtgtagagattgcttcatcaangtatatcatctgtcccgatgggttttgtt

SEQ ID NO: 28057 - DNA, 298 bp, Zea mays
  Clone ID: cC-zmle189069f10a1
gggcgcacaaacacaaaacatctcaaccaaacttaggtagtcttattgcaatcttgagtttagtctacatagccataaaacacaacaatatgagaaaagaggcacaggaaaataccatgaaggcatgaagcagctcagccagtgatcatggtgcctgtgccctcgtctgtgagaatctcaagcagaagagagtgtggaacacgcccatcaatgatacttgcggtgtgtacaccttgtgcaagggcgtgaacacaacactccaccttgggtatgatgccaccagctacctttccgtcag

SEQ ID NO: 28058 - DNA, 312 bp, Zea mays
  Clone ID: cC-zmle189069f10d1
gacccacgcgtccgctgacgggaaggtagctggtgggatgatacccaaggtggtttgttgtgttcacgcccttgcacaaggtgtacacagggcaagtatcattgatgggcgtgttccacactctcttctgcttgagattctcacagacgagggcacaggcaccatgatcactggctgagctgcttcatgccttcatggtattttcctgtgcctcttttctcatattgctgtgttttatggctatgtagactaaactcaagattgcaataagactacctaagtttggttgagatgttttgtgtttgtgcgccc

SEQ ID NO: 28059 - DNA, 462 bp, Zea mays
  Clone ID: cC-zmle189069f11a1
gaaacgggaatttcagttctcatggcattatgatgaatctcagaacataacaggtgaaacacgaatcaagcagaggcgccatggggttcacagatccacacctaaaccgctaaattaaactgcgagcgatacatgataaactaagaccaccactcagatcaccaccatcttattcagatccaaaggaacggacgcagggggagtcgacgatgacggagggagggcggccgaacagaccagatcagagagatctaggagagctgtccgcagtcagcgaccttgaccaccttggaggtggagccgttgcgggtgcccaccttctcgatggccttgacgacgtccatgccctcgacgacctggccgaagacaacgtgcttgccgtcgagccaaggggtcgcgacggtgcaaatgaagaactgggagccgttggtgttgggcccggcgttggccatggagagcaca

SEQ ID NO: 28060 - DNA, 275 bp, Zea mays
  Clone ID: cC-zmle189069f11d1
cccacgcgcccggaaaaatatccccaaaccctagctcccgatctcgatggcttacccttttgtcttcttcgacatgaccgtcggcggggccccggcgggccggatcgtgatggagctgtacgccaacgaggtgcccaagaccgcggagaacttccgcgcgctgtgcacgggcgaaaaagggcgtgggcaagtccgggaagccgctccactacaagggctccaccttccaccgcgtcatccccgagttcatgtgccagggcggcgacttcacccgc

SEQ ID NO: 28061 - DNA, 525 bp, Zea mays
  Clone ID: cC-zmle189069f12a1
ttttataggacctaatttggaatcaaaacaaaactaaaacgcattacagtttgaaatacggaaattacattatatgtaaacatagcaatgtcatatatattatatacatatacacaccatatataccatagtcttatgcgaaaggaacaaaatataccatatagttcctctctaaaaatagatggttactatagatgtgtccaacatccaagcaaataccaagttagcgaatcatactagatgctgccgcaagttcttgctccaaactgtaacacccagacatcattggaattgttaaacgttcctcattataaattggattgatacgttcatgtgggtgctgagcttctgcgcataacaaaggttccatttctccacccttttcaatcaaaagatgtgttttattccgtagcctctttgttcttagacattgcaatctcatatctacttctttcatgcttggtctatgtcctcctttggatcttaagcacgcttctataagtgaggagatttcattaaatctct

SEQ ID NO: 28062 - DNA, 578 bp, Zea mays
  Clone ID: cC-zmle189069f12d1
cacgcgcccgctcatggaaataatacattctcaagttgtggaagaggcattatcaagattagattaatgaaatctcctcacttatggaagcgtgcttaagatccaaaggaggacatagaccaagcatgaaagaagtagatatgagattgcaatgtctaagaacaaagaggctactgaataaaacacatcttttgattgaaaagggtggagaaatggaacctttgttatgcgcagaagctcagcacccacatgaacgtatcaatccaatttataatgaggaacgtttaacaattccaatgatgtctgggtgttacagtttggagcaagaacttgcggcagcatctagtatgattcgctaacttggtatttgcttggatgttggacacatctatagtaaccatctatttttagagaggaactatatggtatattttgttcctttcgcataagactatgggatatatggcgtgtatatgtatataatatatatgacattgctatgtttacatataatgtaatttccgtattttaaactgtaatgcgttttaggtctgttctgattacaaaattggtactct

SEQ ID NO: 28063 - DNA, 519 bp, Zea mays
  Clone ID: cC-zmle189069g01a1
caatggaaccaaacacctcttagcaaaacaatgggaaatactatagtattcttcaatatcatggttttacctcaaaactctaaaaatactttgctccaaacaccccctaaactgggtaaataaataaatttaagacaagcatacattattattatacaaacatacagaagcgcctctcccatcatttgagatgctcttttggctttcccacttacaacagtggccccaatgtgctgcaatacacgcttccatgatttcctacataaccagttctagtacagtattggcaagcattgtgctagttggtattggctcgtcggaatggtgtgattctgatgcacaatgccgcctgtcatgatcactgccacctgaaccatggtggccattgtctccaccactattatcaaagctgtcccctccatctttttgatcctttgaactcccagcgctgccatttcgggtaaagccctggaccaggtctgaccttggctctacaccaactcgtcttagatgtagctg

SEQ ID NO: 28064 - DNA, 582 bp, Zea mays
  Clone ID: cC-zmle189069g01d1
gtccggccttggtctccagttgttaattggaccccttcttttttgctgtttcggtacctcttgacaggaatccgagatggggcccatgaaccattcatcgcagactcagtagattttgttgtgggtcaggtggagacattgtcaagagatgatctttcatcaaggttgatgttaaatgttaatgttgcatccgttgggtcgttaatgttgcctgattcactcatcactataatggatacaaatgactactctgcagttccccagcagttgaaggaacagttgaatgaaaggtaccctggtgcaaggcgtgctgtactgaagactggtggtgattttcccttcctgtctcgtcctgatgaggttaatctgtaccttcagctacatctgagacgagttggtgtagagccaaggtcagacctggtccaaggctttacccgaaatggcagcgctgggagttcaaaggatcaaaaagatggaggggacagctttgataatagtggtggagacaatggccaccatggtttacgtggcagtgatcatgacaggcggcattgtgcatcagaatcacaccattccgacgag

SEQ ID NO: 28065 - DNA, 412 bp, Zea mays
  Clone ID: cC-zmle189069g02a1
tttttattattgcaacagttttaactgagcagttctcggagcaagaaggccccgttttacaaaatttaacacgctgttagtgctagctccttttgttacaagaaactaaaatcaagtttcacaagaaagcaaaagcaaaagcaaaggcagtaagcgtgaacttatagcactccagtgtgaaacaagtgaaaatgaacgaatacagagttaaagatccagagtctacacgtgaattcgacacaacatacaactcgacgtagcaatctcctggtaaaacattaaaattactcgcatatgatggtgatgatgatgataacacttctagcggcgctatcaaaacttctccggcgactgattcctaccagcacatcagacctgagctctcctcacttggatgttgtgagtggattcc

SEQ ID NO: 28066 - DNA, 438 bp, Zea mays
  Clone ID: cC-zmle189069g02d1
aattcttggggcgacacacccgtccgggaatccactcacaacatccaagtgaggagagctcatgtctgatttgctggtaggaatcagtcgccggagaagttgtgatagcgccgctagaagtgttatcatcatcatcaccatcatatgcgagtaattttaatgttttaccaggagattgctacgtcgagttgtatgttgtgtcgaattcacgtgtagactctggatctttaactctgtattcgttcattttcacttgtttcacactggagtgctataagttcacgcttactgcctttgcttttgcttttgctttcttgtgaaacttgattttagtttcttgttacaaaaggagctagcactaacagcgtgttaaattttgtaaaacggggccttcttgctccgagaactgctcagttaaaactgttgcaataataaaaa

SEQ ID NO: 28067 - DNA, 490 bp, Zea mays
  Clone ID: cC-zmle189069g03a1
agctaaatggatgaattgaactgccaataaataaattgtcgaactgtttgtacagtaccgtcaaaaagcagtaagtttaagtaaacctgggcggtacgttctcaaacagtcaacagggcaaagtaaccaatcaggccgtccaacgggagcaaaatcagttccatcagcatcaccatttttaataaagcacactttaaccaatgagttccacacattttcacagccacgatttaagcacaccataacggatcaggtccccatcagcgtagccacgattgaagcgcgccataatttcggttgatgaatagtggaatccatcatactgcagttttacacacgtccgccaattgctatggttcaaacatgctaacagacttacaagaaacaagtttccctattgtcaaaacatgataaatacaaatgaaaaatgcttagacgcagatacatatggatatcttcaacattagtcccaaagcaattagtccagact

SEQ ID NO: 28068 - DNA, 503 bp, Zea mays
  Clone ID: cC-zmle189069g03d1
cacccgtccgtgttgtgcaggctcatatctgattgctggattcggcttacccgttttggatcctgtatcggttagtccttgcctgcaaggttcttgttgttttgttttggtggtcgagcatcgcatgttctgcttctggatccacatctggagaaatcgcgaagtcgtcgtcgttcggttcggagcggatctgaggcgacgatagatggaggcggcggcatctctcggtctgcagtcctgctccacctcgatggatgatgtctctgcgctgataattattggatcaatttcgataattattagtacatctatgagatatgccgcctggaagaggcgaggtaagctgcagcatgtaaaaaagagaaaaaagatgtgacatcctagaggaggaggcctttgccatgatgggtgcgctcgcatggcaggccaggcaataataaaaagatgattattgcgtgccgggggaggagatcgcacggtggttgatgttttggcccgggtct

SEQ ID NO: 28069 - DNA, 516 bp, Zea mays
  Clone ID: cC-zmle189069g04a1
aaaactctcatgcatggctactaatagttccaacttaaacaatcagtaaaagtgttcatcctgagaacaaaaggacatatttcaatttttgaaccacatgcatatatgctaactgataaaacaactcctcatgctgccatatcatgtctgagaaacagcagaagatttcagttaaaaggtacagcagtgagacccatcggaacaatagtgaagtctgattcaaaattattcattgatatcttaatatctgaagacctaattcattttgtggctgagaaaccttttgatttggagccgaaatatgtttggagccctcatgctttcagaaatgctgcttgttgccggtcttcaggagtgatactctcagcagttttagaatcaccatggggagcatcaaatccctgcgaaccattagatgggccatatccagggttgtatcgatagaagccattgttattttggacatgtggcataccaaaacttccctgtgatgtggtaactgagattcatatgact

SEQ ID NO: 28070 - DNA, 597 bp, Zea mays
  Clone ID: cC-zmle189069g04d1
gtccggtttcgctctccccagagagaaccaaaatttagcaattatccatttcaagttgggtatggtgcccaattgcctcagtcaggatatcgctttgagctccaacaagaacaggttggatttggaaatcaagtagcacaacctgcacatgtggcttcaagacaaccctcatatgacacccgctggagctcgagagattatggatcaacccaagggcaactgggatatggtggtcctcaagcacagtcatatgaatctcagttaccacatcaccagggaagttttggtatgccacatgtccaaaataacaatggcttctatcgatacaaccctggatatggcccatctaatggttcgcagggatttgatgctccccatggtgattctaaaactgctgagagtatcactcctgaagaccggcaacaagcagcatttctgaaagcatgagggctccaaacatatttcggctccaaatcaaaaggtttctcagccacaaaatgaattaggtcttcagatattaagatatcaatgaataattttgaatcagacttcactattgttccgatgggtctcactgctgtaccttttactgaaatc

SEQ ID NO: 28071 - DNA, 409 bp, Zea mays
  Clone ID: cC-zmle189069g05a1
ggggcacagggaaccaaagtttttatttcgccatgtaacttattgttacctcacatcgttttgccatgctggggggctataatgcttttactgaatgaaccggcacccgggctaaagcactcccgaattacatatttttaaacatgtccagatcaccaaattcctcaaatctccctgaatgatttgatagggcggaaaccattattgtcaggaaggggggcatttcccgggcgaatggggattattacctcaaaacccgcgtttttagcaccaatggctttttggaagacatcggggatgaataaaatttgagatggactggcccccccccggggctgggagatctcaaaataactccttgtttcttttttgttgtcagttgggggtaaaaaaacccacacaggaactt

SEQ ID NO: 28072 - DNA, 590 bp, Zea mays
  unsure at all n locations
  Clone ID: cC-zmle189069g05d1
caccccgtccggattnggacaatcccctgaacantggttcaataatacaatctcaaggagtttcgcacagcacttttgagnccctgaaatttngggatggatgtcantgctgctgattcatcaacagtgtgttgtactagacattgaggggacaaccactccaatatcatttgtgactgatgtcatgttcccttatgctcgtgataatgtacgaaaacatctgacttctacatttgactttgaggaaactaaagaagacatcaaactattgcgcatccaaattgaagatgatctacaaaatggagttgctggggctgttccagttccacctgatgagggtggcaaagaagaggttatcaattcattggttgccaatgttgaatcaatgattaaagcagaccggaagatcacatcattgaaacaacttcagggtcatatttggaggattggatttcaaaagaaagagctacagggagttgtctttgaggatgttcctggggcgcttaagaactgggcatgctagtggcataaaggtctacatattctcaagtgggagttgagaaagcacaaggctttctatttggtcaata

SEQ ID NO: 28073 - DNA, 79 bp, Zea mays
  Clone ID: cC-zmle189069g06a1
aaacgggggaaccgggttatttttcctttcttaaaaaaccccacaccctacacctagttttgggccgggtgtaaaaccc

SEQ ID NO: 28074 - DNA, 239 bp, Zea mays
  Clone ID: cC-zmle189069g06d1
gggcgaaccacccgtccgcccacgcgtccggtacacgaaacctaataggttttttttccattttgatacgaggttgagtcaattttcatacctatagatttgttaatgagcataaatttatacccgacgagttcatgagtataagtttattatgtgaaccgtgggtttttaaacccgaccaaacttagtgtatattgtcattttattttataaacggacaataaacttgttatctcctt

SEQ ID NO: 28075 - DNA, 459 bp, Zea mays
  Clone ID: cC-zmle189069g07a1
agaggaaaaatcagcaaagagctgggggctctgtcatttctattgttaccgaataccgaggaacgtctcatgatctagtccgccttttatatagggattatttggttgcctgcatctggaagattggggctgagccttttcttgctaacctggctaagagcgtgtagtgtccttacaccagcacgtcaagttagtggctaaatgaacaaaaagcacatcttttgaacctatccaaatctacatcgcccaagctcataaatggaactcgtgctacaggtcctcaacagcaacagaagaaccattttatcaagctgccggcaacaattgattacatatacaaggcacaactgattcccgcgtgatgcggtcccagtctttaccacttgatccgaccacactgggagggttgcatcaacttacaccgttttttctctccgatttaattgcttcgtaagactt

SEQ ID NO: 28076 - DNA, 526 bp, Zea mays
  Clone ID: cC-zmle189069g07d1
ggggcgaaccacccgtccgcggacgcgtgggcacgagcgacaccatatacagatgtttaagtgtttgacttcacctgctgcagactgcttttagagcaaaagcgatggaagtgcatcctgaccaaaatcaaaatgatagagatgctgcagaagagaagttcaaggaggttgtcaagtcttacgaagcaattaaatcggagagaaaaaacggtgtaagttgatgcaaacttccagtgtggtcggatcaagtggtaaagactgggaccggatcacgcgggaatcagttgtgccttgtatatgtaatcaattgttgccggcagcttgataaaatggttcttctgttgctgttgaggacctgtagcacgagttccatttatgagcttgggcgatgtagatttggataggttcaaaagatgtgctttttgttcatttagccactaacttgacgtgctggtgtaaggacactacacgctcttagccaggttagccagaaaaggctcagccccaatcttacagatgcaggcaa

SEQ ID NO: 28077 - DNA, 352 bp, Zea mays
  Clone ID: cC-zmle189069g08a1
atataggatcaaatcatatcatcggggaccaagtaatatatggttacagcagatgcaatcggatcaaccaacatgcaggttgacacacgtacgtacatgagcacaaagactgacgccaaacatgcagagagagatagcaaactgaagaactctgtttgtttctttctcacacacaccacacaatacctatgtatggcagccagctcggcctcgcttattattgttcaaccaccaccacaagctagatagataataatcatatccatggtcgtcgatcgatgtgatcagcagttgcaggggtcgcacttgcagatgccaccgcagctgcagccgtgggcggcctcgccggact

SEQ ID NO: 28078 - DNA, 603 bp, Zea mays
  unsure at all n locations
  Clone ID: cC-zmle189069g08d1
accacccgtccgcccacgcgtccgcgacttgtttcattgattcttgattatatcgttcttcttttgcaccacaaggtcgaggatgtcgtgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgtgtggtgtgtgtgagagagagagaaacagagttcttcagtttgctatctctctctgcatgtttggcgtcagtctttgtgctcatgtacgtacgtgtgtctacctgcatgttggtcgatccgaatgcatctgctgtaaccatattttaattggtccacnatgatatgatttgatactttttattact

SEQ ID NO: 28079 - DNA, 343 bp, Zea mays
  Clone ID: cC-zmle189069g09a1
agtcaaaaaccaagcggataagcggatttcctttttcttattcatgccccgaaaaagggcattgcaataaccttcttacaaaaaaattcaatgatccactaatgacggtttggaaatacctaccatagggacttctacattacttacacgcgtggaaaccgcgcaacatgcccagaaacagagggttttttcatcatatacagcaactgcatgctgcgaagcccggaagaaggaaacagaaatttcaaaactttcagcaacaacacgggcttggtgggtaccataccataccccgagtgttttggcctgagtcgtcttactggtacaggctcggcaccgccct

SEQ ID NO: 28080 - DNA, 529 bp, Zea mays
  Clone ID: cC-zmle189069g09d1
acccgtccgtggcattaatcacacgatgcctgcttggaatcatgtgttgttatttcgggccaattaaggcttatgctacagaagggtgccgaaaagaatacaatcatctggctttggcagttgtttcttcctcacgaggcattggtctcattattggtccagctcttggtggttatcttgcgcagcctgcagataaatatccaagtatattctctcagacgtccatatttgggaggtttccatactttcttccgtgcctgtgtatatcaatccttgcagttattgctctaattgcctgcatctggtttccggaaactttgcataaacacaatggggatgccgttgataattccgttgaaacagtagaagaatctcttgctggcaccgacactgaagaaaatggaggtggcggatgtctaaaattatttacaaactggccgttgatgtcagctattactttatattggatcttctctcttcaggatgtggcttatgcagagacattctctctttgggctgtcagtgacag

SEQ ID NO: 28081 - DNA, 121 bp, Zea mays
  Clone ID: cC-zmle189069g10a1
atattttttattttttttattcttttcattttttttttgggggttgggtggaaaaacaagccattacctgatatgattttggggattatgctattacacaaaggatccatgttgtgcaccc

SEQ ID NO: 28082 - DNA, 376 bp, Zea mays
  Clone ID: cC-zmle189069g10d1
ccggagtcctactggtacaacgggatcggcaacgtcgtcaccttcgatcttgatcccaacacccgctacccggtgggggtgcgggtgaacaaggtgaactacgccggcgtgtccaccaacaactacgccttggacgaggtctcagaggtgaaatgagtggggcccgccggctcaagggctccgcgctagctaccgtgtgattgatttgtagtagttgtgaaatgaggctgtgaagctgcatgctgtgctggctagcgtcacaacatcgatcctatgtgtaatagcataatccacataatcatatcatgtaattgcttgctttataaaaaaacactacctttttaaaatttaatatataatatgggggatggggggg

SEQ ID NO: 28083 - DNA, 389 bp, Zea mays
  Clone ID: cC-zmle189069g11a1
gttgtgttttttttttttttttacaccacaatctgttcctttgtactgggacttgtgataattaactaaaaaacacccaccgaccgcggggtaattgtgtacataaccccaatgggatacacagacttgcccgccgagagcaaaacacgtggcagatcccctttttttttaactccgtgcctctttttctttccctttggtgccgcaaaaactaggcgttggaggcacgttagcgccaggttttccttccatgcttacgcagccacagccgtccacaccttggatggtcacagttcgtccttgacgggctcggcggcggctgccttctcggatgccggtggccccctgatggttgtggtggaggcgacccctgcggccccttgcttttt

SEQ ID NO: 28084 - DNA, 554 bp, Zea mays
  Clone ID: cC-zmle189069g11d1
cccgcccacgcgtccgaaatgatttgcaggctatgctgcttttttacttcttttccggaccttttgattctttcaagggggcctagggtgctgccgcggaggaattcaaggacaaggaaatcaagttccttattggtgacatcgaagccagccagggagcctttcagttctttggcctgaaagaggaccagacaccccttatcctcatccaggatggtgactccaagaagttcttgaaggttcacgttgaggctgaccagatcgtcgcttggttgaaggagtactttgacggcaaattgacgccgttcaggaagtctgagcctattcctgaggtcaacaatgagcctgttaaggtggttgtcgctgacagcgtgcacgactttgtcttcaaatctggcaaaaatgtccttattgaattctatgccccctggtgcggacactgcaagaagctggcgcccatcttggacgaggcaggcaccactctccagagcgacgaagaaagtcgtgattgctaagaaggacgcgactgccaatgacgtttccagtgagtttga

SEQ ID NO: 28085 - DNA, 602 bp, Zea mays
  Clone ID: cC-zmle189069g12d1
cgcgacttgtttcattgattcttgaagagatcgagcttctttttcaccatttggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgtgtggtgtgtgtgagagagagagaaacagagttcttcagtttgctatctctctctgcatgtttggcgtcagtctttgtgctcatgtacgtacgtgtggctacctgcatgttggttgatccgaatgcatctgcttgaaccatatattaattggtccacgatgatatgatttgatactatatatatactaaaaccggactccttattat

SEQ ID NO: 28086 - DNA, 425 bp, Zea mays
  Clone ID: cC-zmle189069h01a1
ggcagcaccaaggggcaccgggttttccttaagattaacttaaaataaagcctgtcgggggtaacagcatccatcgatccccagtccatgctgtttgttgcatgggcctcttttaaaccgaggatgaacacagttctaacaactgacacaaagcgaccttgcaatcaaaaacacagatgggcaacaacaaacacgacacgaacgaagattaaccctctggactagggtaaacatcacgggagcgaacaggataacttggccgcgcgggccccaccgtttaattcctccagttcccgtcggagttgccgtatccgccgccacggttgccaccgccgtagccgtcgccaccaccaccgttgccgccgccgtcaccgtagtcgtcgtcaccgtcgtttccgtcaccgtcatcacggtgcccgccaccg

SEQ ID NO: 28087 - DNA, 500 bp, Zea mays
  Clone ID: cC-zmle189069h01d1
gaattgttgggtcgacccacccgtccgggtgggttggcttctcctccccctccggttcgggttttggttctttaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggctacagtggcggcggcggc

SEQ ID NO: 28088 - DNA, 431 bp, Zea mays
  Clone ID: cC-zmle189069h02a1
caccatcagtaccatttcatcttggtttaaagtatacatacagtcgcagctgacacaacccaaggcatgcctattatatacacacccttggctttgcttggctgctgttattctgtaagcacgctagctagcttttccagctctccgggctctaacacgtttatgtaaaccatctgctacacatacgtacaaagcgtggtggacagaaatggatggatcagggtcttcaggcgtgcgccagctccttggagacgccgtcctggtacggcgcctcgcagaactcgccgccaaggtcattgcacgccttgcccgggaacaccgtctttggctcgtcgtaggacaggtagtccctgtccaccccgaccacacttctgttcgccgccgacgccgtcgaggcgggcttggcctccgggaacatgcggacgcgtggt

SEQ ID NO: 28089 - DNA, 452 bp, Zea mays
  Clone ID: cC-zmle189069h02d1
gtccgcatgttcccggaggccaagcccgcctcggcggcggttttggctttcaggagtgtggtcggggtggacagggactagctgttctactacgagccaaagacggtgttcccgggcgaggcgtgcgatgaccttggcggcgagttctgcgaggtgccgtaccaggacggcgtctccaaggagctggcgcacgcctgaggaccctgagtccatccatttctgtccaccacgctatgtacgtatgtgtagcagagggtttacatctacgggttagagcccggagagctggagaagctagctagcgtgcttacagaataacagcagccaagcacagccaagggtgtgtatataatacgcatgccttgccttgtgtcagctgcgactgtgtgtatagtttaaaccaagatgaaatggtactgatggtgaaaaaaaaaaaaaaaaaaagggcggac

SEQ ID NO: 28090 - DNA, 268 bp, Zea mays
  Clone ID: cC-zmle189069h03a1
aatttttttttttttttttttatattttttttttttagtctctttgggaattatttaatttatcatagacccctgaatccaccccataattttccacacataatcaataaacccaccattttcccctatatcatacaaacataaacaattgtccaaacatagaaatactaatatcccggaaaaaaaaatacaatccccaaaaatttctcccccaaaaaaaatccccctaacataaaactaaaatcccggggaccaaaaaagaaggcct

SEQ ID NO: 28091 - DNA, 336 bp, Zea mays
  Clone ID: cC-zmle189069h03d1
cccacgcgtccgaaaaaaaaaaaaaaaaaaaaaaaaaaaaaaaaaaaaataataaattttaaaaaaaaaaaaaaaaaaaaggggatagggggggactatttaaaggatccacaccctcttccccgggctttcaacctcatggccttttttctttgcctcctttctttattttttggccgcccttttactcgccttctctgggaaacccctgtccttccccatctttttctcctcgtgccctttccccctttttcctactggctttttagccaaaaggcccttccctctcgctcttcctaacatttgctcttcctctttgtttattgggcccccccc

SEQ ID NO: 28092 - DNA, 373 bp, Zea mays
  Clone ID: cC-zmle189069h04a1
gggggacgaacgaaatccattctctttttttatacaacacaccccttaacacaagggtttcctcgaacaatgccgtttggtgcaaaaagaataagctatcgctcaagatcccaacccccacccgggggagacaggggcccaattaacacagcccatgactggtacttttactactaactaaggggaaaacgaacgaacagggcttcgcctgaccccaaaccaacagttggcccccacgtggacgggagggcctactggacgaggccccccgcgacgaggatgaaaaagacggcagatcaagccacgggcaggaccgacgccgggggcccccctggcgcgcccgtgtggggcgccggggcggggcggaccccca

SEQ ID NO: 28093 - DNA, 531 bp, Zea mays
  Clone ID: cC-zmle189069h04d1
cacccgtccgcggacgcgtgggtgcctcgcttagcttagccgccgctgctacgttctctcgccgtccttgttcccgcgtcgctctgctcgcgatggcgtcccgcgttgcagtgctgctcgtggccgtggcggccgtgctgttcgccgcggcgtcggcgcaggagatggacctgggcgtgccgcccgcgccggcgcccgacacgggcgcggcagcgggggccgcggcgtcggtcctggccgtggcttgctctgccgtcttcttcatcctcgtcgccggtggcctcgtgcagtaggcgctgccgtcgacgtggtggctagctgctggttcggggtcaggcggagccctgttcgatcgttttcgccttagttagtagtagaagtagcagtcatgggctgtgttgattgtgtccctgtctccccctggtgggcgttgcgatcttgtgctattgcttattctttttgtaccatactgcattgttcgacgtataccttgtgttgaggcgtgtggtgtatgaataaagacgatggatc

SEQ ID NO: 28094 - DNA, 500 bp, Zea mays
  Clone ID: cC-zmle189069h05a1
aaaaaaaatgtttttaattataaaatacccaatggccctcacaaaaaacaacagggccatttctccctctcaaaaccaaaggcaacccaaaaaaaattagggcacaaagaacccaaaaaagaaactctacccttttccccccccccaaaattccccctcaaaaaccaaaagaatgccccctaggggagcattgtaccccccccccctcccttttggcccccccaaaaagagcgccaccgaaacaacccccgcaccaatggggaaaaaaacaacccccggggtcttctttttactaaccacccaaacacataaacgaccccaatcgccgccccagggtccccccccggaatcccagacccgttcctggacgcaacccccccacaccaaatgaagggtaaaaaaaccctggctaaacacgagaaaatactgctcccccgccaaaatctctctcctccccccttccccaaaaataatacacccctaagccaaaaacggaaaca

SEQ ID NO: 28095 - DNA, 399 bp, Zea mays
  Clone ID: cC-zmle189069h05d1
cacccgtccgcccacgcgtccgtatatgtgtgcgggtacatgaccatttagagttaccaggatacgttgcttgcacaattgctgccgttgttgctgccgttgccatcctcttgggggtaactaaaggaacgcacgtgtggtgaattgcctccagagaaggcaatcaatgtgtatttgcgttgtatatctgtgtgtgctaaaaagtgtggagcaacatccatgtgatcttatgtccatatatattctactttgcaatgaagtttgaaatgtagtaatgtaccatctgcttcttgtaagcagcactgcatcatatataataagataccttttatttaaaaaaaaaaaaagagaaaaggagaaaaaaaaaaaaaaaaaaaaaaatataataaataatatggg

SEQ ID NO: 28096 - DNA, 338 bp, Zea mays
  Clone ID: cC-zmle189069h06a1
gggaaagaaaaacatttttcccacattttggtggggggggcacaaatttacataacagggctgcgttcatattctaaaaaggggggcttcccttttaaaccccccgggggaaaaaaaaaagaggaaactttgtctcaaatatttacagggtggaaaacccccaaaaacctttttggctttgcaattataaaaaaaaatccccaacccttttaaaaattgtgctgatttgcccaaactgccccccctaaatccaaccccaccgggctttgttcccaacttggtcaaagggtgccttttttggtcttcccccccaaggtttgttttggttttttaaaccc

SEQ ID NO: 28097 - DNA, 482 bp, Zea mays
  unsure at all n locations
  Clone ID: cC-zmle189069h06d1
ccgtccgggcaaaggcaacaaaatcgtcagcccctcggaaagtttagccggtgaaacccactcagagcagcgcaaaggtctcgaagagcaaagcaaaacctgaggggcgaagatcaaagagtgacactctgaacaagctgggaactaagctcagtgtggttggatttagagggcgcagctcaggcaaatcagcacaatcttcataaggctttggtatttttttttattattgttatgctaaaaaggttcttggaggatttgcagcctgtaaatatctgagactaagtttcatcatttctttttctccttgcgggtttataagtgaagaccacaatctgagatatgaacgcagcactgctatgtaatattgtactgcactcagcagaatgttggaagaatacttttcattccnnantaaaaaaattaaaaataaaaatttaataaaaaaaataaaaaatatataaaaaaaatatatttaaaaa

SEQ ID NO: 28098 - DNA, 334 bp, Zea mays
  Clone ID: cC-zmle189069h07a1
ttggatcctctagaacagccgccctttttttattttttttttttttttttttttatttaatatttaatatcttggatttttttttataatatttttttatttataatctattatctataaatatattttaaaaatattaatataattaatcattcaaaattattatataatattattccaatacaccacacaaaaaaaaaacataataatatatcataaaaaaataaaaatatatcctcccccccaaaacctcatttaaaataaaacactcaaaaaaaattataaaaaacccattctatttttatatacataaacacactaaaaattatttccc

SEQ ID NO: 28099 - DNA, 436 bp, Zea mays
  Clone ID: cC-zmle189069h07d1
cacccgtccggaaccgttgtgcacaacatggctgagaatttcgagtttttgttttgtacggcctgtatctgtgtcatgagctgttactggtaatgtaagacgtattggttagaaattaggagattaggaataatcgggtagctggactacttgaactggttcctgaaccatcaggagggttatggactcatggttagcttctactgcgtccttgggggcagtagtaattttgaagccaattcgttgttttgttaaaaaaaaaaaaaaaaaaaaataaaaaaaaaaaaaaaaaaaaattaaaaaaaaaaaaataaaaaaaatttgaactctaaacttatccaataataaatggggggggggggggaattataattaatatttatgcataacctatttattttgggggggcgcgttttttggaaacttaattctcctt

SEQ ID NO: 28100 - DNA, 303 bp, Zea mays
  Clone ID: cC-zmle189069h08a1
ggacccaaaaaaaaccccaaaattatttaatcctaacctttttggaaacaaaagaccaccctcaaaattaaagcccaagttcccataagggacgggactattttggggacccccccacaattatttttttgggtcaaaaaaaagggtaggtcaccggcacaaaataatttccctttcccttccccctcccctttttgggaaaaaactttggttggcccccggcttttgcccgggcttttgtttccccccacttttttttctcccttttttggggaaaaaaaaatatctccccgtgtctttaaa

SEQ ID NO: 28101 - DNA, 634 bp, Zea mays
  unsure at all n locations
  Clone ID: cC-zmle189069h08d1
ccgagctacgacacagtgtctgagggcctctttcgctttcctttcgttcgtgcgatttttcnnacccaccacactaaggggtcatggagagagagggatacgattctaatcgtggggatgtgaggctgcttcttatagacatgtcagtgtcggaatagcaataagaatgatngtctatagcgcctatctcgagaagctctgtcccttttggttgactgttcatttatcgataggtatcacccttgctgatgtactggtgaagcttttctgatacccccacccatgatagaataacctctactctttctcactcttgacacattggacacagggcgcctgttcatcaatagtcactgggatattagccctctaagaacctattgataggtgtggcngatgggttgcaataacattacactgcacagtgcagaatagtgcattatggtagctgcatggctcgccacccagagatacccctaatgcatacccttattctttgaggggtggagctagtagccttgcaaggccgaggaaaaggttcaaggcttagtgcagtgtattctgatgagaaaagccagactctgaagaactctaagaagcaaacgggagcttagctgctgctacccaaagaaga

SEQ ID NO: 28102 - DNA, 403 bp, Zea mays
  Clone ID: cC-zmle189069h09a1
aacgaaagggggaacagctttgttggcaccattgttttccttcaatctccggtctgtcctctctctcccccgaacaaaaaggaaaagaaaaaaaaacctgtacagagacactgctgctgcgaggtgcagagtgctacccctactctcaattcctagggcgctaatcaggcaatccggggcacctcttcggcggcagcggcggggggcaggaggcggtggcggcacaacgggcaggtggcgtggtcgtagtcgatccaagtcttgaggcaagcgccgcggaagaggtggccccaggggagccgctgcaccaccgactccgtgttgaaccgcaccaggcacacgcgggagttcccgtccctgtgccgtccgtagcgcgacggccggaacctgctccggaaccggt

SEQ ID NO: 28103 - DNA, 543 bp, Zea mays; identical to SEQ ID NO: 28019
  Clone ID: cC-zmle189069h09d1

SEQ ID NO: 28104 - DNA, 260 bp, Zea mays
  Clone ID: cC-zmle189069h10a1
ggtatgcccgacgcagctggatcttaagcggcgcccgggggggggtttgtaataacagatctaattttccggtgcgtgaccacatacacacatattacactgaatcgctgaagccgaaagttcagtactaccaggcacctacgggcaaggaagagaaaaaaaaaaccatactagggaggggtcacaagagggagcaggataccgggtaaaaacctcggatgcagtcaactttcatcatcatcttcttcttctgtggagga

SEQ ID NO: 28105 - DNA, 555 bp, Zea mays
  Clone ID: cC-zmle189069h10d1
ccggagctgagagaaagaaagcagctggggtggagctgtaacttttcgcttttgctaggctcctctcccctctcagggggcagcgggccctcctgcatgccgatcgcctccaagctcgtctacttccagcgccgccccgcgccggcgccgcctgacgacccgggttccgagccttccgacccccgtcgtccccgccgccgtcgccgacgtagctccctctcctcctctcaccagaagccggagcatgatgttccagggcaccaaagggatcacgctgctgcagccaagcctccggggccagtcggaaaggcagcagggcttcttcacacggcctccagcgcagggcttcttcaccaccgcagcacgtcggaccacggccggcttcccgacgccgtgcagcaggccagggaacggctccttcagaggctcggcagcgtggacctggtcctggcggcgggacgaaggcacaagacatggccgctgcagacactctgggctggagctggaggactcgctcgccccgtcggtgacgcctctttgggcggcggtcaaacc

SEQ ID NO: 28106 - DNA, 232 bp, Zea mays
  Clone ID: cC-zmle189069h11a1
tttttagctttattgcatgcatgcatcattagatataggaacagggatggatcgttacacgctgcagaagcatgcgcttagtcgttatttgcagacgataataagtagatcgatggagtagtgatccaagcaacacacacgtgaccgacgtttgctcttatttacttacacgcacgcacgtgtacggcgctaggggccgtatatatatcgaggtctgcacccacgcgttccg

SEQ ID NO: 28107 - DNA, 227 bp, Zea mays
  Clone ID: cC-zmle189069h11d1
ccgcggacgcgtgggtgcagaactcgatatatatacggccccttgcgccgtacacgtgcgtgcgtgtaagtaaataagagcaaggggcgtcacgtgtgtgttgctcgatcactactccatcgatctacttattatcgtctgcaaataacgactaagcgcatgcctctgcagcgtgtaacgatccatcactgttactatatctaatgatgcatgcatgcaattaagct

SEQ ID NO: 28108 - DNA, 106 bp, Zea mays
  Clone ID: cC-zmle189069h12d1
caaaaaaaaaaaaaaaaaaaaaaaaacaaaaaaaaaaaaaatttaaaatttataaaaaaaaaaaacacaaaaaaaagggcaccagggaaaaaaaacaaaaccaaaa

SEQ ID NO: 28109 - DNA, 305 bp, Zea mays
  Clone ID: cC-zmle189070a01a1
gggggaaaaaaaaagtctttttttttttggcccccccaccaaaaaaaaaagagggggggaacactttttttgttggtttcccaccccccccagggggaaaaaaaaatgggcaaaaaaaaaaaggctttgtcttggttaaaattaaaagcccccggcttgggccaataaaaacccccccacactgttgggtttttttctgcccccccccaagggaaaaccctagttcccttccccgaaatcccccaaaaagggaaccccaaaaaatcccccaaaaaattttttgtaaggggaaaaaaaaaaaacaa

SEQ ID NO: 28110 - DNA, 501 bp, Zea mays
  unsure at all n locations
  Clone ID: cC-zmle189070a01d1
gtccggacggctctggcattggagctgcgcttctcgcagcctcacacttttagtttcagtatggcgcgagtgactagtaggcctgaaatgggcgcggatcgagattttgagtgtagctctcatttatcttttcttttttcccttttcaaaacatctttttggggatttttttcggcttccttttgttggctattccgtggatgcacttacggctctgcattgggatgtagctagtatagagccaatgagtttggaggttatctaatggcacaaggcaggagcatggaaatggaagcagagcaatgacattcatgctctgcccattcttttttccccttgtatggtgttgtaaaccaataaaaaaatgttaaccctttttttttgtgtgtgttggcaataaagagaatacgataatttgaccacnnnaaaaaaatcttattcctcttaaatatcttttcttttcattctcctctaacaattcttctcttttctcctttttta

SEQ ID NO: 28111 - DNA, 329 bp, Zea mays
  Clone ID: cC-zmle189070a02a1
aaaccaaacccggtttgaaaaaaaaaccagcccttgggggttgacggggcctcctaaaaacagaaatttccaccagcgggaacaagcctacccccggggggggggctttttttgttttttgtaatagggggaaccccccgggggggtacttggccttcttgtttaacccaacccaaaaaatttgcccccccccaaaatttttttataaaaagccggcccctcctgcaggggtggttttctatggcccccgggggtggtcaaaaaccaagaattttggtgggcccctttttaacaaagccggcctggacgaggaaaatttaaacgttttt

SEQ ID NO: 28112 - DNA, 510 bp, Zea mays
  Clone ID: cC-zmle189070a02d1
tcccggactacgtacacgtgcgcatccagcagcgtaatggtcgcaatttctctgtctaccgtccagggattgaagaaggaggtcagctacagcaagatcctcaaagatctcaagaaagagttctgctgcaatggtacagtggtccaggacccagaacttggacaggtcattcagctccagggtgatcagaggaagaacgtctcgaatttcctcgtccaggccggcattgtgaagaaggagcacatcaagattcatggtttctgagcaaccgccgggtccatagcaaaccaaccctgcatgcagggccagcttattatatataatatctgaggtggagcatatctatctggctgtgtactacaagcaggcctagtacgccgcctgcgcgttcctcctattacacataacacatatagcccccttcctgcgtgtatgcttgttgccgtcgtgtcgaatcttgtactacgaggctccgtcgaacctcgatggcttgcttctttatcagaacat

SEQ ID NO: 28113 - DNA, 136 bp, Zea mays
  Clone ID: cC-zmle189070a03a1
gatcctctagagcgggcgcccttccattttttcttttccgcatatcaactttccataagagcacttgcttgttggcggggtccgagcaaacttgttcttgaaaacgtacaggaattcagcacgagtgcaaccgaca

SEQ ID NO: 28114 - DNA, 402 bp, Zea mays
  Clone ID: cC-zmle189070a04a1
ggggggggataaaattaaacaaaaagaattttattttgggggccccacacctctattgggcataaattccacaagaaccggggggggccccctcccaaaacccaaggacaaaacccctgccaaacccgttaaccacaaaaaaaaataagggccccgggcaaccccaaacggggggggttccccccccccggggggataaaaaacccctggggagaaaactccccccccccccggggccccccccggggggggggggaggggcctttttaaccctggtttccccccccaaaaaacccgggcccccggggaaaacaaggggggggggggggtgggcccccgccccaaaaaacctttaacccctttaaaaatttttttttaaaaaagtgtctgtgaccccccccc

SEQ ID NO: 28115 - DNA, 541 bp, Zea mays
  Clone ID: cC-zmle189070a04d1
gtccgcacagcaatccacacaagcacttcgacgtcacacgggcgctgttacagacacaccaagcgtcggcaccaatggcgtactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcagggagagcttcctcgccagggctaactgagccgcccggcggccggcatccacgcccgttcgtgcttgcctgcgtgccttatgtatgtctgtggttgactggttgtgcagggtcatcgtacttggctatcgtacgtgcacgcactcagctcctgtacgaattatcgacaatagctcgtgacctgaataaaacttcttcgtaatactaatacctac

SEQ ID NO: 28116 - DNA, 470 bp, Zea mays
  Clone ID: cC-zmle189070a05a1
aactcttctgataattaatcaggatggcaccccacagctcaaatacagcactaccagagtacactacaagagaagtggcagtttttacaccataaaccccaaattccagttgaagctaactacaaacaatttactcggattgtgaattacagctgcaggacagccacccagcaaagagtccaacagtcaatgccttcattgtgcagattggtagtccacctttagtgcccgttcggttcttccggaatactttactggattggttccggattagaatagttcacaaatttgtattagcttgatgagttggaatggttctggcctccaatccggactaaacgaacagagccttaagaacgttagtgctatgaatgctgaaatccagacatcttatgtcagtgtcatttgaacaatgttgacctgtcgaccttaacattaactgagcctcaggtacagaaacttcatcacaa

SEQ ID NO: 28117 - DNA, 570 bp, Zea mays
  Clone ID: cC-zmle189070a05d1
ggtgacacactaagattttctcattgtgtcccgcattatttgtttagcttaactgaaaaagaaggcattccagggggatctcttgaacttgatcctgcagcgcttccctccaacttggaagaggcttttccttctgctaacccagaatgcagttctgtaagaagtaaggagcataactccaaacatgctggtttgtccagtgaagattgcaaagaaaccatgaatgtggggcagcggcaacagacaaaatctgtgaatgcagggatcgctacaaaaacaccaaatgaagagaaaatcaagcataacactcatctgcctgaagttacagatgtcgatgacgataacatttgccaaacagagtatgtatgcgctgaatcagaattctatgatttttcaagaataagatttctccaaaagttttcatctgggcaaatctgggctctctatagtgatatagataaaattccccaattactatgcattcatacagaaagtcgatcttaaaaatggtacagtacacgttagattgctgggatgtctatcctcgaggagaagtggagaaaagattgt

SEQ ID NO: 28118 - DNA, 471 bp, Zea mays
  Clone ID: cC-zmle189070a06a1
ttttgtcgttctttggcgctttttattctctagcatgcaaacttatgtgctagaaccgcaataacgcaaatccctttccgatgcataaccgtaaagcagcccaataaccgatccatgtcctttttaaaccttcgggggaaccctaagccttggggttggtgaccttgactcccaattgcttggcacgggcgatgatttcaactcgcttgcgggaagagacgttgtgggcgatctcagccgcgtgtgtacggttgtgcattaaaagcagttcgacgtctccggtgttgctgacgaggaaagccttgtggccggagggcatcatgtagcgggtcttcttgttggagccatagccgatagagggcatagcaatggtaccacggaatcgacggcgaacgcgactgtcgatacccttgggcttgcgccatgtgcccttgtcaaggcgcatgaagcggtcggcctgatgccgagaga

SEQ ID NO: 28119 - DNA, 549 bp, Zea mays
  Clone ID: cC-zmle189070a06d1
ccgacgaaccgcagcccaccgtcaagatggtttccgccaatattcactgttcctatcgtcaagaagcgcacgaggcactgctctcggcatcaggccgaccgcttcatgcgccttgacaagggcacatggcgcaagcccaagggtatcgacagtcgcgttcgccgtcgattccgtggtaccattgctatgccctctatcggctatggctccaacaagaagacccgctacatgatgccctccggccacaaggctttcctcgtcagcaacaccggagacgtcgaactgcttttaatgcacaaccgtacacacgcggctgagatcgcccacaacgtctcttcccgcaagcgagttgaaatcatcgcccgtgccaagcaattgggagtcaaggtcaccaaccccaaggctaaggttaccaccgaggtttaaaaaggacatggatcggatattgggctgctttacggttatgcatcggaaagggatttgcgttattgcgggtctagcatataagtttgcatgctagagaataaaacgcgccgtttgacgacaaaa

SEQ ID NO: 28120 - DNA, 172 bp, Zea mays
  Clone ID: cC-zmle189070a07a1
gaagcacatgaaccggggggtcgcagatttcaagaacaggcatcaaggttattggataagattcaatcacccgccggttcaccacctaaataaacagccttatcactaacatgaaatagactgccttagcactcggatacaaagcataagaggagcagttcccttggcaagc

SEQ ID NO: 28121 - DNA, 600 bp, Zea mays
  Clone ID: cC-zmle189070a07d1
tcccgggaagaggatggacaggcaacgaggacgcgccccgaggacttatcatttgccgctggcggcggggagggcggggggatgatggacgatgaagagagggtgggccatgcggagatcccgaccagtttcggtcccgagctgcgcgcctgcctccgatgccgcctcgtcaagacctacgaccagttcagggagaacggctgcgaaaactgcccgtttctagagatggacagagagcacgacaacgtcgtcaactgcaccacccccaacttcactggaattatctctctgatggaccccagtaggagctgggcagcccgttggttgagaattggcaggttcattcctgggtgctatacacttgctgtctcggaggagcttccagaagagtatcaagggatttgtcaagacaacaacgtgcagtatgtgccgccaagcgtgtctaagtatcaagacggcggcaatgatggtgtcttggtcctgaagcagtatagatacttaggtagaagtatctgtgcctgccaggggactgctccttctatgctttgatccgagtgctaaggcagtctatttcatgttagtgataaggccgttattagg

SEQ ID NO: 28122 - DNA, 158 bp, Zea mays
  Clone ID: cC-zmle189070a08a1
acttaaactgccatgcgtgagaatagagggacggaaagaacaggaatcttaaccaacacaagacacaacatagctgtagccgcgggaggcatggggcaccgcgcgcactgacaccgggccccaccaccattaccacccgacgcacactttatttagcc

SEQ ID NO: 28123 - DNA, 339 bp, Zea mays
  Clone ID: cC-zmle189070a08d1
gtgaaccacccgtccgcttagagccatctaactgtccgctggacaacaacttttgcacttttaccctttattaacaggaatttgcttacggggtttaggctgtatctagcctcgccaatcctttttgtgaacataaatctattaatgacctctattggtcactggcgatgttcaaactccatccgtcataccaagcgtagacattacacgcgtggagacccggctatcaaccggtgcgccctaggagtttgtccccgacaaagtctaggccgaacacgaggctggtgatcctgctgatcccgaagagctatgcgctgccagacactattcatgcttcca

SEQ ID NO: 28124 - DNA, 521 bp, Zea mays
  Clone ID: cC-zmle189070a09a1
ttttgacttcttgctaagattctggcaaattttcaatcaggtggaagagtcgaatgaaaatcaatcatatcatacaattataacgtatggagagaaatcaactgaggaacttcggggcaatcattccgcattcgagaatcatcaatgaggctcattataagcagccaaggatatacaacgggctgcaaatctctgccaaactccagcctttctataagttaaacgcttgttagaaactgcaaaactgtacaacaaagagagaggaggatctactttggtaaagttaactctgaacaatgaacaggattaatccgctaggctagactgaactaccgccatgaaagacataaaaaccctcattgcatatgagaccacactgaatcccggatcttcatacgccacttcatcaagccacagaaacttaacttggcatccaagcttactgcatgcccaacatgcttgtcgagtgcacagaggtctaaacctttgactgagctatagctacgaagatggaaatgatg

SEQ ID NO: 28125 - DNA, 545 bp, Zea mays
  unsure at all n locations
  Clone ID: cC-zmle189070a09d1
taaaaccatgccggacctgggggaaaaaagatcaccgaaggggtacaaataatttttcaaatctgtaacaagatcgggtacatgctagaaggagagaaatcaatgactactcttgagtttcttganataaaaggaaaattaagattgaatcctttgtgggcaaaatggttgacaagcatttgcatgttgttagcaagtcggccaaaccttaagattcatatgtgtagtgaggtgttctctgcaaagggatctactctcttttaaaacacctatgaatcagtgattgttgatccaagtgaactaaaatctcacttcagaagccagcatgactcatcagtgttgccgcaagatcaacatgaacacatattacccagactatatgcgtggtccagaagagcattgaccacatcaataccatgtaattctgtacttatataggcatcatttccatctttcgagctatagctcagtcaaaggtttaaacctctgtgcactctacaggcatgttgggcatgcagtatgcttggatgccaagttaagtttct

SEQ ID NO: 28126 - DNA, 441 bp, Zea mays
  Clone ID: cC-zmle189070a10a1
aaaaagatcaaaatatattataatctgaggcggaggaagtaacaattaatctctggtgtcaaacagccactcttcgtgtttgcacacgggagtccactggagtacacaagaaagaaagaagaaacccaaactgaaattaaaaaccaacagcccgaatttgcattaatagttacatacacgattcctcctcctctctcaaaagttctccatgacggtccgacgcctctaacagttaaaacgaatcactcgagctgcgcgtaccagaccccctggatcttgacatccttgggcgccttagccccgaggtcggtgtccgacggctgcacgctctcgaatacgccaatgacctcgccggtgtccgggttgctcttggtgacgctcagcgtgatgttgcccgtggacgagcggcgttcttgatgttctccttctggagctccttct

SEQ ID NO: 28127 - DNA, 474 bp, Zea mays
  Clone ID: cC-zmle189070a10d1
cacccgtccgcccacgcgtccggcgacgaggaggagctccagaaggagaacatttagaactccgcctcgtccacgggcaacatggggctgagcgtcaccaagagcaacccggacaccggcgaggtcattggcgtattcgagagcgtgcagccgtcggacaccgacctcggggctaaggcgcccaaggatgtcaagatccagggggtctggtacgcgcagctcgagtgattcgttttaactgttagaggcgtcggaccgtcatggagaacttttgagagaggaggaggaatcgtgtatgtaactattaatgcaaattcgggctgttggtttttaatttcagtttgggtttcttctttctttcttgtgtactccagtggactcccgtgtgcaaacacgaagagtggctgtttgacaccagagattaattgttacttcctccgtcttagattataatatattttgatctttttagat

SEQ ID NO: 28128 - DNA, 426 bp, Zea mays
  Clone ID: cC-zmle189070a11a1
gtgcaccggttcatgggcacgttgtttgtcccggcgtccgtggacccgcgcgccggggtggcttccagggacgtggtcgtggaccacgggacgggcctcgcggtgcggctgtaccggcctagccgccaagccgtcgccggcggcgccggcggcaggctccccgtgctggtgtacttccacggcggcgcgttcgtggtcgagtcggcgttcgaccccgtgtaccacggctacctgaacgcgctgacggccaaggccggggtcatcgcggtgtcggtgaactaccgcctggcgccggagcacccgctcccggcggcgtacgaggacgcgtgggcggcgctggcgtgggtggtcgcgaacgcgaacgcgaacgcgcggcgcggcggggccggggccggggacccctggctgtccaggcacggcgacgcg

SEQ ID NO: 28129 - DNA, 398 bp, Zea mays
  Clone ID: cC-zmle189070a11d1
ggaaaaaaatgtctctttttttacataacatgcatgctagggaccgggttttctggcggccactgacaaaatacagtatacggtatggtggttacagatgtctccactcaccagtgagatagacagaccactatagctacgtacagagggctggctgatcgatcgggtgagcagcactaccacgctgccgacaatttatcagctgccgttgatgaacgcggcgagcgtggccatgtgcatggcggccttgggcgaggcgaggttgttgaggaaatatcattggccctccccgggcgtaacgtacaggggcgcccgtccgcgccacccgttggcccggagcgcgttcacgtacgcgcgctggaacggtccgagccggtcctgcttcgacaccgttatta

SEQ ID NO: 28130 - DNA, 485 bp, Zea mays
  Clone ID: cC-zmle189070a12a1
ttttgcttttatttcaattccaaataccaaaacaaagggggaaatttctacaagttgatctaacagtacttcctaatacagaaaactgagcatattgaacttcagtgcatcttttagatgcagatgatctcttgagcacacatctagaattcatcttctgcaagcttctctagcaaacagcagcactggagattttctatcttccatatggatggtaacgaccagcagcaccactgccgccactgccaccatagcctgtcctagcaccatagagtccaccggtgccaaacccatcaccagtattagcccaggaagagtcataactacgaccatagctagaaccaccatagcccccagcatcacgctcatatgcaccagctaatccaccatcataactaacaccaccatacccaccaccaaggctgcctccataagtgctaccatagcgactagaataaagggaaggttcacggtatcctactaat

SEQ ID NO: 28131 - DNA, 490 bp, Zea mays
  Clone ID: cC-zmle189070a12d1
acccatcccaaatggttctcaggtggagatcaagaaggcagaaccaaagaatttctctttccaaccacctcgttcacttgatggggagcctaggggccgtccatatgcagacagttatgatggatttggcagctcttacaattatggtggtagttttggtccctatacatcacctcgaagttttggcgctaggcctagcagctacagtagtgcttatggtcctggtgattatggtagtggctatgctacttatggtggagcattagtaggataccgtgaaccttccctttattctagtcgctatggtagcacttatggaggcagccttggtggtgggtatggtggtgttagttatgatggtggaatatctggtgcatatgagcgtgatgctgggggctatggtggttctagctatggtcgtagttatgactctttcctgggctatactggtgatgggattggcaccggtggactctatggtgctaggaca

SEQ ID NO: 28132 - DNA, 403 bp, Zea mays
  unsure at all n locations
  Clone ID: cC-zmle189070b01a1
aaaccagggctgcccttcatacagggactatttacaagttaaaacaaaagttgacttgaaagggcaccctgttttttttagggcaaacagaatacttttgatgagagtnnanttncngcccctcaatcaaattggggtgggctaaatccccttgtttccaaaatttacaaaaccttccaggtatcaggttatcacaacttacaaaattccaccatgcctaaaactgctatcccctccataaacattggaatttaaacctggggaatcataccattttgttccagggtaaaatccttttacatgaatacctaccaaattggggtcagttaccatggtatcgtcatgcataaacgggttggtgaccttggaatcctccacgccatcattatccccacagttaaaa

SEQ ID NO: 28133 - DNA, 569 bp, Zea mays
  Clone ID: cC-zmle189070b01d1
gtccgaagattatgcctgcgaccgtgctggagtgcccacttcaagtagtttgagtgctgcatcctcagccaataattccgagggtaagaaggcgcgggttctaaagcgagagccatgccagtcaaagaggtgtggttgtggattccgtattcgggcaattgtgccgatagctaactataatgaaaaagacaagacttttgtgtacttggaggagggcactgcagtgttcaagctttacgctgtgcattcagggcatgaaccagggccacttgatggcaatgcacgaattgttcacaggttggttggtcataagggagctcttgagtttgatccagacatttatggtgtcagtgaggaaggcgatcctaccttttcagcgaagggggatgaagatgttgatattgacgactcgcaccaggcagtcttgcggcaagtacggtatctgggatcagaagttctctcgctagaagggaaggtggctaaaatgcacccagaattgttagggtcactgtccactgagttgtctgacgttttgcacaggattaaggaagttacattggaaggcaatg

SEQ ID NO: 28134 - DNA, 361 bp, Zea mays
  Clone ID: cC-zmle189070b02a1
ccgggaaagcataataatactcacgggtgcatagaatagcagtggcgcatctgtgccacacacaccgagaacattcaaacacacgccgggacaccatcgtagtacttgtatgagcagaacacgagtaatgcacaggcagagccatcagctacatatatacacacgacgacgggtgccgaacgcccacccagtctccggagcggcgtcgcctcatcacttgccgccggcagtggcgacgccgtgctgggagacggcctcgacgaggttgtgcacggccttgtcgtagctgacgaagcccatgaaccaaaagtcgtgggagtcgacggtgacaacgtggacgtacttttccggcgggctctcc

SEQ ID NO: 28135 - DNA, 366 bp, Zea mays
  Clone ID: cC-zmle189070b02d1
gtcccgagagcccgccggagaagtacgtccacgtcgtcaccgtcgacttttcactacttctggttcatgggcttcgtcaggtacgacaaggccgtgcacaacctcgtcgaggccgtctcccagcacggcgtcgccactgccggcggcaagtgatgaggcgacgccgctccggagactgggtgggcgttcggcacccgtcgtcgtgtgtatatatgtagctgatggctctgcctgtgcattactcgtgttctgctactactagtactacgatggtgtcccggcgtgtgtttgaatgttctcggtgtgtgtggcacagatgcgccactgctattctatgcacttgtgagtattattatgctttcacgg

SEQ ID NO: 28136 - DNA, 439 bp, Zea mays
  Clone ID: cC-zmle189070b03a1
aaggaaggacactttacattccaaaactcaagttttacatgggaaaaagagatgtttttattacaagtcctgatagtactcggggggcctaaactttttacaaaaattggaagggggaagcctttccataagaaataaaaacattttaagcttcaaggcctccacatgaagtaactaaccaaaagataagggaatagaacttctccttattggaggagaagatcccaaaatccttctacccaacctttagttagatagctccatccacttgatgagcaggcattggagtagactcctttaaacaccactttttttagatgttcaccggtacggggctcgcgcaaactcaatcaaagaacacttgaattggccggtccacaaggggatgggtgtgaagcggcgttcactgacggcgacatgatgcggacccctgggcgga

SEQ ID NO: 28137 - DNA, 490 bp, Zea mays
  unsure at all n locations
  Clone ID: cC-zmle189070b03d1
gtccgcccacgcgtccgcatcatgtcgccgtcagtgaacgccgcttcgtttccatcgccttgtggaccggccaattcgagtgttctttgattgagtttgcgcgagcaccgtagcggtgaacatctagaagaagtggtgtttgaaggagtctactccaatgcctgctcatcaagtggatggagctatctaactaaaggttgggtagaaggattttgggatcttctcctgcaataaggagaagttctattcccttatcttttggttagttacttcatgtggaggccttgaagcttagaatgtttttatctcttatggaaaggcttcacccttccaattattgtaataagttatgcacatcgagtactatcaggacttgtaataaatacatctctttctaccatgtaaaacttgagttctggaatgtaaagtgtactttgtttaanaaaatatttaattatattttttttatattttatattaattttaatat

SEQ ID NO: 28138 - DNA, 378 bp, Zea mays
  Clone ID: cC-zmle189070b04a1
ggggaaaaaaaaaaaaaaaccccttggggggtgttttgttttttaaaaaccggggaaaggaaaaatttcgggggggggggggccccccttttaaaaaaaaaatttaagggggggaaaaatttgggggccaaaccgggaaaaaccaaaaacctcttggggtttaataacccccccccccaaaaaaggggggggggttcttttaaaaccccccggaaaagggggaaatccttttttcaataaaaaaaaggggtttttttttttcaaaacccccccttgaaagggaaatcccttcgaaggaaaaaacaacccccggaaaaaaaattttgtgggtccaccccccaaagaggctctaaaaaaaaaaaatcctaaccccccggg

SEQ ID NO: 28139 - DNA, 631 bp, Zea mays
  Clone ID: cC-zmle189070b04d1
gtcggcccacgcgagcgagtcaggccgcagaggttcgccggggtttcttagggcgtccagggacgcgccggccgtcttccccttcggctggggcccgcgcacctgcatcggccagagcttcgcgctgctcgaggccaagatggggctctccatgatcctgcagcgcttcgcgttcgagctctcgccggcctacacgcacgcgccgtttgcacacggcatgctgcagccggagcacggcgcgcaggtcatgctcaggcgcctcccctgagacgatgatgcatggcccgggcggggttaggttatttgatttgatggcttcatgtgtgcatgtacagcatatatatgtactacgtagtagatgtaaatcatgcaaggaactacacttgcaaggcgcgctcgtgaaaagttgattgcctttctagttactgatgagatgtatctcacttgttacggctggttgagataggcagctacccatattcatggtccggtgtatgtatgatgcctaaggcttgttcggttgtccaggattgacctagaatatttcagctgataaacttatataataggtaaacaatcaccagaatattcatgtaccgttctggcaccgacaaccctttgtttttttttt

SEQ ID NO: 28140 - DNA, 597 bp, Zea mays
  unsure at all n locations
  Clone ID: cC-zmle189070b05d1
cacccgtccggagaccaacaagcaacatagaaagtggaatccagtagcaacaattgagcattcaatggagaccaagatattttccctccttatgctccttgctctttctacatgtgttgctaacgcgacaattttccctcaatgctcacaagctcctatagcttccctttttcccccataccttccatcaattatagcttcagtatgtgaaaacccagctcttcaaccatataggcttcaacaagcaatcgcagcaagcaacatacctttatcgcccttgttgtgtcaacaatcgccagccctatctttggtgcagtcattggtacaaaccatcagggcacaacagctgcagcaactcgtgctacctgtgatcaaccaagtagctctggcaaacctttctccctactctccgcaacaacaatttcttccattcaaccaactgtctacactgaaccctgctgcttatttgcagcaacaactattaccatttagccagctagctactgcctactctcacaacaacaacttctttcatttaaccaantggccgcactgaaccccgctgcttatttgcagcagcaaatactactaccattt

SEQ ID NO: 28141 - DNA, 467 bp, Zea mays
  Clone ID: cC-zmle189070b06a1
ttttagtattacttagaagttttattcaggtcacgagcttattgtcgtaattcgtacaggagctgagtgcgtgcacgtacgatagccaagtacgatgaccctgcacaaccagtcaaccacagacatccataatgcacgcaggcaggcacgaacgggcgtggatgccggccgccgggcggctcagttagccctggcgaggaagctctccctgcgctcgtggacctcgccggtgcaggtgttgatgtcctcctcgaccctggtctcgcgcaccacgaagccgtggccgccgtggtgaccatggtggtggtggtggtggttggcgccggcgcgtgagaccgtgttgacctcctagaacttctccttgacgacgtgctgctggacgccgcctccgtggcggccgaagccggtcggggccaccgacctcaccttcttcgagcagtagtccacctcctggtagtaagccattg

SEQ ID NO: 28142 - DNA, 544 bp, Zea mays
  Clone ID: cC-zmle189070b06d1
aacacccgtccgcacagcaatccacacaagcacttcgacgtcgcacgggcgctgttttacatacacaccaagcgtcggcaccaatgggttactaccaggaggtggactactgctcggaggaggtgaggtcggtggccccggccggcttcggccgccacggaggcggcgtccagcagcacgtcgtcaaggagaagttcgaggaggtcgacacggtctcacgcgccggcgccaaccaccaccaccaccaccatggtcaccacggcggccacggcttcgtggtgcgcgagaccagggtcgaggaggacatcaacacctgcaccggcgaggtccacgagcgcagggagagcttcctcgccagggctaactgagccgcccggcggccggcatccacgcccgttcgtgcctgcctgcgtgccttatgtatgtctgtggttgactggctgtgcagggtcatcgtacttggctatcgtacgtgcacgcactcagctcctgtacgaattacgacaataagctcgtgacctgaataaaacttcttcgtaatact

SEQ ID NO: 28143 - DNA, 137 bp, Zea mays
  Clone ID: cC-zmle189070b07a1
ggcaaggcaaaaccaaactggtgtctgggctgaaatgtctgcgttcagttccaaacagtctgtctgtacccccacccgttcactggatgtaggcgacggtgcagccgtagttgagagggctctcgtcctcgaacctg

SEQ ID NO: 28144 - DNA, 287 bp, Zea mays
  Clone ID: cC-zmle189070b07d1
cacctcaattgttgagaagcaagctgttgtttgggtgcgtataccagggatacttcatgatacatgaaaaccgtctgtcgtcaagtgagacaaggttgttcaggctggagagaacaggtccgtgcaaacttgaaatgaatgatggtatacgagataaggttagtagaaacaggtaactggtaagaggccatacaggacacttcttttgaaaagcagggcaacaccaacacgatcggacgacacgacttcttcgccggggcacgccaaaacacgggatctggcgtagc

SEQ ID NO: 28145 - DNA, 383 bp, Zea mays
  Clone ID: cC-zmle189070b08a1
atccaagtagacaaatggaattttattgagcgcatttacagcaatacatgaatgaatcatatcatgtacaggtttgtgaacacaagcaatatacacagactacctgtaaaagaaacaactcgtcgcatatacagattccgaaccgcttattcgtggcagcattgaacgaagcttcctgccaactgacacagcaaccgccgagaacagctgaacggaggggcctgtcagattggaatgaagaacttgctctccttgccctccttgtcctcccactccagtttctcccaccattcaactgaaccgcacacctgcttcagtttcccacagttgtacgtgctgctcagtgggatgcttctcagattcgggcaatcctccacccggat

SEQ ID NO: 28146 - DNA, 618 bp, Zea mays
  Clone ID: cC-zmle189070b08d1
ccgtccgcccacgcgtccgccacgcgtccgcccacgcgtccgaaacacttttgttgctgataccgagctgactgcatcagattcaggcctgcagctcctcaccctctcagttcttcctgtgctggagaacgtcattgttgcaccaacgccccaccattttcagcacatccgcaaattgaccatttcgagttgccccaagttgaagaacatcacatgggtcctaaaacttgaaatgctcgagaggctcgtcataacccattgtgatgggttgctgaagattgttgaagaagacagcggtgatgaggcagagacaacaatgctgggtcagggtcatccttctgaagaacaggaagataaacggattgatggtggtcaaagtgtgtgcaagagcgatgacaatgcgcatgctgagctcctgaacctgagatcaatcgtgctgactgatgtcaagagcctgagaagtatctgctagccaagaaactttcccagcctcgagaccatcccggtggaggaatgcccgaatctgagaagcatcccactgagcagcacgtacaactgtgggaaactgaagcaggtgtgccgttccattgaatggtgggagaaactggagtgggagga

SEQ ID NO: 28147 - DNA, 352 bp, Zea mays
  Clone ID: cC-zmle189070b09a1
aaaaactggagcaggggtccccctttgtcctgtttacaaaaaaaatttttagatggggccatgtccaatgagtatagtccatctaaactgctgagctgaaaaaaagggaaaaagaaaaacttacaggcttttatgaagggcactcgaccatcatttggtctgaaatgggctggtgttcaacaccaaataatagatggggaataaacaaagcgactcaagacgaattcttcaaaacaagggtttatttttattggcgacgatgttgttgttttttcccaaacccaaaagggaaaatatttacaggagtcagctcattatgcgctctttttcctttttttcggacgcgggggtt

SEQ ID NO: 28148 - DNA, 399 bp, Zea mays
  unsure at all n locations
  Clone ID: cC-zmle189070b09d1
agaaaaggaaaaagagcgcatgatgagctgactgctgtgaattttttactttctgcgtctgggacacaacaacggcatcgtcgacaatcaagattatgccttgttttgtagtattcgtcttgagtcgctttgtttattaccaatctattatctggtgttgaacagcagcacattgcagaacagatgatcgtcgagtgaccttcatatacgcctgtaactctctctctctccctctctctcagctcagcagtttagatcgactatactcattggacatggacctatctatatatcttctttgtaaacaggacagagtcggactcctgctgcagtnttgaaaagagggggggcaaatttattactaaaataactttatatataaatacaaataaataaaag

SEQ ID NO: 28149 - DNA, 542 bp, Zea mays
  Clone ID: cC-zmle189070b10a1
tttttttctctttttttatatatttatttttaatttttggggttgggttaataaatattttaaattaatttcccattaacaaaaattaataatttaaatattaataaataaaataaaaaaagaaaaatcaataataaaacaaaaaaaaattaaaaaaaagaaaaaaaaaaaaaaaatagggaaaaaaatagaaatttaaaaaagccacaaaaaaaaaaaatacgaaataaaataaaaaaaaaaaaagaagcaaaaaaaaaaaaaaaaaacgctggatttcaaaagaaaaaaataaaaaaaaaaaaaggggggggaggagaaacaaaaactaaaaaaaaaaaaaaaacacacaacctgttaataaaaaaaaaaacacaacaccacaagagaggtaaatttataaaaaacgaacaagggaaaatatttattatttcaaaaaaaaagaaaaaaaaattaattctccataaaacatgataatcataataaaaaaaaacaaagaattaactttttaaataaaaaaaaataaaaataaaataattgtt

SEQ ID NO: 28150 - DNA, 90 bp, Zea mays
  Clone ID: cC-zmle189070b10d1
tccccccacgcgttcgaaaaaaaaaaaaaaaaaaaaaaaaaaaaaatttttttttttataaaaaaaaaaaaaacacaagggggtagggtt

SEQ ID NO: 28151 - DNA, 435 bp, Zea mays
  Clone ID: cC-zmle189070b11a1
ggggggggcaaacacatgcattgccatatattaacccctaggatatacatatgcgccgattggacaaaaagagaaggaaacaaaagaaaagtctttttttacaatggatgtaacgtaagaacctcaaaataattaaactttgggggggtcagttttgttagtagtttcattttcatcatccttgaaaggccaaactaaagggtaattaaaatgctgcataaccattaatcgtcaaattttggaacggggaccaggctggccaacttgaccctgggaatgttgtactcaccactgagtactttggaagccacaatgccatttgcagcatcggggaagagaaccccgtcccaacttatgaactttttgccaagcttgcacaggtatttggccgaagacatgcagcttttcttggggtcatagattgaagggggggct

SEQ ID NO: 28152 - DNA, 601 bp, Zea mays
  Clone ID: cC-zmle189070b11d1
cacccgtccgggcgactccaacagcgacacgggcggcgtggcggcggtcatgtttatccgtatcgcaccgccggagggcagggcctacttccaccaccccacggggcggctctccgacggacgcgtcatcctcgacttcatctgtgagagcctgggcacgccgcacctgagtccgttcatgaagccgctgggctccaacttctccaacggcgtcaacttcgccattgcagggtccacggccatgccgggagtaaccaccttctcgctggacgtgcaggtggatcagttcgtcttcttcaaggagagatgcctcgactccatcgagagaggtgagagtgccccgattgttgagaaggcgttcccagatgctatatacaccatggacatcgggcacaacgatataaacggtgttctccacttgccctatcatacaatgctcgaaaatctccccccagtaattgctgaaaataagaaagccatcgagaggttgcacgagaatggagccaggaagtttggatacatggaacgggagcattaaggtgcatgcctcagagctttctatgccgagggatgacgacagcggcctcgatgagcatggatg

SEQ ID NO: 28153 - DNA, 397 bp, Zea mays
  Clone ID: cC-zmle189070b12a1
tttttattttttttttttttttttttttttttttttttggggttgggtttaaataatatttttatttatccccctctcttaataaaaaaaaaaatacataatttttctacaaccctcaaaaaaaaaaacaataattaaaaaagaaaccccctttaaaaaaaaaaaaaaaaaaaaaaattataaaaaaaaaaaaaaaaattaaaattaaaacagtttaaaaaaaccaaaaaacccattaaaaaaaaaaaaaaaatttaaaaaaaaaaaaatttttaaaacccaatcatcccaaaaaaacaaaaaaagggggaaaaaaaatatttttttaaacaacaaaaaaaaacttttctataccccccaacccctttttttaaaaaaaaaaaaaattatatggagg

SEQ ID NO: 28154 - DNA, 397 bp, Zea mays
  Clone ID: cC-zmle189070b12d1
cgtaccgtgccacatccagctcgccgtccgcaacgacgaagagttttctcttttttgctgggcacggtgaccatcgcgggcgggggtgtaatgcccaacatccataaccttttgctcccgaagaaggccggcggcggcagcgccaaggctgcggctggtgacgaggactaagtccttgactacgcctggtggcacctccaggatgctgccgtatcaacatgtgtctgtgtagtacgttaggcgttcgttgtagctgggtatgtgggttgctgtaacactgctaaactaagttactcttgtgcttgctaaggattaaaatctgtatttgttgctataaaaggtgcatcctttgaatgactggttcctctaaaaaaattacatatctttcttttttctc

SEQ ID NO: 28155 - DNA, 564 bp, Zea mays
  Clone ID: cC-zmle189070c01a1
ttttttttttttttttttttttttttttttaattttttttcatttgggttatgggtttacattcattcccttttttaaccacaacgcccccacaaaaaaaggcacataaaaaaaaacagggtgcccaacacaccccagaaaacaaaaaatcgaacgcgaaaaacaaacccggcaatatccaaaacaaaacccgaaggcgtaccacctgcacctaaagggagactccttaaaactcgaccgaaaaaaaacacatagccctttaaaaaaaaaaaatgttatccgctcccaaatacacaaaaaaacccaaccggaaccaaaaaaagaaaacccggggggcggagggagggaccaaactcacaccaattggggggcactcaatgaccgacataaaaacagaaaccccccatgcccggtggaaaaacaaacaccccaacccccagaaaaaaacccttaacctattgatcacaaaggtggtcttcttccccacaaagaaaaagacacaaatgaattgccgttaccccctgtcccccaaaaaaaaaaaaaaaacacaaccccccttacccc

SEQ ID NO: 28156 - DNA, 233 bp, Zea mays
  Clone ID: cC-zmle189070c01d1
cattttagtcatcagtgctggatgggcaccctgtttatttcgacgtaccctttattgctatagcattgtaataagcgatgggcatgcttgtagttgaataagtacaatgtccatgtattcaaaaaaaaaaaaaaaaaaaaaaaaaaaaaattaaaaaaaaaaaaaaaataaaaaaaaaaaaaaaaaaaaaaaaaaaaagaaaataaaaaataaaacaatttatataatgaagc

SEQ ID NO: 28157 - DNA, 384 bp, Zea mays
  Clone ID: cC-zmle189070c02a1
gggggaaaaaaaaatttttttttataaaaaaaagggggttccggaaaaacttttgccaagttaaaataaaaggtctcctgtccacaacccatttggaaaaaaaaaaattttgtctccaaaaaccaaatctttaaaaaaagggaaagggaaaggtccctctcccaaaaaattgggggttttttataacccaatgaccttaactgacaaaggggcaaaaaaacgggtgaaaaaaaaggccctttttggggggcaagaaaggggggggaccccttctggggcccggggggtaacccgggaaattcggaccggtacccggagggggcccaacttttcctaaaaggaggctaaataaaacctggggaaaaaagggcaaaaccgtttccc

SEQ ID NO: 28158 - DNA, 433 bp, Zea mays
  Clone ID: cC-zmle189070c02d1
gaaggcgtccccagccgttcatgaaccccataaatggcctattttctttttcgtctatttgcacctctgtcagtgagggggattgcgttatcgaagacctgcaatattttgggagatggacctttgcctttgcctttgcttagaggattggtatttggtagcagagattttctctatccaagtgagttgtgagcagcgagcatttagtcaaactgtacaaaagttttccgggataccctttttgtaataaaagaaactgatgtattccgcacaaaaaaaaaaagcttctaaagctgtcattatatatcaacactgacttaatgattaataaaaaacagggaaggggcgggagcaaacaaaattagggggggggccgttttaaaggatccaagtttatttccccgtgcttgcaagggcatatcctttttttagg

SEQ ID NO: 28159 - DNA, 387 bp, Zea mays
  Clone ID: cC-zmle189070c03a1
aagaagcaggaggttcaggtttgcatatactgaaattttgaagggtcacagaatgtttatacacacacatttatgtctacatctttattgggaaaaattccatcaccttttttttccgtcaataaagaagacatgaatatcttatctccatgtgggaacagccaatcttggcaactgcatacgctgtacatttcatttgcactagttttctggaattggatcataaccctggggttcttcaaggggaactggagctatagcagccaccacaacagaggcaccaaataacacgacaaccaatgctgtgaagttcactaaaaatgcctctgtgccatatttgtcgagacctgagctctcgaggaaagtgagcttttcaagaaagccgag

SEQ ID NO: 28160 - DNA, 434 bp, Zea mays
  Clone ID: cC-zmle189070c03d1
caacaatactttgatggtattcagtggataattggattcgtttcttttttcttccctggtgctgcgccaaacgggaagaagggtgttcttccttggcacgtactctttgggctctttgtctacatcttagcactggctaatgcagaactcggctttcttgagaagctcactttcctcgagagctcaggtctcgacaaatatggcacagaggcattcttagtgaacttcacagcattggttgtcgtgttatttggtgcctctgttgtggtggctgctatagctccagttcgccttgaagaaccacagggttatgatccaattccagaaaactagtgcaaatgaaatgtacagcgtatgcaattgccaagattggctgttaccacatggagaaaagatattcatgtctctttattgacggagaaataaggtgatgg

SEQ ID NO: 28161 - DNA, 538 bp, Zea mays
  Clone ID: cC-zmle189070c04a1
tttttttttttttttttttttttttttttttttttttttttttttgggtttttggtttttatttttttttttttttttccttttttccctttaatttttattttttttaaaaaaaaaaaaggacccccctccttaaaaaacaaaaaaattaacccctcctaaaaaataaaaacgggggggaaaaaaaaaaacccatttgaaagcgggttggaaaaattcaaaacctccaaaaaaaaaaaaccccccctttttaaaaaattttccaaagggtttaaaaacccaacaaaaaatgttgtcaccaggggccttcccccaaagaaattcaaaaacttcccccccaaaattttaaacccaaatctccccaaaaaattttggaaagagggggtaaacccaaaaaaaaaaacccccaaaaacccccggtaaaaaccccgggaggaaaccacccccctagaaaaaaaaaaaacccgaaaaacataccttttaaaaaaaaaaattcccgacaaaaaaaacaaaacctcaaattttttggggttccccc

SEQ ID NO: 28162 - DNA, 554 bp, Zea mays
  Clone ID: cC-zmle189070c05a1
ttttgctttttttttttttttaagagttcaaatggatcctctatttgataatggtggcaacatttatatgatgacatgatctgcacagctaaaaattactaatatattagaagcagtcttctcactaagggtaatgacatatcatagctcgccaagtactttacaacacgacagaacaaaattttttaattgaaccagacttgcaggaagaaggggtactcccggtacagcacgagcgcgagcttatagaggacacagttcccttacaatcgagcaaaataaatttagagaactgcatgaaacctgagacgttgccatggagtttctaggcccacttggagaaccctaggtctctatccccagtgtcgtcctcaccactgatctcgtgagagaagaaggggttgcgttgggagccgacgagctcgacgtggatgaacgtgtagtacaggcttatattaagagccctgcaagaagggctgaccttggctcacttgtacaacaaccctcctttatattttaacgaattccatggaacttgattcaatagctagcat

SEQ ID NO: 28163 - DNA, 544 bp, Zea mays
  Clone ID: cC-zmle189070c05d1
acccgtccgggcatcatctcaaccatacaatgggattcattgaaatatcatgttggttgttgtacacgtgagtggaggtcgaacccttcttgtagggctcttaatgtatgaagtacgccatgctagctattgaatcaagttcaatgggattcgttaaaatataaggagggttgttgtacaagtgagacaaggtcagcccttcttgcagggctcttaatataagcctgtactacacgttcatccacgtcgagctcgtcggctcccaacgcaaccccttcttctctcacgagatcagtggtgaggacgacactggggatagagacctagggttctccaagtgggcctagaaactccatggcaacgtctcaggtttcatgcagttctctaaatttattttgctcgattgtaagggaactgtgtcctctataagctcgcgctcgtgctgtaccgggagtaccccttcttcctgcaagtctggttcaattaaaaaattttgttctgtcgtgttgtaaagtacttggcgagctatgatatgtcattacct

SEQ ID NO: 28164 - DNA, 266 bp, Zea mays
  Clone ID: cC-zmle189070c06a1
actaggaacattctgtcgggcattggttttttttttaatttacaatttacttacaaaggaaaacaaagggtataaaaagttaaaggggggagaaattaggttttttcaaaaaaagccctaaaagggccaagaaccacataacaccttgggaggagcttgcctggcaagaaaaactttccaagggggctttatcacggttaaaacccaggaagaccccacttgaaagggtacacatctggcgggggttacaggcggggtttaaacca

SEQ ID NO: 28165 - DNA, 523 bp, Zea mays
  Clone ID: cC-zmle189070c06d1
ccccgtccgcctccatcttcgtcgaggaggaggacggcgagggcgtgtgaggatgaggacctggtcgcggtcgcgggggccggcgtggacgtgccgctgccgctgcgtcggctgctgacgaacacggggctggacgtgtccgccgccgcggcgctggcgttcgtggagcagggcgtcgggggcagcggcgggggcgggaaggcgtgcggcagcagcggcggcaagggtgggatcggggacggcgacggtggcagcaaccgcgccgccacggacgcccactaccggcagatgatcgaggcggacccgggcaactcgctgctcctggtcaactacgccaggttcctcaaggaggtggccggggacgcggcaagggcgcaagagtactgcgagcgcgccatcctcgccagccccggcgacgccgaggcgctgtcgctctacgcgggcctcgtttgggagaccagccgcgacgctggccgcgccgaggactactacagtcgcgccgtccaggccgcgcccgacgact

SEQ ID NO: 28166 - DNA, 442 bp, Zea mays
  Clone ID: cC-zmle189070c07a1
ctcaaatacctccatagtagggcctggatagtcattgtttacataatgaagtttaaaataaaggaggatgtgagataggatatgtaagctgcctctgaacccgataacatagctttgataatgaagtgtgttatatttgattacctgacatctttagtctaaacaactcattagcaaatagtacaagtgtacaaccctagtttaacaacccactatcctagtatagaaacggctgctacctctttagcaagtacagcccatccctcgtttctagcttttcatctgctactagaccagaaagaaaactttgcagctgctgcagcgacttgtcatacgatggcttgggaatccaaacaattttagagggttatgtattctgtccagcgacatacttccaaaatttgttagcattccgacgatgtatttttcgtagactgtcatt

SEQ ID NO: 28167 - DNA, 519 bp, Zea mays
  Clone ID: cC-zmle189070c07d1
ccccggacgcgtgggttctagttggacttcaaaggcacttgctacttaaattttcatacctatggattctcttaacagaagaataagtttctggacaagcaagggggtcctgactgaatcagcaggaccagatgccgatgatcgcaccttcactgttgtcgatagcatgtctgatgtcaacaaggacagtattgtgaatgaacgcatggcagagtatcagatgactgaggaggaaggtgaaagctctgtggcttcagtggaggaacagcttaagaaagaaatgacagtctacgagaaatacatcgtcggaatgctaacaaattttgggagtatgtcgctggacaggatacataacactctaaagatgttttgtattgccgagccatcgtatgacaagtcgctgcagcagctgcaaagttttctttttggtctagtagcagatgaaaagctagaaacgagggatgggctgtacttgctaaagaggtagcagccgtttctatactaagatagtgggttggt

SEQ ID NO: 28168 - DNA, 538 bp, Zea mays
  unsure at all n locations
  Clone ID: cC-zmle189070c08a1
attctcattgncatctctctaggtgcgatgtgccatgcggcccatccctgatgtgatgccaacaggtcgtgcttatattaggtccgtgctgaggacggtccgtttatacatacgatacattatgttataataagaaatcccaggctgcaccataacgatcaatgcgtattttgtttcataaataaactgtcatacacacgtatgagtagagtacttcggaaccccaactgacaatctacctacacagccggggagacgtacaagtaggggtccggtcaactccttcccttcatgattttctattcacaaacagagtttccgttctgtataacccatcgccaagctcaggttaaacatgcattattgatgccaaacagaccatgtaacatttcgtaagggcctcatgcgacaatagggtaggatgcacacgtagcaacaccgcacatgttcttgcccatttcatcttgaagtaaccattataccccagtcagcgccccatgagttcttgatgagccagtaggggacaccatcttcgaca

SEQ ID NO: 28169 - DNA, 558 bp, Zea mays
  Clone ID: cC-zmle189070c08d1
tcactggtttcaggctgtacaagagcggagtttacactagttttccattgtggaactacaccgatggatgtgagccacgctgttctggctgttggctacggtgtcgaagatggtgtcccctactggctcatcaagaactcatggggcgctgactggggtgatgatggttacttcaagatggaaatgggcaagaacatgtgcggcgttgctacgcgtgcatcctaccctattgtcgcatgaggcccttacgaaatgttacatggtctgtttggcatcaataatgcatgtttaacctgagcttggcgatgggttatacagaacggaaactctgtttgtgaatagaaaatcatgaagggaaagagttgaccggacccctacttgtacgtctccccggctgtgtaggtagattgtcagttggggttccgaagtactttactcatacgtgtgtatgacagtttatttatgaaacacaatacgcattgatcgttatggtgcagcctgggatttcttattatacataatgtatcgtatgtataacggaccgtcctcagaccgacc

SEQ ID NO: 28170 - DNA, 493 bp, Zea mays
  Clone ID: cC-zmle189070c09d1
ccacgcgttcggatcatttttgacagtacatttcactctacatttctgttatatatactaagaggaccaacgggggcagggagaaaagacttgggaagcagtcactagccatcaattttgacagagtacatccagcgccatctgttgagtgaacttgtgagctctatggatggttttttctgcagttagaggactttagtgttaagtttgaaggataatgcagtagacaaccttggtggtgcgtggtggtgaggctccacctaagagggagcatcacactacgtaacaggaatgatctttggtggattggggcgtcttaatttaaattggtgccttccatgtgagggattcacgttaattcttttctttgttgattgatttgttgaccccccttgctttgtccttctgtcaataaggacatacacaggttaaaaatcactttctttgctcgtacctggtgcacattgattggtctaatcttattcattattat

SEQ ID NO: 28171 - DNA, 541 bp, Zea mays
  Clone ID: cC-zmle189070c10a1
gtcatttaaatttcacgtcgtccctatttctccattggcggggccagccttccatacaggtatataaagccaaaaatcacagaagaaaagcaatccagtaaaccaaactccagcacatgattgtcgaccaaaggaagcatcacagaaacaatatcaataatgtgatgagcacaacactaggatgcccatgtaaagacagaacgtaaattttagggcaagtcactgggatcggccagtgccaacaacgtagaagtttgtccatcgattcagcagaattaacttgacgatacaactagtttagatcatgtcgaaagcatcttcaactgctctgagccgactcagtcttggcttccgccgactcagtcttctcggcctcagcagcatgtccggcagcttgaggtttcgacacttcttcttcatcactatcatcctcaaaatcatccattcccataccacccataccgcccattccacccatgccaccaagaccacccaagccagccatatcacccataccacccatgccacccataccacccat

SEQ ID NO: 28172 - DNA, 537 bp, Zea mays
  Clone ID: cC-zmle189070c10d1
ggacgcgtgggacctcacaaaaaccctcgctccccacaaccttttcgtttccacgccgccgcctgtaccagcggcgtggagatgagtcggcaccctgaagtgaagtgggctcagaggatcgacaaggtttacatcactgtacagttacctgatgccaaggacgctaaggtcaatttggaaccagatggtgtcttcacattctctggcagtgttggtacaaacttatatgaattgaaactagatctgaatgacaaagtaaacgttgaggctagcaaaataagtgtgggtgtcaggtccatattctgtattgtagaaaaagctgaggccaaatggtggaagaaacttgttcgagatgatcaaagggcacctcactttgtgaaagttgattgggacaaatgggttgacgaagatgatgatggtgctgatgtcaacttggatgggatggacttttctaattttggcggcatgggtggtatgggtggcatgggtggtatgggtgatatggctggcctgggtggtctttgtggcatgggtgga

SEQ ID NO: 28173 - DNA, 450 bp, Zea mays
  Clone ID: cC-zmle189070c11a1
atatacttacttcattcgaaaatggaattcgttttaattaaatatacatccattaattataacttacatccattaatcaagctatgaatatgctctttcgaacgtgggcgaactataggaatattttttatggcatccgttgctaagcacggtcaatccattttttgtacattttgcacaacagtgacgtctaacatgacatgtacgagcagaaaaaagaactgacaaatgcatttttctttggcgaggcacatttttcagctcgcgcgctcgtctttcctctgtttgatcagcttgaagaggctgggcatcaccttcttcttcctcttgatggtgaacgagggcgtccgtgggttccggatccccgccgacgaagacacggacgaccgccgggccctcgttcttcggatcgtcgccgacaccctggtcgaccgccgtcgcgggtacgcg

SEQ ID NO: 28174 - DNA, 596 bp, Zea mays
  Clone ID: cC-zmle189070c11d1
cccggacgctggggccgacgagatgaagcggtggtggacattttactatgagcacgtcctggtggagctcgcgcgcatggaggccgagcgggagcgccgcgagatcgacgcccagcggtgtgccgaggccgagcggttcgcccgggaaatggaggccaccagggctaagatcgaggcgctacggaaggacctgagccgcgcccgggaaatggaggcgaagctcgcggtgacgaacgctgacgtggaggtcctacaggccgagatggagctggtccgtgccatggagaggaacagtgtcaagaacgacggcactgctgacgtggaggctgaggacaaggcgctgctgcggactgcggaggccgagctggatgccgccaagaaggagctggatagcatcaaggccgggagctttcagttcatgacgtccatggacagcgcgcgcaccgagatcatgcgggtcttcgaggaagtgaaaccgctcaaggcgcatgagaagaaggcggacgcgcaagtgcagcagctgaacgccaagttgctgaaggcgagggcccggctggaggccctcaccgagaccagcgagcggtccaaagcgatcg

SEQ ID NO: 28175 - DNA, 449 bp, Zea mays
  Clone ID: cC-zmle189070c12a1
gtatctattcatgctaccatataggggggacattgcctgtgtgagattacaccaccctaccgatatgtctgcaactgctttgatattcttctattttctctgacttctcagcttccggcggtgagatatcctgctcgtagatgacctgagcaaccataccaatgaaaatcatacccagaggagcaaccttcctccactgcacctttggtgttgcaaagatggcattcgcaattgtaatcccgagtattcccatcatccccaggtaaatgttcatacgagtttttgatcctgcactctcctgtgcaatctctttgaccttctgtgcttacaccttgggtttcacctttatttccattttgtttcgaggtttgaccttgccaaggcttttgaagaacatgcctttcgaaatctccttttcgatccacgcttcgaagttctgtaacacctta

SEQ ID NO: 28176 - DNA, 438 bp, Zea mays
  Clone ID: cC-zmle189070c12d1
agggatatggttccccggctccggcgactactagagtttttctttataagtgagccaaatcaacaccggggtcggcgtactgactacatagagtaggagatgcttactatccacaccattcattcttgcccctagctgcgcacatcctctctgtgtcggcctgctctggtacgcaggaagagatctttcatttatgccagcaatcatgaggatgccgaatacggcactgaccacgagcttggtggcgacaaacaccaacaggaggttcttgcacagatagccatgcttcagacgcagaaggtgcgcattatacacttcttggacgagagctctgcttacctgaccactttcgccaaggacgccgactcggagttcgacctgattgggcagaacgctatgaaagaacttgatgccggtggtgaccaaatactgtagagg

SEQ ID NO: 28177 - DNA, 519 bp, Zea mays
  Clone ID: cC-zmle189070d01a1
gtgcctttgttttttttttttttttttttttttgcaaacaatggatcaagcaaggtgattggggcctcctacaagtcacaatggaagccatcagattacaatctttgacgagaacttgacttgaggggcctcaccagggacctccatagccttacatccacggatacagaatgctaaagtttcacaggatttaactcgcaacaccaatctgttgtatgtagcatgaggtgacaacggaattatttcattacttgagaagcatggccaacgtttccattgctgatagatgcgaatgactgggccctgaggacttcaatgtcggacacaagcactgactttgggtgaaatacccaggctgggaaccccgcggctccataagcataattaggcgtgcactggatactagccactttacccacttgcatgggcataaatcccttgtgccatcctttgatcactgaaccctgcccaatgctgaaactgaatggctgctgcccaaggtccttggtgctccaaaat

SEQ ID NO: 28178 - DNA, 524 bp, Zea mays
  Clone ID: cC-zmle189070d01d1
ggcgggctccagtcgcaactcgcaacacagtcacagacgcctttgcctatagaaagacgtcaactccaggagagaggacggtgagaactgaagagaaggatgggcttcgagaagcagatcctgagatccggcaccggccccaagccgataaagggccagaaggtcaccgttcactgcaccggctacgggaaggatcgtgatctgtccaagaaattttggagcaccaaggaccctgggcagcagccattcagtttcagcattggtcagggttcagtgatcaaaggatgggacgagggagttatgaccatgcaagtgggtgaagttgctcgtatccagtgcacgcctgattatgcttatggagccggcgggttcccagcctggggaattcaaccaaactcagtgcttgtgttcgagattgaagtcctcagtgcccagtaattcgcatctgacagctatggaaacgttggccatgcttctcaagtgatgaaataattccgttgtcacctcatgctacatacagcaga

SEQ ID NO: 28179 - DNA, 482 bp, Zea mays
  unsure at all n locations
  Clone ID: cC-zmle189070d02a1
ccgtcgtaccgagaactgtggtggcttttgcggttgccgaggacgagcagcagcagctggcggtcaacaccggtgacttgatgcacctctggcggctcgtcgacgagaaggacggtggcccgtcgtggattcacatgatggacccgaaccttaccaaccatgaggtaccaagcctggcggagagacccaccgagtggtccaccacagtaccgcagcagcacaatcttggaagatgcgtcaccagaggttgtgagagatttcttctgggacgacgagttccggatgaacaacagctgggacgacatgcttcttcagcacgagacgctggaggagtgcaccgagactggaaccatggttgtccggtgggtcaggaagttcccgttcttctgcagcgacagggagtacatcataggccgcaggatatgggcgtctgggaagacattttactgtgtgaccaacccacgcgttcgcncacgcgtncg

SEQ ID NO: 28180 - DNA, 458 bp, Zea mays
  Clone ID: cC-zmle189070d02d1
gtccgcaatagagtgaaagtgccagattcagacgaagagttcttgcttttcctttacagttagacggaatgaccgatccgctcaaagcgtggatgaatggacaggggagcagaaggttcagtacagtgacataccagatgacatcgagccagaagagattaggccgatgggaaactatgcagtttctataacttggcctgatggatttagtcagatagcaccttatgaccaattggaaatgctggagcggttggtggaggctccgagtccagcagcagcgtctgcagtggcctcgtcatgatacagcagaaagaatgttcagttagcaaggggcaagaaggccgacttttagctcccagaaaatttatagctctgctacaaattttgaaagaattttacagtactgtagaaccatgctcattgaattttaaaaaaaggcagcagttttcgttcctctt

SEQ ID NO: 28181 - DNA, 367 bp, Zea mays
  Clone ID: cC-zmle189070d03a1
acggcaacggagttacctttctttcctgtccataaaaaaaaaaacaaatataacaaactttttccactgaaaaaacaaacccctttttttaaaaaaaaaggaggagggggcgcaagggggtaaacataccggacaggcagaggaaaacaaaatgcaccggaaacgtgcccactacatacacattgttcctcaacataccgaacaaccaatttggggaacaaatggggcggtcacggaccaaagaaactggtgggagcacttccgactccaacagcaaacaatctctccaacgaagggtggaccgcggacccctgggtcaacccgggaatttcggaccggtccctggaggcgtaccaactttccctaa

SEQ ID NO: 28182 - DNA, 305 bp, Zea mays
  unsure at all n locations
  Clone ID: cC-zmle189070d03d1
tcgcggtcagccgttcgttggcgagattgtttgctgctggagtcggttttgcttcagcagtttcgctggtccggaccgcgccatttgttngccacgaatggttgttcggtacgttgaggaacgatgtgtatgtagtgtgcacgtttccggtgcatcttgttctcctctgcctgtcctgtatgtttacccccctgcaccccctcctccctcttttgtagagagagggtctgtatgttcagtggaagatgattgttctatttgatttttattttatggacatgtatgctcggtgatgtgttgtggtt

SEQ ID NO: 28183 - DNA, 507 bp, Zea mays
  Clone ID: cC-zmle189070d04a1
agtattcaccaaatgtttgcattagtagggcccccatccccagatttccttgtttttatctacgtcgggctgttacaggaacaaactattcaagaggggaaaattggtccaagtaaaaaaaaaacttctctgtatgacgaatctttctaccatgctgtacatgatacctatgctcaacacaatatacagtggcatgctcggaacgggtgcatcgctcaactcatccataattccatatgcttcaaatcgtctctaccagagcaacatcacaaccggcaatttaatatccgggatgttaaggttgatacttctcgtgctgcgcgatgacacatttgttatcttgaagtgtattatgtccaggggtcaagttgtcgatccgaaatgagtctgtcactacgaactgtaagcatactgtgttcatacacccttcaatcaagaatcttctcgccagttgagaatatatttcataccaaagtccctaccagataaagcactactgataactcg

SEQ ID NO: 28184 - DNA, 611 bp, Zea mays
  unsure at all n locations
  Clone ID: cC-zmle189070d04d1
cacccatccgcctgtttgggcacttatagtttctcatttctgccataactgggtttactttcattttgctcacatggatgcccacggactacaatcaggttctgaaattcaacctcatggaatctggccttatctgtgttcttccctggttcaccatggcggcttctgcaaatgttggtggatggattgcagacacacttgtcagcagaggagtatctgtgacaactgttcgtaagatcatgcaatcaatcggattcttggggccagcattttttctaactcaactaagccatgtcaactcgcctgccatggcggtgttgtgcatggcttgtagccagggaactgatgcattttcgcagtctggtctatactcaaaccatcaagatataggccctcgatatgcaggtgtactgcttggtctttccaacacggccggngtcttagcgggtgtatttggcacagcagcaacaggatacatcttgcagcatggttcttgggacaacgtattcgagttatcagtagtgctttatctggtagggactttggtatggaatatattctcaacttgcgagaagattcttgattgaagggtgtatgtacacagtatgctt

SEQ ID NO: 28185 - DNA, 543 bp, Zea mays
  unsure at all n locations
  Clone ID: cC-zmle189070d05a1
gcagcttctaagaatctccattttttccttaagattaacttggaataaagcctgacgggggtaacagcatccatcgatccgcagtccatgctgtttgatgcatgggtctgctgaaaccgagggatgaacacagcacttacaactgacacagagcgaccttgcaatcaaaaacacagatgggcaacaacaaacacgacacgaacgaagataaaccctctggactagggtaaacatcacggtagcgaacaggataacttggccgcgcgggccccaccgctcagttcctccagttcccgtcggagttgccgtagccgccgccacggttgccaccgccgtagccgccgtcaccaccaccgtagccgccgccgccaccgtagccgtcgccaccgtcgtagccgccaccgccatcacggcgcccgccaccgccgtagccgccgcctccacgggcaccaccgtacccaccgtcgtcgtctccacggncgncgngggactgggcctcgttgacggtgatgttgcggccgtccagcttcttgccgttcatgc

SEQ ID NO: 28186 - DNA, 506 bp, Zea mays
  Clone ID: cC-zmle189070d05d1
ttctcctccccctccggttcgggttcgggttcgtgaggttcttttggtttcgggttcgcgggtgagcggatcgggatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggccgtgggtacagtggtggccgtggaggcggcggctacggcggtggcgggcgccgtgatggcggtggcggctacggcggtggcggcggctactgtggcggcggccgctactgtggtggtggcggcggctaccgcggtggcaacccgtggcg

SEQ ID NO: 28187 - DNA, 413 bp, Zea mays
  Clone ID: cC-zmle189070d06a1
cttacactactttttcattctttcatttttctagcgtatgcttccaatcattggagtcttgggtcattccatcctcccggtaaaacaccaaaccccaaaaaccaaacatccacaatatgcaacgccactaacccccacctatattaaactcgccccaaaaaaacccccactaaaaaaaagctaaaattaccatcaaaaaggaccaaaaacaccaccctttagaaaaaaaaaacccgcccacacagcactcccccccaaccaagccaaaaacaccccccccctaacctgtttattaaagcgcaccccccccctgaataaaaaaaaaaaccccacccaacgcggtgaaagcgaggggcaaaaccccccccctaggcgaagaaggtcttttccatcccggctggtgaatcatcccc

SEQ ID NO: 28188 - DNA, 286 bp, Zea mays
  Clone ID: cC-zmle189070d09a1
ggttgggggggaaaaaaacaatcaataaattgttgatttttaggaaaaacccctcggtgtgagggggccaccattgtggacatcttatatgatgtcaaaaaaaaggggcctcccacaacgggggggtgcctcctcaagacaggatgcatcaaaaaaaactgctggtatggtagcaattattgttgctgatggaaggaggcgaccaacggggggttcaccaccaacggaggaattaactcctgttgctgttgtaggtacgccccagaggaggtcggaataatttgtt

SEQ ID NO: 28189 - DNA, 585 bp, Zea mays
  Clone ID: cC-zmle189070d09d1
tcccattttgagcattcagaaacacaccaagcgaagcgcactagcatttacctatcaacaatggctaccaagatattaggcctccttgcgcttcttgccctttttgtgagcgcaacaaatgcgttcattattccacaatgctcacttgctcctagtgccattattccacagttcctcccaccagttacttcaatgggcttcgaacacctagctgtgcaagccaacatgcaacaacaagcgcttgcggcgagcgtcttacaacaaccaattgcccaattgcaacaacaatccttgccacatctaacaatacaagccatcacaacgcaacagcaacaacagttcctaccagcactgagccacctagccatggtgaaccctgccgcctacttgcaagagcagctgcttgcatccaacccacttgctctggcgaacgtagttgcaaaccagcaacaacaacagctacaacagtttctgccaacgctcagtcaactagccatggtgaaccctgtcgctacgtacaacaacaacaactgctttcatttagcccgctcgctgtgggcaatgcacctacataccttgcacaac

SEQ ID NO: 28190 - DNA, 408 bp, Zea mays
  Clone ID: cC-zmle189070d11a1
ataataagaagtccggttttagtatgtatatagtatcaaatcatatcatcggggaccaattaatatatggttacagcagatgcaatcggatcaaccaacatgcaggtagacacacgtacgtacatgagcacaaagactgacgccaaacatgcagagagagatagcaaactgaagaactctgtttctttttctcttacacacaccacacaatacctatgtatggcagccagctcggcctcgcttattattgttcaaccaccaccacaagctagatagataataatcatatccatggtcgtcgatcgatgtgatcagcagttgcaggggtcgcacttgcagttgccaccgcagctgcagccgtgggcggacttgccggactccgccgcggcctcgacgaactcgggcgcg

SEQ ID NO: 28191 - DNA, 506 bp, Zea mays
  Clone ID: cC-zmle189070d11d1
gacgacttgtttcattgattcttgaagagatcgagcttttttttttcacaaggtcgaggatgtcttgcggctggggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtatcgtgtggtgtgtgtgagagagaaagaaacacagttcttcagcttggtatctctctctgcatgtttggcgtcagtctttgtgctcatgtacctacgtgtgtctacctgcatgttg

SEQ ID NO: 28192 - DNA, 466 bp, Zea mays
  Clone ID: cC-zmle189070d12a1
ggattaatacttttttcttttcatttcaagggttcattcaggtcattgctcacactgacactgccacccatggtgatgcgtgacacattattactcaatcatcgccgctaaatgactcaactagctagctagcccgcgggtatactacagcacatagtttcttcagggggggacaccgccggcacaaccgtagggccttggagtcggctgttgcaggccgcacatcgccgtcggttgttgggttttttgggccgccaaaagccccggaacctggccgtttttcggttgttgttgcaggatggactggaggaccaacccgaaaatcgcctggtaccggggctgcggctccacctgcctgagctgttggcaacactgttgccgcaacgactggcactgaggcgagcagtagggcgtcgccgtcgggctgcactgatgccttaggaactcgacgcactggcccacgatc

SEQ ID NO: 28193 - DNA, 564 bp, Zea mays
  Clone ID: cC-zmle189070d12d1
gaccattagctttatctactccagagcgcagaagaacccgttttgacactatgagggtgttgctcgttgccctggctctgctggctctcgctgcgagcgccacctccacgcatacaagcggcagctgcggctgccagccaccgccgccggttcatctaccgccgccggtgcatctgccacctccggttcacctgccacctcctgtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcggcgttggcagcaccccgatcctgggccagtgcgtcgagttcctgaggcatcagtgcagcccgacggcgacgccctactgttcgcctcagtgccagtcgttgcggcagcagtgttgccagcagctcagcaggtggagccgcagtaccggtaccagccgatctt

SEQ ID NO: 28194 - DNA, 537 bp, Zea mays
  Clone ID: cC-zmle189070e01a1
gaacaagaacaagatagctcatggtacagttggttgactggcagcatttggaacacacaaaaacaaggaaaattgtgatgaaaagtgttcctttttcaagacagagaaagtaaaaaaagaaagaaacaagaaaactagcatgctactctactaccagccgttttgtaactacataacttacagtttaatttaaagctgcagcagggtcaagtattgggtcagcagggtactcttcgtatccacttatgcctgtgattcttaaccttgtgtttggctgtctgtgaccaagtttcctctggtacttcttcttcttcttgtacttgaacactataactttatcatcccgtccctgttcttcaaccactgcgtgaacagcagcattggtcaccactggcatcccaatgtaagctttttctctagttgacaccagtagcaccttgtttaatatgatctgatcattgacattggcacctttcagtctctgtgtgtatatatacctgcccggcatcactatgtactgtcttgaaccaatcatga

SEQ ID NO: 28195 - DNA, 528 bp, Zea mays
  Clone ID: cC-zmle189070e01d1
gacccacccgtccgactccactccttcgtcatccatgcgtcccctccccgccgcggccttggccaccgcgacgctgcccctccgcctcctcccctccaaaacgctgactctctccactctcccctccctgcgccgctccctctccgtcgccgctttggagccccggcgctggcgcctccgagccgccgccgaggaggcgcctgaggccgtggaggttgagttcgtggagcccgagacggaggctgaggagaaacccgcggtaccggagcccatcgaggctcagctggccgccgcgggggccgggaaggacgcggacatcttcgctgttgtcatgattggttcaagacagtacatagtgatgccgggcaggtatatatacacacagagactgaaaggtgccaatgtcaatgatcagatcatattaaacaaggtgctactggtgtcaactagagaaaagcttacattgggatgccagtggtgaccaatgctgctgttcacgcagtggttgaagaacagggacgggatgat

SEQ ID NO: 28196 - DNA, 458 bp, Zea mays
  Clone ID: cC-zmle189070e02a1
cctctaaaacggccgccctttctttttttcttttttttttttttctcccccttttcttttttttttttgttcttgttttttttttttttactttttccccccccccccccccccccccaactacaaacaaacacaaaaacaaaaaaaaacacacaaataaaaaaaaaaacccatcaactccacaaaaacacaaaaaaaaaaaaaaaacacaaaaaaaaaaaaaaaaaaaaaaccaaacacaaataaaaacaaaaaaaaaaaaaaaaaaaacaaaaaaaaaaaacactaaaaacaaaaaaataacccaaaaaaccccacccataaactacataccaactaaacccaccaaaccaaggagaggggacttaaaccataaataaaccaaaccctcaaaaaaacccccaaaaaaaaaaaactaaaaacaccccacacacaacacctatgaacaaaaagaaaaa

SEQ ID NO: 28197 - DNA, 552 bp, Zea mays
  Clone ID: cC-zmle189070e02d1
gtccgctatcctcttctctgttctcacccccttgcaagcaacatttgttttccgatcgatccagtgcgtcctgcatggaaactgccgccgtcgccgccgccggtgccgggcgccgcatcatggtggccgtggacgagggcgaggagagcctgcacgcgctcaactggtgcctcgccaacgtcgtctccccggcaggaggcgacacgctggtgctcgtccacgcccgccgcccgcgcccggtctacgccgccatggacagcgcaggtattactaccgccgcagatgtaaatttctccagatcatatggtgccggccgggcgttgaagctcacaagtatcagtaaatggaggaggcgctgatgccctggatcctgcctgcagggtacatgatgacctctgacgtgctggcgagcgtcgagaggcacgccaacgcggtttcgggggggcggtcgacagggtcagcgcgtttgcgcggaccacccgcacgtaaagtggagacgatggtggagagcggggacccgcgggacgtcatttgcgaacgccgccacaagat

SEQ ID NO: 28198 - DNA, 505 bp, Zea mays
  Clone ID: cC-zmle189070e03a1
tttttatagtatttctttcccatgtactagcacgggtatgagttagactgtgtgatatatagtaatgttttacacagatttttaggtgaagaaaccggccttttcgctgcctgcatgcccgtggcgcgcgaccagccgagtacaagtatcaaggctgtatctaggagtctataggcgggtatctgtctttgaacagcggcgtgccctccttcggcttggaccaagggtacttcatggtgggatccctcgggaacttcctgaagttgacgaatggcgcccagaacatcatcgctgggtagaagaggtaggtgaacatgaactgcaggtacgtcttcacgaattcgcgcttgtaccacctcagcctcatccagttcatgatcaccggaggagcgacgaggaagtataagaaggcgaacaccgcgagcggcggcaggatccctagcaggtcgatgtcctcctcgccggtcaccgccagcgccgtcggcgcctcaacagctgcccagac

SEQ ID NO: 28199 - DNA, 536 bp, Zea mays
  Clone ID: cC-zmle189070e03d1
ccgagccatcgccccgatggacaccgccgcctcatgccgttttctttttccggcctcgtcctctccgccccccggtccgaagcagctacccaagcggcgaccgaccttcgcggcctcgccgcagcagtcgtcgcccagctccagcgctaagttcaggctcctctgcctcctccatgacaagtccgcggcgccaacgtcgtcggtgcagatgcagagctcgcacttgcagaggctggcgacggtgttgcagtgcggagccgtctgggcagctgttgaggcgccggcggcgctggcggtgaccggcgaggaggacatcgacctgctagggatcctgccgccgctcgcggtgttcgccttcttctacttcctcgtcgctcctccggcgatcatgaactggatgaggctgacgtggtacaagcgcgaattcgtggagacgtacctgcagttcatgttcacctacctcttttacccagcgatgatgttctgggcgccattctgtcactttaggaagtttccgagggatcccaccatgaagt

SEQ ID NO: 28200 - DNA, 416 bp, Zea mays
  Clone ID: cC-zmle189070e04a1
gggtgacatttcatcttttttcactccccccttccccccctgtcctctttatggagcaaacaaaattcgcaaaaaacaaacctccaacaatcaccgctcctaatcacacaaaccccagtacagtatgtataaaaaaaaaaacactcaaccccccctctaaacccgaaaaaaaactttcggaacaaaaaaaacgaaccaacgccccccccccgggggggacccccggggaccccccggaatacccccacaaaaatccaaaaccgggccccctggtcccccacctctccctaagggggggggggaaaacacctccccaaaaaaagaacctcaggggtccccggggaaaacccaaattccccaaaaaaattaacacaaaaaaaaaaccggaaaaaaaaagaaaaaccctgggggggccc

SEQ ID NO: 28201 - DNA, 353 bp, Zea mays
  Clone ID: cC-zmle189070e04d1
ccgtgcgcccacgcgtccgcccacgcgtccggtactcgtagactgttttttttaaacaaagcttgctcatggttgggctgcgggttgattagtctttcaactacatagctctaaagtttttgatacaccgagtgatttgccaggaaaaaaatgagcagatcgttgtaagctaaaaaaaaaaaaaataatgaaaataaaaaataaaaaaaaaaaaaaaaaaaaaaaatataaaaaataatagtacaatccagaaaaaaattataaaatatggctaaaaaaggggggcctgcttgagggtacccaagtttcctttcattgtcaagcatctcttttttatatcttttagggggggg

SEQ ID NO: 28202 - DNA, 545 bp, Zea mays
  Clone ID: cC-zmle189070e05a1
ttttgacaatttcagaaattatcaatacattggactggagctcagatcgcttttagaaaacagtgtactaatcaggactgaaaacatggcataacgctctgaacttgagacgactaaccaaaaaaaggtggacttcatcaggacacacattttggtgcaagacaatccatgagaatgctctaagctacagcgctcttgcccttcttcctctgtagcttcttcatgtagaactcaagctctttaccctcaaggatgtacccatcagctcggccacactgtccagggcgggaagaaatgcatgccagcaaccgtccactgccaaattgctcctcaatgtgtgggtcaagggtacgtccctccttgcgcttctcaagcttcctcgtgacatggttgctctttttcgtttcctcagctgctgcctcaacctcttgtccctcagcattattccttctttgcagcaggggtttttcttcttcctaccaatgtcaactccatagtgagtgagggaccactgcttgaatggggcaacatcaacttgcacaatg

SEQ ID NO: 28203 - DNA, 460 bp, Zea mays
  Clone ID: cC-zmle189070e05d1
cccgtccgcctggaggaagaagcgaaagtatgagcttggtcgcctttcatttttaccaagttgtcaagcaataagacagtggggagggtccgtgttcgtggaggtaatgtgaaatggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgctgagggacaagaggttgaggcagcagctgatgaaacgaaaaagagcaaccatgtcacgaggaagcttgagaagcgcaaggagggacgtacccttgacccccaca

SEQ ID NO: 28204 - DNA, 411 bp, Zea mays
  Clone ID: cC-zmle189070e06d1
aaccaactagcatgcatagaactctgctttttatttttaacaacaacaactaccattcagggggcggggtgctgcctacccccagcaatttctaccattcaaccaactgacagcattgaactctcctgcttatttacagcaccaacaactactaccattcacccagctagctggtgtgagccctgctaccttcttgacacaaccacagttgttggcgttctaccagaacgctgcgcctaacgctggcaccctcttacaactgcaacaattgctggcattaaaccaacttgctttgacaaacccagcaacattctaccaacaacccatcatgggtggtgccctcctttacattgcttaagacttatagttcaataataaagttttttgtctgatgtttgtggctccctagaa

SEQ ID NO: 28205 - DNA, 144 bp, Zea mays
  Clone ID: cC-zmle189070e07a1
agctctatatattttcaagaggggcggtacagttcgtacattattggcaaacaaaccacaagttacaaggagcgtcttgttactactaattaacgcggagcttattggaggagatttttccttaacaacaacacattactcaaa

SEQ ID NO: 28206 - DNA, 525 bp, Zea mays
  Clone ID: cC-zmle189070e07d1
cacccgtccgatcagctactatgttactagtaaggagggtgaacattttttttttttcaccggagataccttgttcagggctgggtgtggtaagttttttgagggttctgcaaaacacatgtatcactcccttattgttacactgcgttcgctgccaaagacaaccacagtttactgagggcatgagtacactgtgaagaacctaaacttcatgctgacactgaagccagacaatgaggaagacgaaacagaaactggaatgggctgaaaagcagcgcgaagcgaatcagccaacagtgccctggactataggagaccagtgtgagataaatacatttcatgcgtgttgatctaccagaaatacaagcgaaatttaatgtcaactattcagttgaagcaatgatagaggtcaggaagaccaaggataactggagaggtagatgacacccatggccgtcactaatcatgtgaaccagccattcaaagtgaactaatgctgaaaccttgcactgtaagtgggaatga

SEQ ID NO: 28207 - DNA, 292 bp, Zea mays
  Clone ID: cC-zmle189070e08a1
agagcacagggggggcatattattattcatcatataagacatagtacataaaaagctcaacgttaggaatgaaaagtggtagaaaatgatattgcttattacattcacattgggcgattgatccggtatatatatgtagatgcagaaaacagatatttagtactcgacccattcacattgctcgggtgcatatcggtaggtacctagtagtatagtatagtatatatatttatgatgatgcaggagtcggcgggccggtaaaattgccgtagccctagtttttcactttttc

SEQ ID NO: 28208 - DNA, 344 bp, Zea mays
  unsure at all n locations
  Clone ID: cC-zmle189070e08d1
cccgtgcggaaaaagtgaaaaactagggctacggcaattctacctttccgtttactcctgcatcatcataaatatatgtacggtactatactactacgtacctaccgatatgcacccgagcaatgtgaatgcgtcgagtactatatatctgttttctgcatctacatatatataccggatcaatcgcccaatgtgaatgtaataagcaatatcattttctaccacttttcattcctaacgctgagctttttatgtactatatcttatatgatgaataataatatgaccgccttgtgatctanataaaaacacattttaattaacaataactaattataaagggg

SEQ ID NO: 28209 - DNA, 389 bp, Zea mays
  Clone ID: cC-zmle189070e10a1
gacaatagagtttttgaacattaggccgggcaatacacataaaaggatcgagtctccgttacacgaaatcctggaggacgaatgcagctatgcacgcaggcccatggatcttttattttatgagctaaaatggcttcgagccgagccaaggttaccatggagactctacttgttctgcagcaaggacaccgctgccttatcagtgaaccaggtgaattctccatcttgtagcacagccatctcaacaggcagcaggtctgacgaggtttgcttgtctgagagcgccttctgcaccgctgccgcctttccagctccagtcaccaccatcgcaacgtatgcggatgagttgattactggaaacgtgaatgtaattctctctggaggtgggg

SEQ ID NO: 28210 - DNA, 400 bp, Zea mays
  Clone ID: cC-zmle189070e10d1
cccgtgcgccccaccttcagagagaattacattcacgtttccagttttcattttatccgcatacgttgcgatggtggggacgggagctggaaaggcggcagcggtgcacaaggcgctctcagacaagcaaacctcgtcagacctgctgcctgttgagatggctgtgctacaagatggagaattcacctggttcactgataaggcagcggcgtccttgctgcagaacaagtagagtctccatggtaaccttggctcggctcgaagccattttagctcataaaataaaagatccatgggcctgcgtgcatagctgcattcgtcctccatgatttcgtgtaacggagactcgagccttttatgcgtattgttcggagtaatgttcaaaaactctattgtcttc

SEQ ID NO: 28211 - DNA, 374 bp, Zea mays
  Clone ID: cC-zmle189070e11a1
catattaatttttttttttttttttatttttttattttttcgcggggggggtttttatttaatttgttttaataccaccccacttttttttttatttacttttttctgttttaggaaaaaaaaaaaaaaaaaatactttggaaaaaggctcttaaagaaaaaaaaaaaaaaggccgtggggaaaaaaaaaaataaaaggggggccccggggaccacgggaaaaaaaaagaacttacttcaaagctccggggaaaaaaagaggcgagaaccatcctttggaaaaaaaacaacccataaacggggtgtgcgagggagcgaaaaaaaaaaattctttggtggaaaggaaacggaaccccaacaaccccacaaaaacc

SEQ ID NO: 28212 - DNA, 508 bp, Zea mays
  Clone ID: cC-zmle189070e11d1
cccgtgcgcccacgcgtccgcccacgcgtccgcatcaccatcgtttttgctttttcttcgctcctcctcctcggtgcggtggggtttggttaacttcctcgcgtgccgccgcgcaacagagcaggcggcggagccaggctgtcggtcaccaggagagctcacgccgcctccctcctcctcctcggcctggcgggcggtgcggtgccggcgccggtcatggcggcggaggacgacgggagcagcggaggggagggcgtcctcggcgccatcaagtccatcttcgaccccaacgagacgaccaaggccgggaaggtgctgcccaaggcgtacctcaaggcggtcagggaggtggtgcgcacgctccgccagtcgctggaggaggacgacggtggcgacatggtcaggttccgtcgcaacgtcgacgccgccaaggagtccatcagggcgtttctgggcggttggaggggccagcaggccgttcgcgacgaggagtcgtactccgcgctgg

SEQ ID NO: 28213 - DNA, 451 bp, Zea mays
  Clone ID: cC-zmle189070e12a1
ggaagtactcaaacgggagggtattgatacaacaatcctcagtttcgtccctagcagtagatcagaattggaagcacgaaaggggacgctgaggacgtggccaaggttttcacataattgaaaaacacaccacctgtgttatttaaggtaataaggtctgcgagtagcagggcaccagttttgcaggttgatccttgtcacatgtcaatatatgcaaggatgtcaatagtcattggcagtttgccacacaaccatattcgtactacatagctcactcaagttgcctatatgtatgcgagcttgttagctaaagacgctgcgactggaagcgcacccatgacttcagaattcggattaaccttacattagggcacggttggggtcagggcgcctagttgtagtagagctcgagccccatcccgtcgtggatctcggaatccttgagcgtgat

SEQ ID NO: 28214 - DNA, 560 bp, Zea mays
  Clone ID: cC-zmle189070e12d1
cccgtccgggaggggagaggggagcgcgctcagggtcagggaggtttttttttttcgaggtggtgctgaacgaccgcctgggggggaaggtgcgggtgaagtgcaacgaggaccacaccatcggcgacctcaagaagctggtggcggcgcagacggggacgcgccccgagaagatccgcatccagaagtggtacaacatctacaaggaccacatcacgctcaaggactacgagatccacgacgggatggggctcgagctctactacaactaggcgccctgaccccaaccgtgccctgatgtaaggttaatccgaattctgaagtcatgggtgcgcttccagtcgcagcgtctttagctaacaagctcgcatacatataggcaacttgagtgagctatgtagtacggatatggttgtgtggcaaactgccaatgactattgacatccttgcatatattgacatgtgacaaggatcaacctgcataactggtgccctgttactcgcagaccctattaccttaaataacacaggtggtgtgtctttaattatgtgaaaacctt

SEQ ID NO: 28215 - DNA, 321 bp, Zea mays
  Clone ID: cC-zmle189070f01a1
aaaaacaaaaaccccttttttatacaaaaaaacccttccaaaacaaaaggggaggcctttacacaaggtttcaaacctcccaaaaacctttgcccttttaaaaaaaacaccttttaatttttttttacaagggttcaaaaaaaaaaaccattggaaaattggcccaaaataaaaaacccccccccgctggaccatactaaaaaaatttttttcctaacaattaccttattattggtccccgaaccaaccttttttaatccctttatgggagggggggggattcccccctcctatgaatcaattaccctttaatgcctgagg

SEQ ID NO: 28216 - DNA, 599 bp, Zea mays
  Clone ID: cC-zmle189070f01d1
ccacgcgtccggttctagatctgtcgcgaaacgcatgggcttgaaggattttaaattgggatacaacattgacatccatgagttacagcgtgaggcttaaagctgcaaaaaagtttcttaaagctggcgacaaggttaagataattgtgaacctgaaaggacgggaaaacttgtacaaaaaagaagctatcgaactccttagaagattccaaaatgacgttggcgagctggcgaccgaagaaagtaagaatttcgcggagaggaatatatatctggttcttgttcccaataagatagctatacagaaagaacaggatgaattgaacaaaaagggtgctgtgagagaagagaaagaccaatcatacagtgatgaaccagaagagaacgaccaaccagacagcgatgtacccctgacagaactgctggaggaaagtatggaacccgaggcaaaagtcttagcaaacgtttgatttgaactgtagaggccaaggtgcctgagattgaaacacgtatcacgcacgtacagttgctgtagaattgcagttctcgtaaatacaaggcaggctggttcttttgtgcaacaattatatctgttaaac

SEQ ID NO: 28217 - DNA, 423 bp, Zea mays
  Clone ID: cC-zmle189070f02a1
ttattatttttttttcttaatttttttttttttttttggggttttttttaatttttttttttattttttcccccctcttcctttaaaaaaggggggcccaccattacacccttttttttttttttttaaaacaatattttacccccttcctaaaaaaaaaaaacgttctctgatttacaggaaccccccttttttaaaaaaaccccacccccaaaacctttttttcccaaaactcacacctttcatccccaaaaacaaacatttacaaaggtccgggaagggaccccattttttgaaccaaaaaaaataacccccctaaccaaaaaaaaaaaaaatgggggttgttttttacccccaaaataaataattaggtcacccccccgccgttataaattaaaaacaaaaaaaggggtggtcttcttt

SEQ ID NO: 28218 - DNA, 536 bp, Zea mays
  Clone ID: cC-zmle189070f02d1
ccacccgtccgcggacgcgtgggggagcagcccgccggcgagtacgggttttcctttaccgaggtggtcaccgccaccggggagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaagaaggaccacaaggacgccgaggaggccagcggcgagaagaagcaccaccacctcttcggctgaccgtagtaccggccggcgcgcgaccgagctagctagcttcggcgcacacaaccacacacctgtttaattctgtactgcatgcgtgtgtaatttgatgggtcacaataatgagtccctctccggaccttggtagctgcttgcttgtggtgagtgaaagtgtgagactg

SEQ ID NO: 28219 - DNA, 473 bp, Zea mays
  Clone ID: cC-zmle189070f03a1
tctcgccgccgccaactttagctctccgtcggcgtccgcgtcggcgtcctcgtcctcgtcgctcgtctcggtggaggaggcacaggcacccgagaagatggccagcgggtacctctccgacgggctcgtgggcagggccccggctgagaggaagaagggcgttccgtggacggaggacgagcaccggcggttcctggcgggcctggagaagctcgggaagggcgactggcgaggcatctcccggcacttcgtcacgacgcggacgccgacgcaggtggccagccacgcccagaagtacttcctccggcagagcagcctggcgcacaagaagcgcaggtccagcctcttcgacgtggtggagaacgctgctgagagggcgacgacgacgagctccagggagcgcccgaggctcacggtcacggatgcgataatcgcgaccgcctctgctgcagcacccggaacaacggcagcac

SEQ ID NO: 28220 - DNA, 412 bp, Zea mays
  Clone ID: cC-zmle189070f03d1
ttttggcaacggcgttcttttctttttagaaacaaacgaatgctaaattagggcagggaagtttatagagttctaattaggccactaaagtaaagtttccatctttctgatggatgatgtacaacacctcacccacgtgataaacgaccgcatcgtcgtctcggctgccactggcaggggcagcaacacacacacaccaacaccactgccaaaagctcctccttttcagttttcccaccccggccaagctcttcttttaccagcaggtcattcccgactaaccgccgccgccgtctttccggttacgtgaccctgatggtgcccagaaagggcgttctcggcggcgagcccgtctggacctgtgctttctttgtccgccggcgagatctttagcttcaggtctggtgcctgg

SEQ ID NO: 28221 - DNA, 315 bp, Zea mays
  Clone ID: cC-zmle189070f04a1
aaaagaaagaaaaggggttattagcttgttttattcctaaacaatgagtcgtatgccatggcatgccgacttcattattgggtacaacacaaatgcttattttttgaaatgccgcaccaacaaagggctgttgtaagaacatgggtgggatcgccatggctgtggggctgaacatgaatggccattgatggtgctgaataatgtgggacataaaaccccagtaacattgtggcactgtcatcatgttgggcatcatcattggggacaccatgctcggcttcatcattgggggcatcatactcggcataatcattg

SEQ ID NO: 28222 - DNA, 398 bp, Zea mays
  Clone ID: cC-zmle189070f05a1
aggaataagtaaacaagcaacatatttatgccgttgttcaaggagacccgatcacattaacagtactagcagccatcgtcgccggcaccacagagaagcaacacatactcaaacatgccaaaagctgccggtgacgagattgatatatagttgacacatctatcacacgacacatgtaccagcagtataacaacggaaatcagcagcagactaacagtacaccgcaggccgactgcggcagccgccaggccggagggcggcggtttgattgattatagatcgggtcggcggatgggattgaaaccgaagggaattgcgccccatgcaggcgggcgagccaaccaagcccagcaagcttacttcttgaggctgccgcggacgccgggcttgggcttgga

SEQ ID NO: 28223 - DNA, 422 bp, Zea mays
  Clone ID: cC-zmle189070f05d1
acccgtccggagggcaccacctacaagcccaaacccggcgtacgcgttttgctttattaaccaaacttgctagccttgggtggctggcccccctgcatggggcgccattcccttcacgaaccaatcccattcaccgacccgatctatactcaatcaaaccgccggcctccggcctgtcggttgccacaaacaacctgcggtgtactgatagtctgctgatgctggccgctgatatactgctggtacatgtgtcgtgtgatagatgtgtcaactatatatcaatctcgtcgccggcagctctggcatgtttgagtatgtgttgcttctctgtgctgccggcgacgatggctgctaatactgttaaatgcatcgggtctccttgaacaatggcataaatatgttgctcgattactatttcctct

SEQ ID NO: 28224 - DNA, 453 bp, Zea mays
  Clone ID: cC-zmle189070f06a1
gacagaacattctggatctttatttgagtcatcatgtaaaagactaccttattatactactacgtagctaacaaagtgacgtgggcgtggacgggaccaaaccgttctgattctttttactcattacaggaacaactcagcaagactagctaggtaccagcagagtccagtggctggagcgtcaccggacgtttatccttggctacctatggagggtggccgctccctggcttcctgcgtgggtcatgtttggggttggacccgccggagtcgtagtcctgaacgtacgtcagaaccttcccactgcgttgctcaaccgtaaccgcttcagaaagatctggatcgctggcttgtgtagctgcagcttgtcctgaagacacaccactgaacacgtgagacaccacaagaattacggtgaagatgagcctgagcttgggcattgtcgctctggtt

SEQ ID NO: 28225 - DNA, 504 bp, Zea mays
  Clone ID: cC-zmle189070f06d1
ccacccgtccgcacaaggaaggaaagaaggagacacacaatcgtcgctttcttatccagagcgacaatgcccaagctcaggctcatcttcaccgttattcttgtggtgtctctactgttcagtggtgtgtcttcaggacaaactgcagctacacaagccagcgatgcacatctttctgaagcggttgaggttgagagacgcagtgggaaggttctgacgtacgttcaggactacgactacggcgggtccaaccccaaacatgacccacgcaggaagccagggagcggacaccctccataggtagccaaggataaacgtccggtgacgctccagccactggactctgctggtacctagctagtcttgctgagttgttcctgtaatgagtagaaagaatcagaacggcttggtcccgtccacgcccacgtcactttgttagctacgtagtagtataataaggtagtcttttagatgatgatgaaataaagatccgaatgttctgtc

SEQ ID NO: 28226 - DNA, 136 bp, Zea mays
  Clone ID: cC-zmle189070f07a1
gttgttgggttttttttttttttttttttttcccttttttttaaaaaaaaaaattccttaaacaaaaattttacaaagggggggtttctaacataaacgcccctgcccgcctaataaaaaaattggcgggtttttt

SEQ ID NO: 28227 - DNA, 552 bp, Zea mays
  Clone ID: cC-zmle189070f07d1
ccacgcgtccggctagtcagttacctccatccaccagaccagaccattttatactagaccagaccaatggccctgcgcggggcaatctcatcgtcccacgggctggcctccacgccggcgccaatctccacgacgacgtgccggccggccgtcttggcgacggccgcggcccagaagaggagcctgctgctggcgacggcctccgagacgaggggagtcgcgccggtgaggtccagcgggatcgagacgagcacggtgggtctgggatgtgaggccgtcaccgggcaggtcacggaggtcaacaaggacaccttctggcccatcgtcgaggccgccggcgacaaggtcggcgtcctcgacatgtacaccgaatggtgcgggccttgcaaagtgatggcttcgaaattccaggagatgtttgagaagaacctggatgttgcgttcctggagctcgactgcaaccaggacaacaagccgcttgcgaaggagctgggcataaagggtgtgccaacgttcaagatcctcaagggttggaaggtcttgaatgaggtg

SEQ ID NO: 28228 - DNA, 501 bp, Zea mays
  Clone ID: cC-zmle189070f08a1
tttgtcagggaagcgtcgccatcgactcaacatggaagggtaaaaacagttgctgtactcaacaacatcgcctatcctacatttcaactctgaactcccaattcccaaggggaaggaagcagcagcagaagcttcaaaggcctctcaggtagccaaacctgacacggttgctattacacgtcttacacgtacacatacacaaaaaggacacatgcagctgaacatactcagcatttagccgccaaaaaaacaaaacactcgccaatgtgactccgcgcccctcctctttcttcactgacctgtctacctctgactgaatcctacaggctcctcctgaggctcccagtcgccagaggcatgacacacacaggtcgcattggcaggaatgggcgccaggagaattgcattcgccacaggagggcaagaaaagccttattcacagacacttggaccgacagccatgtccccagaatcggatctgactggtgctgatgagtggac

SEQ ID NO: 28229 - DNA, 350 bp, Zea mays
  Clone ID: cC-zmle189070f08d1
ccacccgtccgggttttggtcgtgtatataaaggacgcttggagaatgttcaggttagtatctcttaaacatgatgcatggccattttatctgtaaagctaaatccttccaaatttggcctctgggttgaaacattaagtaaaatattggttggaaatgctaacataacgattatacttaagccctggattagtcctggatactaacagagttttacttcccaggctgttgctgtgaaacaacttgatcgtaatggtctccaaggaaacagagaatttatggttgaggttctcatgctcagtctcttacatcacactaacctggtcaatctaattggctactgtgctgat

SEQ ID NO: 28230 - DNA, 407 bp, Zea mays
  Clone ID: cC-zmle189070f09a1
ctccccccccccttttctttcccccccccccccccccccccgggggctggacttttattttttttttttttttccccaaccactcgaaccctgtgaaccccaaaagggcaaaaattttcccaccaccgaaaaaagaaacccaaactgttgcccaagaaaaaaagccaaaaaccgggaaaaacggggccccacaatccgccacagaaaaaaaaaaatggaaaaaaaggccccagggcacaaaaaacctcccacaaaaaaaaaaaacatcccctaccagagcaccgggacctagacacccttaagcccctaaaaacggggggaaaaaaaaccacgaaaacaccctctaaaaaggcggcaaggaccccccacccccccccggaaggcccgggggacccccacacgggaac

SEQ ID NO: 28231 - DNA, 411 bp, Zea mays
  Clone ID: cC-zmle189070f09d1
ccacccgtccgcggacgcgtgggttttttttttttttttttgcacaatttttttttttcagacgctccaactcggattggggacggggatacccaagacgtagcttgactcacctccatagctatgcggaatgaaaaggccaacaagaaactcatgacctttgctggcccacgagcttggacaactcaagaggtgattacttcgtgtgagaggttatctgggcaagatgccaatgtaaccactgtacctgttgcagtcttgaaattcatctcgtcagttgacaacggtgcttccaatggacaaatgatgtggctgacagactgtcatttaaataggtgccctcaagggacacagggggtctctgttccaatgaatgaaacctaccaccttctcggggtggatgggaatgac

SEQ ID NO: 28232 - DNA, 252 bp, Zea mays
  Clone ID: cC-zmle189070f10a1
taaaacggccacccttttaatacatttttttttttttcgcacaaacacaaaacatcggagccagggttaagtagatttattgtaatcttccccctcccctacataaccataaatacacaacaatttcaaaatagatgtacaataaaaataccattacggcatcaagcaactcatccaataattattgtacccgttccctttcttgtgagaatctcattcagaatacatttagtaacacgcccataaaatgat

SEQ ID NO: 28233 - DNA, 353 bp, Zea mays
  Clone ID: cC-zmle189070f11a1
gggacgatcatttattcttagcattatcccgcctcacagttcacagagaggtacaacttacaggcaaacacctttagctaatagataccagacattgaacaaacctacatgtagtccgctttaaacccagctaacactacaagcacgacgccatccacacaccatccctaaaccctaatggcatagccgcagaagaaacatacaacacagcccggggcaaagcgcaaacgcagccctggtcctgagccactctatgcgcataacaccttattgatacagcacggcaccatgagcttttaacatactagaatacaacctatgccacgtagtagataggggggaacaatacacat

SEQ ID NO: 28234 - DNA, 621 bp, Zea mays
  Clone ID: cC-zmle189070f11d1
ccacccgttcgcaagtttcgtgggtagaggaggcactagatactgtgttttatctttgtctggtagtggcagttgggtgagtacgacggagtgggatgggccttctcgacaagctgtgggacgacaccgtcgcgggcccgcgcccggacaccggcctcagtcgcctccgcaagcagtccgcgcgccccgccgtcgttaagatcagtgatccggccggggacgctgcatcgctcgtgccgccctcgccggcttcgggtagcgaggagacgccggtgaaggtgacgcgcagcatcatgatcaagcgccccgcggggtacccgtcttcgccgaggagcgcggcaagcacgccgccggcctctccacttgggactaccccgcccatctcgccgtttgccggcgctggtggtcgattcagaaggaaatcatcatccgacgcatatgagagggcaacccctccagggacgaccagccacccttctcccttcgaagtgtgaacccgggtgcacccctacacttggttttgctccttgacaagcatttctttacctataataaggtagaggcagggaggagagaagactatatcaagaggggaacggggatgagttgcgggtttacttt

SEQ ID NO: 28235 - DNA, 331 bp, Zea mays
  Clone ID: cC-zmle189070f12a1
aaaacaaaatatgggttgggcgcttttaaattacgattgccaaccaaacataatgttcaaaacataacaatccaagccctactttcttggtaataggtcaatacacacccaattttttttaataatcatggaatcaacttctccggttaaaaaaatgaattgcttagaagtcactcactggcactggtaggggtagtacaacacaacaggcctaagagggattttcattgaaacttgtcgaagaaactacaggtttctttccccaaatgggccgggtgggggggcctacagatttattttcccaactgtgccgggagtggtaaaacaaccc

SEQ ID NO: 28236 - DNA, 330 bp, Zea mays
  Clone ID: cC-zmle189070f12d1
taccactaacgcctcagatcagaaatgaatatggaatttcaaaacagacatcacataagaggggagaggtgttatatacaatggtccaccatcaatgaaaatacttattaagcctgtcgtgttgtacttccactaccagagacagagagagacttctaacctatataatctataacctggcgaatgtgataccaagataataaaaaaaaattggcagtgtattgaactattaccaggaaactagaactagcattgcgatgtgctgaacaatatcgctatgtatgcaattgaaaaatagaaagccgtcgaggatctatctcgctaaagaaa

SEQ ID NO: 28237 - DNA, 355 bp, Zea mays
  Clone ID: cC-zmle189070g01a1
aaaaaaaaaaagatgataaaccggggttcttgttttaaaccggggggtttttttgggagagaacaaaaacccgttgtcttttgggaacaacccccccgggaaacaaacccaagcctttttccttatcaaaaggaacgggggcctaccttggtctcatgggggaacactgagccccggtggttccggaacattcttatgcctttcaccatggggcccccccgggcccgaaatcggtctccaccccccggacaaaaaagaccttgccggcctcaacttcttcttaaaccaaggcccacgaaaaaagggcccggccaaggaccaccttgccccgggtgttgtaccgggaacccgggca

SEQ ID NO: 28238 - DNA, 484 bp, Zea mays
  unsure at all n locations
  Clone ID: cC-zmle189070g01d1
cctgacncnncctacccgatccctcgcggctgctggcgagccnnatggacgacctcccccgcggcgcctctctcancccgccgcncnnaatcccaccnnncagctcttactcggtcccgccgcccttcgctgggccaagcatcggtgaagggggccttggctcttngagcatgggccgcgaggcgcgctctcagcggagccattgctgtgccacggcggctgagcagacatctccgctcgacccgcgtcctccgacantggagaagacgganaagctgatgaacctcctcctncctcggcgccatcttcgttgcccacccgtcggcatnggtcgtcccctacggcgccttcttcgtccctgccggctccgggaacgccggcggcgggacctacgcgaaggacaagctgggcaacgacatcacggtggaggcgtggctcaacacgcacggtcccaacgaccgcacgctcgcgcangggctcaagg

SEQ ID NO: 28239 - DNA, 249 bp, Zea mays
  Clone ID: cC-zmle189070g02a1
tttttatttttttctctcctcctcctctttctctttttggggttctgggtcttttatattattaaataccaacccattaccacccaaaaacatccaaaccaaacaacctccaacacccataacacccccttaaacaacaaaagcttcaaaaaccccctaaaccaacacaaccacccaagcaacacagactaaaaacaaaataactcttgaaaaacctctcccgcaaatgaaaaaaaattcaaactcgga

SEQ ID NO: 28240 - DNA, 467 bp, Zea mays
  Clone ID: cC-zmle189070g02d1
cacccgtccgcccacgcgttcgcccacgcgtccgcggacgcgtgggtgtttgtttatgtgtgcgatatggagtaaaatccctggagaattaggtggaggagaaggttaagttcaacgctccttaggtgttctatgaagtgcttgaactgaagttcgttgtcgttctgttcaccgcggttcgttaattgatcacgtgatgcggacgacaagagccgagttgatcccaaaatgatgctggtgaacgaacctgaagcttggatgatctggtcaagtaccaggatgagagatgctccccaagcggacatcatctaacaacactgacttagtgttatctcaaacaagccccggtgcatttgccacctccttctgttttaaaaacttttatcacttacctgctgcattaggtgataggagttgtgcgaataaacaattgatgcattatcattccttggaatttgattattctt

SEQ ID NO: 28241 - DNA, 513 bp, Zea mays
  Clone ID: cC-zmle189070g03a1
tttttagggaatttgcaggggatttaataaccatctgcagtttcatttcacaagcacaactgaacgaggtagcaaagtaaccctaattaactccacagatcccgcaacaccagatcttagtttatggaaatgaatcccgccagattgtcagattcgacatacgaatttacagtttacagaaggccacaggatggatttagtttgctaaaccaaacaaaaagatgcacacagcacagcggacggaggtagcagcagagacacggaccagagcaccacggggaccggtccatctgtcatgcgacgtatacgtagtcgtcgtcgtcgcggtggcggtgggggtcgacggagcagatgacgtatacggcgtaaaggacgccggggaggtagccgaggatggtgagcagcacactgatccagaactccatggagcagcagccgtggcggaggcagaccccgaggggcgggaggaggaccgagcacagcagctccaggcaccggcagcagcacgagcac

SEQ ID NO: 28242 - DNA, 542 bp, Zea mays
  unsure at all n locations
  Clone ID: cC-zmle189070g03d1
ccagaacggtccgtgctcggctgccgngaatctctctcattttcttttagcaagcgagcggggcagcgcgccgggaaggatcggagcagacgccatcaatcagcacttgcacgcgcgcggtcggccgcaggtggaggaaggagatgggcctgtgctcgtgctgctgccggtgcctggagctgctgtgctcggtcctcctcccgcccctcggcgtctgcctccgccacggctgctgctccatggagttctggatcagtgtgctgctcaccatcctcggctacctccccggcgtcctctacgccgtctacgtcatctgctccgtcgacccccaccgccaccgcgacgacgacgactacgtctacgtcgcatgacagatggaccggtccccgtggtgctctggtccgtgtctctgctgctacctccgtccgctgtgctgtgtgcatctttttgtttggtttagcaaactaaatccatcctgtggccctctgaaactgtaaattctatggtgaatttgacaatctggacggattcatttcataaac

SEQ ID NO: 28243 - DNA, 375 bp, Zea mays
  Clone ID: cC-zmle189070g04a1
atcaagactcagggttcaaactcatatattggctaaacccattttttgtaaacattagtaaagatttataaatagtttatattggctaattattggaaaaaagcgggcttcggatattttgcagcgtgtctctgacatatcaatcgacggcctgctgcaggggtaggcccttgtactccatgatagtggacacgtcccacttgaacatgcacgacacggggcacaccccgcatgtgtatgtgtcgaacctgatcaggggggaatccttgatgcgcccgagcaattttgctcattaaccgtctgtggacctggttgtcgcacacccaacattttcaatgggtacacactgatgggcaatttggtcattaccatgcc

SEQ ID NO: 28244 - DNA, 573 bp, Zea mays
  Clone ID: cC-zmle189070g04d1
ccgtgcgaatgtcactgtaccgcataatctatgagctctctccattttctttttcaggacttttctcaaacttctggggtgggcacttgggagacttgagtgatcctgaaactttcgactaccttcagcatgctcaagctcgtcacggaggccagcaggcggcaacatcctggtttcttcttgttcacccgtctcatacatcactgtttttatttcttatcttagttgtatgtttaccaaaaaaggaatcgattcaacagtgaactaaccatggttgttttttcccctacttttcgcactcgcgcagttcgactacctcatcccgccgatagggatggacaagtgcagcacgaatagacaagtgcagcacgaacaacgtgggccgtgacaacatacacaaggcgggcatggtgatgaacagattgcccatcagtgtgtacacattggagatgttgcgtgtgcggcagccacgtccacagacggttgatgagcaagatgctcgggcgcatcgaggattcaccgctgatcagggttcacacatacacatgctgcctgtgccccggtcgtgcatgt

SEQ ID NO: 28245 - DNA, 298 bp, Zea mays
  Clone ID: cC-zmle189070g05a1
gtaataaaaagggaaaatggattaaaatgtttaggttgtgaaatctatttgggagaaaatgggtggagatcgtcttatagacaaacctggaaatgaacccttttgaaaaacacaaaatatacagttctttgttcctacattccaaagatggcttacaactttcgctagaggcacaacatttcaccttgtcggctacctactattacaattttaaaaacctaaaccctcgttctaaacgtttccgctttccatccttgcctggaatcctaggcacacccataatttctaacccgatgat

SEQ ID NO: 28246 - DNA, 452 bp, Zea mays
  Clone ID: cC-zmle189070g05d1
tccggagggcgctaaacctgaccaagacaatccctaccaattttccttttctttgccggagacttcctcaggggggccggggtcaaccatttgggggtcaatctctgcctggacgatagccgccacgcaagggggctgcacacctacctccatgagagggcctggggctatggcgtgaacgacaggccctttgtccagaacgtccataacatgaacaagccggctgcttgggacggcactactgtgcataaatgaaaggaataagccaagaccgggaccctgcgtgagctggtacagggaggagcctatgcatgaaaaaagattactgtctaagcaaaagcatgcgggaatcctactaaagctttcatggtccgtgaagaaaccattccttgccggatactgagaatatacactccgtcccgttgctgccttttgatgaaagctttgggcaa

SEQ ID NO: 28247 - DNA, 467 bp, Zea mays
  unsure at all n locations
  Clone ID: cC-zmle189070g07a1
accaaccagaagccgtaactttatgttctggttgatccgcgtcacacaggccacaagtttcttcagttcatgtaactttggtgcagccaaaattaatgtcactgcagttgcttatttgggtgtaaagtgtttgaacaacaaagagaaaaacaagcatctcagcaggagatggacctccaactcgtgctgcctaactgcgaaaagcataaacaatcgcttaaatccaaaaatggaacttgattgtacaggattcaacaagcaagaagccgccttatgaagcagactccttggcgattttctcggccttagcaatgacttcctcaatgcctccaaccatgtagaatgactgctcaggagggcatcatacttgccatccaaaacaccctggaaactcttcacactttccttcagctccacatacttncctggagcacctgtgaaaacttcaacgacatggaaaggctggc

SEQ ID NO: 28248 - DNA, 585 bp, Zea mays
  Clone ID: cC-zmle189070g07d1
tgcggacagatcctgctcctgctactacctttgcccatcttgatgctttatctgtgttgtcacggcacatctgtgagcggggtatttatcctgctgtcgatccactggattccacatcaagaatgctttctccccacgtgctgggtgaggatcattacaatactgctcgtggtgttcagaaggttcttcataactacaaaaatcttcaggatattattgctatcttgggtatggatgagctcagtgaggatgacaagttgacggtcgctcgtgcaagaaagattcagcgtttcctgagccagcctttccatgtcgctgaagttttcacaggtgcttcagggaaggatgtggagcttaaggaaagtgtgaagagtttccagggtgttttggatggcaagtatgatgacctccctgagccgtcattctacatggttggaggcattgaggaagtcattgcttaggctctgaaaatcgcaaggagtctgcttaataggccgcttcttgcttgttgaatcctgtacaatcaagttccttttttgatttaagcgattgtttatcctttcgcacttaggcacactagttgga

SEQ ID NO: 28249 - DNA, 528 bp, Zea mays
  Clone ID: cC-zmle189070g08a1
ttttccatttgaagggtctttgaattgattgagagcggcggtacatttcacgagatcgttcagggatggtctttatagatacatacactatactagtccacagtcttcttgtatgtgtaccaccgcgcgatgagcaggtagacgccgaagtttccggcgcagagcatggccagcagccagaagaagttgtcgaggtgcgcccggttgatgtcgtcggggatccagccgtcccgcccgccccgcgcggtggcgcgcgccaccacggtgacgagcgcggagctgacgtagttcccgagcgcgaaggacgtcatggagagccccgagcagaggctccgcatcgcgtcgggcgcctggtcgtagaagaactccatctggccgatgaacgtgaacaccttcgacgcgcccaccaccacgtactgcggcacctgccagaagacccgcgctcttcctcgtcgaactggtcggcgccgaacgacgacagcaccggcttgagcgcgccgcccagcgccagcaggtacagccccgcgt

SEQ ID NO: 28250 - DNA, 517 bp, Zea mays
  Clone ID: cC-zmle189070g08d1
cccgtccgagttgcagctgccagcagccagtcatttcagtggcaattcagtgttgaaataaatatccgtggataagagctgcgctgtgtgctgctgagatatcaagaacgtacggcggtggaagacaaggccccgttctcgattagcccaagccaaaggtccgttccgtttacatcagtttttttcttcttcaaaatatatgtgtgaacgaacaatagtttgcagtacacgaccgaaacacaatatttcatcgattcgcttgtctcctcacctctgacgattctgtttctgaaatctgcttcctgcaaaatggttccatggccacggaattcgccgtggtcagagtcattgagagagagagagagtcctattggtcgtcacctgtcgaaccttttcggtgtctcctgagccacagctgctgctgctgctggaaccatggagatggaggccgtggagtcgcacggcggcgccggacgtcgtcggacgcccaagagggatcgcggcatcttctgggcct

SEQ ID NO: 28251 - DNA, 358 bp, Zea mays
  Clone ID: cC-zmle189070g09a1
caacggggaaagaaaaaaaatggcaaaaaaaaaaaacaggacttcaaaaaaaatttaaggggaaatccccccgggcgcaaaaaaaaaaaaggaaccggagaaccttaggggcccgaaaaaaaaaaaacttaattatccaaaaaaaaaaaaaaggccaaaggggactaaaaccattttaagagccccccggggctggaaaaaaggggcgtttccaatcaaacgggccattgttgtttttttcccaccccaaaaccgagggggtggcggggccctaaaaaaacccaaaggggaccatgtaaaaaaattgcccaaagcaaaaaaaaactttttttttccggggcaccttccggacccgggg

SEQ ID NO: 28252 - DNA, 369 bp, Zea mays
  Clone ID: cC-zmle189070g09d1
cccgtccggaaggtgcccaggaaaactagagcttttctgtgcatgtttcatttattcgacatggtcccatttggggggtgtgagggccctgctatcctctcgtgtctcgtgtcgtatatcagcagcaatggcccgtgtgactggatacgtccatctgtgccagcgccgtggtgctctataattgctgttagtcccttgtggccttgtgtgttcgatcggataatcgagttattttctttgcagtaccctaaggtcatcaggttccttgtaatgtctcgcgcacgtggggatatgccatgaaattgtcgtggaagtcatgttattgtttactgcaatgtgattcctgtcaacgtgaaaaaaattaaaaat

SEQ ID NO: 28253 - DNA, 517 bp, Zea mays
  Clone ID: cC-zmle189070g11a1
ttttgatttctattcaagctccagatattattaaacaggggaacattatgaaagtaacagaacaagagggttcccgccaaaaattgtgactaaggaacatttacctcaagaacaatctagctaaagacttcataaaacttctcaatgacaagtaaacccgagtcaatggattcaagcggatccttgcggagccgatgcctcaagcagtttggaatgacagtagcaatgtcctccacggtgacgctgtcccttcctttcaacgcagccagcgccttggcagccctgttagtcacaatgtcacctctgagtccatcaacgttcaactcagaacacaccttggatatcttgacacggaggtcatggtcaatctgcacagcgccaaggttactccgtgcagatgatatctgctgctggagcttctcctgctcgtcatggtacgactcacggaacgtctttggatccctgtcgaaacgagccctcttctccacgatctttaccctgagctcggcgtccctga

SEQ ID NO: 28254 - DNA, 522 bp, Zea mays
  Clone ID: cC-zmle189070g11d1
cccgtccgccggaggaaggggagctcaagccccagctgctggactttttttttatgcacgcgcaggttggtaccggggggggggccgatctcagggtgaagatcgtgcatgacagggctcgtttttacagggatccgaagacgttccgtgagtcgtaccatgacgagcaggagaagctccagcagcagatatcatctgcacggagtaaccttggcgctgtgcaaattgaccatgacctccgtgtcaagatatccaaggtgtgttctgagttgaacgttgatggactcagaggtgacattgtgactaacagggctgccaaggcgctggctgcctttaaaggaagggacagtgtcaccttggaggacattgctactgtcattccaaactgcttgaggcatctgcttcgcaaggatcccgttgaattcattgacttgggtttacttgtcattgagaagttttatgaagtcttaagctagattgtttttgagggtaatgttccttagtcacaatttttggcgggaa

SEQ ID NO: 28255 - DNA, 332 bp, Zea mays
  Clone ID: cC-zmle189070g12a1
gggggaaggcactttattatcgcacacccgacaaatttaaaaaattggggggttactattgggcatagctcagtacaaaaaccccccattttttaaaagcccccccccttatttagaaggggttccactcatactacacaagggacttgatctgaaaacctggggaaatgcaacaaataaaatggggctatatatagaacgggtaccagcatatgaggggggggaggctatatatgtatgcctgaactttagggaatgcaacccggagctaattttgggggttgcttgagaggggtgcttgagcaaccaggagctaagcggacgcgtggggt

SEQ ID NO: 28256 - DNA, 385 bp, Zea mays
  Clone ID: cC-zmle189070g12d1
gtccgttagctcctggttgctcaagcaaccctctcaagcatttttcatttttagctcctggttgcattccctagagttgatgcatacatatatagccttccactcatcatatgctggtatccgatctatatatagacacatatgatatgttgcatatcgccaggttctcagatcaagtcccttgtgtagtatgagtggaaacctatctaaataatgtgtgtggcttctgaaatatgtggtgttattgtactgagctatgctcaatagtaaacaacaaattattgaaatatgtcgcgtgtgcgataataaagtgacttcgacaaaaaaaaatgaggggggggggggggggtaatttacctctaatactccaaatcttacaactacc

SEQ ID NO: 28257 - DNA, 588 bp, Zea mays
  unsure at all n locations
  Clone ID: cC-zmle189070h01a1
tttttcgcactttaataattgttataataataacaattgacacacaggggaagaggtcatccgacaacgaagcgttaaagcccaaacacttgtattcggccgaaactacaaggcccagcagcctacaccatctaggcctcgggcttcaggataccatttaccacggataggcccacgacgaccccgagcgcctcggcgccggcgaccaccgcggcctgcactagcccgtccccggcgagctccgcgccggccaccagctgcaggccctcgctggcgacctccttctccgcctccgtcaccgcccccttcacggcctccccgcccaccgccgcggtctcctccacctcccgcaccgcctcggccgccgcctccttcacggcttccccgcccaccgccgaggcctccgccgccgtctcctccacctccctcaccgnctagggcgccgtctactccgcgcgctccagctttttgcggatgccgaagagaccgatgcccgcggcgctcgctgggggagctgtcgctgccgatgccgctggaaccgccgtggacagcaggagcagggccgtcgagcgccggtcgagccgcgcc

SEQ ID NO: 28258 - DNA, 449 bp, Zea mays
  Clone ID: cC-zmle189070h01d1
gtccggtctcccacgtcctacacaacagagtagagctagcatttgtatttgccatccaccatggccgtctccatcgccgggggcagcatccgcctccacgttgccccgcccagtcgccgccgcgtcagcgtggtctccgccgccgccgcggcgcggctcgaccggcgctcggcggccctgctcctgctgtccacggcggttccagcggcatcggcagcgacagctcccccagcgagcgccgcgggcatcggtctcttcggcatccgcaagaagctggagcgcgcggaggaggcggcggccgaggcggtgagggaggtggaggaagcggcggcggaggccgcggcggtgggcggggaagccgtgaaggaggcggcggtcgatgcggtgcgggaggtggaggaagccgcggcggtgggcggggaggccgtgaagggggcggtgacggaggc

SEQ ID NO: 28259 - DNA, 492 bp, Zea mays
  Clone ID: cC-zmle189070h03a1
acgaattatcagcttaaaacaattctcaaaaatgaaaatggggcgacacacatatatacacgcactgtaacacaattcttgacattaacgaacaaatcggccacagcattgcgcgcaaggtccaacagcgcacaataacactgctagtccagactgtcagcgcatagttaacttaagtattcgaccctagcaataacaccagcaaaggtagcagcaacagtagcagaagagaaacttgcgatccacaaaacaaaccctactcatatgtccttacaatggcaccagattaacaataaccccaggacttcatgtttttgtcacgatgtttgaggtggcgattatgccctctcgccgcggatcctccttgccagctgaatgtcctttggcatgatggtcacacgcttagcatggatggcgcacaggttggtgtcctcaaacaggccaacaaggtatgcctcagcagcctcctggagggcaagcaccgcatggccc

SEQ ID NO: 28260 - DNA, 524 bp, Zea mays
  Clone ID: cC-zmle189070h03d1
cacccgtccggtcatgcggtgcttgccctccaggaggctgctgaggcatttctttttggcctgtttgaggacaccaacctgtgcggcatccatgctaagcgtgtgaccatcatgccaaaggacattcagctggcaaggaggatccgcggcgagagggcctaattgccacctcaaacatcgtgacaaaaacatgaagtcctggggttattgttaatctggtgccattgtaaggacatatgagtagggtttgttttgtggatcgcaagtttctcttttgctactgttgctgctacctttgctggtgttattgctagggtcgaatacttaagttaactatgcgctgacagtctggactagcagtgttatgtgcgctgctggaccttgcgcgcaatgctgtggccgatttgttcgttaatgtcaagacatgtgttacagtgcgtgtatatatgtgtgttgccgcatctttatttttgagaattgtcttaagcctgatgtttcgttaaaaaaaatataaaatagggggg

SEQ ID NO: 28261 - DNA, 475 bp, Zea mays
  Clone ID: cC-zmle189070h04a1
gcagagaatttcctctctatattatatatatcggcgacgctgtggatcattgatgtccacgtagcttacatattttcaccattatcgtcgcggtgaagcaggcaaagaaaaccaaaagaaagaaagctgccgtttctttctcctccaaggtaatttgatccaggaggaagaggcgagcaaagaagaatttcaaagggtgaaaaaaaaaacttctctagctagcttggggttaaattcatgcctaactcaagagtcaaactaaaatatcctcctccatatgatcgtcgtcggtctcacgcccctttatgtcgaccggattgttttgtctccataatctgacaggcaagccgtgcttgggcacagggaacgggctgtactcgacctcgtcactggatccaacgatttgccacctgcaaatttaaaaataaagcatgcagagacgccaatcagtgcctcagtgtaagcggacccgtgg

SEQ ID NO: 28262 - DNA, 464 bp, Zea mays
  Clone ID: cC-zmle189070h04d1
cgcttacactgaggcactgattggcgtctctgcatgcttttttttttattttgcaggtggcaaatcgttggggccagggacgaggtcgagtacagcccgttccctgtgcccaagcacggcttgcctgtcagattatggagacaaaacaatccggtcgacataaaggggcgtgagaccgacgacgatcatatggaggaggatattttagtttgactcttgagttaggcatgaatttaaccccaagctagctagagaagttttttttttcaccctttgaaattcttctttgctcgcctcttcctcctggatcaaattaccttggaggagaagaaacggcagctttctctctttcgttttctttgcctgcttcaccgcgacgataatggtgaaaatatgtaagctacgtggacatcaatgatccacagcgtcgttgatatatataatatagagaggaaattctctgc

SEQ ID NO: 28263 - DNA, 505 bp, Zea mays
  unsure at all n locations
  Clone ID: cC-zmle189070h05a1
gcaccaagaagcaccattttttccttaagatggacttaaaataaagcctgacgggggtaacagcatccatcgatccgcagtccatgctgtttgatgcatgggtctgctgaaacccggggatgaacacagcactaacaactgacacagagcgaccttgcaatcaaaaacacagatgggcaacaacaaacacgacacgaacgaagataaaccctctggactagggtaaacatcacggtagcgaacaggataacttggccgcgcgggccccaccgctcagttcctccagttcccgtcggagttgccgtagccgccgccacggttgccaccgtcgtagccgccgccaccaccaccgtagccgtcgtcgccaccgtagccgccgtcaccgccgtagccgccaccgccatcacggtgcccgccaccgccgtagccgtcgtcttcaggtcaccaccgtacccaccggcgtcgtctcacgggcgnncggggactgggcctcgttgacggtgat

SEQ ID NO: 28264 - DNA, 425 bp, Zea mays
  Clone ID: cC-zmle189070h05d1
tgcggggttcgtgaggttctccggggttcgggttcgtgggttttctgtgcgagatggcggcgtcggatgttgggtacgggtgcttcgtcggtggcctcgcctgggccaccgacgaccactccctccacaacgccttcagcacctacggcgaggtcctcgagtccaaggcccgttcccgtcccacatccgtccatggcttcgtccacatctgacctgtcctgacacaccctcacccggatctgtccctccttcccctctcccctgcagatcatcctcgatcgggagacgcagaggtcccgcggcttaggcttcgtcaccttctccacacaggaggcgatgcggagcgccatccatggcatgaacagcaaggagctggactggcgaaacatcaccgtcaacgaggcccagtcccgcggcggccttgg

SEQ ID NO: 28265 - DNA, 469 bp, Zea mays
  Clone ID: cC-zmle189070h07a1
ggcaaatggtctcatgggttggcttttcctttccctactcctacgccgacatgccagtggttgtcaaagacagggtatgtaagagaagaattgacgaagatgctcaagatgatatctaccactgggtgggggtagcaggggcagcagtctcagcaccccagccctcgttgccagtctgagcatcgccagacgcagcccagtcaggggtatcagcgtcccaactggtgccgggggcagcggcggcctgggcagtgaaagcaccatcagatgcgccggagacctcccactcgctagtgaagccatcaacgacggcaccagggccaacctcgtcggcaccagggaccttggccttctcaacaccagcgctgtccttgttctccttagcctcggggtcgcggtagaagtacaagtcagtcatgacgtcccactcggtctttcggttggcgagggtgccgcggaggccgaggac

SEQ ID NO: 28266 - DNA, 334 bp, Zea mays
  Clone ID: cC-zmle189070h07d1
tcggaaaaggtcttcaacctcccatttttcatcacagacatgatctctgtgggagccttggagagacctccactacaggcctcctgggagaccgcccacggaactctgacatgcagacctggaagatgtctgcgcgctatgcgcattgcacccgcacattggtatcttgccgtctcgacagggcgcctaagttcgatcgacaccgtgcaccgcttgtggcgttacccgaacttacactcataccgtcttaggagcccgctggtatctcaccacccgaccgccccggccataagggttctctaacatcccgcttgccttggaggaactacctacc

SEQ ID NO: 28267 - DNA, 424 bp, Zea mays
  Clone ID: cC-zmle189070h08a1
ggcagcaccaagaagcaccggggttttccttaagattaacttagaataaagcctgacgggggtaacagcatccatcgatccgcagtccatgctgtttgatgcatgggtctgctgaaaccgaggatgaacacagcactaacaactgacacagagcgaccttgcaatcaaaaacacagatgggcaacaacaaacacgacacgaacgaagataaaccctctggactagggtaaacatcacggtagcgaacaggataacttggccgcgcgggccccaccgctcagttcctccagttcccgtcggagttgccgtaaccgccgccacggttgccaccgccgtagccgccgccaccaccaccgtagccggcgacgccaccgtagccgacggcaccgccgtagccgccaccgtcattacggggcccgccacc

SEQ ID NO: 28268 - DNA, 509 bp, Zea mays
  Clone ID: cC-zmle189070h08d1
cacccgtccgcggacgcgtgggcggacgcgtgggcggacgcgtggtgttggtttttcctccccctccggttcgggttggggtgggtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggtcgcaacatcaccgtcaacgaggcccagtcccgcggcggccgtggaggcggcggccgtgggtacagtggtggccgtggaggcggcggctactgccgtggcgggcgccgtgaaggcggtggctgcttccgcggtggcggcggctaccggtggcggc

SEQ ID NO: 28269 - DNA, 321 bp, Zea mays
  Clone ID: cC-zmle189070h09a1
cctctcctcttttttttttttttccccccttccctttctttttgggtccggtgtttttttaaaaaaacatactcccccacccccccacagccccaaaccaaacccacaaaaaaaacaaaccacaaaaaaaacacacaatccaaccaaaaacacctcaaaccaaaaaaaaaaaaaccccacaaaataattattgaaaaaaaacaaacaaaaaaaaaaaaaaaaaaacaaacccccggaaaaccccccccaaaaaaacgccggaaaaaaaaaaaccaacccaccccataaatcaaacacacctccccggggggggggggggaa

SEQ ID NO: 28270 - DNA, 338 bp, Zea mays
  Clone ID: cC-zmle189070h09d1
cccgtccgcgagaagttcggcggcaggatgaaggagatcgaggggttcattttctagtgcaacaacaacctggaccggaagaaccgctgcggcgccgggatcgtgccgtacgagctgctcaagcccttctccaagccgggagtcaccgggaggggcatccccagcagcatctccatctgatccatcctcagcatgcattagtccaattaattaaatcgggggttgtactattattgcatgcagaggctgcttgtcgaataaaacgtactatatgtacgattgtattgtacatgtgtgtcaatgcaacaagaggcacgtttgagactttgagttaatac

SEQ ID NO: 28271 - DNA, 482 bp, Zea mays
  Clone ID: cC-zmle189070h10a1
tttttgatttgggaagtaatatttcgtaagcaacagaggggcaacttacaaagtcagtcaacagctggttttgtttatccaggcatccagcgatgacaagggaggagtgcaaacttcaagcatatcatataacatgctgcagaccgactatacaaatcggaaagaacgcaaccccacgcatacgaacatgacgctaagaccacgaatcaaagactgggatgaacgtggactgagatttgccattagcagactaaacatttcccaaatcaaccgcgaagcgctgccgccggctccatgcaccgcttgctagttcttcaggaagtgagggctcagtagcttcgagacctccatcatcccgatcttgtccctcccaccaaacaagctcttgagcgtcgcgtcacagttgatctcggttttgttggacgggttctggaggccgtgggccttgatgtgggtccagacgagcttgatggcctcggagc

SEQ ID NO: 28272 - DNA, 560 bp, Zea mays
  Clone ID: cC-zmle189070h10d1
cccgtgcgcccacgcgttcgcccacgcgtccgcggacgcgtgggttttatatttatttttaaatccgtggctctaatggggaacggtaaacccccaccaaaacccctcctcgcctccctcccctgcatccaatcctcgaaacgagcgcgcgggcgaggaggtccccctctccgagatggctagggtttttcgcgggtccctcctcctgatgtccccggcggcggcagcggcggcggcggcggcggcaggggccaagaaggcggtctccacgaagccgagggcgccggccgggatcacgaagccgatgccggtctccgaagcgttccgcaagttcgccggcggcgcgcgcgaggtcgcacgctccgaggccatcaagctcgtctggacccacatcaaggcccacggcctgcagaacccctccaacataaccgagatcaactgtgacgcgacgctcaagagcttgtttggtgggagggacaagatcgggatgatggaggtcttgaagctactgagccctccttcctgagaactaacagcggtgcatggagtcggcgcagcgc

SEQ ID NO: 28273 - DNA, 479 bp, Zea mays
  unsure at all n locations
  Clone ID: cC-zmle189070h11a1
ttttgcactgtaccgnaccagtattattattatttttgggctgtacaagaatggcgcatgtgtcaaattgtgttgctgagcctgagggaatgaacaaatgaatgacagaacaaacgcgtagctgcagaggagactgcaggcagagacagagcaggtgaacaatgggtgacgcctgcctggctgccaggaggacgctacggcgacctggagcggcagtcgatgggcatggcggtgccattgccggggtagaagaagaggaagcggcaggagatgcgcgtccagaactggagcgaggcgaagatgccgacctttcaggtggtgcgcgccttgccgaagaggtcgagcgggacgacgcccgcccggagcgcgccggccatgtactccatcccctcggggctgagctggcgccccgccgacacgacctggtaacggagcgggaaggagctgcggcgcggcacatcgaaggtgcccgcgcggag

SEQ ID NO: 28274 - DNA, 490 bp, Zea mays
  Clone ID: cC-zmle189070h12a1
tttcatttgcttttcgtctcctgtccatcccttgtgcgctaccgctcctctcccttggcaacgacgactggcgccgccgctgccagacttcgctgggcatctcgccggcgacgagctcccaccaggattagagaaggtgatggcgaggagtgacagctgcctggcgcgcgtgggtgccggagttgcgatcggtggcgcggtcggcggagccgtcggtgcttgttatggaacttttgaggcattcagatacaacatccctggattgctaaagatcagacatatcgggcaaactactgttggcagcgctgcaatttttgggcttttcttgggggctgggagcttgattcactgcggaaaatcctactagtttgtttccctcctttttctgaacacgactttgtcgatgtgcttcagaggaggattctagattttgagcgctaccctgagtggcttcagtgaaaactattcaacgcctgtacaatttaacagc

SEQ ID NO: 28275 - DNA, 526 bp, Zea mays
  Clone ID: cC-zmle189070h12d1
tccgcggacgcgtgggcggacgcgtgggctacttctagatcttgagctgtcgtcctttatttcttttttttttgctttgggggttttttttggacataacttgatcgctctttccaaccctgaggtattagctgttaaattggccaggccttgaatatttttcactgaagccactcagggtagcgctcaaaatctataatcctcctctgaagcacattgacaaaagtcttgtttaaaaaaaggggggaaacaaactaataggattttccgctgtgaatcaagctcccagcccccaagaaaagcccaaaaattgcagtgctgccaacagtagtttgcccgatatggttgatctttatcaattcagggatccttgttattgaatgcctcaaaaggtccataacaagcaccgacggttcccgcgaccgcgctcaccgatcgtaactttggtacccactcccgccaagcagatgtcaattctttgcattacctttctttaatctggggggagcttttctccggcaaaatg

SEQ ID NO: 28276 - DNA, 391 bp, Zea mays
  Clone ID: cC-zmle189071a01a1
ccgcttggtttttaatttatatgggatccatccctttaaaaccatcaaatttgatctccttccataatttacaaactggggctatgtcaacactccatttgcaagccgccttgataaattcattacctttacaaacaaaaaccccccctttgttacaaacttgtacacaggcttttaaaaccacaccattaacttctgcaccaagtgcatttccccaaggatgtcctaaaattcctccaccaaaatttaataccgaatcatctccaaaaattttggtcaaaacttgcatattccaaacatgaatacccccaaaagcccccgcgataacacctggcatggatacccaatcctgagtgaaaaaaaaaccccgagaaccaccctttttaataaa

SEQ ID NO: 28277 - DNA, 447 bp, Zea mays
  unsure at all n locations
  Clone ID: cC-zmle189071a02a1
atccacaacactaattcatataaacaggcccggattttcaaacattcgacaaacaaaccttattaggggtcctgtcacaacaaaagctccataaacaactcttacggcttgcattatccaacacaacgcttgagatacaagacttaaaatattgagacacgaactatataacagcaaaatacttcaggtgcttcaaagtcatgcttatatagaaccaaaaagctacagctttgattccatacttcacttgtttagctttctttggcaccacgcatatcgagctggggctgcgacaggcgctgttgcatctcatgggccctgagccagacttttctgccttctagcaatctttctatcacggcttgccttgctctatgcacgcttggccttaaactgatcaaaaagangaattctatctggccttcataaccttagacttgtggatac

SEQ ID NO: 28278 - DNA, 407 bp, Zea mays
  Clone ID: cC-zmle189071a03a1
atacgcgtgttttttttttttttttttgggttttttttttttttttttttttttttttttttttttttaaaaaaaaaaaaggggtttttactttttttttaaaaaggaaactcctttttttataaaaaaaaaaaaatgaataaaaaaaaaattgacctaaatttttaaaaagggcccaaattaaaaaattaataaaaaaaacccttgaaaaaaaaaaaaacctaaaatgcttaagccccttggggcctttccaaaaaaaaatttaaaagggcccggaataaaataaaaaaacgaaaaaaaaccccccgcaaaaaaaaaaatatttgggggtttttttaccgttattttccaaattcaaaaaaattttaattttaaaaggttaaaaaaaaaatttttaaaaagggggg

SEQ ID NO: 28279 - DNA, 295 bp, Zea mays
  Clone ID: cC-zmle189071a04a1
tttttttttttttttttttttttcggcgttttttttttttttttttttcccaaaaaattttttcccccctccaaaaaaaaacctttttttttcaaacaaaactgaaaagaaaaaacccaactgactgcctgacccccatccaaccaaaaagttcaaaaccacttttttcacctaaaataccttcaaacacaaaaacaattttaaccccccccgccttactaaaacccattcgttatcctttaacgaaggataaaacaaaccttggcccttccattccgaacaaacaatagccccc

SEQ ID NO: 28280 - DNA, 468 bp, Zea mays
  Clone ID: cC-zmle189071a06a1
gtagcccatcaaaatgccgggggattagaatggtgaacacaattcatgcctcaatgcgtgcgaaggtaatcacacgtgatgacccacacaaacagcatataacctcgagcagtttgactgacacaaagtttgcagtctcagatacattatatagctaagtaaagatagccatcaaactgctaaaagccagaagagacgattgtcaacggtataaatagagcatttaaatgcaagtcaaaaggcgtttctcaatgttttggtgagtttgagcaacgtgcttgcaaacagaaattattgaatggcatggccatatcccttctcaaaactatagaaccaaaattggacatagctggccagtatttagttgtcagccacttcaattagggtttgctcgtagtcagcaggggcctcaaatccatggaggttcatcacagttgcggctacattggcgagcccagggatttgaat

SEQ ID NO: 28281 - DNA, 535 bp, Zea mays
  Clone ID: cC-zmle189071a07a1
ctcttccccccctcttttatttctcccccctccccttctttttttccgcccgcttttttttttttttcccctctccccccccccttttttttttttttaaaaaaaaaaaaaaaccccttttattttttggggcccccccacccctaaaaaaaaaacttttttttttccccctcccccaaaaaaaaaataaaaaaccccccccccccaaaagggcctttttaaaaaaaacccctcctctttaaaaaaaaaatttcttaaaaagcccccaatttctccccaaaaaaaaaggcccccccttaaccccccccctctctaaaaaacccaaacccctttttttttttaaaaaaagaaaaggcctccccccaccctacttttaaaaaagaaaaaactttttctccccaaaaaaaacccaaaaacccccccccccccccctggtaaaaaaaaaaaaatctctggggcagcacacaacaaaccccccaaaaagctcactcccttctctccaaaaaaaaaaccccctcccacccccttttttttt

SEQ ID NO: 28282 - DNA, 572 bp, Zea mays
  unsure at all n locations
  Clone ID: cC-zmle189071a07d1
agcaacataggaagcacaatagcgnaccaacaanggcttctaatttattnngcctccttatgctccttggtctttgtgcaagtgctgctacggcgaccatcttcccacaatgctcacaagctcctatagcttcccttcttcccccgtacctctcaccaacggtgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaaacatcatggcacaacaactacaacaacttgtgctagcaaaccttgctgcctactctcagcaacagcagtttcttccattcaaccaactagctgcattgaactctgcttcttttttgcaacaacaacaactaccattcaaccagctatctgctgcctacccccagcaatttctttcattcaaccaactgacagcattgaactctcctgcttatttacagcagcaacaactactaccattcatccagctagctggtgtgagccct

SEQ ID NO: 28283 - DNA, 572 bp, Zea mays
  Clone ID: cC-zmle189071a08a1
ttttgactgtgttaactcttacaatctacatgttcagggtcgggaatgaacatacagcgatgaaaatacaacagatggtacatacaacaaggttgatttctcgagtggggatggggggtaggggtgggggcagcaaaaccccgtgaaaactcagttgagttacaaatgtgctaacaaaatgccgccaaaaagtacatagtagttgaagaatgtacaacttcatgaactatcaactccagatgaagctgaatttacaacttcaagccatggcaaaacagcacccatctgaagtatatgtcagatccaaactgaatgtgttattcatttcattgttttggacattttgacggccaaagagccttgttcacacaacatctcctatacagatgcactttgatccccaagactgtttgaagtatctgtcagcagtgacatgtgaaactttgaacactgagcttcattatcttggtaacaaaacatttgtgcagtggtcaccgaatttgatttgcaggattttgatttggagatgtttgcctcgactgcatggttactgacttttacacaaagattta

SEQ ID NO: 28284 - DNA, 558 bp, Zea mays
  unsure at all n locations
  Clone ID: cC-zmle189071a08d1
ctggcgcctggggcaagaaccnangggaccactttccttatgcatttcctaataaaactagcggggagggggttagctactattttaacgtttccatgctcaggaaaagggctcagcagaacaggtctgacgtgttggctgtggacagtgatgatgatgaactgcatggtgaacctctagctgagcgggtggaaggggatcctgcagttgagtcctctacacatgaacattctgtcagcaattctctgcccatggatgatgaccataaagagtttgaaggagcacagcttgatgaatctttgtgtgagaagtcagtatacaatgcagtcgagtgcagacatctaccaaatcagatgcctgcagattcaaatacggtgaacactgcacaagatgttcgtgaccaagataatggagctcagtgttcagagcttcacatgtcactgctgagcgatacttcaaacagtcttggggatcaaagtgcatctgtataggagatgctgcgtggacaaggctctttggccgtcgagatgtccaagacaatgaaatggataacacatt

SEQ ID NO: 28285 - DNA, 477 bp, Zea mays
  Clone ID: cC-zmle189071a09a1
ttttgattattttactcctatttattagcaccagctagtgtaggtatagccatgtctggagtctggactagcaagcaaccgagatcgatgatacagagatagattcatcggtttgcatgagcatgacttgttggcagccactatgttacaccaccatccaccaacgcatgtacaaagttctgcatcatcatcgcatcgcctccgcctgatgatgatagatcagtgcagcgccgtcaggacagtagacccttccaccaccttgaaagtggcaccgcagatctcttcttcgtcggcggggacagcggtgaccttgtgcttggggttctcgtagcacttgagccctccgagggcgttggagtagaagcagccttgcgggaacggcgcgagcgacttgccgcatgagcctttgagcatgtcgatgtcgtcggagaaggcgacgcaaccgtcggcggtgatccctcagaagagcggcaccct

SEQ ID NO: 28286 - DNA, 551 bp, Zea mays
  Clone ID: cC-zmle189071a09d1
gcaggttctgcttgctctggggggaaggagagagagagagtttttagtttgagatctagtagagaggctcagtggcggtgctcgaacgaagatgtcggcggtgtccatcggtcaggtggtggaggtgccggcggagctggtggcggcgggcagccggacgccgtcgcccaagacgaaggcgtcgcatctggtggggcgcttcctggccgcgtccgagccggccgtgtccgtgcagctcggcgaccacggtcacctcgcctactcccacaccaaccaggcgctcctccgccccaggtcgttcgcggccaaggacgaggtgttctgcctgttcgaaggggtgctggacaacctgtgtcgtctgagccagcagcacgggctgtcaagcaagggcgccaacgaggtgctcctcgtcatcgaggcctacaagacgctgcgcgaccgcgcgccctacccggtcagcttcatgctcgcccagctcaccggctcctacgccttcgtcctcttcgacaagtccaccaactccctgctagtcgcattcgacccccagggca

SEQ ID NO: 28287 - DNA, 130 bp, Zea mays
  Clone ID: cC-zmle189071a10d1
ggaaccccccatgaccaatgcaaccccccctgaagcggtgcattaaacccacagggtgtcgtttttactcgcaaggttaccactaccctttccattgccttaatgcccgccctttttgctaccttccctt

SEQ ID NO: 28288 - DNA, 476 bp, Zea mays
  Clone ID: cC-zmle189071a11d1
ccacgcgtgctcccgcgcgtccgcaacgaagtgcgagcgatttttgtttcacacgacacgaaccacctccaccagccatgtttcgctccacgcacccagcgcaaagcgatggcgtcgctcaccatgatggcgtccttcgccgccgtggcggtggccgcgccctctcgccgcggcaccttctccgtggtcaggtccgccaaggtcgaccgctgccagtagcccgccacgctagcagcaaccgatgccaggcccgccgtcgactgacgccgcgccgtcatgctcgcggctgctgcggcggccgtggcatccatcggcggcgccggcgccgtcatggcgggccccaagatcgggacccccgatgcgaataataagtacgcggtcatctgcgtcaccatgcccacccgcaatgtctgccacaactgagcacgcccgcgttgcatgcagctgcatggcccgggggtggtatataattaatg

SEQ ID NO: 28289 - DNA, 366 bp, Zea mays
  Clone ID: cC-zmle189071a12d1
gaagtggatttgacatgtcccggtcttgtaacgttaaacttgagcaactgtacctcactggaggtgctgaagcttgattgcccaagattgtccaatctccagcttctggcatgcatcatgttgcaagaggaggaattagaatctgcaatatccctttgtagtgcgttggagttccttaatgtgcattcttgtccaaagatcaatgctttggattttggcagactccgtttgggttgccccagtctgaagcgcatccagagcagcctcatctcataatacagaggctgctaccatataaaggagggcaattcatgcaataagccgctgttcagagttgaagaaaaaaacaaggggatgtttggtttt

SEQ ID NO: 28290 - DNA, 357 bp, Zea mays
  Clone ID: cC-zmle189071b01a1
cggtggcacattaaaatctggaaaggtaacttcttatttttggttgcccccatacctcatccaaaaaacctttttttttgaattccaactaataagcaatctaaaagagggcccccccaataatgtgtttttggtaggaggcttttggttttgtcaaaacaagttggacaaagggcaacaattgttgtatttttaaaagggttgcggggttacccccaaactgttggaaaaaaggcaacaactgttgctttttaaaaaaggaagcacggtttgctgcacctacctggctaaatggcactaatatttgctgttgcaaataaacaacggggttcagggcgcccaattggttaaatggaa

SEQ ID NO: 28291 - DNA, 518 bp, Zea mays
  Clone ID: cC-zmle189071b02a1
ataaaatcgcttggtttttttttaaatatatttttttttctttaaaaaaaaattataaaaaaaaaattttttaaaaataaattgaaaaaaaaaaaaaaaaaaacctgaaaaataatataaaaaaaaaaaaaaaaaaaaaaaaaatattaaaaaaaaaaaaataacaaaaaaaaaaaaaaaaaaaaaaatttaaaaaaaaaaaaaaaaaaaaaaaaaaattacaaaataaaatctaacaaacaaaaaaacaaacaaacaattaactcttaattggaaaccacaaaaaaaaaaaaaaacaaacatgtttaaaaacaatccttataaaaaaaaaaaaaaaaaactgcataaaaaaatgtaaaaacaaataaattaacctaaaaaaaatatacctcccaaaaaaaacaaaaaaaaaaaacgtaaaaaaaaaaaaaaaaacgtttagctaaataaaaaaaaaacccaaaaaaaatattgttttccttaactcttaaaaaaaaaaaacctattatcgttaaaaa

SEQ ID NO: 28292 - DNA, 189 bp, Zea mays
  Clone ID: cC-zmle189071b03a1
aacgggaggagaacaaatttaattcataaacaaaaagggcacacagatatttatccatacaaacatgctcatttggggaagacacaacttaccacataaagttgtttactttcttatttaaactgaaccaacatggggaaacgctacgaattaaacatcttattgacccatcgtccgacacttacttct

SEQ ID NO: 28293 - DNA, 511 bp, Zea mays
  Clone ID: cC-zmle189071b04a1
ttttcattttataattgtatattatttatgttatcgaagaaggtcttaatattggtatagattacacactctatttgttttacccttatttttgtttacgtacaaataaaattgctaaatcaaaaagaagaatttagcagataggtaatacgatacatttaaactacaatgctactacgtacataacaaacgaaccttcctttgtatacagaagatatacagcacacaatacatgggcaataatagtactcaagtagttgcatattggttctccgatcgaatagatctctttccaaagaagaaaggacgctctaaaactttccatgagcgtttattctgttccagctatttttttcttcaaggtctcaatgtcggcggccaactctttcctgctttccttaaagagaaggtagcggtacacgaaccagccggtgtagccgagcccaacgagctccaggatcttggggagcagcggcacggcgttgatggcgcccacgaccacggacgttag

SEQ ID NO: 28294 - DNA, 385 bp, Zea mays
  Clone ID: cC-zmle189071b05a1
gggacaaccaaccaaaacccttcaaaccaagtttttacctttgacaagtcttaccgggggttctaaaaaaaaaaaaaaaaaaacccccccaaaaaaaaaccaaccatccaacccaaaattttacattcggcccccggtccaaccccaaaaaaaaccgtaacctgaaaaacctttccccctttccccccagtaaaaacaacccgcaaacaaaaacccttttcatgtacaaaaacccccccccccccttctttttttcacaaggaaaaagaaaccccaacccactttttaaccccttgcccgggcccccccgttaacgccaaacccaaggggaccgccatttttaacaaaaactttaacacccaccaaaaggccaccggccaaggga

SEQ ID NO: 28295 - DNA, 528 bp, Zea mays
  Clone ID: cC-zmle189071b06a1
ctttttagtttattcacatcataataatatatagtatatagggggggagtgcatacataactatggcatatatatgcagtacgcacactacagtccagcaggccggcggtacgacggtaggcaaaggtgaattattgaaccagtctcgagctcgcttccaatcatagacggcagcaacacactatacacacattgccatagagttcgactgccagaagcatgtatactactagatataggagagacaaaacgatagcggatggcggatgatgcaactgcctctcgccctcgtctcgtctccagctagcagcgccaacacatttttttttcttgcggttctcaataagcaccagctgctgccagcatgagcagctcgtcgaggctccagatatccccggcgctcgccccatcctgtggagcaccatcagcctgcagaagaccaaggctgcccaccgacgcgtcgtctgacgagccgctgctgctctcgacgtaataaggaggcaacggcaacggctggtagtggtagct

SEQ ID NO: 28296 - DNA, 367 bp, Zea mays
  Clone ID: cC-zmle189071b08a1
aaaaaaagggggggggttttagtatatatatagtatcaaatcatatcatcgtggaccaattaatatatggttacagcaaaagcaatcggatcaaccaacatgcaggtagacacacgtacctacatgagcacaaagactgaccccaaacatgccgagagagatagcaaactgaaaaactttgtttttttttttttcacacacaccacacaatacctatgtatggcagccaactcggcctcgcttattattgttcaaccaccaccacaagctagatagataataatcatatccatggtcgtcgatcgatgtgatcaacaattgcaggggtcccacttgcagttgccaccgcaactgcaaccgtgggcgg

SEQ ID NO: 28297 - DNA, 578 bp, Zea mays
  unsure at all n locations
  Clone ID: cC-zmle189071b08d1
tgattttgaagagatcgagctnttttgcaccacaggtttggatttcttgaactgcggatcaagctggggctgggctcatctgaagtgcggcaagaactccctgacctgaggagacgagcaccgccggcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgtgtggcgtgtgtgagagagagagaaacagagttcttcagtttgctatctctctctgcatgtttggcgtcagtctttgtgctcatgtacgtacgtgtgtctacctgcatgttggttgatccgaatgcatttgctgtaaccatatattaattggtccacgatgatataatttgatactatatatatactaaaaccggacttctttttatat

SEQ ID NO: 28298 - DNA, 476 bp, Zea mays
  Clone ID: cC-zmle189071b09a1
gcaactcgaattccggtcttgtaccgatgggatttcgacacatgtccatggggaaaaaacaaactacacacctaagatgacgaaggtagggaggaagaaccggtatatattgctttatttacactcgggacggcatgctaaaaggctgaggaattgcccggacgtgcgcccggagttccgatgcaagcggccggcataagttggagatgtccacgagcgcgaccatggcgtacgctaccacggcatccccgtgcgcccgctgctgcactcacttgaggcggagcaaggcgtacacctggtgcttcggttgctgcaacacgggcacggcggcccgggcggtggctcccaagtaccgttcgagatcggttccgaacaaggacgcgaccccgcggaacgcgatgcacgcctgcggcaagaggggcgccaacggcatcgccaggtttaagggccacagcaggaacgcgaactggaactcc

SEQ ID NO: 28299 - DNA, 419 bp, Zea mays
  Clone ID: cC-zmle189071b09d1
agttgatcatggcgtcttggctcactaaccaccaccacttttctcttcaaacatataaccatgccatggggggcgcgtgttcacaaagatagataggtccaccacaagccctcatgcatcagtatccagggagggtggtggcccgtggtccacatacatgctatgccagatcacgttgcactcctctccgtgccggctttgggccctggttctcctgcaggcgttccatttcacgttcctgatgaggtccttcaaccttactctgacgctggcacgccacctgccgcaagcgtgcattgcgttccacggagtcgcgttcttgtacggatcctagctgcctcggaacactggctcctccaacccagccgccgtgcccgtgctgcatgcgccgaaccaccaccgttacgcctctcttcgcc

SEQ ID NO: 28300 - DNA, 415 bp, Zea mays
  Clone ID: cC-zmle189071b10d1
cacgcgtccttccaggcgtgcggacacaaataaatgggcttttcattatgatcaaggcatggagctgctctggtcttgagattttgaacccgatgcccgtatacattgtggctgcaacaccattaccgcggtgctgcgtggtggcttctgccttttcttcgcttcagcaataatgctcttagtgagctacgaggtgggcatgtgcatctatggcaagtagcagcctggtactggtctaagataaatctcacagcatttaggttaatcctatgttttgaggcagactcaactggagcctcctgctagcttttaagtgtgccgcattgcatggcatggacctgtggggtgtttagcactagcagtaccattttgcagctcgagagctaatggtgtatgtatgaattcaaggctattt

SEQ ID NO: 28301 - DNA, 322 bp, Zea mays
  Clone ID: cC-zmle189071b11d1
accatgctgctttgttcctcgcacctggggtgggtccctccccggagcctcccctgtcaccttggctggattcactgccaagctctccaggttcccgcataaggcggtatgcccaagctcatggccaggcgcccacccgcgggcgatcgcaggttcagcggtggatccgcgttggccctgtccaccacatccatatcccccaggcacgtgcgctctacaccgcgccacgacgaccgaaacgtctactcatacggcagcgttggaccgcgtgcttacgctcgctggtggcgctcatgtcacccactgtgacgtcggcttactg

SEQ ID NO: 28302 - DNA, 543 bp, Zea mays
  Clone ID: cC-zmle189071c01a1
tttttctttattttagctcagcacaaattattcactaagctggcagactgttgaaaacgtatgctgttgatacaaagctcccaagtccgatgtacatcacatgtaaaacatcctcagttccacaagctactactctatgtaccttgtaaaaataccactccgatcaccaatcacatcccatatttccatctcggtgaaacaagagtacctttgatgaagttttctgagacctaaagacctgatctatatgtaaaaaggaaagcacaaaatttcctatcgagcacaatgatgaagttttgattaattgtggtccaacttcgtatgtggataagccaatcctagagcacatcccatgcttaatactgctggagaaaaatggatttcgtactctagaaagcagtcagcaacctttacaaacttaaccacttgcaaagttgctgtcccgttgatccactattgctcaagagtcagcacccactggtcctcactattgtttccattcacaaggacagcaccatcagttgaatcctcagccttaacccg

SEQ ID NO: 28303 - DNA, 491 bp, Zea mays
  Clone ID: cC-zmle189071c02a1
ttttcttttcattaagttcaacgagacgtttcctttggcggcgggtaacacatcatcgacatgtttttaacaaaatcttctccgagatccataacaagcgcaataccaaaacagagatagcttaaatggtttccgatacaacaaattgacaactaaagcagtcactatgcggggtgcccggcgcctagaagcggagcttggtaaagaaccacctgttcttgccggtcttgaacctctcctcgaggcgcgccttggcggccttgcaggcctcgaccttcttgtcccgggtggagagcgcgtcgggcccgcccgaggcgacgtccttgaagtcgacgtcgagggtgtagcgggtgggcatgaggtgagtgaaattgacgagcttgatgaagcacttgacgcgggacttcttggccgtcttcttggcggagtccttgcggatcaccttcttggggtacttggccaggccggcgacaaggcaatgcccataggga

SEQ ID NO: 28304 - DNA, 406 bp, Zea mays
  Clone ID: cC-zmle189071c03a1
atataaacacacgtcgaggggcattattcaggacatctctcgatacaaaaaaaaagagataaaaattaaaaaaaaagatatatgcacacacacttattcaaggcctgatttgatcttgatacaagaacgccgaggaccgaccaacacagttcctacgtccatgcaaatatcggtagcccaaatcaaggcctggccggcacacagtaaacgaagacgaggctggaagaacagatggaacagcaaccgcgacggatcatttgtgggcgtgcttcttggcgtccttcttctcgtggtgctcgtggaaagcgaaaccggcggagcccacggcggcgacggcggccacctcctccttgacccggtgcccgtgctcgttctctgggtccttcttggccttgtgcttctcgtg

SEQ ID NO: 28305 - DNA, 418 bp, Zea mays
  Clone ID: cC-zmle189071c04a1
aatcatcacggtggggtttaagtttccccatgcttcaatgtctccctggggctgatgacttaagaagatggactcacttgctcgaaggctggaagagaatttatgggatcaaaacatgatcggaccttggaactaaaaactccaaccaagaaaacggaaaccaaatacacaacggggcttatgaactggacgagcaaaagcacatgccatagatgctgtattactgacatactgctctactcgccttgcaaaactacggcctttatcctgcgtctttcgctggcttaaagccatttgaagagaatgccaccatgggcggcgaaaaagggggcgaaaacaagggattcaaccgccataaacttgatgaggatgttgagggaagggccaaacgtgtccttgagaggatcttcaatggtgt

SEQ ID NO: 28306 - DNA, 168 bp, Zea mays
  Clone ID: cC-zmle189071c05a1
gaaaacccaggagagggtaattggaatgtcacttgctgcccttacatctttcactaacacattcccgccttgttgctcgtcgtctacccacaactttagaaagatacgtactccttacaagctaccccctcaccggccggtgaaccccctcttggccggacccgtggg

SEQ ID NO: 28307 - DNA, 335 bp, Zea mays
  Clone ID: cC-zmle189071c06a1
atcgaccgcgttttttttttttttccttccttttcggaaaccaaaaaaaccaaacttgcaaatctttcccttccaaaaagtgaaaattaaccgcttgatttttcttcccccccccaaaaaaccctaatagtaaaaacaaaaacacttttctttctttggcgccccccccaacggtctaaaataccttgcccaaaccctaaatcggggggcggataaaactaggcccctaatcccacaatttcatttaacccaccccccccaaaccgctattcccctccttggggccctccaccgggggccggggggggtcaaaaaaaaatcccttcaccaagctt

SEQ ID NO: 28308 - DNA, 533 bp, Zea mays
  unsure at all n locations
  Clone ID: cC-zmle189071c07a1
ttttcgtttgttccaaaaaatgcggattgaatttttgggcgaggggctagcaaagaacaaatcaacatatctcggacgaaacaaacaaaaaaacacgggcacacgcacaaataaggaatcctctgatcctaaagttgggtatgtacaactaaagttgcagattagagtagtaaccaagctgagttgcgtgtgatgaccctacacgcaatcgtctgatcctccacaccaccatttttttgtgtgtgtttctcatctttctgctcgtttattattttatagcatttattgcgatatgagattcggatcattcctggtggatatgaatactgggacaaccctgagcgatgaatcaacggccctgcaatcctcgctccaattgatccatgctttgtccctgcaatccttacatccaatcgatcgatctatggagtgccgctccagctttccgattgcaatcgatctatgggcatgctgacacgatcctncagtgtgacgctgggtggctcctccagtataccacccatngacaatga

SEQ ID NO: 28309 - DNA, 540 bp, Zea mays
  unsure at all n locations
  Clone ID: cC-zmle189071c07d1
caaatttcattttacaaacaaggaaagaggccgcacgggcnggggtagcattgatggagataccaccacagtataaagcaaccgtggaattagggattttgggtcgtcgctctttcaagtctcctgacagggttcctctgcctcccccttccggaagtcatggcgcttattcctactattcatctaaaggctttagcaaaccgagcacctaccctcagagttcttcatcctcatcaccctatcctcactatgaaactccacatacagccaccccagctgcgccttcagccacttatgacaaccaggtctgtcctatctgcctcgtgaaccccaaggacatggcgtttggttgtggacaccagacctgctgtgactgcggacagatcctggagtcgtgcccaatctgtcgcactcccatcaccacatggataaagctatactagcaagtagtggcttggatcattgtcaatgggtggtatactggaggagccacccagcgtcacactggaggatcgtgtcagcatgcccatagatcgattg

SEQ ID NO: 28310 - DNA, 418 bp, Zea mays
  Clone ID: cC-zmle189071c08a1
atccatcatcaaccaggcgggggttattgtatatatgatcgcagtcccacccaaatccggagactctgcagtgcaaaaattcaagggatgggttcaggttcaggttcaggttcaggaaccttgtattccttgaggtagggcatggtggtgagcgctttggtcatgagtggctccaccatttcccacgcccacacacgttcttcttcttctgtccccttggctttcttttcgatgacggtgataatgtcttcctcgacgctgaacctcatgctgccgatgatctcatccgcagctgggcccaggtcaacgcgttcaatctcgaagccgccatcttttgtagtgctactattgacacgaacgagtgttgggccactgaacaggttgtgcttgccagcaatggccttctggtacgcccccg

SEQ ID NO: 28311 - DNA, 233 bp, Zea mays
  Clone ID: cC-zmle189071c08d1
tacaggacccttaagccctggacataccgacggacgaaacaacttataccgaaaccttgcctgaccgtaccacctcgggtcatgggcgactcttcggcgaccgagccttgctgcagccacctgtcggcccacctctcggtaatagtagccacaaaatgcgctcaatgaaccttgcctgtcccactgcgataacatcgcgagagacagcgcagaagacatatacgcatcgaaaa

SEQ ID NO: 28312 - DNA, 261 bp, Zea mays
  Clone ID: cC-zmle189071c09a1
atataaatccattttattatgggaacgcttttattaaattttacaagtcttaaaacacccacttataaatctaaatttaaactacatataaaaaaaaaaaaaaaaaccaaacatcccaaaaacaaaaacacgacaccttattacatgccaaacaaacagaccccaacctaacacaaaaatatcatccactaaaacaacaccaacataaaaaaacaaaaaactaactcatcccttcacttatgaaggaaaacctaaataccc

SEQ ID NO: 28313 - DNA, 527 bp, Zea mays
  unsure at all n locations
  Clone ID: cC-zmle189071c09d1
ccacgcgtccgcccccagaccagcagcgtctgatctttgctttcaatttgctggaggatggccgcactctgngggactgcaacatccagaaggagagcacccttcaccttgttctccgcctcaggggtggtatgcacatctttgtgaagaccctgactggaaaaaccataaccctggaggttgagagctcggacaccatcgacaatgtgaaggcgaagatccaggacaaggagggcatccccccggaccagcagcgtctgatcttcgccggcaaacagctggaggatggccgcaccctagcagactacaacatccaaaaggagagcaccctccaccttgtgctccgtctccgtggtggtcagtaagtcatgggtcgcttaagctgccgatgtgcctgcgtcgtctggtgccctctccatatggaggttgtcgaagtatctgcctgtcgtgtcagtgttggtttaataatggaccggttgtgttgtgtgtgcgtactacccagaactatgacaaatcatgaataagtt

SEQ ID NO: 28314 - DNA, 74 bp, Zea mays
  Clone ID: cC-zmle189071c10d1
ctagtcaaaaaaaaaaaaaaaaagaaaaagttttaattaaaaaaaaaaaaaaaaaccaaaacaaaaaaaacaag

SEQ ID NO: 28315 - DNA, 52 bp, Zea mays
  Clone ID: cC-zmle189071c11d1
ccacgcgttctcccacgcgtccgcccactcgtccgactagttttagatttcg

SEQ ID NO: 28316 - DNA, 514 bp, Zea mays
  Clone ID: cC-zmle189071c12d1
ggaatcgccatctggttcggcagggcaccaccagcaagcgatttcaattttagggccgggcggaattctacgtggacctgtcccgcctccgtgtaattccaccgctgccggggcatctcttcggtcaccccgattcaagactgtaatcttgctgacggagagtacatcctcgtgccggagcaaggagctgctcaggaggtagccccacatccagcacccgatcctgcaccagaggacctgcctgccactgctttggaaggttctctggaggagatggttgctgggattacttggccgaccaccctgccaccgggttggactgtcgagtgggatcctgcctcggctgaggaggagcatgaggagtgatgggacaggctttcccatctctccgtttatttaccgttagttttattccgctgcacttcgaacaatgatggatactcttgcaaaaactccgatgatgatgatggtgatgtaataatttaacattatgacatgtatggctttatgcctt

SEQ ID NO: 28317 - DNA, 424 bp, Zea mays
  Clone ID: cC-zmle189071d01a1
ttgctccgtcgtcccactttgttagcccgtcgtacaagtccgggaccagcgacgggactgccacgaggaggagaaggccgggggtgcaagcgcaacgccgccgacgaggtcgagctgcgggaagaagctgccgtcgctgaggaacgggaaggcggacggcaggcacgcgtccgcgaccgacggcggcggggatgagggctcggcggagaccctgcgccgcttgccgccgccgccgccagtggcggcgcggcgcgaggcgccgccgacggggacgtcgcgcagcgtgcccccgtgcgtccagtagcggcggcacgcgcggcagaagtggcgcggctgcgccgtgctgtagttgttgtagtagcagaacttggtgttggtggagcggcagcgcgggcactcaagctgctgctgctgccgcggttgc

SEQ ID NO: 28318 - DNA, 555 bp, Zea mays
  Clone ID: cC-zmle189071d02a1
tttttcattacatccattcccacgctataatttttgtaggggggcaggatcctttcaattcatgagaagataggtcaacaaccgctacattacgacagccaccaccatgagcaaccggggctcttgatgggggcagaacgacgacgacagactacaaaccaatcactggggttcttcaatgtttcgacaagcctggcgaaccagaaacacaaggagtgggtgtgtttttttttcacgctttcttattgtgcccctatcgggcacggcgagcatccttatgcactagtcggctgtccagctctgctccacgatctcacggactttgcggttgtactcccgcttgttctcgctgaacagtcttgctgcttctgagtttgcagggagtttgggtttggatcacacagcagggactggatagaagttaaaattgcagcaacatcatatataggactccactggttctgtaggatatccaaacagatgcttccatcagcatatatatttggatgaaacatcctagaaacaaatcgaacagttggtggcttgtttgggtaa

SEQ ID NO: 28319 - DNA, 529 bp, Zea mays
  unsure at all n locations
  Clone ID: cC-zmle189071d03a1
tttttttttttttttttttttttttttttttttttttgggtggttttttttttttttttttttttttttttttttttttttttttttttttttttttangaaaaaaaaaaaaaaattccaaaaatttttttgggccttttccccaaaaaaaaaaaaaacaaatgttaaaaaaaccctttaaaaaaaaaaaaaaacccccccccccttattttggcaaaaaaaaaaacaaaaaaaaactcccccccaaaaaaaagggggggccttaaaaaaaatttaaaaaacccccccctaaaaaaaggggggggaaaaaaaaaccggggggaaaaaaaaaccaaaaaaagggggtttttttttcccccccgcccattaggactttttgggggcctttattttttttgggggccccagaaaaaaaaaaaccctgaaaaccaaaggccccccccccaaaaaattttttttaaattttgggggggggcccgccttccgggacttttttcccttggcttttaaaaaaaaaaaaacccccccg

SEQ ID NO: 28320 - DNA, 470 bp, Zea mays
  Clone ID: cC-zmle189071d04a1
aaccaaagtgattattacattgtttgggggtctcatgactacatatctccgagcataacatatccatgctctttatttcagaaactttacgagtaaaaaggcgactagcaagcaagcatcgccttgattatttaaaccctgtcgtctgcatcttgagaaagatgcaaatggagctccgaacggaaattatttattggcaaggttatttgcctaattaagtgattataagtcacgcatcatcatcatcagtacgacgggtgcagcggcgcttgcagaagttgacgatcttgtccttgcacacgaagaggccgtcggagatggacagggcgcacgccttgcaagccgggtggcagccggtcgtcgacgtgtccctgcactcgcatatcggcggctgcgacctggtgcaaatgccgcactggtcgcagcacggccaccgccttctgctggctttgagtttaacccctttcttc

SEQ ID NO: 28321 - DNA, 546 bp, Zea mays
  Clone ID: cC-zmle189071d05a1
cctctagagcggccgccccccccccccccccccctttcttccccccccccttaaaaccccccccctccccccggccccaaacacccccccccccccccccccccccccacccccccccacccccccacacccccactaacccacaaaaacaaaccaaaaacaaacaaaaaacaccacaaaaaccccccaccccccccccaaaacccaaaaaaaaaaaaaaaaacccccaccaccctttataacccaccccccacaaccaaaaaaaaaaaataaaaaaaaaaacaaaacaacaaaaacaaaaaaaaaaccccccccccaaaataaatactgagaaaaaaacccccccccctttaaaaaaaaaaacaccacaaaaaaaaacaaacaacccccacaaaaaaaaaaaaaccccccaaacccccacccctacaaaaaaaaaacacaaacatccttcctcaaaaaaaaaaccatccacacccaaaaactaccttgcaaaaaaaaaaaaacaaccccaaacaaaaacaaaaaacacaccccccccccccacac

SEQ ID NO: 28322 - DNA, 544 bp, Zea mays
  unsure at all n locations
  Clone ID: cC-zmle189071d06a1
cagcaccaagaagcaccattttttcggtaggattaacttagaataaagcctgacgggggtaacagcatccatcgatccgcagtccatgctgtttgatgcatgggtctgctgaaaccgaggatgaacacagcactaacaactgacacagagcgaccttgcaatcaaaaacacagatgggcaacaacaaacacgacacgaacgaagataaaccctctggactagggtaaacatcacggtagcgaacaggataacttggccgcgcgggccccaccgctcagttcctccagttcccgtcggagttgccgtagccgccgccacggttgccaccgccgtagccgccgccaccaccaccgtagccgccgccgccaccgtagccgccgccaccgccgtagccgccaccgtcatcacggcgcccgccaccgccgtagccgtcgccttcacggtcaccaccgtacccaccgtcgtcgtcttcacggtcgtncggggactgggcctcgttgacggtgatgttgcggccgttcagctccttgccgttcatgccctc

SEQ ID NO: 28323 - DNA, 467 bp, Zea mays
  Clone ID: cC-zmle189071d07a1
tttttcctccatcttttttttttttttttttttaaaacgcaagtttttttttttttaatttttttttatcaaataaatataaaaaaataaataaaataaatatttaaaataaataaaaataataatccaaaacaaaaaaaaaaaaggaaaaaaaataaaaaaaaaaaacactacaacaaaaattccttaataaaaataatattataaaaaaaaaaaaataactttaaaataaaaataaatacaaataaataaacacactgtaattttttcaaaaaaaaaaaaaaaaataaaaaatacttaaaaaagaaatcctaaaaaaaaaaaaaaaaaaaatttaaaaataaaaaataatattcttcctaaatcaaaaaaaaaaattacaaatataaaaaatatttataactttcaaatttacaaaaaaagtgaaataaataaataagccaaaaaatatatttactttaatttat

SEQ ID NO: 28324 - DNA, 363 bp, Zea mays
  unsure at all n locations
  Clone ID: cC-zmle189071d07d1
aaaaccaggccaagaatcgattagtagattgaaaagtagnctaattcaactttttttttcactgcatccacttaatttcaatggagtgggaatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaatttcccacaccctttcataataaaaaccttcaaattcccccaaaaaaaaaccttaaaatctcataaccctttcccaaataaatcaaatccccacaaaaccaacacccccttactttaaaaac

SEQ ID NO: 28325 - DNA, 429 bp, Zea mays
  Clone ID: cC-zmle189071d09a1
atatactcacttcattctaggaaggtaattcgttttaattaaatatacatccattaattataacttacatccattaatcaagctatgaatatgctctttcgaacgtgggcgaactataggaatattttttatggcatccgttgctaagcacgggcaatccattttttgtacattttgcacaacagtgacgtctaacatgacatgtacgagcagaaaaaagaactgacaaatgcatttttctttggcgaggcacatttttcagctcgcgcgctcgtctttcctctgtttgatcagcttgaagaggctgggcatcaccttcttcttcctcttgatggggaacgagggcgttcgcgggtttcggatccccgccgacgaagacacggacgaccgccgcgcccttgttcttcgcatcgtcgccgacaccctggt

SEQ ID NO: 28326 - DNA, 385 bp, Zea mays
  Clone ID: cC-zmle189071d09d1
ccacgcgtcctctagaacgcgaacgccgagatcgcagcgactcttgctctgatgcagcagtctgtgaaggagggggagggggcgaatacagccgaggccgcggcgatgaagaagctcaaggccgccgtggaaggcacaatgcaggcgagggcgtcacggcggtcggggaccataaccatctcgcggttcgagtacgagtacctgagcgggcgcgcggcgctggtccgcgtggtggccgacaagaaggtgtccgcggcgcatgcgtgggtgcaggcgctcaaggccggcgagaaggagctggcggcgcgcgcggaggccacggagcgcgtgacagccgagctgcgcgccagggaggccgaggcggcggctgatgcggagagcgcgg

SEQ ID NO: 28327 - DNA, 574 bp, Zea mays
  Clone ID: cC-zmle189071d10d1
gaagggggcgggaagatgatgatgacgcgggcaccgatggttccgatttagggcggccgaggcgggcgccaggggcaggtgtccgatgcggacatccggcagctctgcgtagagggcaagcgggtgctcctctcccagcccaatctcctccgaatccacgccccagtcaagatctgcggtgatatccatggccagtttgtcgaccttctgagattattcgatttgggtggttatcctccagcttcaacttacgtattcctcggagactatgtcgatagaggcaaacagagcctggagactatatgcttgctgctggcgtacaaaatccggtaccccgaaaatattttcctgttgaggggtaaccacgaggatgcaaagatcaacagagtctatggtttttatgacgaatgtaagaggaggttcaatgttcggctgtggaagatattctctgattgcttcaactgcctgcccatcgcagcgctcatcgatgacaagatactgtgcatgcatggtggcctctcgcccgaattgactagtttggaccagataaaagatattgagcgacctgctgaga

SEQ ID NO: 28328 - DNA, 121 bp, Zea mays
  Clone ID: cC-zmle189071d12d1
caaaaaaaaaaaaaaaaaaaaaaaaaaaaaaaaaaaaaaaaaaataaaaaagggcgaccaaacaaaaaaaaaccagggaaacgggacacaaacaaacaacgacaaaacccccccacagggc

SEQ ID NO: 28329 - DNA, 413 bp, Zea mays
  unsure at all n locations
  Clone ID: cC-zmle189071e01a1
gctcagcggggcataccaatccatttggaaaattgtgcacaatcttgtcccctttgaagccacaacaacactacctatatattggactctctaaccacgagcgagcgaaacaacgctttcgacggacgcagcataattcatttggcgaaaattttggcgaaaaagttcgtcggtttggggttctccaggcacccaacgtgagcgtatcttcctagcttgtcaacctgcctcggctccccccttgtgtccttcttgcacatcttgcaggtcttgttgacccaaccctccttcacgtattgcccgtcgacttcaacatatgacttgaagaaatcctggtaggtgccaccaatttttcgcctaaatgctccggactggtccctcgtcatcctccctccacctttggnggactccct

SEQ ID NO: 28330 - DNA, 392 bp, Zea mays
  Clone ID: cC-zmle189071e02a1
ttctctttttttttttttttttttttttaaaaagggggggcttgtttactcaaatcatgggcaggtctgacataccttatcctaatcgagaggcaatttacaaaacccccaggctccagccgaaagtattctgtgttcacaggcccaagtcctactttagcagctgaaaaaactaaacgaaaagattcgagaaactcacattaatctaaaattgcaacactatcaacgaagatgtttagcattattccaccaccataactcaagacgatgatgggggaccttgttctaggtctaaatcgtccaccatcttctgtataaattccatatcacctgttgctgataggggtgtgaatccccaagctgtttgcattggacgcgtgggcggacccctg

SEQ ID NO: 28331 - DNA, 553 bp, Zea mays
  Clone ID: cC-zmle189071e03a1
ttttctttctttttctctctcttttttttaaaacggagggtttttttttttaattcccacctttccccccctttaaaccaccaccccccatagcaaggcccaaaaaaatcaaacccaaaacactaaaaaaaacccaacccccaaaaaaaaaaaatcccaaaacaatgccaaaaaacaaaccaaccccaatcccaaaaaaaaaaacaaccccttccaaaaaacaaaaaaaccaaacatccaaaacctaaacctaaaaaccctcattccccaaaaaaaaacccccaccccaaaaaaatgaaaaaccccccccccccccttcaaaaagaaaaaaccaaaatcccccccaagattttaaaaatatcaaccccccagaaaggcaccacttcaataatcttaacccgcctcccttttttttttttcaccaacccgccaaaaaaaaaattccacaacaccccaaacccccttaaaaaaaaaaaaaaacaacccatctaacatttcccctacacaaaaaaaaaacaaaccacttctaaaaaaacaaaaaaacaaaaaaaca

SEQ ID NO: 28332 - DNA, 279 bp, Zea mays
  Clone ID: cC-zmle189071e04a1
agtaaatgtccatcgcagttcggttagctgacaaacgacccaaacaatacaatagcttctgcttaatattgcagaacactggagtagcgagttcaccacgagagcagcaagacacaaacgagaagaaaatagcggcagagcacagggctcgcaatcatatacggccctttatttaaccgaccacggactcacgggaggacgaggcacccttcagcgacgggcagaggggtaaccttgacaggaacataggccgtagggccctcaccgtcgctggcttcc

SEQ ID NO: 28333 - DNA, 496 bp, Zea mays
  Clone ID: cC-zmle189071e05a1
tttatttgtttttttttttttttttttccttgggaggaacttaaaataaagcctgacgggggtaacagcatccatcgatccgcagtccatgctgtttgatgcatgggtctgctgaaaccgaggatgaacacagcactaacaactgacacagagcgaccttgcaatcaaaaacacagatgggcaacaacaaacacgacacgaacgaagataaaccctttggactagggtaaacatcacggtagcgaacaggataacttggccgcgcgggccccaccgttcagttcctccagttcccgtcggagttgccgtagccgccgccacggttgccaccgccgtagccgccgccaccaccaccgtagccgccgccgccaccgtagccgccgccaccgccgtagccgccaccgccatcacggggcccgccaccgccgtagccgtcgtcttcacggtcaccaccgtacccaccgccgtcgtcttcatcggtcgtcggggactgggc

SEQ ID NO: 28334 - DNA, 448 bp, Zea mays
  Clone ID: cC-zmle189071e06a1
tttttcttttttttttttttttttttttttttcgctcgttttttttggtttttttgacccccaaaaacctatttgccattatgttttataatttggggcaaaacttaatccaacatgttatacaggacaggaacccctttgacaaaaaccaacacattccctatttttcaagggtttttttttttacctcatcaaatagggaaaacaatataattcattcatgctatattggaggcaaaaaccaacttccgacaacacctgggaatttatgcctaccaccaaaggccgggggagcaaaaacccaaatgaaccaacccgcttacctttaaaactgaccactttcatgcaacaccactggtgatgcaacacaaggacttaccctgtttactgggactgacatgacaaaaaccttaaaccaaaccaatgggacccaaccaaggttttggag

SEQ ID NO: 28335 - DNA, 367 bp, Zea mays
  Clone ID: cC-zmle189071e07a1
cgggacaaaaaaaacttttttttttttttttacccaaaaatatccttcccctaaaacaccaaaaaaattttttagtcttaagggacctttttaaaggcccccaattttggacattcataaaaggcaaaactccccaaaaagccccaattatgacaaccctttttgaaaaaaaaaatcccggatgaatatatgccccctgtttctggaacaaaagcccagggttttcgggggaaaaaagctcctttagcttttaaaaccctttggggatctccaaaaaaaaagggcttaaactgatatccccaaaccaacaaatctaaaccaaattctttaaaccaaggggttgaattttacgggaaaacggaccaag

SEQ ID NO: 28336 - DNA, 563 bp, Zea mays
  Clone ID: cC-zmle189071e07d1
gtgcgcggacgcgtgggttaaaaccaagaaacattcttctggttaattttgctgccaaccacttgaaggttggggacttgtgccttatcaagatcatcaaagctcagcatgcgaatgatgtatacaagatgactggagagacaggaagctatcggtacatggcccctgaagttttcaagcaccggaaatatgacaagaaagttgatatcttctcttttgccatgattctatatgagatgctggaaggtgattcacccttctccaactacgaaccttatgaggctgctaagtacgtggcagatgggcatcgtccggttttccgtaaaaatcataccactgagttgaaggatttggttgagctatgttggtctggggatatcagtctgagaccatctttcttggagatcctcaagaggcttgagaagctcaaggagcattattcacacgagaaccactggcatttgttccagtagcagtgcgcatataatcatacagtatatccttttactatgactgttgtcatgattggggctttctcgggagatctgacattgatgaatgta

SEQ ID NO: 28337 - DNA, 458 bp, Zea mays
  Clone ID: cC-zmle189071e08a1
cacgttctcatagcattagcaggaattttaaaacataacaggtgaaacacgaatcaagcagaggcgccatggggttcacacatccccacctaaaccgctaaattaaactgcgagcgatacatgataaactaagaccaccactcagatcaccaccattttattcacatccaaaggaacggacgcagggggagtcgacgattacggagggagggcggccgaacagaccacatcagagagatctaggagagctgtccgcagtcagcgaccttgaccaccttggaggtggagccgttgcgggtgcccaccttctcgatggccttgacgacgtccatgccctcgacgacctggccgaagacgacgtgcttgccgtcgagccaaggggtcgcgacggtgcaaatgaagaactgggagccgttggtgttgggcccggcgttggccatggaaagcacaccgggggc

SEQ ID NO: 28338 - DNA, 591 bp, Zea mays
  unsure at all n locations
  Clone ID: cC-zmle189071e08d1
cacccgggcgactcgtagagagaaggaaaaatatccccaaaccctttctcctttatctcgatggcgaaccctcgcgtgggcttggggatgaccgtcggcggcgccccggcgggccgcatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcgaccccttggctcgacggcaagcacgtcgtcttcggccaggtcgtcgagggcatggacgtcgtcaaggccatcgagaaggtgggcacccgcaacggctccacctncaggtggtcaaggtcgctgactgcggacagctctcctagatctctctgatct

SEQ ID NO: 28339 - DNA, 272 bp, Zea mays
  Clone ID: cC-zmle189071e09a1
ctcatctataacttttatttcctttttcgacaaacccaccacggggggagatataaatgcattcacttaaaaatacaaccataaattataacatacatccactaatatacctatgaatatgcccttatcaacaggtgcaaacatataacaaaaatgtttatcacatacgccaatgatcacgcctaatccaaaatttctacatacagaacgacacatacgttaaacatgacatggaccagcagaaaaacaaactgacgaaggcactttatttt

SEQ ID NO: 28340 - DNA, 476 bp, Zea mays
  unsure at all n locations
  Clone ID: cC-zmle189071e09d1
ccgggcggccacgcgtgcgcgagaacncgaacgccaagaacacattaaccttggcacggaagcagaaggctgggagggagggggaggctgagaacacggacgaggccacaacaacgaaaaagctcaaggccgccggggaaggcacaaagcaggcgagggccgcacggaaggcggggaccagaaccaactcgagggtcgagtacgagtacctgagcgggcgcgcggcgctggaccacgaggcggccgacaagaaggtgaacgcggcgcaggcaagggcgcaggcactcaaggccgccgagaaggagccggcggcgcgcgcggaagccacagagcgcgagacagccgagctgcgcaccagagaggccgaggcgggcgccgaggccgagagcgcggccggcgaacagaaggcccctgagcaggaaccatacgacctgaacgccgcggcggaacgggacgggctgctgggcgcgtacccg

SEQ ID NO: 28341 - DNA, 557 bp, Zea mays
  Clone ID: cC-zmle189071e10d1
cacccgggcgggggcggcaggtagaggctattttcttggcggctggtttgatttatagccacgccgccgggtcgaggtggggggtgtcctgtgatggcggcgcgcagcccatgaggagctccaggaagcccaagtattccaagtttactcagcaggagcttccagcttgcaagccgattcttactccaaaatgggttatttcagtattcgttcttgttggcgtgatttttgtcccgattggtattgtttcgctgcaagcttcacgacaggttgtcgagatcgttgatcggtatgatgatgcatgtgtccctgctggtgtgactgacaagcttgcttacatccggaatgatagtataccaaaaagctgcacaaggaatctgacgattacaaaggatatgaagcagccgatttttgtgtattatcagctggatgacttttaccagaatcataggaggtatgtcaagagtcgtaatgatgcacagctaagagataaaagtaaagcgactgactttaccaattgtgatcctgaggccaaaacggtagatggaaaaccaatt

SEQ ID NO: 28342 - DNA, 399 bp, Zea mays
  unsure at all n locations
  Clone ID: cC-zmle189071e11d1
cacccggccgcccacgcgtccgcggacgcgcgggaaaagggcggcgttggattttggtaaggcttggctttgtcgagagaccgggtgagatggggtgataaggacggtggggctcctatgttgaagtcgtggtcatggacaatttgtgactttttctcctttatgccatgttttggaatttttgtagctgcctaggccttgtggcaatgtgctgctgtgggggttcattagcgtgaagaggaagacgctgctggcgctgagtctttttctctttattagtattttgcttaaaactatgtatgaccgaatggtggtatttatttgtgtcatccttgactcttattctgctgcaaccagatgtatcgtgccatgtctgcaccaaancaaaaaaattaaccc

SEQ ID NO: 28343 - DNA, 403 bp, Zea mays
  Clone ID: cC-zmle189071e12d1
cacccggccggccacgcgagcacccgacactgcccgacctcaaccttccgtttaccgcccaccacgcccacttcaccagggccggggaaacacgccacccaccaagacaccatcgaggctcaatacaacaaaacgaaccgaccgagcccaggagtggaccgcgggacaacgccttccgccgaaaaagtccaacagatcctgctcgacacaggccacaccgtccatgcagggccaagcgaagcacaagcccaacatgaacgacgggccaccaccacctacacatgactccacaccaatagcaccaaagagaggcggcacccacacctgccgccccatcgcgcaccaagccaacaacgccgacgaggggaacctcgccgggggggaccacaacacgacgctcaag

SEQ ID NO: 28344 - DNA, 436 bp, Zea mays
  Clone ID: cC-zmle189071f01a1
ctggggctgggcgtctttcttttgacgcacccggactgtggcggtgcgggcgctcgtacataaacaccagcatggacgcttcttatatggcacactccacgtgctttctaggcggacacacgcgcacggcgctgtacttggagtaacccctgaattggaaaccacatggcggccagagaagagtcagattccttggcgcggataggcgtacacgacggtaaagaagatccgagcgcccaacggtctagctatgccgacaggtccgtatgaggagattggattttacatacaacttaccgtgcttagggggagcccttagatgggcttctggccgtacttccttcactagtactcgtgcggttggatatccgctatcttagcgcttaaccacgtactatgatggtccttttacacggtttttactgtcaatctaaaa

SEQ ID NO: 28345 - DNA, 273 bp, Zea mays
  Clone ID: cC-zmle189071f02a1
tttttctttggaaataaattctttattacaaaaggggggcaagttacaacatttacaagttatagcaagattacaatatatatcatcggagttggttacaaaaagaaagtgattcaaaagaattacaatttaaaatgtataaaatatttataggttttaaaatacatgctagcttaagtgacaatcctcaataaagaagctaaagatgggatatacttatataagaaggccgagcccaccggcacttagcccacgcgtccgcccacgcgtccg

SEQ ID NO: 28346 - DNA, 444 bp, Zea mays
  Clone ID: cC-zmle189071f03a1
ttccctcactttacaatatttttttttttattccccgccaaaaaattttaaataattttctcatccccccccaactataaatattcatacttacaaaaaaaacactccaaaaaaacaaccaatctcacctaacaaaccaaaaacataacaacataaaaaaaaacaacaaatctactaatagaaaattaacttaaaaactccaataccaaaaaaaaaccaaaaccccaaccaatttataaaataaaaaaaacccaaaccataaaaacaaaaacaaaaacttttaaaaacaaaccctaccctaaaaaaaaacgcaaactttccttataactattccaaataataaaacaaatcaccccaaacaacaataaaaatccccaaataaaaaaaatatctacaccttaaaacctcccaaaaaaaaaaaaaaattttaaaaacctactacac

SEQ ID NO: 28347 - DNA, 565 bp, Zea mays
  unsure at all n locations
  Clone ID: cC-zmle189071f04a1
ccgcgagcgaggatacggcgtccacggcggcgaggacgcgcgcggggggcgtgagctgcccgcggggctgctcgaacgggagccaagggagcggcggaggggccggggggtcgcggtccgcgagcgccgcgcgcgcgcgcgtccgcccggacggcgaggtggaggagaggaggaggtggagcgcgaggctggcgaggagacggcgcctgcggaggccgtcgagccgcgcggcgatggcgttgcaggcgtcgaggagcgcgacgccggcgtcgaggtgggcggcgacggcggcgccctcgccggagcaggcgagcgcgggccccgcctcggcgagcgtgagcgcgaggaggtcggccacccgcacgagcgccgcgagcggggaggccggcagcggcagcaggccccggaggcgcgcggccagcgccgtgccgaaccggggcgcctcccccttctgctgctggcgtcggctgggctggaatggtggtggtggaagggcagcancgagctgtacttgttcgcgaagaacatctgggctgggatgctgggggctccgacgcgtgggtcg

SEQ ID NO: 28348 - DNA, 533 bp, Zea mays
  Clone ID: cC-zmle189071f05a1
gcacaaaactcttgctgggacgatttcacatacatactgactctccatgtataaaaattatcaatatgtgctcaaaatcctaaactattttgcgactgcatacataactttacatctttgaggtgctttagttctacttgctatgagaaacacagaaactggcggtggacgagcagaggagaaacgtaattagtaagtatgatgcgcccgcggctcacccatgttggcaggatgatattcctcttgcgactgccatctcttttccacccttgtggcaagctatcagagttgggtggagatgccactgattcatgccaggcgccctgttctccacatcagaatctgtactcgatgccaggcaactccggttggctccaaacgcagctatgctgaaattataatggcctgctaagaggtgcaagaaatcaagttatgtttgatgcattgtgaagatggtaggcaggtgtaacttcagagtacagcaaaaagaaccaacgcatagtagcacacgactacacgacccctgaacataa

SEQ ID NO: 28349 - DNA, 478 bp, Zea mays
  Clone ID: cC-zmle189071f06a1
gattaagcaaaacaagggggcggggacaaatatgcgtaactcaacattggaaaaatagaagcgcgcacacacagaaatagtagagatcgagagagagagagacgatggcagggcaactcgacgcttacacgaacagtgctcaaatgaaacaaaagcagtacgtgtacgcgcgtactcaaattacacacaacgacgacccacagagatagagatggatgggcatgaatgattatgcgccggtgagctcctcctccttgtgcgtctcgatgacgacgtcagaggtggggtaggcgtggcaggtgagcacccagccggcggcgatctggccgtcgtcgaggtagctctggtcggactggtccacggagccggagacgaccttgccggcgcaagaggagcaggaccccgcgcggcaagagtagggcaggtcgatgccgtcctcctcggcctggtccaggatgtacacggtcgtcgggcacct

SEQ ID NO: 28350 - DNA, 545 bp, Zea mays
  Clone ID: cC-zmle189071f07a1
cagcaccaagaagcaccattttttcgttgagattaacttagaataaagcctgacgggggtaacagcatccatcgatccgcagtccatgctgtttgatgcatgggtctgctgaaaccgaggatgaacacagcactaacaactgacacagagcgaccttgcaatcaaaaacacagatgggcaacaacaaacacgacacgaacgaagataaaccctctggactagggtaaacatcacggtagcgaacaggataacttggccgcgcgggccccaccgctcagttcctccagttcccgtcggagttgccgtagccgccgccacggttgccaccgccgtagccgccgccaccaccaccgtagccgccgccgccaccgtagccgccgccaccgccgtagccgccaccgtcatcacggcgcccgccaccgccgtagccgtcgccttcacggtcaccaccgtacccaccgtcgtcgtcttcacggtcgttcggggactgggcctcgttgacggtgatgttgcggccgttcagctcttgccgtcatgccctcgat

SEQ ID NO: 28351 - DNA, 548 bp, Zea mays
  Clone ID: cC-zmle189071f07d1
ggcgaggtgggttggcttctcctccccctccggttcgggttcttgtttttgaggttctccggggttcgggttgggggggtagcggatcgagatggcggcgtccgatgttgagtaccgctgcttcgtcggcggcctcgcctgggccacggacgaccactccctccacaacgccttcagcacctacggcgaggtcctcgagtccaagatcatcctccatcgggagacgcagaggtcccgcggcttcggcttcgtcaccttctccacggaggaggcgatgctgaacgccatcgagggcatgaacggcaaggagctggacggccgcatcatcaccgtcaacgaggcccagtcccgcggcggccgtggaggcggcggccgtgggtactgtggtggccgttgaggcggcggctacggcggtggcgggcgccgtgatggcggtggcggctaccgcggtggcggcggctaccgtggcggcggcggctactgtggtggtggcggcggctaccgcggtggcaaccgtggcggcggctacggcaacttcgaccggaact

SEQ ID NO: 28352 - DNA, 431 bp, Zea mays
  Clone ID: cC-zmle189071f08a1
aaatgacgcggggggacaccccccaaacccggacccgtacctccaggcctaccacctttccctatagtaacaagacttagagccaggcacaatgatgcacaaacctgcaccaagggaaaaacaggtaaccggttaaaaatccacacaacaaacaaacctaaaacataaaccctaaaacctggagggcccaaagacccaaccaacaaacattaatggcgtaacgcccactgccccctttccaaatggaaaaccgggaaacccatattcattaatgaaaaaaccaacaccccaagaaaggcggaatgggaaaaaggccccagggggaactgcccctataacattgaaacagaaaaaaagtgaatgcccaacaacccctgaccctgaaacacatgcaaaaaagggaacaccctgaatagccccaacatgccaaa

SEQ ID NO: 28353 - DNA, 491 bp, Zea mays
  Clone ID: cC-zmle189071f08d1
cacccgtccgttcaaaaaaaaaaaagaaaaaaaaaaaaaaaaaaaatttttattttaaaaaaaaaaaaaggccaaccggggctgggttttcattcttacatactcctgcttccaacctcataactcttttatattgtcacctaatttcatttcactgaccgtctttttacaactttcagactgcgaaaaccctgacttttcccaacttattagccttttagcacttccccttttttccatttggctttttagcgaattggccaatacccatcgccctttccacctttttcacatcctgaatggctaatgggacactccctgtagcgatgcattaagcccttaggctttgggggttacgcgctactttacctttacactttccaacttccttatgccctagcccttaggctttttcctttctttttttgccactttggtccggctttcccctttaagctttaaatctgaagttcccttttggtttccatttt

SEQ ID NO: 28354 - DNA, 557 bp, Zea mays
  unsure at all n locations
  Clone ID: cC-zmle189071f09a1
tttgattctacagaaaagatttggaacgacagggtggagtacttggtgcgggtatcttcaaaagttcaaaaccagacgagaacaagcgcgccatcagaaaactcaaagatttctcacaaggctatcgacttagtgctaacaaactcaaaaacaccaaaaaaaatgatttgacagttgacacagatcagtacccaggcagatctactcgtcgtcctccacaaccttggtacccagacccttcaggccttctggggggatctcagcaacggtaacaagagagtaaagctcttccttggcgtcttcctcatcgttcctcttgcgtgcgatcctgacacggacacgcctcggcacactccggataccactgctccagatgtgcttgttgagtttcacatcaatcctgatgtcagtggtgcccattgccttctgtgcaaacttcctgatttcctttatagcattgggggctttcttcttngaggtgcatccgtggaggcgcttgtgtaggttgatggtgtactcgcgggtaaccaccttcgtcttcctgaccctctgggcgc

SEQ ID NO: 28355 - DNA, 552 bp, Zea mays
  Clone ID: cC-zmle189071f09d1
gtgcgggagcgcgatggcggagaagaagcagcgcccaggatgttcctttaaggacgaggtggttacccgcgaggacagggtcaacctacacaagcgcctccacggattcaccttcaagaagaaagcccccaatgctataaaggaaatcaggaagtttgcacagaaggcaatgggcaccactgacatcaggattgatgtgaaactcaacaagcacatctggagcagtggtatccggagtgtgccgaggcgtgtccgtgtcaggatcgcacgcaagaggaacgatgaggaagacgccaaggaagagctttactctcttgttaccgttgctgacatccccccagaaggcctgaagggtctgggtaccaaggttgtggaggacgacgagtacatctgcctgggtactgatctgtgtcaactgtcaaatcattttttttggtgtttttgagtttgttagcactaagtcgatagccttgtgagaaatctttgagttttctgatggcgcgcttgttcttcgctggttttgaacttttgaagatacccgcaccaagtact

SEQ ID NO: 28356 - DNA, 436 bp, Zea mays
  Clone ID: cC-zmle189071f10d1
gtgcgagggcatgaacgcctacagcggcctcaaggggctcatcaaggttaacatgctcggggtgcgcaagacgggcgagtactccttcgccaaggtcgtggcgtcgctcatccccgcgggcaggaagcggcgcggcggcgcgttcggcgcccagatgaacgacgccgccgagatcttcaggatcgccgccaccatgaacggcctcgtgctcgtcggcgtcgccgtcgggttcgtgctgctccgggtggaggccgccgtcgaggagtccgagtagggtgcgtgggcctgccactgtcggctgtcgccccgggccgcaatctgcttcagaaaccgtgatatatatataaccagatgtacgctttcgaatcaatttactttggtatgtatccatgacaattggtgaatactgtggaaatatgcttttgggaaacaaaaa

SEQ ID NO: 28357 - DNA, 484 bp, Zea mays
  Clone ID: cC-zmle189071f11d1
gccaaccacccgtgcgcggacgcgtgggcggacgcgtgggcggacgcgtggtctggtctccccaggacggcgccaggtcgccgtggtacgtgaatacccaggcggtgcacgtgtacggcatgccttgtgtgtccaacaacgataacaacaactacgacgacaagaggacgaagagaggcgacgggttcttcggcccggtgttccatgccgtcggccacttcttagatcgaaagttcggcttcgacggcagggactgatgactgatccatatgtagacatggccgacgtgccatctatatatgatcatatatgtttaatttgcttcaccctagccgtctccacatgtagacatctatatatgatcatatatgtttaactagctgaatgcccgtgcgttgcaacggaaatatataataccagtatactgcgataacttatatacaaaatgtgtgttatattgttatgagaaaatgtttcataatcc

SEQ ID NO: 28358 - DNA, 574 bp, Zea mays
  Clone ID: cC-zmle189071f12d1
cacccgtgcgcccacgcgtgcgctccgcccagaaaaacgagagagagttaatttaacttcaagacgttagcaggttagggatcagcagtcgccaaccacggctgctgcgcctccactgaccagcagcccagaccggtgacggagctcacagcctgacgggcaagccgtagttgggaaaagaccggatgacgccatcgcggccggcggtcacgatgaccgtgctccacgcggcggatagcatggagaggcagtcgtccagccgcgggctgctttccacaggcttcgctgcagaaaggagcttctcctcgggccacgtcgccgaccccttgctgctgctgccgccgccgtccacgaacggtcacggcccgggggccgactggcgcatgatgggcgcgctggcggatttctcggccacacaggcaggtttcgcgctcgcgtgcccgtcttgttgccgcactcccggccatggcactgcggtcgtcacgttcttggagaagaacagctcgcacgagtggactggctttgcgtcgtctctcgagttggccaagtcccagatgtataccttggaatcttt

SEQ ID NO: 28359 - DNA, 490 bp, Zea mays
  Clone ID: cC-zmle189071g02a1
ttttttctctttttttttttttttaaatttttttggttgtttttattaattttttttaataattacccttttttaaattaaaaaaaaatttaaaaaaaaaataaaaatttaaaaaataaaaataaaaaaaataaacaaataacaaaaaattaaaaaaaaaaaaattaaaaaataaataaaaatcttttaataaaaaaaaaaaaaaaaaaaaacaaaaaaaaaaaaaaaagaaaaacatttctaaaaaaaaacaaaaaaaaaaaaaattttaaacaccacaaaaaaaaaaaaagataaaaaaaaataaaacacccttaacgaacaaaaaacatggaaccaaaaacaataatctttaaaaaaaaaccccttcacatttaaatactaaaccaaaaaaaaaaaccgacaaaaaaacccaataccattaaaaaaaaaaaaaggagaaaaaacttaaaaaaacataaaaaaaaaatttttaaaaaaaataatttac

SEQ ID NO: 28360 - DNA, 556 bp, Zea mays
  unsure at all n locations
  Clone ID: cC-zmle189071g03a1
tttttatcttaactttctgccattgatcacgagggggaaatggagacacgatcgattcagaggacccaacaagggaccaaaaacgtatatgtgcaacctcgatctgcctacactgattggtatggtacacaaatcaaaacggggaggaaatataatgatggtcttnnnnnnntnntnnnnnttttttttttttttttttttttntttttttttttntnttttttttttttttttttttttttttctttctttctcttttttttttttttttttctctctttcttttctggggggggggggggtttcttctccttttttctcctttctttttctggttttttttctctttcttgctcttttcttttttttttttgtttttctttttcttttttttgccttttttttcttttctctttttttttttttttttttttgttcgtcctttcttcttgtttttttttttttgtttttctcttgttcttttctttttgtcctttcctcccgttgttttgcttttttttttctttttttttttttcgttttttttgtttttttt

SEQ ID NO: 28361 - DNA, 480 bp, Zea mays
  Clone ID: cC-zmle189071g04a1
cttcccccttttttttctttcccccccccccctctctaccccgcccgccttttttatattattttttctttttccccccccaaaacctttttctcttacccaaaaaaccccacccaccaaaaaacaaaactaaaacaacaacccataacaaaaaaactaaaaaacacacccaaaaaaaaagaaaaaaaataaaaactcacaaaaaaccaaaaccaaaaaaaaacaaaaaaaaaaaccaaacaaaaaaaaaaaaaaaaaaacccaacaaaaaaaaaaaaaaatctaaaaaaaaaaaaaaaaaaacctcaaaaaccccacttacaaaaaaaaaaaaccatcaaacaaaaaaaaaaaaaaaaatttcaaacccccataaaaacaacccaccacaaataaaaccacaactaaaatgtcttttaaaaaactaaaacaaaaaccacaaatttcccataaaaccaaccccccaaaaaaatctataaa

SEQ ID NO: 28362 - DNA, 632 bp, Zea mays
  unsure at all n locations
  Clone ID: cC-zmle189071g05a1
cttctttcgtaccccgtcagggctgacccatcacgcgtttttttgtttctacccanngcgagcggagggcgggcaaggcgagggggcatcttnttcgtcatggaccctctctccacagagacaaccaatgnngccccgaagggggcccatgcattactgctcacgttggtacccggacacccgaactnnncatctagggtctagtccangcnnagctatcagccggtggcctgacctgcaatcnnatggtganatctcacgcgcncgcgatacgtccggtcggtcactccacgttctttcgggtaaccgggcccagaggcgttcaatgctncttcgcgcctgtgcccgtccgcatacctctgctaggngtctcaggctctgnttcgacacattcgtnnaatcatgnngtcatagctcggtttccctgctgtgaacattcgttatctcgcttcacacattctcaccacanatcatacnngagctcggaagccataacagtgggtaaagctctggcggtggcctaaatgaggtgggagctacactcacattacattggcgtnntgcgctcactgggcccgcttntccaagttcgggaaacccctgtcgtgccaagctgcatttaaatggaatcg

SEQ ID NO: 28363 - DNA, 412 bp, Zea mays
  Clone ID: cC-zmle189071g07a1
ggtggggaaaacaaagcattgcaaacctgcaactgcaaggttgtccaaactccaaacattcttttacacttccctttttgacgaatccctgtatactgattcccaaaaataatttactagccctagacgtcgatgatgctacaggggctttcaagaccaaatgccccacagaaaaaaagttccgtcccggtagaataaaccatccatcatacaggcggggggggcaggtccagcaggagccaaaaccccacccacccgttggagttgaggttctcctggatggccagaaagtggagccccccccaggccttttttgccgccttccaggccttcgccttctgcgttgacgcgggggttttttggtacccaaagtaaacgtaccgggttgacacccccgccgacaggatcaggc

SEQ ID NO: 28364 - DNA, 549 bp, Zea mays
  Clone ID: cC-zmle189071g07d1
cacccgtgcgggggttcgagcttgatgacaccacgctagtccctggtttctctttggaatcatctcgcgccaagcctggggccgcgtggatgaacggtctggagatctgcgcgatggaggcggacactggcagggcgagcctgatcctgtcggcgggggtgtcgacgcggtacgtctactctgggtaccagaaaaccgccgcgtcgacgcaggaggcggaggcctgggaggcggcgaagaaggcctgcggcgggctccacttcctggccatccaggagaacctcaactccgacggctgcgtcggcttctggctcctgctggacctgcccccgccgcctgtatgatggatggtctattctaccgggacgctacttcttctctgtcgtgcatttcgtcttgatagccactgtagcatcatcgacgtctagtgctagtaaattatttttgggaatcagtatacagggattcgtcagagagggaagtgtaaaagaatgtttggagtttggacaaccttgcagttgcaggtttgcaatgctttgttttttaaaa

SEQ ID NO: 28365 - DNA, 392 bp, Zea mays
  Clone ID: cC-zmle189071g08a1
gcaatgctgaaattgtaaattactaccgggcaaaagtgtatgctcagcgatcaagttttgcagtacacaaaatgctcgtacacgactacgacacgtacattaccattcaccaaagaagagttaatggtacacaaacttgcaacagcagcagcaggttttaaaaccgggaacccaaatgttaggacgccgacggtttacacgttcgaagggacacccctgtacagctcctccttgtccaagcccggcgtggcgacggcctgcaacggcgtggccattaaggggacaagcccgggcgactccattatgctcacgtcctcgggacaggtcccgttcggcagcgtccacgtgaagtggtgcaacatgtggccgatcatggacgccacgaggttgat

SEQ ID NO: 28366 - DNA, 487 bp, Zea mays
  Clone ID: cC-zmle189071g08d1
cacccgtgcggacttccgcgtgctggcgttcggcgccggccgccgtttgtgtttcggcgcgcagctcgggatcaacggggtgtgttccattatcggccacatgctgcaccacttcacgtggactctgccgagcgggacctgtcccgaggacgtgagcatgatggagtcgcccgggctcgtcaccttcatggccacgccgctgcaggccgtcgccacgccgcgcctggacaaggaggagctgtacaggcgtgtcccttcggacgtgtgagccgtcggcgtcctgacatctgcgttcccggttttgaaacctgctgctgctgttgcgagtttgtgtaccattaactcttctctggtgaatggtgatgtacgtgtcgtagtcgtgtacgagcattttgtgtactgcagaacttgatcgctgagcatacacttttgcccggtagtaatttacacattcagcattgccccttttaaaagaaaaattcaattc

SEQ ID NO: 28367 - DNA, 466 bp, Zea mays
  Clone ID: cC-zmle189071g09a1
aacagacaacgaattgagtttggggggggggcaccaaagttgacaagtttagtccaagcttgtttactggacttcagctgctgataaaaataaaaataaacctaacatcccaaaagcagaagctggtgacctcagggcttgaggaccagggagagcccaaccttagagctcttctcgatggccttggtgtccacctccgtggagatggtgaccagtgacttgggcctccactcgtgttggatcagtgcacttgccatgccgtagttgttgaagcgtgccttcacagtggtcagagggtccagggcatgctgcgtcccaaaggtgatggtgttcccgttggtcgagaagctgtggctcacttctcctccgacggctgtggttggactcaccgagtggtagtaggaagcggcaatgttgtctcctttgttgttcaaagtcgctgcaacaacaaaatcaggcgtcgtgt

SEQ ID NO: 28368 - DNA, 516 bp, Zea mays
  unsure at all n locations
  Clone ID: cC-zmle189071g09d1
cacccggccgcggacgcgtgggcacaccaggctngaaggcaacnttatgngtttctttcccgtaccagaaatctgcaaaggcggaactccattatttgcaccaccatgctggtgttgctgcaagtgttggcctaaatgcaaaccctgttgttaacctttctggtgtattcggaactaaagctattgctgttggcgctgatgctgcatttgatacttcttctggggacttaaccaaatacaatgctggactgagctacacgacgcctgactttgttgctgcagcgactttgaacaacaaaggagacaacattgccgcttcctactaccactcggtgagtccaaccacagccgtcggaggagaactgatccacagcttctcgaccaacgggaacaccatcacctttgggacgcagcatgccctggaccctctgaccactgtgaaggcacgctttaacaactacggcatggcaagtgcactgatccaacacgagtggatgcccaagtcactggtcacca

SEQ ID NO: 28369 - DNA, 611 bp, Zea mays
  Clone ID: cC-zmle189071g10d1
caaccacccggccgaaaaaaaaaaaaaaaaaaaaaaaaaaaaaaaaaaaaataaaaataaaaaaaaaaaaaaaaaaaaaaaaagaaaaagaaaaaaaaaaaaaaaaaaaaaaaaaaaaaaaaaaaaaaaaaaaaaaaaaaaaaaaaaaaaaaaaagggggccccccctaaaaaaaacccaaccctccccccccccgacccacaaagaaaaaacctcttaaaaaacccacaaaaaaaaaaaaccagggccccccccaaaaaaccgcaggaaaaaaaaaaccccggccccccccaacaaaaaaccccaaaaaaaccccccccccccccccaagggaaaaaaaacaaaaaacccccccccaagcgcccccccaaaaaagcccccccccaaaaagaaaaaagaaccccccccctacaaagcccaaaaaccccgcgggggggggggtataacccccaaaaaaacccaacactttgcccccccacaaaccccacggccggtgttccttaaaccccccctaaaaagccaaaaagccggcttatccccaaaaaacaaaaaaaggggcccccccccaaaaagcccaaaaagcctaataacccccccccccaaaaaccaaa

SEQ ID NO: 28370 - DNA, 574 bp, Zea mays
  Clone ID: cC-zmle189071g11d1
cccgggcgacctggacggctcgggccgcaccttcaccaacgccttttcatgtttacgtggacgtgcgcgacgtgggggacgggctcctcctcatcttctagagccccctctcgtcctgccgccacctctgcgccgagcgcgtcctccaccgcgaggacgtcgtccgcatcctcgccaagctattccccgagtaccccgtcccagccaggtgctccgacgaggtgaatccgctgaagcagccgtacaagttctccaaccagaagctccgggacctggggctgcagttccggccggtcagccagtcgctttacgacacggtgaagaacctccatgagaatggacacctgccggtgctcggagagcggacgacgactgaagccgccgacaaggatgcccccgcggccgagatgcagcagggagggatcgccatccgtgcctgatagggcgatgccacacatgaacacaaagcagtgttcatactgcttgcctgcacctgcacctgcttcttcccctgctgtgtaaacaagcctgtgttctgtctggctgatagtgatgtaccctaaacttgtaacgt

SEQ ID NO: 28371 - DNA, 576 bp, Zea mays
  Clone ID: cC-zmle189071g12d1
acccgtccgagcagattttgcaggagatgaacaatgcttcctccactgaattcttgagcagttcgcttacggaggtggtatgggcaatcgaaactgtcacggagaaggtcatcatggaagaagagaagttcaagaagtggaagaaggagaacattcggaggaaacataactacatccctttcttgttcaacttgctgaagatgcttgcagagaagcagcagctaaaacctctggtcgagaaggccaaacagcaaaagtcagcaagcccgagcacgagttgatggtgaaatgtcaatagactggtagcttttgccgatgtcttctgagcgtcgtgttatcttatcagatacattgccaagttggcagctcagataagataaattatgaccgatgttatttataccatgttgcacgccgtgatgtgtcagcagctatgccatttttttttttgcagagcacgtgcgttgttgaagtggttaattttagtcgtttagagattgtttcagagtaagggtaatggaatggactgaggaggttaaaatccctcaatattcaatcttaataatgatgggttcc

SEQ ID NO: 28372 - DNA, 428 bp, Zea mays
  Clone ID: cC-zmle189071h01a1
aactattatacttagaacccttcacgagcggccggttcttttaaaaaatcagggcgcttaaaacacaattcatcagatccatactatcatattttctcaaatttatgattcctgtaactgtaaaatgaactccaacattacaacttgcaaccatttcattgcacatttacaagttctataatacatttccttacccccaaataaattttaaaaaggtaaactggatgccaaaacaagatccttaaagttagccttcacaggacccattttaactttacaattttacaaatttgtcatagctccatccaaaaaactatccttactttttgctaacctaagttagctccaccacaccatccttaaagatagccttctcactcaactcttaaaatgctttaacaacaatttttgtgttcttctacaaactc

SEQ ID NO: 28373 - DNA, 517 bp, Zea mays
  Clone ID: cC-zmle189071h02a1
gggtcgcgttttttttttaatttttttttaaatcccttaaattttcaacctttccctctaattttaccaaatttaacaaaaaaaaaacctataaaaacataacgaaaaaaaagaaaaacctaaaaaaatgaaaaaaaaataaaaccccaaaaaatccacaaaaaaaaaaaaaaaaaaaaaaaaaaaaaaaaaccaaaaaaccaaaaaaaataaaaaaaattaaattaatctaattaaccaaaaaacccacaaaaaaactataaaacccttcatcccaaataaaaaaaaaaaacccaaaaaaaccaaaaaaacccaaaaaacatatatgacctcaaagttttaaaatcccttaaacaaaaaaaaacttaaacaccttaaccccctaaacccaaaaaacctaaaaaaattggaacaaactttctacccccattacacaaaaaaaaaaaaaaatcccgtaaatggctaaaacaaaaaaaaaaaacatagtatattcgttatcaataattaaaaaaccaaa

SEQ ID NO: 28374 - DNA, 502 bp, Zea mays
  unsure at all n locations
  Clone ID: cC-zmle189071h04a1
ttgtttgatggataccaagtatccggaccatgtgggtcatcgatgctgtggtattctggctaaatacaggtatgcttcatgtatcacattatgacaaacttgacagacatttgtatatgatgtatgtgtggatcacgtttgctgttgctgcctccctccctcggattgagatggagctccatcatcattcctcggaatcagactcgagggggcaggagccgtcgtcgacggtggccagcgggtcgaacatgtcggagctggggtccgtgcatccgctcacgatgtccagtttgcaccgatcccccccctcctcgaggtagccgtccatggcgcagctggtgatggcgatgttctcgtccgggtagatggccaggtcacaggcgccctccctgttgagctcgtccgccaggccctcgttgaagaagctcagcggcttgttctgccatggcttggggaccctgaactngagcgtgtacggnccgtccccactcgccccgttggt

SEQ ID NO: 28375 - DNA, 528 bp, Zea mays
  Clone ID: cC-zmle189071h05a1
ttttttctcttttttttttttttttttttttttgtgttgtttttttttttttttttttttttttttttttttttttttttttttttttttttattttttttttttaaaataaaaaaaaatataaataaaaatattaaaaaaaaaaaatagaaaacaaaataaaaataattataaaataaaaaaaaaaaaaaaaaaaaaaaaaaaaaattaaaaaaaaaaagtaaaaaaaaaaatgaaaaaaaaaaaaaaaaattattaaatctaaaaaaatattataatttaaaaaaataaaaaaagcaagttggctgaaaaaaaaaataatacctcgcaagggcacaaaaaaaataaacattaaaaataaaggttttttttttttatgccaaattaaaaaaaaaaaaaaacattaatctcctctaacaaataaaaaaagaaacacgccgaaaaaaagttttttttttaatataaaaaaaatatttttttttttttaaaaggaaaaaaaaaaaaaaaagttgttctatacttgttcat

SEQ ID NO: 28376 - DNA, 399 bp, Zea mays
  Clone ID: cC-zmle189071h06a1
ataggattggaaaaacatgattttgaaaaaaattggggccaaacatacccttaaccggattataaaaaccaaactggaattttaccacccggctcacaaataatcatacaaggggggggttttaaagggcataccaaagtttgacaaacatagcacaattagatgacattcaactccataccaaaactaccaagacagttttccgcctaaacgcaacctcctagcctcccttttaaacttgagcaggggggggatgttttccttgcgaaccggtcccttgacgttcctaaagaagagacggttctgggcatccaaaaactttactttgacctgggtaacctgacccctggagccgggcctttccataacctttaccacaacagaaagcttcaattgggg

SEQ ID NO: 28377 - DNA, 542 bp, Zea mays
  Clone ID: cC-zmle189071h07a1
ttttaatttagcgaaagaataacaaacattggtagccgggattgtttgctttcacaacgttacaacatatatatatcatatatgcatggacaggtacaatgcctctccagcagcaccagcaacaagggtggttagcagcagggactataaacaacagagtaccatccgcgttgatagattttttattactgcaaaattgatccccgcagcactaccggtagttgcggtagacgggagtgtacatgcagttctctgcatatttcaccaggtcgctggggggaggcagacgggtcgccagaccgagctcgtaggcttttgcagccacggctgcagcgatgtgcgcagagatctttctgatgctggtgaagggtgggaagatggagcccttctcgaagttgtcctgtgtggcctgatcagctagcgctttcgaggcggcgagaagcatgttcttgtggacacggacggctccagagatcacaagaccgaggccgagtccagggaaaatgtaggcattgttcgactgcccaggcacaaaagtcttt

SEQ ID NO: 28378 - DNA, 513 bp, Zea mays
  Clone ID: cC-zmle189071h07d1
cacccgggcgcggacgcgtgggctggtattgcagaacttattgctctttagttttcgaaacagacgaatgctccaatggaagaggtccgcatgaaggtttggctggtggactcaaagggtttgattgttgactctcgtaaaggctcccttcatccattcaagaaaccttgggcgcatgagcacgatcccttgaaaaccttgtatgatgctgttcagtccatcaaacctacagttctgatcgggacatctggagttggaagaacattcacaaaagaaatcattgaggccatgtcttccttcaacgagaggcctatcatcttttcactgtcaaacccaacctcgcattctgaatgcactgctgaacaagcatatacatggagtcagggccgttcaatctttgccagtggcagtccatttgcccccgtggagtacgaatgaaagacttttgtgcctgggcagtcgaacaatgcctacattttccctggactcggcctccgtcttgtgatctctgga

SEQ ID NO: 28379 - DNA, 400 bp, Zea mays
  unsure at all n locations
  Clone ID: cC-zmle189071h09a1
ggtaaagggggtaaaggcctctgtcactgttagcgtcatgatctgtatatttgatgtgaacaatgtacattggacatcaagactagtatgttatgtgggagtgccatataatacaatataatataatataatacagggggtcgtacatggatgtatcaataccatatattcagaatttgtgatctgatgaattttggtagtgttgctcgtcatcaaggttttgccanccgggaggggaggggcttttgatcgtccatcctcgcctccatcagcttttccttgaggctttgcttaagcctgccttccccttcccctacccggtgtggcaattcaaagccgcctgacaagctgtactgctcgcctgcgacggttggaggaggaaacggcggtggcggccctt

SEQ ID NO: 28380 - DNA, 502 bp, Zea mays
  Clone ID: cC-zmle189071h09d1
cacccgtccgcccacgcgtccgccgagagcaggaagaagaccgggattacagttgccgactggtcgccgtcttattcggacaggaggatgtcgagcgtgaccgcggaagggccgcctccgccgcttcctcctccagccgtcgcaggcgagcagtgcagctcgtcaggcggctctggattgccacagcgggtagggggagggggaggcaggctgaagcagagcctcaaggagaagctgatggaggcgaggatggacgatcagaagcccctcccctccgtgtgcaaaaaccttgatgacgagcaacactaccaaaattcatcagatcacaaattctgaatatatggtattgatacatccatgtactactccctgtattatattatattatattgcattatattgcactcctacataacatactagtcttgatgtccaatgtacattgttcacatcagatatacagatcatgacgctaacagtgacagaggcctctaactcattt

SEQ ID NO: 28381 - DNA, 571 bp, Zea mays
  unsure at all n locations
  Clone ID: cC-zmle189071h10d1
cacccgggcgggaggtgctgccgtggaagcgggcgctcgcgccgcttttcgttggccgcgacgccacgcgccggccgggggaggggggccagaccaagaacgcagnggacgaacncgnggnggcggacgagaagaaccgggacgggcnggngaaggcgngcgagacgccggngcnggaggagnncngggcgccgaggngcgggccgngccggangaacgcgccggngancgacgagcnggccaaggactacgccggcaagatcacgtgctgcaaggtgaacacggacgacagccccaacgtggcgtccacctacggcatccgcagcatccccaccgtgctcatcttcaagggcggcgagaagaatgagagcgtcatcggcgccgtcccaaagtccacgctcaccaccctcatcgacaagtacatcggtagctcatgagcatgccatgcatgcatgcttcgacgactaaacacatatgtgtatctctagtagcctttgcatacgggatatgatcaattcaagcagccagccgtctgctactgctgtgttatatataccatacctccatgtcg

SEQ ID NO: 28382 - DNA, 377 bp, Zea mays
  Clone ID: cC-zmle189071h11d1
aaccacccgggcggccacgcgtccgactgtgagaaacctttcctgtacctttcattttagctggctggtgatccgaaccttgagctggttgaagctgttgctcttaagcctccggaagttaccatcgacatggctatgcagcagcagcatgaagctgagcttgctgcagcagctgcacaacctcttcctgatgacgatgatgatctgattgagtagaaaggatcatgagtcttgaacttgagcaggagttgtgccttgcgtgttttaagttgttctagggtgaactcttgagttctcattgtctggatcatctttttctccttggatgtgttgcatcttttgagtgtggaaatggatggtactcctcgccatgaaaa

SEQ ID NO: 28383 - DNA, 459 bp, Zea mays
  Clone ID: cC-zmle189072a01a1
gtcttttttttttttttttttttttcaaatcgggaggcagggttgatgaaacaaatacacaccccaggattacactacacgactcccaacaggaaatggaaagcggaagcctgtaccgccagttcggtgactgcatacaactcatatatatatataacatacgtctctttcgtcgaataatctgtatattattctctatggaaagaaccctcgcgcccgtgctgtacgtttcgtcgtggaaagaaccctggcctcatgcttcgtacaccttgcactcgtcggtctcggggttgtccttgcagaagtcctccagagggtcgccgttgccggccgccgccgcgccgggccacttggccgccaccaggtgcgccagatcaaccacgcgttggctgtacccccactcgttgtcgtaccatgcgacgaccttgaccatgtcgtcgcccatgaccatgctgagcg

SEQ ID NO: 28384 - DNA, 452 bp, Zea mays
  Clone ID: cC-zmle189072a01d1
gcccacgcgtccggacgtgccgctcgtgtccgtcgacttcaggttttccgacttgtcctgcaccatcgacgcgtgggtgagcggggtcatgggcgacgacatggtcaaggtcgtcgcctggtacgacaacgagtgggggtacagccaacgcgtggttgatctggcgcacctggtggcggccaagtggcccggcgcggcggcggccggcagcggcgaccctctggaggacttctgcaaggacaaccccgagaccgacgagtgcaaggtgtacgaagcatgaggccagggttctttccacgacgaaacgtacagcacgggcgcgagggttctttccatagagaataatatacagattattcgacgaaagagacgtatgttatatatatatatgagttgtatgcagtcaccgaactggcggtacaggcttacgctttccatttcctgttgggagt

SEQ ID NO: 28385 - DNA, 56 bp, Zea mays
  Clone ID: cC-zmle189072a02d1
aaaaaaaaaaaaagaaaaaaaaaaaaaaaaaaaaaaaaaatttttaaattttaagg

SEQ ID NO: 28386 - DNA, 436 bp, Zea mays
  Clone ID: cC-zmle189072a03a1
ttttagtttaagttccatacataagctgcaaccgatgaggataacaccacgagattacactactgactcttctcgactggccgtgccgtgagaaaaaaaaacaaccggctgctcaaccaggagagactagcacgcatgtacttgacgctgcttcacaacactggacgacgacgagtcgacgacgatgtactagctagctagttactcattgctacttgcagccgccatggccgacgtctaaaatgccatcgggccaccgcagccgcaaaacccagacagtagaaaattaaattacacggagctattattgctcatgacaggatggaatcccagtcgatctcccaggacgggtacttgcgcaggtggaaggcctccgtctcgtcccacggcgcctccgtgaagtccagcttcgccatctccggcaccggcacgggcg

SEQ ID NO: 28387 - DNA, 503 bp, Zea mays
  Clone ID: cC-zmle189072a03d1
aaaaggtccggttcaagaggctcttctgttgggtttttttattatccttaagagaagcttgttcttgggttagggagtttgggttctcacctcataacacctctcctaggaggaacagagatccagagaaccttttttctcttctggatccttgccgccttttggccttcgaaagggttgttttgcaataccctctctctgtttttttcttcttcgcacaaacccacctcgtttctctacttttattgaggaacagagctggttttccaaaacaaattctgctttgattttctataaagaaaacctctcagcctctttcttctagctccatccaagctttagtcctaatggccgcagccatcgacatgtacaagtactacaataccagcgcacaccagatcgcctgctcctcctccccctcggatcaggagctcgcgaaagcactcgagccttttataacgagtgctttctcctctttcgtccttcttcccctaccatgggta

SEQ ID NO: 28388 - DNA, 334 bp, Zea mays
  Clone ID: cC-zmle189072a04a1
agggcaaagggagagggattttccttttggtttattaccaagcacataatttaacaaatgaataacccttacaagactaccagcaacagttgcagaattcaaaccctccaaattttaaacctgctgttcctagccagtctaaccactcctacgcccaagatcatttctttccccttccatcacagcaactcttaaaacggaggcaggatcgtctgccacatcttcgtcgacggggagctcatagactgcaagtagccatggccttgcccagccgccagattcatcgtttggaccgggttcggattcaacacatgggtcacgttgtagggcgcct

SEQ ID NO: 28389 - DNA, 397 bp, Zea mays
  Clone ID: cC-zmle189072a06a1
agttatcaacaaagagcattgcattatttacacctccaattgcctttttttctcgttttcggagacaaagcagatagtacaaagatgaacatgaaccctacaaactagagactcaacattatccatttatcctgatattgtacagtgatcattgaagcgagatgaggatgtctggatcttcaggggacacgctgacatcggcaccagtaagctacgcccccgcctttgccttgcgcaacagcgatctcctcgtcaacgtagaaccaaacgaagaaggggtccttcgtgctgggctccctaccaccgtcaccgctttcgaggctgatttccaggggaccaaacggtccgaccttgacgcgaacccgctcgaagacgaacgcgagtattttcttttttc

SEQ ID NO: 28390 - DNA, 432 bp, Zea mays
  Clone ID: cC-zmle189072a06d1
aaaagaaaatactggcgttcgtcttcgagcgggttcgcgtttggtcttaccgtttggtcccctggaaatgggcctgggaggcggttacggtggtagggagcccatcacgaaggaccccttcttcgtttggttctacgttgacgaggagatcgctgttgcgcaaggcagaggcgggggcgtagcttactggtgccgatgtcagcgtgtcccctgaagatccagacatcctcatctcgcttcaatgatcactgtacaatatcaggataaatggataatgttgagtctctagtttgtagggttcatgttcatctttgtactatctgctttgtctccgaaaacgagaaaaaaaggcaattggaggtgtaaataatgaaatgctatttgttgataactaaaattttcttttgtataaagtcattaacccctactttg

SEQ ID NO: 28391 - DNA, 486 bp, Zea mays
  Clone ID: cC-zmle189072a08a1
ttttggtttctaggtcttgtactctacaaactctcttatgggacattgggtgagaaagatcagacatacatatacccagtgtttgtcatctatctcacgccacagagctacgcttacagggattaaaatgccgcgaaatagctagctgccggttaataccgaaggtaccgctactgcttgttactgctcactacaagctggggctggggctggggctggggctgggtacacaaatatttacatcgcaaaggcagaggggagcaaatcagcaataacaataatactagcaataaaacttgctaccaacagcgagcttcggagaagcaggcggagacagtagtttctacgttcccaactaaaacccaaacggacgggggatggggctgcaacggacaagcaaaagatctcaggagtttttacttccctgggacccgggctggcaccacctcctgcacaaggaacgggttcatcacgcatgcatcatcg

SEQ ID NO: 28392 - DNA, 517 bp, Zea mays
  unsure at all n locations
  Clone ID: cC-zmle189072a08d1
cgcccacgcgggcgnggacgcgngggctggcagaacgcnaanactttcaacgttggtgatatgatgcttgtcggagaggaccggggggaggagttctgcaacatagtgcgcaacatctacatctacacgaaggaggaggtccagaagatgaactcgaaatcatccgtgccgaggaaggaggaacccccagcagcaggcgaaggctgcgccgccgccgccgcaaacgagtaggatgtctgcctgcactgcagcaagcagctttagatgactaggtcgtgtggaggaagccgacgatgatgcatgcgtgatgaacccgttccttgtgcaagaggtggtgccagcccgggtcccagggaagtaaaaactcctgagatcttttgcttgtccgatgcagccccatcccccgtccgtttgggttttagttgggaacgtaaaaactactgtctccgcctgcttctccgaagctcgctggtggtagcaagccttattgctagaattatcggtaatgctgaattgc

SEQ ID NO: 28393 - DNA, 511 bp, Zea mays
  Clone ID: cC-zmle189072a09a1
tttttttttctttttttttttttttttttttttttttcgggacactgggtaattttttttttcttttttcccctttccccctttttttttcctttttttttttctatctcctctataaaagcacccaaaaaaaaaaactttttttggtaaaaaaaaaaaaaaaaaacaaaaaaaaaaaaccctaaaacccccctttttcccccccaacaaaccccaaatggtcaacctttaaaaaaaaaaaattccccctccccactatccccctttattaaccccaaaaaaacccccccataactcccccccccctaaaaaaaaaaaacaaatttccccccccccttcccaaaaccccccccccccaaaaaaaaccttcaaaaaaaattttttgacccccccccccccccccccgtttctaccccaaaaatatcaacaccgccctctaaaaaaccccctcttcccttaaataaaaccaataaaaaacctgtcaaaaaaaaaaaaaaaaccttccccccgt

SEQ ID NO: 28394 - DNA, 333 bp, Zea mays
  unsure at all n locations
  Clone ID: cC-zmle189072a09d1
gaagctnagcaggactctganagnnagcgaaaaaagggtttgnggttttcgcgaacgagcgcggggcagggggtaggggtgttgccacgcgcggcagctcaccggctcgttcatgccgtgcatgatgcgggtgacgtgcgggatgggcacgtcgctgcctgagaagctcgcaccggtggcgtacgtgtggctgcagaaagggcgtcatggattgaaatgctctctacttatttctggaaattgacccagaaaagctgctgcgtgcagcgccgcttcaaaaaaaaaaaaaaaaacctggagggaaactaaataaacaccaccaagacgctctta

SEQ ID NO: 28395 - DNA, 505 bp, Zea mays
  Clone ID: cC-zmle189072a10a1
tttttaagtttagtattgactagcgtagcaacaaagacagggagtgggcttagagttatcatgttcacagctgtgcaatactacagtcaaagatgcacgacacgacactggttgtacacacagcaggagaagaaacaaaactcctgccctttcttttattttagccgagatcagggacgatgaggtggtcctcgtcgtcggtgacctcggtccgggccttcttgctctggcgcaccccggcgccggcagtggcagtggctttggctggcctgtagtacgccgcgtcgttcgcggcctgggttccggaaagctccggtacctcagccaatctcctgccggctttcggcgtctgctcgtggaagaggtcgatgtcggtgaaccactccagctccttgaacccgagcggggactccttgtgcagcttgtcgctggactcgcagtcggagaactgcaggagctcgtcgacggcccagccctgtggcaggaactgcggcggcgagggcac

SEQ ID NO: 28396 - DNA, 543 bp, Zea mays
  Clone ID: cC-zmle189072a10d1
ggggaaccacccgtccgcggacgcgtgggcggacgcgtgggcggacgcgtggggttcgttcttgcctccctcgttgttgcgacttgcgaggggacaggacaggatagcgagctgggcctgggagtatagaccgcagacagagaggtggagcggccatgaagatccagtgcgacgcgtgcgagggcgcggctgccaccgtggtgtgctgcgccgacgaggccgcgctgtgcgcgcgctgcgacgtcgagatccacgccgccaacaagctcgccagcaagcaccagcgcctcccgctcgaggctctctccgccagcctcccgcgctgcgacgtctgccaggagaaagcggcgttcatcttctgcgtggaggaccgggcgctcttctgccgggactgcgacgagcccatccacgtgccgggcacgctctccgggaaccaccagcgctacctcgccaccgacatttcgcgtcggcttcgcctccgcttcgtcagcgtgcagtgacgcctgcgacgcccacgacgactccgaccaccacgccccgccc

SEQ ID NO: 28397 - DNA, 416 bp, Zea mays
  Clone ID: cC-zmle189072a11a1
gatccactctatatattgggggttggggattctttaataaataatttccccctaatcaaaatcatcttgatagaaataacaggccccttctatgtattatcaataggatcaattctaacaagtcacacactcatattccagagataccaaaacaaaaaaatccacggtcgaactaccaaaatgtttaaaaatgtggagcttaaagaaaaaaggctttttttggatggaaaaactatgaacccatagttttagttagtaaaaacctaattccttaaaattcccgccagttaaacagaagaattatacatttctaaaattatagataggaatatcgcgaataaagccattgcgacccccattaaaagagtagtcccccaacccggagcaactttcccatattcccaaattaaaggttt

SEQ ID NO: 28398 - DNA, 504 bp, Zea mays
  Clone ID: cC-zmle189072a11d1
cacccgtccggagatgacaaacacggaatataaagcatacccaaaaaagcatactaatttaaccaaatatggaaatggcgacggaggaggctgattccatttttatagaatttcaagattacaatgcatctatgaaaagatcgtgtatttacaactacaacggaatagtatacaaagtcaacaccaatgattaaatagaatttatggctacacaaaccgttgaagatagttctagacctaagccaaaacggactggcgcaggtagtttattgaaacccttgaattcggaatatgggaaagttgctccggcttgggggactactccttttatgggggtcgcaatggctgtattcgcgatattcctatctataattttagaaatttataattcttctgttttactggacggaattttaacgaattaagtttctactaactaaaactatgactttatagtttttccatccaaaaaagcctttttactttaagctccacatttctaga

SEQ ID NO: 28399 - DNA, 446 bp, Zea mays
  Clone ID: cC-zmle189072a12a1
attcgggggtaatggtgttcatatcttttcggggttgacggacacaaccattatattggtgaaaaatacatgcagctcctgtcctcaagactcgggcagaggcgcagagcacatccttctaatggtgtatacatatgctttccctgtctatcgtggccatggactttgcaataccatagataccatacgaaaacacgaaacgggagaagcaaggaaacgttacaaatcgtacatgtggatacaacactaaaacaagcgttccacacagctagcacggcactgatcactgtgcctgatcccgtggagtgaagcggtgaacggtccgacccacaggacaactgaactgaactgaactgcacaggcggcggcggcaagacagaagaactggtgaagaagaggccggtgggttcagaagaaagagcgcttggtggagggcgcccttccca

SEQ ID NO: 28400 - DNA, 524 bp, Zea mays
  Clone ID: cC-zmle189072a12d1
acacccgtccgggcgggggggtgtccgtggggcacgtcatgaaggaggaggttttgtctttagatcgccgcgtggcaggtcgcggggggggccaaggtcaacaaccgcttcaagcgcgaggaggtcgtcatcaacggctgggagggcgaccaggtcgagaaggccagcgcgtggctcaagaagtacgagaggaagcttgaggagaagcgtgccaaggcgatggagaaggcgcataacgaggtggccaaggcgcggcggaaggcggaggagaagcgcgcgttcgcggaggccaagcggggcaccaaggtggcgcgagtgctggagctcgccaacttcatgagggccgtggggagggcgccctccaccaagcgctccttcttctgaacccaccggcctcttcttcaccagttcctctgtcttgccgccgccgcctgtgcagttcagttcagttcagttgtcctgtgggtcggaccgttcaccgcttcactccacggcatcaggcacagtgatcagtgccgtgctag

SEQ ID NO: 28401 - DNA, 403 bp, Zea mays
  Clone ID: cC-zmle189072b01a1
gggacgggtacaagtcctccaaaacttttttatttttattattttgtatttaacataaaagctgaaaaactacacatccttgctgggggcggtaccaaactataaaacaccttcttttttccccttaaataaattgcctaacaacaactttagttgctcgggagtgtgcttaacgtatttcccaagggccttgctattctcaatgaaaggcccaaaaccttttattaattaacggtaggcatgcaacaagatttcaaccacccccaatcttatttactcccccaactcattgttttgaaccgaccaaccccattgcttggggtagatctctttgaacaacacattgaaagaccttaatttctccttcacaactgttctttaaactccactgttttttccacca

SEQ ID NO: 28402 - DNA, 494 bp, Zea mays
  unsure at all n locations
  Clone ID: cC-zmle189072b01d1
tcactatattgtcaaatctgtccgcatatcagaagccaattttttgttttgtgatgactggattcaaaggcggcgaagggttgtacaacaaaatgccaatcagtatataaggattgcttgggcgaaggtgttgcaatgcctctctggtcaaggtttgacttcatcaggtggtagtggtcatgtaggaagtgatggtggcaatagcagtggagcttcaagaacagctgtgaaggagagattcaggtctttcaatgtgttgttcgaagagatctaccacaagcaatgtggctggtccgttccagacactgagctgcgcgagtcactaatacttgccgtcgctgaaatcctgttgcctgcctacccatcattcataaaacgttttgggcctctcattgagaatagcaaagcacctgngaaatacgtgaagcacactcccgagcaacttgagctgctgctaggcaatttatttcaggggaaacatgaacgtgcttgat

SEQ ID NO: 28403 - DNA, 399 bp, Zea mays
  Clone ID: cC-zmle189072b02a1
gactaaacctcttagggcagcagaggaagggctttcatggtaataagttaataaccgaccattgaccacataagtcttacgcgagacattcgcaagcaaagtgactcccaaaatacttacaaccattaggacaacataaagtagacatagtagtagacaccacgaaacttaggcatcaatagatccagcacctccttactcgaaggcccactggttctccctgcggatctcctcttcctcctcaggggtgaagtcattcttgatgttgaaggtcttgcgaatctcttctggtgtcttgcccttgatcatgtcagcaacagtctgacaggtcaggtcgagtagacccttgatgttcagatagtttgcagccaagatgaggtcgaaaagcgtggcctggtc

SEQ ID NO: 28404 - DNA, 585 bp, Zea mays
  Clone ID: cC-zmle189072b02d1
tcttggcctcctttctggagcagctagggttccgtcctcgttccgatttgccgagtgcacaccacctttcgggactcgggtcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggcatccctcttcctaacgttaactccaagatcctatccaaggtaatcgagtactgcaacaagcacgtacatgccgccgccgccgccgccgccgcctcgaaggccggttccgacgacgtgggtgccgccttcgccaacagcaccgccgcctccggtgaggacctcaagaactgggatgcggacttcgtcaaggtcgaccaggccacgcttttcgacctcatcttggctgcaaactatctgaacatcaagggtctactcgacctgacctgtcagactgttgctgacatgatcaagggcaagacaccagaagagattcgcaagaccttcaacatcaagaatgacttcacccctgaggaggaagagga

SEQ ID NO: 28405 - DNA, 301 bp, Zea mays
  unsure at all n locations
  Clone ID: cC-zmle189072b03a1
cccccccccctttttnggggggccaaaaaaaacccccctctttttgagtaatgacctaaccaaaccttaaacaaaaaacatggggtaacccaaccctttttttaaccccctttcccccccacggggggggcccaacaaaaaccccccccccccaaaaaaaaggcccccccccccccctgcccccggtggtgggcccccccccccccggcttcccccacccaacttttgttcctttgacccaaccccccgggccccccaaaatcccacgggccctcccctttaatcccccccattaaaaaca

SEQ ID NO: 28406 - DNA, 535 bp, Zea mays
  Clone ID: cC-zmle189072b03d1
cgctaactactttcaccattgtttccagaaaaatctccgcgcatattatttttttagagcaaacgctctgtcatcaggcaacaggagttcgtccgcacgacactcccgcagttcctcgacagggggggtttggggtttccattccaggcggttgcggttgcggttggcggcggagatgagccgggggagcaagctccggtggctgtggcgcgcgccggcgcgggcgctggggcgggcgcgggacctgtacgtgcgtgggctgacggggtgcgcgcgccacgtcccctccgacgccgcgttcgggtaccccgtgttcgtgccggcgccgctgtccaggagccacagcgccgtcggctgggccgccgggtcgtccgaggccgacgaggacctgcgcgagctggtccgcgccgcgtcgcagcgccgcgtggagcagcgccgcgccgagctgcaggccgtggcccggagccagagcatggccgcctcgctcttcatggcgcgcatcgacgaggacgcgccgtgcgactttggggcgccc

SEQ ID NO: 28407 - DNA, 445 bp, Zea mays
  Clone ID: cC-zmle189072b04a1
aaataaggccatccaatgggctggggggttaatgaattattacaaaacagcatgcagattgtaccatgtttattattacaatatgtataatatgccaagattttccacttggacttgacaacaagagtgaatataaagaggcaggaaattacatatgcatagggaaaacagacgctgccagttcggcatttccatccaaaactgacaaaacgccaccatccggaagctgattattgcggtgcactctgcaggtgagtgaagagaagccgcctagccagtgttctgcatgccggcggcgatgcccttcatggtgaggatgagcgtgtcttccaggccgggcgggtactcgctcgccgggttcagcttgaccagtccggcgggcttgttctcgtcggcgaactccttggacagcggcggctggggcgtcaccttgaagttggggtcc

SEQ ID NO: 28408 - DNA, 527 bp, Zea mays
  Clone ID: cC-zmle189072b04d1
gccgacgcgtgggaagtggaagtgcagtgatgtatgcagctgatttatcctatcgaacgaacgatttgaacgccgggttcagggtcgccatcgacaaggacgtcaggaacttccaggtcctcaaagagatgtacaacgagtggccattcttcagggtcaccctggacctgctggagatggttttcgccaagggagaccccggcattgccggcttgtatgacgagctgcttgtggcggaagaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcgagtac

SEQ ID NO: 28409 - DNA, 562 bp, Zea mays
  Clone ID: cC-zmle189072b05a1
ctactcgctcatctccgcgttcaacgttcagaaggcgatgcgcggcctcggggttacagatgctgaccactatgggaggcttggagtcaccaggctagcttctactgatgaggtaaaagctgcgtacgagaagatgtgtgaagaactaaatagcaaagaactagaagaagaggagcttaacaaggaacatgagctcctaaaggaatcatttactatactatcaaccgaggaagaatgaagattatatgattggagcttgtcaagaagtggacagcctgagcgatatgtctggccatttgaagttgatccattggagttggcaccagatcctccaaaggaaccagaagatgagttcccaaccaagctcgttggctacttcttactggcgtggttcatactctctgttggcctctcggtggccctcaacaaatgaagattttctccccaaaagaacatgaattgtaatccaataatctctctgccatgtacatcaatgacgctgctgtgtgcacagaagcatatggatgtacatgccatgctcttgcaattagccgaaacatat

SEQ ID NO: 28410 - DNA, 420 bp, Zea mays
  Clone ID: cC-zmle189072b05d1
cggttgaaaatggggatatgggtaattcaagattgggaaaactccaggcacaagattcacgacttcaatctgtgcaaaacgtgttgttatatgtttcggctaattgccaagagcatggcatgtacatccatatgcttctgtgcacacaacagcgtcattgatgtacatggcagagagattattggattacaattcatgttcttttggggagaaaatcttcatttgttgagggccaccgagaggccaacagagagtatgaaccaccccagtaagaagtagccaacgagcttggttgggaactcatcttctggttcctttggaggatctggtgccaactccaatggatcaacttcaaatggccagacatatcgctcaggctggccacttcttgacaagctccaatcatataatcttcattct

SEQ ID NO: 28411 - DNA, 84 bp, Zea mays
  Clone ID: cC-zmle189072b06d1
ggattttgccgaggtcatgctatacgttaagaaacgagcttatgttttacagatttaacgccaatgacggggaagtgggagcgc

SEQ ID NO: 28412 - DNA, 417 bp, Zea mays
  Clone ID: cC-zmle189072b07a1
gaattccaccacggatagtacgggtccgagcaagaatggggtaaagtttcacatgatcaccagtcggctacatagaaatagcagtaacgcgtccttcatttttatggaattacaaactacacatctgctaacaaactatagggaatatatacagcaacgaccaatacaattgccaaataactttccgactatatatgtacaccggaaattgggcatagctatgtaatctggaacgacggtggaacagctataatagtggtataagtctgcttcacctatggttcaagaactaggacccccctgaggactggtaatgtaaaccagttcgttgcggtggagcggctgaaatatttcgcctcaccttatgattcttaggcgctaaaacccttgtggatagaactccagcggacgcgtggg

SEQ ID NO: 28413 - DNA, 428 bp, Zea mays
  Clone ID: cC-zmle189072b07d1
cgcccacgcgtgcgctggagttctatccacaagggttttagcgctcttttaattttaaggtgaggcgaaatatttcaggcgttcggccgcaacgaactggtttacattaccagtcctcaggggggtcctagttcttgaaccataggtgaagcagacttataccactattatagctgttccaccgtcgttccagattacatagctatgcccaatttccggtgtacatatatagtcggaaagttatttggcaattgtattggtcgttgctgtatatattccctatagtttgttagcagatgtgtagttcgtaattccataaaaatgaaggacgcgttactgctatttctatgtagccgactggtgctcatgtgaaactttaccccattcttgttgggaaatgtactatccgtggtggaattcttgcatcg

SEQ ID NO: 28414 - DNA, 333 bp, Zea mays
  Clone ID: cC-zmle189072b08a1
aataaggacctgggccttttttttttttttacagggaaccctcccaaaacaattttttgaaaaaaatggaaccggaccccaacccaccaaaagaggccccccaaaaataaagggcattgaccccaccctggattttccgcatcactgcagcgaccactaaaaagaccgccccctggggggggacacaacaggcccaaaaaatggatcattgatcctcgaggggggccaataccggaggaaaaaacccccaacaatgttcctcactggaaggggacccccgctgggggaaaaaaaactcttgttggggttgtttcccaaaacaaaaacaaaaac

SEQ ID NO: 28415 - DNA, 576 bp, Zea mays
  Clone ID: cC-zmle189072b08d1
cgccccatggcgatccgcatcaccgtctcctactccggctacgtgttttcagatttctcgccgcgtcgctcggccacgggttctggggcgcctccgcctcgggcagccgcctcctccatgacggcgcctggcgccccttctgcatcttcacctccacccgccagcccgagcagcaccgcggcagcggcagcgaccgccatgacggaggcgactacaaccacccgaagccccaggccatcgccgccggagctcactcgttgctgctcacgcgtgcgtgcttatcgtccaagtcgccgccgccgtctcttgccgtggggctgctctcggtgcttgcgcagaggacgggaccgacgcctggaaccaccggatcggcggcttctctctcaggctcgtcgccgatttccctcggtttcaaccccacctccttcctcccgttcctgcagacagcgaggtggctcccgtgcagcgaccttgccacctccgcggcttcggcaccctcttgccctccccgctcgctggcgccttcggctcccccccagaaagcgttgattggtgcctctactggttctaccggaa

SEQ ID NO: 28416 - DNA, 460 bp, Zea mays
  Clone ID: cC-zmle189072b09a1
ttttaattttttaatttttgatgtattgaagaacagagccgggaacgggggagcattttggaagttttacatgactggggaaaaaaaggacatgggattgtagcttttatgagcactgctactagtaatgttcacatagcatggctctgtaataatactgttgatcaccacatccaccagcagcaggcaatccggttgccaatgaggaggcagcctcagacaagcacctgagctgcagctagcctagcaatcggaaccctgaaaggggagcaagaaacgtaatccagcccagccttttcgaagaaggccacagaggaaggctttccaccgtgttctccacaaatgcccacctttaagttaggcctagctttgcggcccctttctgttgcaagctttaccagctcgcccacttccctttggttcaagaccttcgaagggtcatgttggagaatgccctgag

SEQ ID NO: 28417 - DNA, 444 bp, Zea mays
  Clone ID: cC-zmle189072b09d1
tgttggagcaccacaggaactggggcatcaagtgtctcttattcgccaagttgctgagaaagtgggggccagggggggcaagactatcgggtacaaagctggaacaatgattgagatccccagggcagctctggtggctgatgagatagcggagcaggctgaattcttctccttcggaacgaacgacctgacgcagatgacctttgggtacagcagggatgatgtgggaaagttcattcccgtctatctggctcagggcattctccaacatgaccccttcgaggtcctggaccaaaggggagtgggcgagctggtgaagcttgctacaaagaggggccgcaaagctaggcctaacttgaaggtgggcatttgtggagaacacggtggaaagccttcctctgtggccttctttgcgaaggctgggctggattacgtttcttgctc

SEQ ID NO: 28418 - DNA, 349 bp, Zea mays
  unsure at all n locations
  Clone ID: cC-zmle189072b10a1
ttttatagtatacttttatattgcattaacttacccccngggctatcggtacactactctagctatatctacctcatatacaaaccatcacatgatatatagatacacacacgcatgcatcatacatgcatctataatacttaattacacgcacgcgcgctatctctccatcgtgaagaatagagattgctagctttattcccgtccgatgatgatatggacgcacacatatatttatacatacattcttggttctacaataccttgacagtaatctgtatatatgcttcccgtattggttttggttggtttttattgtcttcaccgccttctttcatcctcttggatg

SEQ ID NO: 28419 - DNA, 431 bp, Zea mays
  Clone ID: cC-zmle189072b11a1
ccagcaaaatttcgggggattggggcttccgtaacatactaactattcacagcaaaagggttctttatctaagttttttttcctcctttttctaaaatttcctttttttttttggcttttcaaaattttctatggagaagggggaccccctgtaagctaaaataaaagaatcatatttctttggcccatttatgggctaaacaaactatgggaaaacttttcaccacagcaaattgaatcttgtactcaacccaaccaccgaaatctccatccccatccgatgaatatcagcgttcaagccttccaggggtcacaaccataccgatgcgagactttttccacgcccaccatctttgcatctagccatgtcatctgctcgcatccatttcctgcgggcacagattctaccgagttgtcaagcaagacaaaag

SEQ ID NO: 28420 - DNA, 535 bp, Zea mays
  Clone ID: cC-zmle189072b11d1
cgtccgcagaattgcttccaatgcaacagctggatgatattagagaacttaccttctctgcgccagagatctccatatgggaacgtaacccgtgctccagtgtgaactacggcagagtgcctggaagacactctatttcagaagagcggcagagttatttgaaaagattaggttaccctgaattgcattcttcaaatttcctcgaccttgatttgttgtcgtcttctgggaattcctgtgacgaggaagtttttgagaggtcatcactgatcaattcacctatggatgtggtcagcgttgaatcatctacgtcgtacagtgaacaaggacacactgatgagggaagggatgacatggatctttcccgttcaagcagccaggtctcagacgttcgggactattctgaccggcttgcgcactgggtcgcggatggaggcatgctttggtaaaaggccatggacttttgtcttgcttgacaactcggtagaatctgtgaccgcaggacatggatgcgagcagatgacatggctagatg

SEQ ID NO: 28421 - DNA, 386 bp, Zea mays
  unsure at all n locations
  Clone ID: cC-zmle189072b12a1
ctcccccccccccccccccttttnggatttaactgcaaaacttattggtggggaactggggattacaacaacaaaaaaacttgttccaatgaaaataaatcttattttttttcaagttacaacattactgcatatctgtatacaacacagaaacatacaaactttttgcaaactgagaaattctgacaagctaagcaaagctgaggtattttgaaacaaatacactaacaactggagcaacctataacacttggacaaataacctatgggtcaacagatgttagggccgctacaaccgaacctgtcgtgctgaacgcgcagctgacgtccgtgtaatctttcaggcacctgcttatttttgtggatgggtacaaccagggcttcac

SEQ ID NO: 28422 - DNA, 378 bp, Zea mays
  Clone ID: cC-zmle189072b12d1
gaagccctggttgacccatccacaaaaataagcaggttcttgatttattacacggacgtcagctgcgcgggcagggcgacaggttcggttgtagcggccctaacatctgttgacccataggttatttgtccaagtgttataggttgctccagttgttagtgtatttgtttcaaaatacctcagctttgcttagcttgtcagaatttctcagtttgcaaaaagtttgtatgtttctgtgttgtatacagatatgcagtaatgttgtaacttgaaaaaaaataagatttattttcattggaacaagtttttttgttgttgtaataaacagttaagcaccggtaagttttgcagttacttctataaaaaaacaagctattc

SEQ ID NO: 28423 - DNA, 320 bp, Zea mays
  Clone ID: cC-zmle189072c01a1
aaaaaaaaacaactgctgaaaatttattcccccccctttaaaaggggtaacccaatgattcaaaacccccaaatcccatgtccctcacaggtaaaaaccttctcagttcgacaagctactatttgccccctttaaaaaatcactcccatcccctattttatttaccctctcccggaaaccagtcccccatgaaaggctataaaaagtcttcgacacccaaaacccgatctacattttaaaagggaagcccaaaatttcctatcgggcccaaaaaaggaaaggttgattaattgcgggtgccacctccttttttgataaac

SEQ ID NO: 28424 - DNA, 492 bp, Zea mays
  Clone ID: cC-zmle189072c01d1
ggaaagctggaagagtgtcttcaattgctaatagaaagcatttgtatttcggaagcagcattgatggcaagaggttatggtcccagcaaagtccctgagattgtagcattgtggaaaaaggatctccagaaggtaaactcaaaagcagcagagtcgctggctgatcctaatgagtacccaaacttatttgaagactggcagattgctctcaacgtagaagctgctgttgcctctaaaaggagtatctatccaccggccgaggagtacatgattcatgctgaaaggtcaaataaaagttaaggggaagtttttaaaaatatgcatgtccatgaagagatggtaccagatgataatgaagatactgttcacgaggttattgaggatggtggagtagagagtcaagaagatgctgttgaggtcgatgcagaggatgacggagtagaagaaagtcaagatgaacctgttgaggttgaggctgaaggttcaactgaa

SEQ ID NO: 28425 - DNA, 443 bp, Zea mays
  unsure at all n locations
  Clone ID: cC-zmle189072c02a1
tttttattcccgtttctttttattagncgctggataggggaaaggggagattacacgctaacacgttcgcgcgctgggcagaaaccaaagcaattattaacgcatccaggtagcccagccgaattacaacgcgcagctgctcataattcaacaaacccagtacacaacatccagaccgaccgtgacttttgacttggaaccaaaataaaacccgtacgtaccacgtcctacacaagcagcaacactcactgccagtcacgcgatccaccttaaaaagcacacggaccttgaccaggcgatccaccttgaaacaaacttttggtaaaagcaaaccataaccgaacccacatgccaacgctagctaccttctgatcgcccaaagcccggccacggccaggacacgcgctgcgactgcgaccttatgagctggtcctgtgctcgcc

SEQ ID NO: 28426 - DNA, 457 bp, Zea mays
  Clone ID: cC-zmle189072c02d1
caaaaggcactgaagaagccagtcaatagcgagttctactattagtatctagcctgctgatctgttctgttggggagttggcaaagccttctgtttcggcgaccatggaggatgagaggaacacccagcagcaccagggcggtgaggcccagcaggacgccgccgatcaggtggacgtgaaggatagggggctcctggacagccttctcggcaggaagaagcacgacgacgaccaggagaagaagaagcagacggatgagctggcgaccggcatggagaaggtcacggtgtccgagcccgagaagcacgggcacaaggaggaggagcacgaggtcgtcggcgagaagaaggagggccttctcgccaagctgcaccgcaccagttccagctccagctcgtcgagcgacgaggaagaggaggcgatcgatgagaacggcgagattatcaagaggaagaa

SEQ ID NO: 28427 - DNA, 399 bp, Zea mays
  Clone ID: cC-zmle189072c03a1
aacgctcgcgactggttcaagtgggagaggtttcctgactaccgtacagaatgctttcatcaaacagccacgttctgtgcgcagaaatattctattacaacgtatatccccgcacatgtaaatttagctactacaaggtaagcatttttgcttcacttagaccgactgtagaggcttaattgggagggcaaaacggcactgttaacacctcaaacagtgattgcctgcccagagaaatgtatactgtctactacaactccgattatatacaacccactgactggctggctgactgactgactgatagagaaacccaaagtgctgctctacatgctaatagaaggagctaagcttgatcagcaacccgaaaggactcggcgcctccgcatgcatcaggca

SEQ ID NO: 28428 - DNA, 471 bp, Zea mays
  Clone ID: cC-zmle189072c03d1
gccgacgcgtggggccactgctaagctgctccccgttcgccaggtttgcgtttaggcgaaacgtgctgctgcaagaagaagagggggtacacagacagcatgtccggagttcatgcgatgccggcggccgtgggcgtggcggggctgagagggtcagggttggttagcagcagcagtaccggcttgttcgccggcgactgcaagaggaaggctcgtcgcccggcgtgctcggcctgggccctcaggcagagccggatcggcagcaggagcaggagcaagaggggcctcggcatcgtctgcaacctcgcgggacagtacgaggattccttcgacgacgtccagcggcaactgatgaactacttcacctacaaggccgtgaggaccgtgctgacccagctctacgagctgaacccgccgagctaccgctggttctacaacttcgtcgctgtcaacaagcctaccgacggcaag

SEQ ID NO: 28429 - DNA, 467 bp, Zea mays
  Clone ID: cC-zmle189072c04a1
tttttttttttttttttttttttttttttttttttttttgggttttggggtttttttacccggggggaaagggggtaaaattttttcggaattgacatacacaaccctttttttggggaaaaaaacaagcagctcctggcctaaaaaatcgggcagaggcccaaaacacatccttttaaggggggatacaaatgctttccctggttatcgggggcatggactttggaataccatagattccctaccaaaacaccaaacgggggaaggaaggaaaccttacaaaacgtacatggggatacaacactaaaacaaggggtccaaacaattagcacgggacttatcactgggcctgaaccccgggagggaaacggggaacggtcccccccacaagacaactgaactgaactgaactgcccagggggggggggcaaaacaaaagaactggggaaaaaaaggccggcgggttc

SEQ ID NO: 28430 - DNA, 477 bp, Zea mays
  Clone ID: cC-zmle189072c04d1
ccgctggagctcgccaacttcatgagggccgtggggagggcgccctttaccattcgctccttcttctgaacccaccgggctctgggtcaccagttcctctgtcttgccgccgccgcctgtgcagttcagttcagttcagttgtcctgtgggtcggaccgttcaccgcttcactccacgggatcaggcacagtgatcagtgccgtgctagctgtgtggaacgcttgttttagtgttgtatccacatgtacgatttgtaacgtttccttgcttctcccgtttcgtgttttcgtatggtatctatggtattgcaaagtccatggccacgatagacagggaaagcatatgtatacaccattagaaggatgtgctctgcgcctctgcccgagtcttgaggacaggagctgcatgtatttttcaccaatataatggttgtgtatgtcaattacgaaaagatatgaacaccattaccaccgcgt

SEQ ID NO: 28431 - DNA, 95 bp, Zea mays
  Clone ID: cC-zmle189072c05a1
ctattcctcaccgccaccttttttgcttttattcctccccacatttattcgggggattggggtggttttatcatgggcatagcccctttcccccc

SEQ ID NO: 28432 - DNA, 328 bp, Zea mays
  Clone ID: cC-zmle189072c05d1
aacaaacacaagcaaaacaaaaaacaaaacaaaaaaaaaatttaacctaaaaaaaaaaaacaaaaccaacgggggacaggggggggactcctaaaaccctgacccaacccaacctactcggccagcagcacatccccctcctcccagctgccacaaaaacgaaaaggcccgccccgatcgcccaaccaacaggcgggcaacccccagggcgaaccgaactcaccctgcagcggagcaccccccgcggcgcgggcggtggaaacacaaacagggaccgaacacccgccctaaccctagcgccccatcctgaacgtccaaccgccccccc

SEQ ID NO: 28433 - DNA, 481 bp, Zea mays
  unsure at all n locations
  Clone ID: cC-zmle189072c06a1
cccccccccccccnncacctttcaccntccccttagcttccaattcacggggggtgatggggctcatagaattttacaatgagtaatatacaaaatatcattaaatcataattctcctaacaagaaaatattgtggcgctttagcactctgcattccagtaaagcatgtaagctatccatatgctatctaaaaatatcctctttccttcataggcaattcttgaaagagctttagtgactagtaactccctttacatgttcatactgctgctattatgctttgcagaccagctgtgattgttcacaatccctagtcaaagatcattttaacccgatgtattatcccttccttacatctcactgatgcgggagccttcagcaatggtcctgctcttgtgaataatctgctggactgactctgaaagaaaattaattctgattctcttcctcatcttgcttagcttcttgagccaattaaaca

SEQ ID NO: 28434 - DNA, 532 bp, Zea mays
  Clone ID: cC-zmle189072c06d1
ctcctttcgttcttaaggttaagatctccaacatgtcaggcattacatgtatcttcacaaggaggaggcaacactagaaagggaggccctgtcaaatggttatggtttattaaataaacacaaaataatggtgatatgtttaaataatagtggttgactaaataatatcagactttttattgtaatttcaatcagttgaataatagtttagcttttttattattgtgctcttttgcagatgagtggagctacattgttcaacctttcactgctaacatctgacatgtgggcagtcgccattcgagttttattctatcagcaagagataaacaggttgtactacctagcattcacagttgtggccattggattaatcatctattccttgaatgatagatcttcagatgatgaaacagctggaagtacagaagcaccagcccaatatcagcaacttccaattgaagacaattcaacaagaattggttctagttcaggaaaatgtttaattggctcaagaagcctaagcagatga

SEQ ID NO: 28435 - DNA, 508 bp, Zea mays
  unsure at all n locations
  Clone ID: cC-zmle189072c07a1
ctcccccccccccnnggattttaaagtttcttaagaagcgaaattcatattgggatggagttcacatatttacactaccanagcgtatggcaacaagaggccagtggtgtttgacggcccatcataaaagtagtttcacaaacatgagatgtcccatgatccaccacagatagggttcctattttcgtctatgtcgatgaccagcagatgatctggattcgaaccattcggcccctctttgtacagtgttggcagatatgcatggtatgccggtaggtagcgtgatacaaaatccataacctcctcatcagacattccaggctttccatctgctctcatagcgacctctgcctgcagtctccactggtaaacgctaccgggttctcttattttaataacaatccatgactggatgaacctgtcccaagcatcagagtatgcttcaaggttcttgttaaccacctccagctgtggatccacttcttcggacgcgtgggttcgacccggg

SEQ ID NO: 28436 - DNA, 462 bp, Zea mays
  unsure at all n locations
  Clone ID: cC-zmle189072c07d1
aagtggatccacagctggaggtggttaacaagaacctngattcatattttgatgcttgggacaggttcatggggtcggggattgttattaaaataagagaaccccgtagcgtttaccagtggagactgcaggcagaggtcgctatgagagcagatggaaagcctggaatgtctgatgaggaggttatggattttgtatcacgctacctaccggcataccatgcatatctgccaacactgtacaaagaggggccgaatggttcgaatccagatcatctgctggtcatcgacatagacgaaaataggaaccctatctgtggtggatcatgggacatctcatgggggtgaaactacttttatgatgggccgtcaaacaccactggcctcttgttgccctacactctggtagtgtaaatccgtgaattccatgttaataagaaattcccttcttaaggcacttttt

SEQ ID NO: 28437 - DNA, 460 bp, Zea mays
  Clone ID: cC-zmle189072c08a1
gtaagtttacttttttgggcgtccggcgagccatcggcagcagggacaggattcagcacagcagcaaaccactaggcagagcacaccaagcttcttggccaaatgctgtccctgcctcgccggaggtggagctgcggaatacatcaagaactgcctcctgcagccctgctaagggcacccaacgaattgtgcgcatgagaaatggagttaatctgggatggtgatctatctttctgtatctgaattgaaactcgtgctctggaaactcctcttttttttttttcctcagtgttccacttttaatcgtttcttctgcatccttgtgcatccataccactgtcgcgtagtgcgaattggtccaaccagctgatttttgtttgtttgcccccacccccaaaaaaacgatatgtttcatttcaaaaaaaaaaaaaaaaacccacgcgtccgcccacgcgttcgt

SEQ ID NO: 28438 - DNA, 461 bp, Zea mays
  unsure at all n locations
  Clone ID: cC-zmle189072c08d1
cgccgacgcgtgggcggacgcgtgggnccctcccccccccnnggttttgaattatatcgcccttttgggggtgggggggaacgggcaaaaatcatctggttggaccaattcncactacgcgacagtggtatggatgcacaaggatgcagaagaaacgattaaaagtggaacactgaggaaaaaaaaaaaagaggagtttccagagcacaagtttcaattcagatacagaaagatagatcaccatcccagattaactccatttctcatgcgcacaattcgttgggtgcccttatcagggctgcaggaggcagttcttgatctattccgcagctccacctccggcgaggcagggacagcatttggccaaaaagcttggtgtgctctgcctagtggtttgctgctgtgctgcttcctgttcctgctggggatggctcgccggacgcccaacgaagtactcttac

SEQ ID NO: 28439 - DNA, 221 bp, Zea mays
  unsure at all n locations
  Clone ID: cC-zmle189072c09a1
cccataatacaaaatgaaatgcattttttttaccacaacatcccattcataaacaataccacccatctantacctaacaagcatcaccacacaaaccttaaactgactaattctaacaaccatacaaggaatattatatctgtaccaatcactgcagaaaatgacttaggtcactacctctttttcctcctactcctcccggacacatgggtcaaccctta

SEQ ID NO: 28440 - DNA, 466 bp, Zea mays
  Clone ID: cC-zmle189072c10a1
ccctctttcttcttttttttttttttttgcatatatagaaggtagtacgggtcacgggggccaccttcaagtcaccactcaatacaaaacggtacaacacgcacacgtagtagtgagtgtaatgctagagctgcagaagacagagcagcccatgcatcgtcatcacagctactactaataacaaatcaaaaagtaccgagatggacacaacacaacagctcaacaagtacgtgcagccacaactgcagctatgggtggagcacatctctccgttcctgtcaaaggctcaaagcctggcggcggagggaagggggggctgcctagtcgcagcacatctcgcacatccagcagcagcagagcgccgcgatgcatccttcgatgaagcccttctccccgcgcgaggtcgtcttcccccggcgtccctgcttcctgccgctgcctccctgctgctccgcgcctgccgtcg

SEQ ID NO: 28441 - DNA, 542 bp, Zea mays
  Clone ID: cC-zmle189072c10d1
ggttgaaccacacgtccgcggacgcgtgggcgatcgccgagcgtgcgtgctctagctctttcaatttcagcgaggagacggtcgaggatggggcaggacaacagcaacaggcagcagcagcaggcgccgccgccaccacccgcgggctacccgacggcaggcgcggagcagcagggaggcagcggcaggaagcagggacgccgggggaagacgacctcgcgcggggagaagggcttcatcgaaggatgcatcgcggcgctctgctgctgctggatctgcgagatgtgctgcgactaggcagcccccccttccctccgccgccaggctttgagcctttgacaggaacggagagatctgctccacccatagctgcagttgtggctgcacgtacttgttgagctgttgtgttgtgtccatctcggtacttcttgatttgttattagtagtagctgtgatgacgatgcatgggctgctctgtcttctgcagctctagcattacactcactactacgtgtgcgtgttgtaccgtcttgaattgagtg

SEQ ID NO: 28442 - DNA, 303 bp, Zea mays
  unsure at all n locations
  Clone ID: cC-zmle189072c11a1
cctccctcccccccttttttctttttttccccctcccccccaaaggggatnggttttttttttttttctttcccccccaaaccctttntcctcccccccacgnnnaattaaaaaaaacctacaaccccccccaaaccaaaaaaaaaacccccccccccccccaaaaaaaacccccctccacacacccacacccctaaaaaaaccccttcccaaactaaccccctctaaccaaaaacaaccccccccggggccaacccagaaaaacacccccccccccccccccctgacccccattcccaaaaa

SEQ ID NO: 28443 - DNA, 255 bp, Zea mays
  Clone ID: cC-zmle189072c11d1
agtatggagagcagacttcttagatgtccagtattgtaaaagtagcttccagaacggagtgtatatgcgtttttatcttgttatcgggaactctgaaacttatcttacactacacacggaggaaacgctccaattttgttaaaaaaaaaaaaaaaaaaaaaaaaaaaaaaaaaaaaaaaaaaaaaaaataaaaaaaaaaaaaaaaaaaaaaaaaaaaaaaaagaggccggcccttttagaggaacggggcttccg

SEQ ID NO: 28444 - DNA, 400 bp, Zea mays
  Clone ID: cC-zmle189072c12a1
ttttgcatttattgttttccattttccctttttttaattgggggtatggggtattctattattacaataactacactatactactatattgatcgcagcccgtgtagacgaacagcgagtgtgtttatcgatgccacaccgcctccacttgctaacagcagcatcctatctggtgtttgatgattctcctccatctccgtccagcggcactgcaagaagctggtgatacatgccgccagaagggcctggcctggactgaggtgagctcaccggcgggtgaccagcgggaaccacatgtcgcggaaaccagggcgagcgcgagcgccacgccccacggtgacgacgacgcgccgtcccgctggccccatccgccgccgccggcgtaccaggagggctggtt

SEQ ID NO: 28445 - DNA, 572 bp, Zea mays
  Clone ID: cC-zmle189072c12d1
cacccgtccgcccacgcgtccggagcagctctagcatggcgagcggcggcttttacttctaccagagcgcgggctacggcggggacagggtactcggcggcgccgaggacgacgccgtcccacctcctggtgttcctggccaccgtggcgctgctgggcgccacgtcgctctactcgcgctacgagtccgcggtggagagcctggtggaccaggtgcggttcgccgtggtgctgtccccgctgctgctcctgctcgcggtccagtactgggcggccacggccgggtcccggcggccccggggcggcgccctcccgtcgctgctggccgggaaccagccctcctggtacgccggcggcggcggatggggccagcgggacggcgcgtcgtcgtcgccgtggggcgtggcgctcgcgctcgccctggtttccgcgacatgtggttcccgctggtcacccgccggtgagctcacctcagtccaggccaggccctttggcggcatgtatcaccagcttcttgcagtgccgctggacggagatggaggagaatcatcaacaccaaatggatgctgctg

SEQ ID NO: 28446 - DNA, 251 bp, Zea mays
  Clone ID: cC-zmle189072d02a1
taatgctgacaatcgaggggactttctttaccacacagacatcttgattatcccaccagatatcttgtcacattcaatgacctgctcaaccaacttatttgagcttcagttgttactgggacaaccccttattaaaatcaaagcttggagctccgtcttaaagtggggagctccacattgaattaaccaagagctcattatgtactgcgtaagaagcacctatgtatgcttatcttggaagggacacccaa

SEQ ID NO: 28447 - DNA, 489 bp, Zea mays
  Clone ID: cC-zmle189072d02d1
gtccgcccacgcgtccgcaccacacacacgcacacacactatcgtccattaagctcgctgttgcttgccacccaccgcctgagctcgatcgcaacgcgcttggcatggcgtccgaggtgtggctatcgccggcgtctcgcctcccatccctctccaacgcaccacctcgcttacgctccaagcctgccaccacaaccgcctctttgctctctccctgtccccgccctgcccgcgccctgcctgtgctgcgtgtccgtcgccgccgccgacttcgcgccaccgagcagcaaggccaggttcaggagcaagatgacgaggtggtggacaggaacatcctcccctactgcagcgtcgtcatgctaaacgaagatgagcaaaagcttttggaagcttccttggcctatacctccggcaacccaatcatgtctgatgctgagttcgacgaactgaaacttagattaaagacagacggcagtgtcattgtgaagg

SEQ ID NO: 28448 - DNA, 414 bp, Zea mays
  unsure at all n locations
  Clone ID: cC-zmle189072d03a1
gatcctctagagcgaccgccctctcccccttctttttttttttttttttttttttttttttttttttatttgtnttgggttaatttttatttcctttcccccccacccccatattattacttttttatatttaaaaaccacaaaacccaaccaccccaaccccaaaaaaaaagtcccaaacaaaaacacagatatacaggcaggcaaaaaacacccccgacaaaaaaacccgaacaacttgtactcacaccccaatgcaacacaagcaataacaaaaaaacaccacgcccgccaaaaatagaccacacccccccccgagaaccaaaattaaaggagccgaattttcaccccccccccccccttgaccccccgaggcccctcaaaccaaaaaatcccaaaaacaacaaaaacccc

SEQ ID NO: 28449 - DNA, 541 bp, Zea mays
  Clone ID: cC-zmle189072d03d1
cgcccacgcgtccggaaccggaaagtggtgtgaaagtacttgaagtttgaggttatgtacaaggcatatatgaccggggaccgggtagatttggttcagaggcgatttttgttcccaagcatccaggtgtgtctggagaagaagatgacggctatttgatattctttgtacacgacgagaacacagggaaatctgaagtaaatgttatcgatgcaaagacaatgtctgctgatccagttgcggtggttgagcttcctaatagggttccttatggatttcatgccttttttgtaactgaggaccaactggctcgacaggcggaggggcagtgaaaatacggcacctgcagattctgcacacgcgggtacaggttggaaattattgcagaggacatgtatatgtatatgacaagtttattacacatgtattcgaaccacacattacacgagtttattgcaggacgtgtattcgaaccacacattacacatgtatatgtataggacacgtttattacagtcctggttgattgcaatttgcaaat

SEQ ID NO: 28450 - DNA, 475 bp, Zea mays
  Clone ID: cC-zmle189072d04a1
aaaaaaaggaaaaatgttttttttttatttttttttttccctttaacaaaaaatttaaaaataaaaaaaaaaattaaaaaaaaaaaaaacaaaacccaatacaaacacaacaacatttcaaaaaaaaaacaaaaaaaaaaaacactaatcaaaaaaaaaaaaaaaaaaaaaaaaacttttgcccaaaaaaaaaaaaaaaatttattaacctccccaatccaaccaaacaaaaaaaaagtaataaaaatctccctttttttttttaaaaaaaaaaaaggtgaggggggaaaaaactatcacataaaaaaaaaaacaacactcctttgtaaaaaaaaaaaccccaatggggacacccacaccccctaggggaaactaaaaataatttaaacccccctatattcccaggttgcaaacaaaaaaaccccaaaaaaaaaaaaaaaaaacaacccccccacaaaaaaaaaaaaaatttttt

SEQ ID NO: 28451 - DNA, 293 bp, Zea mays
  Clone ID: cC-zmle189072d04d1
ggcaattgctgaatttgctgagtctttgttaatcataccatttgtactatctgttaatgctgcaaaagatgcgactgagcttgtagcaaagcttagggcatatcatcatactgctcaaacaaaggccgacaagcaacattattcaagtatgggccttgacctctctaagggtatcattcgcaacaaccttgagtatggcgtgatagagccatcgatgagcaaagtaaagatcattcagtttgccacggaggctgccattactatcctgaggattgacgacatgatcaagctta

SEQ ID NO: 28452 - DNA, 394 bp, Zea mays
  Clone ID: cC-zmle189072d05a1
aaagaaacaggggattcgggtttgcatatactgaaattttgaagtgtcacaaaatgtatatacacacacatttatgtctacatctttattgggaaaattccatcaccttcttctccgtcaataaagagacatgaatatcttatctccatggggtaacaaccaatcttggcaactgcataccctggacatttcatttgcactaattttctggaattggatcataaccctggggttcttcaaggggaactggagctatagcagccaccacaacagaggccccaaatgacacgacaaccaatgctgtgaagttcactaaaaatgcctctgtgccatatttgtcgagacctgagctctcgaggaaagggagcttctcaagaaagcccagttctgcatt

SEQ ID NO: 28453 - DNA, 516 bp, Zea mays
  unsure at all n locations
  Clone ID: cC-zmle189072d05d1
gattcgacacgtgcttcttccctggtgctgcgccaaactttaatattggtgttcttccttggcacgtacggtttggggtctttgtctacatcttatcactggctaatgcanaactcggctttcttgagaagctcactttcctcgagagctcaggtctcgacaaatatggcacagaggcattcttagtgaacttcacagcattggttgtcgtgttatttggtgcctctgttgtggtggctgctatagctccagttcgccttgaagaaccacagggttatgatccaattccagaaaactagtgcaaatgaaatgtacagcgtatgcagttgccaagattggctgttaccacatggagataagatattcatgtctctttattgacggagaagaaggtgatggaattatcacaataaagatgtagacataaatgtgtgtgtatatacattctgtgacacttcaaaatttcagcatatgcaaaactgaatatcctgcttcataannnaaaaaaaaccacct

SEQ ID NO: 28454 - DNA, 456 bp, Zea mays
  Clone ID: cC-zmle189072d06a1
aatataatgggcatgttttatggagcgtaaggggtccgaagggaactaagaccatataagctgcagggccaataaatccagtgagcagaaaaccaggacaaaactttagattgacaagaggattatttcctgatctccttgcatgtatgtaagacgttcctttatgcttttgcttgaagcataaagatgctgcagtggtgccgctagttaatcccatcaaatgcccaagatggccatccgagagcaatcatggctccttgttgctggaggttgatacttctgcactgcacatagggcataccttatttatttgcagccactggtttatgcattcaggatggtataagtgcttgcagggaagtgcaatcaaagattcaccctcctccaattccacacggcaaattacacattgctctgtgttgccatcctgaacactttgcatcttgtatgttactg

SEQ ID NO: 28455 - DNA, 525 bp, Zea mays
  Clone ID: cC-zmle189072d06d1
ggagagggagagggcgagggcgccgaggggagcgattacttttgaattttacgaggaggacgaagaagggggggcgggggtagatcccgcggagtttgagaacgatgaggcttatgcgcgtgcgctgcaggatgctgaggagcttgaggtcgccgcgcggcttatggctctcgctggtctcagcgattggcgaactgtggatgtggagcatgaggaggatcatgtgaatgacccacaggaggcatggcaagaggttgatccagacgagtactcctatgaggagctagttgcattgggtgaagtagttggcacagaaaacagaggtctctctgctgatgcacttgcttctttaccttcagtaacatacaagatgcaaagtgttcaggatggcaacacagagcaatgtgtaatttgccgtgtggaattggaggagggtgaatctttgattgcacttccctgcaagcacttataccatcctgaatgcataaaccagtggctgcaaataattaaggtatgccctatgtg

SEQ ID NO: 28456 - DNA, 471 bp, Zea mays
  Clone ID: cC-zmle189072d07a1
gcctataacgatgatgaacttcattggggtgacgggtttttttcaccaaccttgcaaatattttccaagtatcaactgggaaccgacaagcagcggaaaagcaggggaggggggcaaaaaggctttaatttaagatcacatgatggaccgacagccattacgagacaagtctcaacaaaacaagacccaggccccagcacagctaatgacacacctacgccaatatgaacagggcagataagttgaacgccggtaaccattacggtggaattgttgtagcacacagataagctgctataataataaggcgcacgagaatctccattcttcgtcaggatggagaagacaaaataatgtcccgtataagactcctgcagaccacaatacgccacgtaacacattttcctacctcccacgcttaacctggtcctctaggtgcaccctcatgttgacccatctgtggcccaagca

SEQ ID NO: 28457 - DNA, 573 bp, Zea mays
  unsure at all n locations
  Clone ID: cC-zmle189072d07d1
cgccgacgcgtgggagggaatgaattcatgagatcaaaccaacattttaaatttgtagagctgtacacctgtgccggggcatggaaccaacaaaatgccatttactattgcaacagggctgctgcatatacccttcttaatatgaacaacaaagctattgaggactgcctgaagtcaattgaaattgaccctcactacagcaaagcatatagccgactcggatctgcttattttgctatggggaattatcacgatgctctgtacaagggatacttgaaagccgccgagcttgatcccagtaatgaaaatgtcaggcagaatattgaggtcacaaaaaagaaactggctgaacaacgagtcccaccagaagagcagaacacacatgcaggccaagctcaaggaccacatccaatatttacacagtggtggtgttcctttcaatctgtttccaccaggtagttctccagttcaagaattcttcgctggctggtcgtncgatgttggtgcaccaccaccaggacattcgatacgtataaatttgaatgatatttttggccaagcaaatgtcaatgc

SEQ ID NO: 28458 - DNA, 459 bp, Zea mays
  Clone ID: cC-zmle189072d08a1
aaaaaaggaaaaagggaaattttttttttttttttttcccctttccccttttttttttttttattttttaatattctaaaccaaaataaaaccctaaaaaattttccaaaaaaaaaaaaaaaaaaaaaaacccaaaaaaaatttcaaaatcccaatcttttcaaaaaattaaataccccaaaaaaaaaacaaaaaaaaaatcagaaaaaaaaaaaaaaaaaaatctgggtcactaaaataaaactaacaaaccctttttccttcctcaacaattaccggggggtaaaagtaaaaaaaccctcaacaactgtttaaaaataaacccccaaacttccccaaaaataatttttcttttaaacacaaaaatatttttttttttctcccataaaaaatcatacacctaaaatatccccttcaccctgtccccaaaaaaaaaaaaaaaaattcaaaaccctttta

SEQ ID NO: 28459 - DNA, 403 bp, Zea mays
  unsure at all n locations
  Clone ID: cC-zmle189072d08d1
cgcccacgcgtgcgaaaaaaaaaaaaaaaaaaaaaaaaaaaaaaaattaaaaaaaaaaaaaaaaaaaaaaaaaaaagggacccgggggaaaaaaaaaaaaaagaaaaaaaaccccccccccaacaaccccaaataaacacccccattaccccctccctaaacacccccaaaaaccaaccccccatccacccccccaaaacctccccaccgaaaaacccccccccccccccccccccattacccatccccacaacccccctcctccccccnccaaaaccccaaaaaacccccccccctccccccccccccacaaaaccccccccaaacaaccccaaacaacccccccctgggggggggagaaggccccccacccgtaaatcatacccccccccttacccccacc

SEQ ID NO: 28460 - DNA, 521 bp, Zea mays
  unsure at all n locations
  Clone ID: cC-zmle189072d09a1
aattatctatactgtattaaggttaggtatcacggaacacaggaacatttcgaggtacagatgtctcgagtcaacttagggcactagcaatgcaagagagtcttaccagaaaacgcacgcgcctacggtatacggctgccgaatttacatcagctctcgctgtcctttttagtttaacgccgcatcattccaagtcacgtagactactatgtctgactagatagtatgcaacacaactgccatttccttttcccttactactgtaaatcagtcttcaccaatatggaggatacaaatacaacacttaatttgagcagatcccttgtcctttcatcagcgcctactacccaggatgttagcccagccgagtccagaaaatcgtatcgccagtcagatattggtagattgcgtgtaaaggtggtctgaaagcaactccgagacaccatgagcggtaagactttcacgtccaaagagtngtttaagcttcgagtcacacagtatcaccgtaggattctctggat

SEQ ID NO: 28461 - DNA, 489 bp, Zea mays
  Clone ID: cC-zmle189072d09d1
cgcccacgcgtccgctagtttctatcttgctccccaaaccagcgcttaccctgtcctgacaccggcagcgacacgtgggccgggggcgccatggtgctcgaggcaacgatgatctgcatagacaattcggaatggatgcggaacggcgactacgctccgtcgcggttccaggcgcaggccgatgccgtcaacctcatctgcggcgccaagacccagtcaaacccggagaacacggtaggcgtgatgacaatggccgggaagggtgttcgcgtgcttgtcactcccaccagcgacctcgggaagattctcgcctgtatgcacgggttagaagttggcgctgaggcaaacttggctgcggcaatccacgttgcccagcttgctctaaagcatcgccagaacaagaggcagcagcagaggattatagctttcattggaagtcctgtgacgtacgacaagaaagttttggagaccattgggaagaagctgaaa

SEQ ID NO: 28462 - DNA, 92 bp, Zea mays
  Clone ID: cC-zmle189072d10d1
gtccgcttgcagccaaaaaaaaaaaaaaaaaaaaaaaaaaaaaaaaattttattttaaaaaaaaaaaaaaaaaaaaggggggggggttttaa

SEQ ID NO: 28463 - DNA, 442 bp, Zea mays
  Clone ID: cC-zmle189072d11a1
ctctttttttttttttttttttcttttttcttttttttggggaaaagggtaaaaataaaaaaaaattttccccaaaccccccaaaaaaaaccccttaaattcccctcgggccacaaaaacaaacaaataaaaaaacccaattaaaaaacacatcaaaaaaaacaagaagaaaaacaaagcccccaactaccagaggtacaaaaaaagaaaaaaaaccatgaacaccaacactttgaaaaacacaaaaaaaaaaaggagggaaaaaactcttaacacaacaaacacccccaccccttttttaaagttgtgaaaaaatggggaatagttaaaaccgattccccccgcccaacaattgcatgagttgccaaaacttccccaaacccttgaacccaaaaaaccctcaaaaataaaaaaaagggaaaaaaatcaaaaaaaccccccc

SEQ ID NO: 28464 - DNA, 566 bp, Zea mays
  Clone ID: cC-zmle189072d11d1
cccgtccgcggacgcgtggggttctagatgaagatgcgggggaactcttttttgtttatgacgctgatgaggctagtgaggggaggggagatgagatactgcatctgggagatgggttggcagatgatggagaatatgactatgacgaccttgactcaaatgcatttgaagaggaaaaagatttacttagagatgacagtgatgtggaatttgatgacgtttcagatgatactgcatctggggatgaagggtcagaaaatgacgatgacattcctattctcgcgggcgattcagatggcaacttaagtgatgacgagatggttgatgctggtaagggcggtgtctcttacacaaagaaaaggagggcagggaagaagagtgggttgtctccatttgcaagcctggatgattatgagcacctaatggttggggatgctgatgcaacaacagcaaagcggaagcacatggcaacagggagagctggtggtgagaaaaaaccaaagttgagaccacgaaagaaaaggtcgcggagttcagaatgagaaacatgcctttacccttactct

SEQ ID NO: 28465 - DNA, 197 bp, Zea mays
  Clone ID: cC-zmle189072d12a1
agggacccggggatgtttttttttaatttcctaacgatacccacattgttacaaagtttccctatcaccttggactttagatcgtggctgatctatgtgaataggaggcgcctgtggtaaattagtatccgctcataaaccaaaataatatagaacccgtaaacaaaattagtaaacactccgggggccaatgaacc

SEQ ID NO: 28466 - DNA, 109 bp, Zea mays
  Clone ID: cC-zmle189072d12d1
ggttgaaccacccgtccgaaaaaaaaaaaaaaaaaaaaaaaaaaaaaaaaaaaaaaaaatttttaattttggcgcaccatctaaacccatccgggcttgggttcgcttt

SEQ ID NO: 28467 - DNA, 591 bp, Zea mays
  Clone ID: cC-zmle189072e01a1
ctaccttccttctccatttcctcccctttcccagtcgccccaagacactgctcagaccacgcctccaccgcctcgccgcgtccatcaacccctcgtccaccgacgagacccccgccgcggacccaccggtcatcccctcgatcagcatcaagaacactgagcccgaggaggtcgcccgccgccgcagttgggtggagcacggatgggctccgtgggaggaaatcatgacgccggaggtcgcctttgcgcgccacagcctcaacgagggcgaggaggtgccgcttcagtcgccggagtccctcgaggctttccggatgctcacgccttcctaccggaagaaggtggaggctgagccaggatacctggagcgcctcttcgcgacgcgcgacacgcccgagcctctcgagacgacgtgggccggccggctcccgctgcggctcgtgccgccgcgggactggccgccgcctggctgtgaggtggacccggacgagctggagttcataagggaggcgcacagggcggcctctgagaggctggacatggaggcggccgctgcggcaggtgtgaccaacgtggagaagctggatgatg

SEQ ID NO: 28468 - DNA, 475 bp, Zea mays
  unsure at all n locations
  Clone ID: cC-zmle189072e01d1
agctgntcagacttcagcagctagggatctggagaataaaatactggagattccatgctgaatacttgtactgagcgtggctagcacgcccccgcgtttgaccaatcggaatgtcagcaccagaggcggcggcccaacaacaacaaccaaggcaatcgaacctcttgcacaaccaacaactatctctaacctttcatttcgtgatgtaaaaccggttgtgcggggcgcgtggatcggtcatcttcttcaggtccaggtccatgccgtcatcgtactcctcctcgccctcttgcgcctcggccgccttcctccgcctttccctcgcttccaaccgcagcttcttgcggacgtagtcgtcgtacgacatctcgcaccacttcttcgcgtcgccgaccacctgctggttgtggcgctccacgttccgctccagcttcgtctttccgngttcttgggctcgccccagtagtcgtaccgg

SEQ ID NO: 28469 - DNA, 493 bp, Zea mays
  Clone ID: cC-zmle189072e02a1
tttttacttacaaaaaccaagaactcttgttatgaactgctaatacacagcagtgtatttcttatctaacagcggttttcttgcataatacttctatgtttcctcgtaacaaatgctatatttctaacctattaacccgcagcgggctgcagtgcagcaacacttgttttgtgttgtgccgctggatctttccgtccaccgttacaccgtacctaccgccttcctggccctcctgcaaacctcctggcagtgccgaagatgacggccttggtcaacaacccaccgtcgaaggtgcagcaggccagggccacagcgccaccgaccatgagaaccttgggtatgctgttcgcccagtgcttcgtcgccttgtcaacctctgcgccgtcgccggacgaagaagaactggcctccgtgttgcccggccctgcgatgacgagctcgtcggcactgaacctggtggtgacctgtgccatggcagcacacttggaaacag

SEQ ID NO: 28470 - DNA, 517 bp, Zea mays
  Clone ID: cC-zmle189072e02d1
cacccgtccggggaggaccgccggagaggctgtttccaagtgtgctgtcatgtttcaggtcaccaccaggttcagtggggacgagggcgtcatcgcagggccgggcaacacggaggccagttcttcttcgtccggcgacggcgcagaggttgacaaggcgacgaagcactgggcgaacagcatacccaaggttctcatggtcggtggcgctgtggccctggcctgctgcaccttcgacggtgggttgttgaccaaggccgtcatcttcggcactgccaggaggtttgcaggagggccaggaaggcggtaggtacggtgtaacggtggacggaaagatccagcggcacaacacaaaacaagtgttgctgcactgcagcccgctgcgggttaataggttagaaatatagcatttgttacgaggaaacataaaagtattatgcaagaaaaccgctgttagataagaaatacactgctgtgtattagtaagttaaaacaagagttcttggcttctgtatgt

SEQ ID NO: 28471 - DNA, 487 bp, Zea mays
  unsure at all n locations
  Clone ID: cC-zmle189072e03a1
tttttttttttttttttttttttttttttaattgaattgtttttttttaatttttttatttcccccttcccctttttttttttttatttttttttctttttttttcttttaaaaaaaaaaaaaaaaaaaataggttataaaaacaaagggatggaaaaaccaaacccccttaaaaaattaaaaacacccccccccaacaaaaaaaaaaccccctttttaaaacccccccttataaataaaaaaaaacccccccccaacattaaaaatttttctaaaacaacccactggaaaaaaaaagaaaaaaaaaaaccncccccccccccttggaaagagacccccccttttttaaaacacccctaaaaaacagaatataaataataatcttttcctttcaaaagccccaatgtccccaatctcttaaaaaaaacccgcccaaaaaaaaaaccccccccaaaaaaaccaaaaaaggttataaactctccccccc

SEQ ID NO: 28472 - DNA, 416 bp, Zea mays
  Clone ID: cC-zmle189072e03d1
gggccaaccacccgtgcgcggacgcgtgggtgaacaattcccagggcgtaccattttagcttttgcaccatctctggcagcacaggggctagagcttctgtgctctcttgggagatgcctctctacgctgccaggttatctgcaagccttggcacgctgcgccgtgaagcgaacagactagctgaactgccgtcttgagcggtgctgagcagaggacggtccatccaacagcgatggagtgcttgtttttttccctttctttcccagttgtgttctgaaactaatttaagctgtcgcggtttttatttgatagtgagtggtgttgcaaaggtgctatcttgtaacggtgaagtcctaactgatctaacacatctgcttcccatacccctgtaatatgccattttgttcttgatgcc

SEQ ID NO: 28473 - DNA, 462 bp, Zea mays
  Clone ID: cC-zmle189072e04a1
ttttgggtttccacgaacttattttccagatgggtaagggggccttgtcaattacagaacgaagtttgacgagttccaaatttcacgcgtgatctacactttggtacagaacaacttgataaggaaagggaaaaaaaaacagatctccgaacggcaatgcgcaaacatgaccactcagcctgcatggcaccaaccaatgaaaccacagcaaccgatggaaaatcctaaacaagctcaatgtacgccataggtgcattatctccccgcctcgggaacgtcgggatgatccttgtgtagccaccttctcggtctccatacctgtctgcaacctcagcaaacaaggcatggacgatatgcttctcataaataaatgccagagcctgtcttctcttgtgaagagatccatcctttgccaacgtgatcatcttctcgacatacttcctcattgcctttgcccttggc

SEQ ID NO: 28474 - DNA, 556 bp, Zea mays
  unsure at all n locations
  Clone ID: cC-zmle189072e04d1
cacccgtgcgccacgcgtgccaggcctccggatcaaaggaaagttttgttgtgtgggcttaccacacagctgctggggcatggggggataaagactacaaagccaagggcaaaggcaatgaggaagtatgtcgagaagatgatcacgttggcaaaggatggatctcttcacaagaggagacaggctctggcatttatttatgagaagcatatcgtccatgccttgtttgctgaggttgcagacaggtatggagaccgagaaggtggctacacaaggatcatcccgacgttcccgaggcggggagataatgcacctatggcgtacattgagcttgtttaggattttccatcggttgctgtggtttcattggttggtgccatgcaagctgagtggtcatgtttgcgcattgccgttcggagatctgttnttttttccctttccttaacaagttgttctgtaccaaagtgtagatcacgcctgaaatttggaactcgtcaaacttcgttctgaaatggaaaagggccattttttatctggaaaaaagttcgtggcctac

SEQ ID NO: 28475 - DNA, 302 bp, Zea mays
  Clone ID: cC-zmle189072e05a1
cgggccccggggtgttttttttttttttttttttccctttttcccaaaaacgggcccttggtggcattgacccccatgtccaaaacaatcgcccataatgaaccttttattcaacaagccccccctggatccaaaaaaaacacaacccccgatttaaataattggcctaatgccccccggggaaggaccaaaaggaaatccctgtggggatcccccccccggggaccccccgcttggaaaagggttttaacaattcttacggaaccaccccgggcccgaaggggtttttgccgacccctggt

SEQ ID NO: 28476 - DNA, 264 bp, Zea mays
  Clone ID: cC-zmle189072e05d1
gggccaaccacccgtgcgcaagaaccgctgcggcgccgggatcgtgccgtacgatctgctcttgcccttctccaagccgggagtcaggggggggggcatccccagcagcatctccatctgatccatcctcagcatgcattagtccaattaattaaatcgggggttgtactattattgcatgcagaggctgcttgtcgaataaaacgtactatatgtacgattgtattgtacatgtgtgtcaatgcaacaagaggcacgtttgag

SEQ ID NO: 28477 - DNA, 435 bp, Zea mays
  Clone ID: cC-zmle189072e06a1
ggaacgggctacggggttcttttttatttggcacgggttaatttaaaaataaactcgcagacgacaaatattcgagaacggaactattctaagggggcatcccaccagctacaaaatagacataggccgttctgatacgtactgcaagataacatatacccctgtggtccaacagcatgctatccgttactcattactacattattccagcctacacaaaacacaacaccatatccagattatatacagatagtaagtacttcagttccatcgagcaggctctgcaggtttaaaatatcctcgggaatcgggagcctcccacactcgcgcttagtagcaatcctggcttatgattccctgagtcactgggctgatacttaccgagcacgatatgagccccttccaggaatgtggaaacgggacaccttgatcgag

SEQ ID NO: 28478 - DNA, 503 bp, Zea mays
  Clone ID: cC-zmle189072e06d1
gggcgaaccacccgtgcgcccacgcgtccggcggcggcggcgaccggcgacggctagaaggttcacgcgcacctagggcagcctggggtcggggggccgcagccccctcaacaaccctactacgcctacccggccgcctcctacgtgcagcccgccccaccgccgccgccggccccgacgctcgtcttcgtgccgtccccctgctccccgatgctcgtgcgcctccgccgcctgcgcccgcgccgcgcgtcctgcctccgccgattctgcgcgcgcgcgctcccgctcctcctcttcctcgcgctcctcgcggggctcgccttcctcctctacccgtccgccccggccgcccgcgtcgccgacctccgtgtcgacagcttccgcgcgcagccgcccgtcctcggcctcggcctcgcgctgcggctccgcgtcagcaaccccggcttcgtcctcccgctccgctaccgcgcggtctccgccgccgtctcctaccgcggacacct

SEQ ID NO: 28479 - DNA, 400 bp, Zea mays
  Clone ID: cC-zmle189072e07a1
ttttgcatttaaatcaaagtaaaaaaaaattgggggttgggggttacatcccaatccatccatgtgcagaggaattgcatgtatccacgatgctcgtcactgctgaaatggcatacctttgcacgcagagaggaggatcggaggcggagctatattatatatatgcatctttatgaatttgtattctacttgaagtagtaggggaggtcgagcacgtagaggaggaagtatgcccagagcacgccggagataccaccgaagaagaaccctccggtgaacttggcccagccgtcggcggtctgcagcttgtcggcctccttcttccggccggtgagcgtgagcgtgggcgccgtggacgggtcgccctcgttgaaggaagcgacgccgtacatggtgaggc

SEQ ID NO: 28480 - DNA, 491 bp, Zea mays
  Clone ID: cC-zmle189072e07d1
cgtgcggagcaggcggagccgcccgacccgatccgtgcgtgtttgtttttagagatggctacagcagcttacgggcccggggcgagccaggtgatgaagagcagcccggtgcactcgaggccgaggggcctgtcaggcgctgcgctcacgcggccccggccccggttcagcgtcgtcaaggccgccatccagcccgagaaggcaacgtaccaggtggtgcagcccatcaacggcgacccgttcatcggcagcctggagacgcccgtcacctccagcccgctcatcgcgtggtacctctccaacctgccggcctaccgcaccgccgtgagcccgctgctgcggggcgtcgaggtcggcctcgcccacggctaccttctcgtcgggcccttcgcgctcaccggcccgctccgcaacacgcccgtgcacggtcaggcgggcgcgctcggcgccgccgggcttgtcgccatcctcagcgtctgcctcaccatgta

SEQ ID NO: 28481 - DNA, 462 bp, Zea mays
  Clone ID: cC-zmle189072e08a1
ataggaacaagcatttagcctgggcgaggaggtttacacatgctgttgaactgctgctgcacctttgtaaccttaagagagttagagtggtcatcaaaagtgatgctcacttgtcctctctccgtattaccgtctcccatgtcctctaatcatatcaacaagagccaggcgctgtaaaaaaaagtagtagtaggaattggaaccctacacgactcgaaatgattgggctatctgtttgaggtccttgtaatgcctcttccactgcagaccgtttgcagttacactgaaaaggtagagcctgttcccagctgccgtggcggtgatgaacacatggggcggctccagctcgaactggtagtaagttcttcccgaatgcgccgccgtcgccgaggacaggaccttcccttccacgttttctccgatgacctccggaccgaaggcggtgatcacctttttcgggct

SEQ ID NO: 28482 - DNA, 435 bp, Zea mays
  Clone ID: cC-zmle189072e08d1
accacccgtgcggcaggggagaatcgcggaggtctgggaaacaccatcttgcagatatgacagtgctgctctccccgagggcctcgggggtcctcgccaaaccttctgccgtcgccaagggcagggcggcggctgcggctgtgacgtgcttcagcgggccctccctgtcagtggggcgtgaagaggagggtgtagcagtggtggtggggaggcgtgcgttggcttccgcagcagctgtcgcctcagtgcttgggtttgcaggccgtggtctggcggccaaccagggcctgctcgccgggagggtccccggcttgtctgaacctgacgaaaatggttggagaacgtaccgcaggccagacgacaagtccggtggccacggagttggctggagccccatcatcccgtacagcttcaaagttccagacggctgggatg

SEQ ID NO: 28483 - DNA, 457 bp, Zea mays
  Clone ID: cC-zmle189072e09a1
gcaacaagcacttacttaggggtgggttaattttattcaccatcccacacgtttacccaaaatacatggtccgtctcgtgccggccgctctcttcccgtttacacgattgcttatattagcttattcatgtaccagctcgtacgtagcactcctggggtggtagtggtaccagtcgctcagatggagatgctgttggggatgcccttggcagtgagccctgcggcggcgccactgtggtcagaggtgttgggatagagcaacatgtaggggaactcggcggggccgttcctgttcctcagctgcgggtcgcggttctcgcccaccaccttgccctcgatcttgaccagcgcgtcgctgaacctcttgaacgccgccagcgcccgggcgtcggaggtccactcgggggtgtcgcgctggccgaagtacacctcgttggaagagtgcttggagaggatc

SEQ ID NO: 28484 - DNA, 438 bp, Zea mays
  Clone ID: cC-zmle189072e09d1
acccgtgcgcccacgcgtcctcggacgcgtgggggacaagaactcttttgaggtttgacgaggagttcgcgcgggaggggctcggcggcgtttacccgatggtgatcacgcgcctcacggagttcccgcccaagagcacgctggaccccagcaagtacggcgaccacaccagcacgatcacggcggagcacatcgagaagaacctcgagggcctcacggtgcagcaggcgctggacggcaacaggctctacatcctggaccaccacgaccgcttcatgccgttcctcatcgacgtcaacaacctggagggcaacttcatctacgccaccaggacgctcttcttcctgcgcggggacggcaggctcgcgcccctcgccatcgagctcagcgagccgtacatcgacggggaccttaccgtggccaagagcaaggtctaca

SEQ ID NO: 28485 - DNA, 432 bp, Zea mays
  Clone ID: cC-zmle189072e10a1
aaaaaaaataggggccgggaggaatattacagctttgtgaaaccgtccatatcagtgctctggacaagctcctcgatggcctccatcttctcctggatgtcgtcgacgctgaccttagcatcctcgacgtggcaagagatctggagcttcttgattccctatccgatgggtgtcaactttgaggccttccactcaagaccgtcaaggaccatctctctgacgagtctctccatctcaaccatatcggtggtatcgtcccaaggctttacctttatgaccatggcagacttgagagactctgccttctttccagtggcggccaacttctcggccttcttggcggcctgctccttggctcttttggtgatctcggcctggggctcctcatcttcctcatcatttccaaagagggggaaggccgcatcctttttt

SEQ ID NO: 28486 - DNA, 505 bp, Zea mays
  Clone ID: cC-zmle189072e10d1
cccgtgcggatagggggctcctggacagccttctcggcaggaagaatcacttctacgaccaggagaagaaggaggggatgggggacgacttcgacctctttggagatgatgaggaagatgaggagcaccaggccgacatcaccagaagagccaaggagcaggccgccaagaaggccgagaagttggccgccactggaaagaaggcagagtctctcaagtctgccatcgtcatcgacgtaaagccttgggacgataccaccgatatggttgagatggagagactcgtcagagagatcgtccttgacggtcttgagtggaaggcctcaaagttgacacccatcggatacggaatcaagaagctccacatctcttgccacgtcgaggatgctaaggtcagcgtcgacgacatccaagagaagatcgaggccatcgaggagcttgtccagagcactgatatcgacagtttcacaaagctgtaatcttcttcaatacatatattcttctt

SEQ ID NO: 28487 - DNA, 503 bp, Zea mays
  Clone ID: cC-zmle189072e11a1
ccggagtacttcggctttttccggatcaggccggcgagcggggtttaggggctctgcgtgctgatgctcgaggtcctgacggggcaaccaccggtggtcagtgtctgggacgcggcgaagcagggcgtggtggccgtgaccttggcgtcgttcgcgctgccgagcatccaggccggccggcttggggacgtgctcgacaggcgtccggcgccgcagcagctccagccgctgcagctggtggccaacatggcggcgcgttgtctgcatctgcaggggggtagtcgcccggccatatcagacgtcgtcgccaacctcgagcaggcactccgcctcatatgaaagcatgtggacatctttgcttgtacaaaagtgaacttgcttgtcgttcagctagctatgatgctcaaactgtgtctgtgtgtacgtttggtccgtgcgagtcctcctagtagaccatggtagacttgcaacatttgcgcaacatcttctactagagaagcagc

SEQ ID NO: 28488 - DNA, 459 bp, Zea mays
  Clone ID: cC-zmle189072e11d1
cacccgtacgcttttttttttttttttctttttttttttttttttttttttttttttgaattgctcgtacaattattggggggggcaaagcaatcaaaaaaatcatgggtaatggtggagcaatgcaaggaccctggcagccatatttgggcaccatcattgatgcaccctgctgcttctttagtaggagatgttgcccaaatgttgcaagtttaccatggtctactaggaggacttgcacggaccaaacgtacacacagacacagtttgagcatcatagctagctgaacgacaagcaagttcacttttgtacaagcaaaaatgtccacatgctttcatatgagggggagggcctgctcgaggttggcgactacctctgatatggccgggcgactacccccctgcagatgcaaacaacgcgcccccatgttggccaccaactgcaacggttggagcttt

SEQ ID NO: 28489 - DNA, 385 bp, Zea mays
  Clone ID: cC-zmle189072e12a1
gggtaagggggacattatttattcattttcaggccattacaacaccggcgtatgtcactttgctacaaacatccataggggtacaacacaacaagagcagcaaacgccccaaatcaaaccagtctccagtttacacccaggcaagcagcacgacccattaacttttactaggggttagattatcaagtagcacgcattatatacacagtacatcgcaggcccaagctatactgctaagcatcaaggagacatcaggatcttcctcgactcacggtcacgggtgccctcctggatgcaccctgaaccagcaagagagtttatccacacgtcatcggttctcaccggctcttcgtcgtcgtttctgtgccaggtccagtgggcatgg

SEQ ID NO: 28490 - DNA, 546 bp, Zea mays
  unsure at all n locations
  Clone ID: cC-zmle189072e12d1
cacgcgtccgttttttttttaaaaacttaaatatatgcattttttttttttttttttcattttacccagtcgtcgacgcgtcgggcacggataagtacagcacaacaatcacactagcttggaaggaaaattaaagcaagcaaaatgcagtggaaatacaaactgatcataaggcatgcatatataacgacgcatggctagaggcaaccaacgacgacacgctgtccttgtccagcctctggtatatctacagttcacgcctccggctgtccttgtccggcgggaggccatcgatctagcggctgaaggaggcagaccatcccagcttggcggcgctggccctcagcacgtactggtggtacgccgcggcgatggcggcgccgatgaatggacccacccagaagatccagtggtcattccaggccttgtcgttgttgtagatgacagcagcgcccatgctcctggccgggttgatgccggtgccngtgatggggatcgtggccagatggaccatgaacaccgcatacccgatggggagaggggcaa

SEQ ID NO: 28491 - DNA, 409 bp, Zea mays
  Clone ID: cC-zmle189072f01a1
agaggagcaacaggagctatatggggatggggaccaatatggatgcaatgtacacttactcacgcacacacgttacaaagtcaccacctgcaggcacctgccggccggcggcgcgatcgaggctgctgagtctgatcttaacaacgacgacgtagggatctagccgatgatctggtcgagggcgccggtgttcttgagcccgagcacgatgccgacgccgaggatgtggccgacggcgccgcaggccagcgtgtcggcgagggtgaacccggcggggtcacccgtctgcaggccggagtcgcgcgcctccagcttcagccccgccgtcgccttgcggttcgccgacggcgccagcccgaaccgccccgcgaacagcatcagcgtcgtcgtcgtcaccatgatcaggttg

SEQ ID NO: 28492 - DNA, 422 bp, Zea mays
  Clone ID: cC-zmle189072f01d1
accacccgtgcgcaacctgatcatggtgacgacgacgacgctgatgctgttcgctttgcggttcgggctggcgccgtcggggaacggggaggcgacggcggggctgaagctggaggcgcgcgactccggcctgcagacgggtgaccccgccgggttcaccctcgccgacacgctggcctgcggcgccgtcggccacatcctcggcgtcggcatcgtgctcgggctcaagaacaccggcgccctcgaccagatcatcggctagatccctacgtcgtcgttgttaagatcagactcagcagcctcgatcgcgccgccggccggcaggtgcctgcaggtggtgactttgtaacgtgtgtgcgtgcgtacgtgtacattgcatccatcttggttccaatggacatatagctcctgttgctcctctg

SEQ ID NO: 28493 - DNA, 373 bp, Zea mays
  Clone ID: cC-zmle189072f02a1
atggtattgtttttttttatttttttatttttccccttccttttttttttttttttaaaaaaaccaattttaaaaaaattaaaaaaaaatacccccacccccccaaaaaaattttctccccccccctttaaaacaaatttagggccaaaaaaacaagtaaaaaactcccccattcccaaaaaacccctttattacctccttacccacttccaaaaaaccctggaccccccctaaaactttcccttccccatcaaataaaacttaaataccctcccaaaaaaaaaaacttttttccttttgaaaaaccccccccccccaaaaaaattattaaaaaacttgtatctccccaaccccccgttttaaacccccccaa

SEQ ID NO: 28494 - DNA, 450 bp, Zea mays
  unsure at all n locations
  Clone ID: cC-zmle189072f02d1
aaccacccgtccgcggacgcgtgggcggacgcgtgggggccaccagngtttccaattttgcgcgcgcctacaccgtggagggcggggggggccagttcccctacaacttcactgggtgccaggacctcgccaagcagaagaaagtccccttcatcagcgacgacctcgagattgagtgcgaggggaaggagaagttcaagtgcggctccaacgttttctggaagtggtgaagcagctagcagcagcgtctgatgggaatggaggagatcatcacctgtcttgtcgaccctagatatgtccaaactgcagggaaattaaatcttcatgtgtaattgtgctcattctgtttcaatcatctcaacatccgatcntgaaaaaaaaaannaaaaaaccaaaaaaacaaggaagatggatttattaatgtgaaaaaattcaaacttttatgaaagc

SEQ ID NO: 28495 - DNA, 418 bp, Zea mays
  Clone ID: cC-zmle189072f03a1
gctgccaacagaatgggttcactttgcaaaaaggggcgacatttgaatacctttatttatgcattacttaattagtgagaattcacacatccattattcggcatgcccgcgttatttcatcgtatatatatttatttcaagttctggggcaaggaaaggaaatagcggctatcttatatattatcaaccgatgtggggcgtctgggcgaccatgtctaccaaaatgcggacaccgttagggcgataatccgcggtcaccacggagcccacgggcaacaccacgatgtcggcgtccggcttgtccttgaagatcaccttcttggcgtcctccacgctcagcccgaccaccttaagccactacttcttggtgccgccgccgccgccgccgcactccgtggagctcatggtgtcgcgaact

SEQ ID NO: 28496 - DNA, 460 bp, Zea mays
  unsure at all n locations
  Clone ID: cC-zmle189072f03d1
cacccgggcgcccacgcgggcggcaggaannaccngcccancgancatatcgtttacnggnccggcagnncgcgacagggtgaggggcacggagagcggcggcggcggcggcggccccaagacgacgaggcccgagggggncgggctgagcgtggaggacgccaagaaggtgatcctcaaggacaagccggacgccgacatcgtggtgctgcccgtcggctccgtggtgaccgcggattatcgccctaaccgcgtccgcatcttcgtcgacatcgtcgcccagacgccccacatcggctgataatatataagctagccgctatttcctttccttgccccagaacttgaaagagaggtatatacgatgaaataacgcgggcatgccgaataatggatgcgtgaaatctcactaattaagtaatgcataaataaacgtattcaaatgtcgccccttcctgca

SEQ ID NO: 28497 - DNA, 236 bp, Zea mays
  Clone ID: cC-zmle189072f04a1
ttttttttttttttttttttttttttttataaggaaaatggggttttttttttttttttttttataccattttcccccaatttattattatacaccattttttacaaacaccaacttataattttaaaacaaaaaaaaaaaaaaaacaaaataaaacaaaaaaaaaaaaaaaaaaaaaaaaaaaaaaaaaaaaaaaaaaaaaaataaacaaaaaaaaacataaaagccttcacact

SEQ ID NO: 28498 - DNA, 538 bp, Zea mays
  Clone ID: cC-zmle189072f04d1
aaccacccgtgcgggagaccgaagatgagaagaaggctgctgaagagcgttctgcttttgccaaggcttctggcaagaagagagaatgggggaagtcatcagttttacttgatgtgaagccatgggacgatgagactgacatggccaagcttgaggaagctgttaggagtgtccagatggaagggctgctctggggcgcatccaagcttgtcccagtcggatatggtatcaagaagctgcaaatcatgatgaccatagtcgacgatcttgtctctgtcgacactctcattgaggactatctgtgcgctgagccagttaacgagtacgtccagagctgcgacatcgttgccttcaacaagatctaggcgtgactttcgatcagtccttcccctggggtgctggcgatggtggtggctgggcaatgcaccagcctaatttttccatagctatatgtctgctttgtgtggccagtgatattgccgtgagtattttttggatcctattcgagtcgaatgtaccagtaccagagttaatttgc

SEQ ID NO: 28499 - DNA, 181 bp, Zea mays
  Clone ID: cC-zmle189072f05a1
ctctaaggcccctggttttttttacttcaaaaaaaaccccattttccagaccaaatataaccatcaatacaaaaaacaaccacgataagaccccaaaataacaacaagaaccaaaaccccatacaaaagaatttgaacaaacccccctacaaccaaaataaacatacaccaccctactatg

SEQ ID NO: 28500 - DNA, 539 bp, Zea mays
  Clone ID: cC-zmle189072f05d1
gggccaaccacccgtgcgagatacccgcacctggacctatcgagcagcgttggattgccctttcaagagcccgatgagcccggcatgaaggggtgaagaagatgatgtattttcatgggttggtattataatgtatctgccaacatctgatgctcgccaaaggaaggaaatcacagaggagttcttcagttacaggagcctggcgcgaagtctctgggatgattattccgcctatgaacactgggccaagatcgaggttccaaaagacaaggacgaacttgccgaactccaggcccggctgaggaagcgttttcctgtcgatgcatataacaaggcacgtatggagctggaccccaacaaggtgctctcaaacgccaagttggagaagatgttcccagtgttggagcctcctcaccagacaaagtaatacgtgttgaagagcgcagagcaagggcacgtacgtagaacttggttgcaggaggcttaacccatacacatttgtagcactgttagttcctgtcatgattctgggcccctac

SEQ ID NO: 28501 - DNA, 122 bp, Zea mays
  Clone ID: cC-zmle189072f06a1
gttccatgaacaaggagcacatttattccagcagagaagcaacagtttgccctcaaatttgggaccttacttcaattcgaaatattctttataactagcaggggggggggggggggattcat

SEQ ID NO: 28502 - DNA, 477 bp, Zea mays
  Clone ID: cC-zmle189072f06d1
gggccaaccacccgtgcgcccacgcgtccgcggacgcgtgggtttggatacaatgtatccattttccatcgtgtcatcagcgactggatgagggggggtggagattttgacaagggcaatggtaccggtgggaagagcatatatggacgcaccttcaaagatgagaacttcaaattggttcacactggacctggagtggtcagcatggctaatgctgggccgaacaccaatggcagccagttctttatttgcactgtcaagacaccttggttggacggaaggcatgtcgtgtttggccaggtcctggaagggatggatgtcgtaagtctgatcgagtcgcaggagaccgacagaggtgaccgcccgaagaagaaagtagtcatcagcgagtgtggggagcttccagtggtctaagtgttactcatctgttgtcggtcttacctaacctcggatggatgaatattttttccccacctg

SEQ ID NO: 28503 - DNA, 456 bp, Zea mays
  unsure at all n locations
  Clone ID: cC-zmle189072f07a1
ctcccccccccttttttaattacatccaacagnatagtagggggggaaacggggaacattaacatcattacacatcaaacaaaaaatatatatagtgccggtagaagacatctaacaggttgcaactgcgattctgtcctgagtttccatgatacatccggagctcctagtcagttcgcggttgacattcaaggtaggcctcaagccttgctcgcaatgttgctggacagccagtccaggccttcatacagaccctcgccagttgtggcacaagtgctctggatgtaccagtgtcgctggcgcagggagtgtaatccaagcttgtcagtaatctcagcagcattcatggcattgggaagatcttgcttgttggcaaaaacaagcagcacagcatcacgtagctcatcctcgttcagcatcctgtggagctcatctctggctttaacaacacggtca

SEQ ID NO: 28504 - DNA, 553 bp, Zea mays
  unsure at all n locations
  Clone ID: cC-zmle189072f07d1
acccgggcggttgactgtctgggatggcgggggncaggacaagattttacctttttggaggcattacttccagaacagcgaggggggtatctttgttgtggacagcaacgaccgtgaccgtgttgttgaagccagagatgagctccacaggatgctgaacgaggatgagctacgtgatgctgtgctgcttgcttttgccaacaagcaagatcttcccaatgccatgaatgctgctgagattactgacaagcttggattacactccctgcgccagcgacactggtacatccagagcacttgtgccacaactggcgagggtctgtatgaaggcctggactggctgtccagcaacattgcgagcaaggcttgaggcctaccttgaatgtcaaccgcgaactgactaggagctccggatgtatcatggaaactcaggacagaatcgcagttgcaacctggtagatgtcttctaccggcactatatatattttttggttgatgtgtaatgatgttactgtcaaacgtttattaccctactatactgttggatggtctt

SEQ ID NO: 28505 - DNA, 385 bp, Zea mays
  Clone ID: cC-zmle189072f08a1
gggacccaaaattgggggcttggggaacgttacaacatatatatatcatatatgcatggacaggtacaatgcctttccagcagcaccagcaacaagggtggttagcagcagggactataaacaacagagtaccatccgcgttgatagattttttattactgcaaaattgatccccgcagcactaccggtagttgcggtagacgggagtgtacatgcagttctctgcatatttcaccaggtcgctggggggaggcagacgggtcgccagaccgagctcgtaggcttttgcagccacggctgcagcgatgtgcgcagagatctttctgatgctggtgaaaggtgggaagatggagcccttctcgaagttgtcctgggtggcctgatc

SEQ ID NO: 28506 - DNA, 583 bp, Zea mays
  Clone ID: cC-zmle189072f08d1
aaccacccgtgcgcgcattctgaatgcactgctgaacaagcatatacatttagtcatttccgttcaatctttgccagtgggggtccaggggcccccgtggagtacgaaggaaagacttttgtgcctgggcagtcgaacaatgcctacattttccctggactcggcctcggtcttgtgatctctggagccgtccgtgtccacgaggacatgcttctcgccgcatcgaaagcgctagctgatcaggccacacaggacaacttcgagaagggctccatcttcccacccttcaccagcatcagaaagatctctgcgcacatcgctgcagccgtggctgcaaaagcctacgagctcggtctggcgacccgtctgcctccccccagcgacctggtgaaatatgcagagaactgcatgtacactcccgtctaccgcaactaccggtagtgctgcggcgatcaattttgcagtaataaaaaatctattaacgcggatggtactctgctgtttatagtccctgctgctaaccacccttgttgctggtgctgctggagaggcattgtacctgtccatgcatatatgatatata

SEQ ID NO: 28507 - DNA, 126 bp, Zea mays
  Clone ID: cC-zmle189072f09a1
ggggcttggggtgtaatttttaatattttcaccccatcaccacttaaaaaaaatattcactactccacctttcttctacacacattctatataagaaacaaaactcactccccttcttttcatttt

SEQ ID NO: 28508 - DNA, 211 bp, Zea mays
  unsure at all n locations
  Clone ID: cC-zmle189072f09d1
cacccgtccggcattgcatcattatggaaaagaatnaatcaaangattttgatttctacccgcgccgcgacacctgagggagtngggaagaatttatatacagtaacgagactatacccatcggaagatgaaaatgggtggcaactacaactcgtgctgctgccgctatgcatgaatcatcatttgatgcaattccatctgtcggagggca

SEQ ID NO: 28509 - DNA, 367 bp, Zea mays
  Clone ID: cC-zmle189072f10a1
aacatctgcagaaggaatctgggggacaggggacttcccattcctcgtttaggatttatggaatgaatgatacagttagagaagcatttccatgtcattatgcaccaccaccaaatccatctcctaaagataaaaccaaaaaaaatcctaactccaagaggggaaaaagatcaagggagaagaaacaagaggaggtacgatgggcgtgcaccaagaaaggctcaactcataggtagtagtaccactctgatggaccggaacggcggatagatcggccggtggcggggtgggctgggccgacgatggagctagcgatcaccaccagccgtacaccacgctggagcacttccccttgatccagtttacg

SEQ ID NO: 28510 - DNA, 380 bp, Zea mays
  unsure at all n locations
  Clone ID: cC-zmle189072f10d1
cacccgtgcgcgtaaactggatcaaggggaagtgctccagcgtggtgttctgttggtggtgatcgctagctccatcggggggggggcccaccccgccaccggccgatctctccgccgttccggtccatcagagtggtactactacctatgagttgagcctttcttggtgcacgcccatcgtacctcctcttgtttcttctcccttgatctttttcccctcttggagttaggattttttttggttttatctttaggagatggatttggtggtggtgcataatgacatggaaatgcttctctaactgtatcattcattccataaatcctaaacnaggaatgggaagtggattgttaagcacattccttctgcagatgttgat

SEQ ID NO: 28511 - DNA, 497 bp, Zea mays
  Clone ID: cC-zmle189072f11a1
ttttgctttcacaacgttacaacatatatatgggatatggggggacaggtacaatgcctctccagcagcaccagcaacaagggtggttagcagcagggactataaacaacagagtaccatccgcgttgatagatttttattactgcaaaattgatccccgcagcactaccggtagttgcggtagacgggagtgtacatgcagttctctgcatatttcaccaggtcgctggggggaggcagacgggtcgccagaccgagctcgtaggcttttgcagccacggctgcagcgatgtgcgcagagatctttctgatgctggtgaagggtgggaagatggagcccttctcgaagttgtcctgtgtggcctgatcagctagcgctttcgaggcggcgagaagcatgtcctcgtggacacggacggctccagagatcacaagaccgaggccgagtccaaggaaaatgtaggcattgttcgactgcccaggcacaaaagtctttc

SEQ ID NO: 28512 - DNA, 533 bp, Zea mays
  Clone ID: cC-zmle189072f11d1
caccgtccgggacgcgtgggaaaatatagcaagagccatcttgttttcaattatgatatccagggcacagcatcaggggtggttgcaggtttgttagcagcactcaagatggttggtgggaccctggcagagcagacttatttgttccttggtgctggggaggctggaactggtattgcagaacttattgctcttgagatttcgaaacagacgaatgctccaattgaagagtgccgcaagaaggtttggctggtggactcaaagggtttgattgttgactctcgtaaaggctcccttcagccattcaagaaaccttgggcgcatgagcacgagcccttgaaaaccttgtatgatgctgttcagtccatcaaacctacagttctgatcgggacatctggagttggaagaacattcacaaaagaaatcattgaggccatgtcttccttcaacgagaggcctatcatcttttcactgtcaaacccaacctcgcatactgaatgcactgctgaacaagcatatacctggagtcaggg

SEQ ID NO: 28513 - DNA, 304 bp, Zea mays
  Clone ID: cC-zmle189072f12a1
actacaaacaatgaatggggattaggggatacctccactggtggagcattcgtttgatagtgacaaaacatacagctgcgacctgaacaacggtataagctaaagctctatttaagtgtcaaaacaccggagcaaaaattcaattcaagacaatgttccgaataactcactttactagcaggtaaatgctgtttaacaagacagaagaacaaatgcagtaagatccccctactgcaggggcttctttactgctcacccggtgtagtcttgatgatatcagcccacgcgttcgcccacgcgtacg

SEQ ID NO: 28514 - DNA, 328 bp, Zea mays
  Clone ID: cC-zmle189072f12d1
cccgtgcgcggacgcgtgggcggacgcgtgggctgatatcatcattactataccgggtgagcagtaaagaagccggtgcgggagggggatcttactgcatttgttcttctgtcttgttaaacagcatttacctgctagtaaactgagttattcggaacattgtcttgaattgaatttttgctccggtgttttgacacttaaatagagctttagcttataccgttgttcaggtcgcagctgtatgttttgtcactatcaaacgaatgctccaccagtggaggtatcctataataaggattcattgtttgtagtaaaaaaaaaaaaatat

SEQ ID NO: 28515 - DNA, 330 bp, Zea mays
  Clone ID: cC-zmle189072g01a1
gaggctaccaataattatattcaaaatttataatggcgttataacactacaatgacatacagcaagaagcttacttccaacttttgacaaatttgtattcacttctctttgggtacattatttgggcacatccataatgacatcattctttacatgcattgtgatgtggcttcactaaaatggaactaataatggcgcttttaaacctgaggtatcttgctattaccctccttggcaaatttggcaaagccctctaaacctttgaaaaacaagctttccaaaaacggtttcaatgcttatgcaactggggccaaaattttaggaacttta

SEQ ID NO: 28516 - DNA, 533 bp, Zea mays
  unsure at all n locations
  Clone ID: cC-zmle189072g01d1
gggccaaccacccgtgcgcgacggtcgacggagagctgccatggccgcaggagcttcgttgttctactaccacccaggcgccggggaggtgagggtcgaggcggtcgccccgtcctctccgtcgctggccctgaggccatcgcagagcaaggtgctgtgcgtcagcagcagccggtggtggatgaggcgaagatgggaggggaaggcgagcagcgtcagcagcagggcaagggcaagcgcaaggcctgccttgttctcccctgtggccatggactggcaggagtgcactaccgagcttgaagttgatgttccatgctcggtggcctatcagtgttactcanaacgggagagtattcctcagtggatgccattcatctcgtctgtcaagatccttgaagataaacctgatctttcacggtggactctgaagtacgaggtgcttgggcgggatgtagaattttcttggcttgcacgtaacatgacacctattataaaccagaagatccattgggcgatctcttgaaaggtcttgc

SEQ ID NO: 28517 - DNA, 363 bp, Zea mays
  Clone ID: cC-zmle189072g02a1
ctaacttcatcacgggcacatgtattatttattttatttccgacacccaaaccccaacaaatcatagcaccgaccgaactgacacatcgcatgcataatgtgttcatccctctctaggaaggcaacaccgttctacaactaaaaaacccaaaccaactacaaatccaccgacccaaacatgtcagttgacccattattattcctccgcctgatcaacacattacacacttgtttccttcattcatctgtccgttcttctttttaggccccttcctcaagcaccatctgatcgaagtgccacaccccgtgccccttgcccactctcctcagatgggcgacatacttggaaatcctgattatggc

SEQ ID NO: 28518 - DNA, 392 bp, Zea mays
  Clone ID: cC-zmle189072g02d1
gtccgagatgagcaacccgggagcacgaggaagccataattaagattttcaagactggcacccatctaaggggagtgggggaggtccactgcgtgaggcactaccctcagatgctgcttgaggaagaggcccaaaaagaagaacggacagatgaatgacggaaacacgtgcgtaacgagtggatcaggccgtggactcatcttgggtcaactgacaactctgggtcggtggatttgtagttggtttgggttttttagttgtagaacggtgttgccctcctagagagggatgaacacattatgcatgcgatgtgtcacaatcggacggcgctatgcttcggagggaggtgattgtcggaaataaactccctaatctatgtcctgccgatgaag

SEQ ID NO: 28519 - DNA, 435 bp, Zea mays
  Clone ID: cC-zmle189072g03a1
acagcacgatttattctttaatggataagtccaactcttagctcttttccccctcaccagatatattataactatataagatgtgacctctacaatacagatcgaggattatgacatactaaaggtccggatgctgaagcatatatgtacaggcaagcgatcaaaactatgggccaagagagctgtgctacttatactcgcaacttaatcctacgctagcaatgtcataatttgatcacgcatgccatctttagacgagaccttcatccgaaaaccaaacttctgggatgttagctctcaccgccctttttatgttgaccgttgtagcttattgaaacctgacttccctttggagaactttgcccaactgtctgtgcaatatgtgatcttacaggggacagacttgtctgtaacgtcccaggtgactgaccatgg

SEQ ID NO: 28520 - DNA, 508 bp, Zea mays
  Clone ID: cC-zmle189072g03d1
gggccaaccacccgtccggtgggggccaaggcggcgcccgcggtccggctgctgttcatccttttcttccccagagcctacccgatgggcacgggagggaactggctcctgggaaagggacattttgcactaacgagaagagctgaactaaagacgttaggtgacatgcatggcaacgaggctggaaaaggtggagagctgactcatgatgaaaccactatcattacaggagctctggagctgactcaaaagattgcaaaagatgccatgactgctatatctgaaacattctcactagacatagatgctaagccggacttacacacaatgggcatgataatgactacagggcatagtgcgcgttcctatatactctgggatggcaagcaatattatcggccttatattggtgaaaaacctgaatacttgccgcgctgagatgaagtgcccatctcgaatgttactatcagaaaaattcaagggtggctgatgatcttcctctctatga

SEQ ID NO: 28521 - DNA, 515 bp, Zea mays
  Clone ID: cC-zmle189072g06a1
gtatcctcccgatcaagtatagattcaagagtatgtttttactggttacaactcaagcacgttaattttcatatggtattgtaggtacacatttacaatttttggcttccatcacatatcagcatctccaatacagttccaaaaaaaaaggtgagagaaaccaacaaggttacctgaatatagtggtacgtagtagattagtcccaacccttttcggcgggagaattccaaacctttctgtaaaggctgtcatcatatcgtacttacattttgcagttttccagatggacaggcgtcatgagcttccaggaagcacaccaaaccatcatcagatctatacatcctgtatcttcctttgaacatctattgctaccaattcttttagtttttctgtgtatgcatattctaaacctaaaagaatatcacaacctatttcattgatcttggaaatgaagatctgtatctcctaatgttgcatcatcggcatcgtcaaggtaatccacaggcacatttgc

SEQ ID NO: 28522 - DNA, 568 bp, Zea mays
  Clone ID: cC-zmle189072g06d1
gggccaaccacccgtccgcccacgcgtccgagaatatagatggtttagatccatttggaattattattctacaaaaagagagatcggggatggagcaagggtgcaaagtgggcgagcaggttattccattggcaaggaatttcaatggtgtgaacgctgatattgaatcacaaaatgtgccattggttgaaaacactgtggagatgaaagtaggggcaacttcttccagaaatgacgggagagctggccagttgaagtatgcaaacaacagggagactatcgccagcaaatacacttctattagagaacagaaccggcagtcagggaaggtagtgagaaaggaaatttcaccgaactctatatctttgctcgaagaaagaaattcagagcaggggtccaatgctggtgtaccaccaactggtgtgtctgcaacatgggcctcgatgaagattggttttcaaaatttcaaagcaaatatgggttctaagaagtttctttctttgcgccaagatccaggatttgttccaaatttgaatgtctcttcaccagaatctcttgatgacatatt

SEQ ID NO: 28523 - DNA, 515 bp, Zea mays
  Clone ID: cC-zmle189072g07a1
cacaaaagcatcacaattataggatcaggggcaactagatcatttacagatagctagctacatcattcacaaaagctccagagatgatcagtcacaaaagcaccacagcgacatcacttcagcttgaaacagttcaaaagcccacaactacatcactaatgttttatatcactctagctattgttcaaaatcccacaactacatcactctagctgctccagagctgatcagtcacaaaagcaccaaagctacactaacgcttcaaacagttcaaaagccttcagacaaccactccagcttcttgtatcctcctgttttaatgtacaagatttctttgtccagaacaccttggaagtacttagtaagggccttagactttcctgcccgcttgaagtgccttttgggtcaattacatagctcacagatctcaatgcacatgtggaagaagacatgaccaaagcagtatcactcttccttcaaatgccacgcaaatgtcacttatttgttctgaacta

SEQ ID NO: 28524 - DNA, 515 bp, Zea mays
  Clone ID: cC-zmle189072g07d1
ggccaaccacccgggcgcggtctctgcctctctgctagtttccccaaaaacgatttcctttttccgccgccccggtggccgtgggggcctggagtagaaaaatagagcaggcgtcggtggccgtggacctgtggaggagagcaggcgccgccgcgccagtgtgctgcgtcgccggcgagtgagccaaccactgtccactggtctgctcttgtttattcaatggccacgaaaggatctcatccagccgagctttctccccactatgtacctcatcggtgcacttgaagaagcgtcattgagcaccgttcggagattccccttcccagcatcatcgcctgaccaagatttgacacaggtcatctgtcgctcgagccataacgggcgtgatgtgatgaagaaactgaattttgtagtggaaatgaggtactcacatcgtgaatctttctaaaattgtggttatcaatgtgcactaggatcctgcaacaaacagatagacataaacctgctcataacct

SEQ ID NO: 28525 - DNA, 496 bp, Zea mays
  Clone ID: cC-zmle189072g09a1
aaaacacatattccaaacctaggggggcggagaatccatagtagcaacgtagcatacacaaaccatggttcttaaagcataagtcgagataagacgttggcctatcgactggacgcctaggcgagcaaggcgcctatgatttttggacgccttggcgacaccttaaaaacaatgacacacacacacacaccaagagaaccttaaaaacattgacacaccacacacaccaagagaacataaggtaacgatttaagctaccaaattaataaggttcagtactttctggtctaaggacatgtttgctctgcgccttaaaccaatcaagctaggctgattcttgattctttcactgtgcctgagacggtcagaaaccaacagtaaccattttatccaaacacatctaaacatactgccatctcagatttgcagaagatctcttgctatgttttggagctgatgaagacgccaaactgccaaaatgatgagggcatgaact

SEQ ID NO: 28526 - DNA, 344 bp, Zea mays
  unsure at all n locations
  Clone ID: cC-zmle189072g09d1
accacccgtccgtaaccctccttatgtgccaactcctgtggaagaagttttatgtttaggcattgcttcntcctgggcagggggttggaatggcctccaagtgattgacaggatccttcctgctgtgcgtgagatgctatcagaaagggggtggctgtacatggtggccctcgaagataatgatccttcagacatatgccatctgatgagcgagatggggtatgcatcccgcgttatcttgaagaggtgtactgaggaggagagcctttatgttctcaagttctggcgagacccacacgctgttacaagtgtgtcgccgaaatcttcaggctctgaatcatggt

SEQ ID NO: 28527 - DNA, 515 bp, Zea mays
  Clone ID: cC-zmle189072g10a1
tttttagttttacgaagaagttttattcagggggcgaggtgattgtcttaattcgtacaggagctgagtgcgtgcacgtacgatagccaagtacgatgaccctgcacaaccagtcaaccacagacatacataaggcacgcaggcaagcacgaacgggcgtggatgccggccgccgggcggctcagttagccctggcgaggaagctctccctgcgctcgtggacctcgccggtgcaggtgttgatgtcctcttcgaccctggtctcgcgcaccacgaagccgtggccgccgtggtgaccatggtggtggtggtggttggcgccggcgcgtgagaccgtgtcgacctcctcgaacttctccttgacgacgtgctgctggacgccgccgccgtggcggccgaagccggtcggggccaccgaccttaccttcttcgagcagtagtccacctcctggtagttagccattggtgccgacgcttggtgtgtctgtgcgcaacgcccgtgtgacgtcgaaatg

SEQ ID NO: 28528 - DNA, 533 bp, Zea mays
  Clone ID: cC-zmle189072g10d1
gtccgcacagcaatccacacaggcacttcgacgtcacacgggtgctgttcacagacacaccaagcgtcggcgggaagggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcagggagagcttgctcgccagggctaactgagccgtccggcggtcggcatccacgcccgttcgtgcttgcctgcgtgccttatgtatgtctgtggttgactgggtgtgcagggtcatcgtacttggctatcgtacgtgcacgcactcagcttctgtacgaattacgacaatatgctcgtgacctgaataaaacttcttcgtaatact

SEQ ID NO: 28529 - DNA, 428 bp, Zea mays
  Clone ID: cC-zmle189072g11a1
ttttaaatttagaacggcttcaaccgaattcagggttggggtgcacttgatattcttacagctcccaggccctcagaaagcaattaagcggcctcacgtcaggcatgcatctaaagctcgaaccaacaatagggacaacaacaccgtggcacgtacattaattatataccaccccccggccctgcagctgcatgcaacgcgggcgtgctcagttgtggcagaccttggcggtgggcatggtgacgcagatggccgcgtacttcttcttcgcctcgggggtcccgttcttggggcccgccatggcggcgccggcgccgccgatggctgccacggccgccgcagcagccgcgagcatgacggcgcggcgtccgtcggcggcgggcctggcctcggttgctgctagcgtggcgggctcctggcagcggtcg

SEQ ID NO: 28530 - DNA, 544 bp, Zea mays
  Clone ID: cC-zmle189072g11d1
cccgtgcgcaacgaagtgcgagcgacccacgtccacacgacacgttccatttccaccaaccagcagccgcaccaggggcggggcgcatagcgatggcgtcgctcaccatgatggcgtccttcgccgccgtggcggtggccgcgccctcgcgccgcggcaccttcgccgtggtcaggtccgccaaggtcgaccgctgccaggagcccgccacgctagcagcaaccgaggccaggcccgccgccgacggacgccgcgccgtcatgctcgcggctgctgcggcggccgtggcagccatcggcggcgccggcgccgccatggcgggccccaagaacgggacccccgaggcgaagaataagtacgcggccatctgcgtcaccatgcccaccgccaaggtctgccacaactgagcacgcccgcgttgcatgcagctgcagggccggggggtggtatataattaatgtacgtgccacggtgttgttgtccctattggtgggtcgagctttaaatgcctgcctgacgtgaggccgcttaaatgctttttgac

SEQ ID NO: 28531 - DNA, 304 bp, Zea mays
  Clone ID: cC-zmle189072h01a1
aaaaaaaaccgaggggggcccaccctacaaaaaccaaatcaaaccaaaaacgcagacagatagaccaaacaaaaaacaacgctcaaataaacacaactcaaacaaaccaccacacaacacaccaaaccgaacatgacaattaacctgaaaccaaaaaaaaacccatacaaaaaccaggcctaacaaccaccaacaaataacgacaaacacaccatccaaccaaaaaaacacacggaccttgaccaagccaaccacccagaaacaaacctttggaaaaaaaaaaccaaaaccctacccatatgcc

SEQ ID NO: 28532 - DNA, 449 bp, Zea mays
  Clone ID: cC-zmle189072h02a1
ctcccccccccttttttttttttgcagcaccaaaaaacaccatgggttcgggagattaacttacaataaagcccgacgggggtaacagcatccatcgatccgcagtccatgctgtttgatgcatgggtctgctgaaaccgaggatgaacacagcactaacaactgacacagagcgaccttgcaatcaaaaacacagatgggcaacaacaaacacgacacgaacgaagataaaccctctggactagggtaaacatcacggtagcgaacaggataacttggccgcgcgggccccaccgctcacttcctccagtacccgtcggagttgccgtaacccccgccacggttgccaccgccgtatccgacgacaccaccaccgtaaccgccgccgacaccgtagccgccgccaccgccgtaaccgccaccgccatcacggtgcccgccaccgccgt

SEQ ID NO: 28533 - DNA, 444 bp, Zea mays
  Clone ID: cC-zmle189072h03a1
gggccaaaaaaaaaaaccccatatttaaaaaaaaaattttacaaaaaccaaaccccggaaaaaaaaagggggtgaaaaaaaaaaaatcaaaaaaaaacaattttttttttcttcacaaaccaaattttgggacaaaaccaccaaaaaaaatttggaaaaaaaaataggggaacaagcaataaaaacttttgcacaaaaaccttaaacctaaataaaaaaaaaaaaaggatttttttaaaccaaaggccttgaattccccaaaaaaaagggggccccccttccaaaaaaacctaaaaaaaaaacccctaaaaataaaaaaaaagaataatagggattccctccccatctcaaaaaggctttttaacaaaaaaaaaaaaagccaaaacaaaaaaaaaaaacacccccatataaagccccaaaaagaaatttctttttttctttttt

SEQ ID NO: 28534 - DNA, 402 bp, Zea mays
  unsure at all n locations
  Clone ID: cC-zmle189072h03d1
ccgtccgcatgtgatgcgggaggagcctgctgttccgcctcttatccctttacttcttccaagatgcaatcatggggccgcgagctcctcgggccctcggccgccatgattgcctcaccgcctctcaagagtcgcctccacctacttccaagaggaagaggccggagaagctatagtccgtgaagaaatcaagcggaggggcggcggtgtatgaggggccggcggaggagagagagggccgggggaggtgacagaaagctagagagagagagagagagagatgcatgatggagcatgatgatggcgtggttgatctcttcgatctagcacttctatcattcgagtcaagaagccatcatcagatcggtgcagtcctccctcctctncctcctcctcctcctt

SEQ ID NO: 28535 - DNA, 250 bp, Zea mays
  Clone ID: cC-zmle189072h04a1
gggttccggggccccttccccaaaaagggagggatggggcatatatatatagcatcaaaattatgtaatgaaaaatacccccgattattgttacatgaccaagggtgaccatccatggaggctaaattataaacaaaccccctgattttacatgaccaatcccaaaaagcccatgccttggatatccttaacccgaaagggccctggtgttttaaacaaagagggcccccccccccaggatcccaacgag

SEQ ID NO: 28536 - DNA, 517 bp, Zea mays
  Clone ID: cC-zmle189072h05a1
ttttacattatgcgagctgattgtgatatatgaggcacaggattgaattacaatcaaatacccggctttttccagaatgaggatctatctacattttttttctaagtcacacttacataattgacctcacggtgtaggatcagcagatgactccaggaatccacggtatggtatgtgcacacatttggtggcatgtgccggaacgccaaactatactgttccgaatagcagtaccatggagtaattacagactgaaaacaacatggatgcactaaaataatcttcttgtataactcaagcatcatgatggttgttgatggcttcaagtgtgaacaatgtttgcttcgactctcacttggagatgaccctcataaaccgactcacggaactgaacacgcccatgacattgttcatcaacgatggtgcctcttcagattgctcatcggcaccaccaaatattctctcaatatcagttgcatcgggcctacttgtgagttctcgggcaagcaaataccga

SEQ ID NO: 28537 - DNA, 539 bp, Zea mays
  Clone ID: cC-zmle189072h05d1
accacccgtccgctgcggagaaatttcttaagcacttttaccactgtttactcgattaggccattgccaactggtgcaggggttaggtgctttccagggcagtggaaagtgttttatgatgatccaaataggccaaatcggtatttgcttgcccgagaactcacaagtaggcccgatgcaactgatattgagagaatatttggtggtgccgatgagcaatctgaagaggcaccatcgttgatgaacaatgtcatgggcgtgttcagttccgtgagtcggtttatgagggtcatctccaagtgagagtcgaagcaaacattgttcacacttgaagccatcaacaaccatcatgatgcttgagttatacaagaagattattttagtgcatccatgttgctttcagtctgtaattactccatggtactgctattcgaacagtatagcttggcgttccggcacatgccacaaaatgtgtgcacataccataccgtggatttctggagtcatctgctgatcctacaccgtgaggtcaattatgt

SEQ ID NO: 28538 - DNA, 487 bp, Zea mays
  Clone ID: cC-zmle189072h06a1
ttttaagttttaaaaaatttatgactgacttgggattctggcaatcttgtgtgattcatgaatacatcaaggcacgcttacaaagattttacaaacaccagcctcggggctcaggtccagctgatcatggtgacaaaaccacatatagccccgaaacgtagggctacaaagagaaaatgatttacacttgttgggcatcaaatacttgacctcctcataaatgatacgttgagaaaaatgttgtgaaggctgtcaagtctgcccaacttgggaagaggctcttgagtttctttgtactatcaacaaggtactgatcaagtactgcgacatcgactctcagactttcagaagagtttgcctccaaccagaaagaccaatccacatcgctctttccactgagtcgacaaatatatgatggtggcccaccacttacagtttgaggagctgggagcatgttatcagcgaaagaccaatttgatagtggccc

SEQ ID NO: 28539 - DNA, 528 bp, Zea mays
  Clone ID: cC-zmle189072h06d1
acccgtccggtggattcaagctatggcttctctgtggttgattctatactcatttgagttccttttcaacaatgcacgggagggggccaaatggctgaaggataactctgagttgtcctttgaagaaaaatatcggtctgatagaagctcatggttggctttgtatcctgtcccattcttgttctctggaagtttaaaattccaggcacaaactgaagagattaaaaagtactaccagcatttccctcagttagctgttcaggagatctgggataacaatggacagcgaagggtgcatctcaaacttgcacttggttccttatcagaaatttggacctctgtgctcaatattactgggccactatcaaattggtccttcgctgataacatgctcccagctcctcaaactgtaagtggtgggccaccatcatatatttgtcgactcagtggaaagagcgatgtggattggtctttctgttggaggcaaactcttctgaaagtctgagagtcgatgtcgcagtacttgat

SEQ ID NO: 28540 - DNA, 493 bp, Zea mays
  Clone ID: cC-zmle189072h07a1
aactcaaaaactcaaagaaggggttttaagtttgcaacagacggtcatgatgtcgcccagcataactgggaagtgatccttgcaagacaaaatttatagcacatagaaagcaaaatcaatctggtaaacgccacaaacctacgtcctcatgtcaactgatgagtgctacaacaaacaagcaaataataaaacgagaggtaactggctatgcatgactgcaaaacaaactaccgaaacgaagacaaccagtacgaggtggtagcatgtcaagaaaagggcccctgttttggtgcaggggagggttcatcccctgttttggtgcggggggtggatcacccctatgtacaagtatgtatctcgaaatcctgcaaagaccaatctgcagcatgaatacggctctacccctgttttggtgcgggggagggttcatccaacagcttgggcttagcaaacgacttctgcctctccatagttggcatgtaagctgcagtgc

SEQ ID NO: 28541 - DNA, 554 bp, Zea mays
  Clone ID: cC-zmle189072h07d1
aaccacccgtgcgaccagaagaatcaaggaaattgcagatgactgatactttatgtttaagatgcagcgaaaagaaagttggggtatgggatattatccatgcaggtcatggagaccgctatcagttggaatgcacttcctgtggctacacatggttttcgtccagagatgccatcacaacacttacagaggatgccccaagcactgctgggaatgtgggcactgcccccttggcaacagcaaagttcgaggtcgttgagaagaagctcacgagcccacgggaccaatccggcaagcctgcttctgatgctctgcagaagagcactgcagcttacatgccaactatggagaggcagaagtcgcttgctaagaccaagctgttggatgaaccctcccccgcaccaaaacaggggtagagccgtattcatgctgcagattggtctttgcaggatttcgagatacatacttgtacataggggtgatccaccccccgcaccaaaacaggggatgaacccttccctgcaccaaaacaggggccccttttcttgacatgc

SEQ ID NO: 28542 - DNA, 251 bp, Zea mays
  Clone ID: cC-zmle189072h08a1
agcaacaatcaggggagctagcgggccttatggtaatataacatcttgaacaaccataatacaaaatgaaatgcagttctgtcacgacaacatcgcattcataagcaataccacccatctagtacctagcaagcatcaccacacgaacctcaaactgacgagtactaacagcgatacaaggaatatcatatctgtaccaagcactgcggagaatgacttaggtctcttcctcttcttcctcctcctcctcg

SEQ ID NO: 28543 - DNA, 261 bp, Zea mays
  Clone ID: cC-zmle189072h08d1
cacccgtccgcgaggaggaggaggaagaagaggaagagacctaagtttttcttttcagtgcttggtacagatatgatagtcctgggatcgctgttagtactcgtcagtttgaggttcgtgtggtgatgcttgctaggtactagatgggtggtattgcttatgaatgcgatgttgtcgtgacagaactgcatttcattttgtattatggttgttcaagatgttatattaccatgaggcgaggtagcttgactgattgttgct

SEQ ID NO: 28544 - DNA, 245 bp, Zea mays
  unsure at all n locations
  Clone ID: cC-zmle189072h09a1
aaaaaaaaaaattttaaatttaaaaaaaaaaaaaaaaaaaaagggacacngggaaagaccttaaaanaaaaaacccaaaaaaaacccgacaacacacacacnnaanaangancgaaaagaaaaagccgcaaaaaacaaaacagcccaagcagcggcancacagctaccaccaaaaacaaaacaaaaaggaccgagaaggacacaacacaacagcgcaacaaggaccggcaaccacaaccgcaact

SEQ ID NO: 28545 - DNA, 364 bp, Zea mays
  Clone ID: cC-zmle189072h10a1
ctccccccccctttttcctttttcccccccccccccccccctggggccccgggagcccttctgctggcataacccccccaatatatagttcatcccttccacaacaaattttgacaaaacctccacccgtcaagggcatgaccgaatgaaccatctaacttgccaacaaatggccctttaagcccaaaaaaaaagtaaaaaatacccatggcatttctagtccatctttaccccaacaaaaccctaaatgctgctaggggacatgaacaccctgaccctgccccccatggacccaggcgggaggttccacttgaacctggcgcggacaacgccggaattgccctgccggcgggtgaccctaccc

SEQ ID NO: 28546 - DNA, 535 bp, Zea mays
  Clone ID: cC-zmle189072h10d1
gtgcggcggaagcggaagcggaaggaagtaggcggccaccattgtgtatggacgcacggggcagcgcgtcaggctctgggtccggggcaccatcctcggatacaagaggtccaagtcgaaccagtacgagaccacgtcgcttgtgcagatcgagggggtgaacaccaaggaggacgtcgcgtggtacgctggcaagcgcatggcgtacatctacaaggccaagaccaagagcagtgagacccgctacaggtgcatctggggtaaggtcacccgcccgcacggcaactccggcgttgtccgcgccaagttcaagtcgaacctcccgcctgagtccatggggcgcaaggtcagagtgttcatgtaccctagcagcatttaaggttttgttggagtaaagatggactagaaatgccatgcgtatttcttactttttttctgagcttaaaatgccatttgttggcaacttagattgctcattcagtcatgcacttgaccgtgggaagttctgtcaaattttgctggcgaacggatgaac

SEQ ID NO: 28547 - DNA, 368 bp, Zea mays
  unsure at all n locations
  Clone ID: cC-zmle189072h11a1
ttttagattctacgaatcaaacagaacaacaggggcattgggaacaaaacgcccaaacgaaatgaatataatcttccgcgcgcgcttccctggaccacgcacgccaaggacaatctcgtgctcgtgcgcgcgcgcgtgcagttttcctgtcagttgaacacgtcgcactgcttgcggacgttgccccgcctgccggacttgaccccgacgcggccgagccggacgacggcgtcggctaaggcgcggtagaaggcggcggtgctgttggccagcgagtccaccatggggcgcgtccggttgtcggtgtagagcagctggtcggagcccaacagcccgccgccgtcctggaggttgcgcccacgcgtncg

SEQ ID NO: 28548 - DNA, 376 bp, Zea mays
  Clone ID: cC-zmle189072h11d1
cccgtccgcggacgcgtgggcgcaacctccaggacggcggcgggttgctggtctccgaccagctgctctacaccggcaaggggacgcgccccatggtggactcgctggccaacagcaccgccgccttctaccgcgccttagccgacgccgtcgtccggctcggccgcgtcggggtcaagtccggcaggcggggcaacgtccgcaagcagtgcgacgtgttcaactgacaggaaaactgcacgcgcgcgcgcacgagcacgagattgtccttggcgtgcgtggtccagggaagcgcgcgcggaagattatattcatttcgtttgggcgttttgtttgtaatgcatctgttgttctgtttgattcgttgcatctaaaa

SEQ ID NO: 28549 - DNA, 338 bp, Zea mays
  Clone ID: cC-zmle189072h12a1
gataaaaattaaggggaaaggggtattatttttacccctatccccagcccccccccccaaaatctacggcgggcagccaccggaacaaactacacaaaaagggaaaattggacgggaaaaaaaaaaacctacaaagaaagacgaatctttataccaaactgtacaagaaacctatgcccaacacaaaatacaatggcatgctccgaacgggtgcatcgctcaactcaaccataaaaccaaagcctaaaaaccgatgctaccaaagcaacatcacaaccaggcaattcaatatccgggatgaaaaggccgaaacttcacgtgcagaccaatgacacatc

SEQ ID NO: 28550 - DNA, 586 bp, Zea mays
  Clone ID: cC-zmle189072h12d1
cacccgtgcgcaactcgcctgccatggcggtgttgtgcatggcttgttgcctgtgaactgatgcattttcacagtcgggtctgtactcaaaccatcaagatataggccctcgatatgcaggtgtactgcttggtctttccaacacggctggggtcttagcgggtgtatttggcacagcagcaacaggatacatcttgcagcatggttcttgggacaacgtattcgagttatcagtagtgctttatctggtagggactttggtatggaatgtattctcaactggcgagaagattcttgattgaagggtgtatgtacacagtgtgcttacagttcgtagtgacaaactcatttcggatcgacaacttgacccctggacataatacacttcaagataacaaatgtgtcatcgcgcagcacgagaagtatcaacctctacatcccggatattaaattgcctgggtgtgatgttgctctggtagagacgatttgaagcatatggaatattgatgagttgagcgatgcacccgttccgagcatgccactgtatattgtgttgagcataggtatcatgtacagcatggtagaa

SEQ ID NO: 28551 - DNA, 223 bp, Zea mays
  Clone ID: cC-zmle189089a01a1
atgtaaccgttttaaaagcctcatccaacaattcaggtgttacacaaaaactacattttgccttaaaaaacaactaaaacattttttgtttataaaacgggctattggcttcacagggaaattatttttcacaggccattgtttggcacctttatcttttgaacataaagcccttttccattccaccttatacaacatcctttttgcaaccctttacaaaatt

SEQ ID NO: 28552 - DNA, 475 bp, Zea mays
  Clone ID: cC-zmle189089a01d1
ggcagaggctgtggaagataaaaagggatcatacaaaaatacatttgatatttagaattgactctctgaatccttggaccagctgatcccggttgccgtttttgcttgagggaacatggatcagttcctagtgaagaccaaaggtcaccacataaaaataatgcaaattttgtggttgtgaacaactggaactttgtacagggttgcaaaattgttgttgtattatgttgtattgtacatggctctatgttcaagagatcaaggtgccgaacaatggcctgtgatcgatgatttccctgtgtagccactagcccgtttatcaacataagctgttcagtgatctgtaaggcacaatgtatcttctgtgtaacacctgcattgttggatgaggcttttaaaacagtttgtttaaaaaaaattaatataaaatttataaaaaattattttttctttttttttaatattataataaagg

SEQ ID NO: 28553 - DNA, 289 bp, Zea mays
  Clone ID: cC-zmle189089a02a1
ttagagcggccacccttcttccttttttttttttttttttttttttttttttaagggacgcgaaaagcattgagttgaagtacacccttacaaaataaaatttgaaataaaatatgatagctgcttgggacaagcaaacaaccttttttaattaacacccccaaaaccccccatgacaatacccagcttatctattactatgttggctcatccatccaacacctttttttcgtcgacgacctcataatctatatgatagctgctttggacaagcaaacccgacccctgg

SEQ ID NO: 28554 - DNA, 221 bp, Zea mays
  Clone ID: cC-zmle189089a02d1
ctgcctgtcccaagcagctatcatatacattacgacgacgtttacgatttaaaaggtgttggatcgatgagccgacatagggatagattagctgggtattgtcatgggtgcgtctggtgttgttatctataaggctgtctgcctgtcccaagcagctatcatattctatttcaaattctattctgtaagcgtgtagttcaaaacaatgctttacacaacct

SEQ ID NO: 28555 - DNA, 408 bp, Zea mays
  Clone ID: cC-zmle189089a03a1
cccattgtaacatatatttgaatttcgatcaatgacaggcgcttggtgcatgttgcaaagtagaaaaaggaaaaaaaaaagttgaggggtagaacggcgttgccgttgcataccaaaatatcgacagatatatccatacttgtggttttccaaacaaaattgggatttttgtcctatatataagggggcctccagtgaagagtagatcagcattctatagaggcaggcaagccatcgatggtattgtgaacgtgcctagtgaggcagtgacagcggaacatgcaggcaagctgctagaactttaggcctcttcgtgagacttctggacgcctatccatctggcatagtcaacccacagcaaggagccaaggaatgtgttgcccgtacgaacgatgaagcacattgcac

SEQ ID NO: 28556 - DNA, 591 bp, Zea mays
  unsure at all n locations
  Clone ID: cC-zmle189089a03d1
gacctgatgtggtcatggcgattgttgcggacgtcatgcttgtttatctttctgctccaactattggtttacaggggccactggcaagaaacgctggagctattgccaactttttctataactgccctgataatactttccaaattgctatggctggaaggtcattctcacttctgcagaggattggagcttttgtgaggaatggtataaagcttttggcagtgggaactactgcttctttgattggcactagtgtcacgaatgcagcgctcaaagcaaagagggctgttgataaggaccttgaggacgaagtcatggaaattccagtcgtctcaactagtgttgcctatggtgtatacatgtccatttctagtaacctcaggtatcagcttctggctggtgtgatcgagcagaggatgctggagccgttgctgcataaccagaagctactgctgagtgcaatgtgcttcaacgttcgtacgggcaacacattccttggctccttgctgggggttgactatgccagatggataggcgtncagaagtctcacgaagaggcctaaagttctagcagcttgcctgcatgttccg

SEQ ID NO: 28557 - DNA, 327 bp, Zea mays
  Clone ID: cC-zmle189089a04a1
catatgaatccgggcggttcaattaaagtcagaactggttcgcaggaaccttacacgattgtgtggactcccgaatataaaaaatataaaattactgcgttcccccaaacaaaaattggcacaaggaaagatatgcaagcacatcacatgaatcagctgtggccgtgttacagttgaaaagctaaaagaaaaccagacaaagcattaccgagttaatccaaagttcgatcttaattatacaggcgttttgcagttccgctgaacggcccgatacagagcacaagcttagttttccacacatttacaacacaccagttacacaagggt

SEQ ID NO: 28558 - DNA, 510 bp, Zea mays
  Clone ID: cC-zmle189089a04d1
ggcgaattggccctgatgtttcatgtccagtgtttgtgttcttccgctccttgattcgcgactagcgagcatggggtctggggtggattcagagcgtcgtggagttttttcgtgtcgccgatcaagtcaagatcgctaccctgttttgcaccgatcatatcctgctttcattgtcgatcctcgtttgtgacgtactgccactgttcatctcggtttgacttttccatcgctcgtcttcctgatgccactgaaacagcgacggccacggcctgagcggcgctgccagcaaggcggctagtatgagcagcatggagtcgcggccgggccgaacgaacctggtggagcccatagggcacggcgccgcgctgccgtccggcggccaggcagtgcagccgtggtggacgagctccggggctgtgctcggtgcagtctcgccagccgtcgtggcggtggcgcccgggagcgggacggggattagcctgttcagcagcccggcatgtggtagtgggt

SEQ ID NO: 28559 - DNA, 335 bp, Zea mays
  Clone ID: cC-zmle189089a06a1
caacgcaactcccatcctctagagcggccaccctttcttcttttttttttttttatttttttttttttttttttttttatttttttttttggtttgagatacacacaacttttccttatagctacctcacaacaaaccaataacatatataaacatacccacacccctttcaataaattaatatcaaaaaaacacatagtattgaacacaatctataataactcaaaacacgcacactcgctatttctcaatcttcaaaaaaacacaatactacctatatacccgtccaaagattatggacgcacataaatatacatacatccttctttctacaa

SEQ ID NO: 28560 - DNA, 652 bp, Zea mays
  Clone ID: cC-zmle189089a06d1
cgcgtggtcagacgcgtgtcaaataaaaaaaaaaaaatataataattttaaaaaaaaaaaaaaaaaaaaaagaaaaatgtataattttataaccctaaaacccccccctcccctattatttttttctttttttaattttctttcttctcctcccccttttttttaccctttctctctttttttttcttcttaacttttatttttttttttttttcctccaacttatcttttcttccttttccttttctctccctaatttataatactcttttacttccccccctttttatcctttttctttttatatctttttccctccctttcttttttttcaatccttctccttcttttttctttccatatttttttccctctttcttttttttctttttcctccccctcctttttactttctcttaacccctcctccctttttttttttcccccccttttatcccccctttcctttttctttttcttttatttcctttttttcttttcatttctttttcttttccttttcatcccattttttatcccttttttcctttttaatattttttttatattccttctcttacccctctcccccctattttctttcttattcttttttcttacatactttctacttttttatctctttcttttt

SEQ ID NO: 28561 - DNA, 355 bp, Zea mays
  Clone ID: cC-zmle189089a07a1
gcttcacctttaagcaccattttttccttaacattggcttagggtaaaacctgacgggggtaacagcatccatcgatccgcaatccatgctgtttgatgcatgggtctcttcttgaccctgggatgaacacagcactaactactgacacagagcgaccttgcactcaaaaacacagatgggcaacaccaaacacgagacgaacgaagataaaccctctggactagggtaaacatcacggaagcgaacaggataacttggccgcgcgggccccaccgttcagttcctccagttcccgtcagagttgccgtagccgccgccacggttgccaccgccgtatccgccgacaccaccacc

SEQ ID NO: 28562 - DNA, 446 bp, Zea mays
  unsure at all n locations
  Clone ID: cC-zmle189089a07d1
agggcaccgaggagccgacggatctgcgccggcgacgctcccggatttctgatctacnccgccncangggggggtatgtggagcttaaaccggtctctgcccatnagcgcccggattcgtcccgcctgaaggattatggatccgaaagagaagccaaatgtatcgagcagtccaccaacaccacggctggactgcataaaatgctttgatatgctctggttctgttactcaccattccaccagatgcataattattaccggtatggggagttcgacacctgcttcggcaagtggggcgatcttatgggctgcctcgctctcaagacaaagcggaaggcagaggtggaggacatcctcatcgtgcgggagaaggccaaaccacatatctggacctaccggacggtcgatgaggcatcggagaaatggtggcggatgtacaagcatgc

SEQ ID NO: 28563 - DNA, 379 bp, Zea mays
  Clone ID: cC-zmle189089a08a1
gataaccatgatacaccaccattgaattgggtccggaaacaactttttcatatgtgcttaagtatcacaaatggagtgggaaaacacaagtcacgaaccgttgaacctttccaggccagttcgaacacccacatgctaatagcatttaggcataacagatttaaggaccatgacatgtggctatccagacaaaaacaaccggtatgaaaaaaaaaaacatgacaccaagagtccaagtgtatacgaaaggcatggtattcaaaggaaggcgtccttctcgagcaacttcagaacctcgtcctggttattcagcttggcgacatcgataggtgtcttcccgtccaggttttgaagcgttacaccagcaccgtgcttaaaa

SEQ ID NO: 28564 - DNA, 435 bp, Zea mays
  Clone ID: cC-zmle189089a08d1
caggagaacagggcacacctccattaaatcctcaacaattcatggaatcaatgcaaaaggtcatggaaaaggcccagtgtatgaccatggcagagcgtctggcgaatgctcttatgcaggatcctgctatgtccagtatgctggaaacctttagtagtccatcacataaggagcagctggaagagcgtatgtctcgcattaaggaagatccagctatgaagtcaattcttgatgagttagagaatgggggcccttctgcaatgatgaagtactggaacgaccctgatactcttcaaaagattggtgaggcaatgggagctagcttcccatttggtgcaggttcttctgctgaaccttctggtactgaagaaactgaggaagaaggtggggatgacgatgaatccatcgttcatcacactgccagtgttggtgatg

SEQ ID NO: 28565 - DNA, 433 bp, Zea mays
  Clone ID: cC-zmle189089a09a1
agtacaaaactcataaccatgtagcccttgcattcgatgttccataaaaaaattaactcttaatagcatcacggtttcaaccaaagttataattccttttgcccagcaaacattgccatcatagattacttgttcacgcgacaactgcaaggatgtcaacaagacgagattttttaagcttccactaggtaaccaacaagcaagcacagcaccagacagatagatcatttcttcttggcagcaaccttcgtcaccttggctccagttgggtccttcttctccacactcttgatgactccgacagccaccgtttgcctcatgtcacggacagcaaatcgaccaagaggacgatactgagaaaaggtctccaccaccatgggcttagtgggaaccatcttcaccataccagcatcaccgttcttgagaaatttgg

SEQ ID NO: 28566 - DNA, 437 bp, Zea mays
  Clone ID: cC-zmle189089a09d1
cgcgtggggaagcaaatgatttgctgctgcaacaagatgtatgctattacacccaagtattcaaaggcccgttatggtgagattgttaaggaagtctcttcctacctgaagaaggttggatacaaccctgataacatccacttcgttccaatctctggttttgaaggtgacaacatgattgagaggtccaccaaccttgactggtacaagggcccaaccctacttgaggctctggacttgatcaatgagccaaagaggccttcagacaagcccctgcgtctcccccttcatgatgtgtacaagattggtggtattggaactgtccctgttggacgtgttgagactggagacattaaacctggtatggttgttacttttgggcctactggtcttactactgaagttaagttccgttgagatgcaccatgaagctcttc

SEQ ID NO: 28567 - DNA, 459 bp, Zea mays
  Clone ID: cC-zmle189089a10a1
agcaaaccaatcaaaaggaattgcgtgtctcagagatggatatacaaagagaaccaataatgttactcgcacaagtacagttacaatacgatcctaggaacttcaataatttccatcctctctttttttgtggttgctgttctcaccactgttgtcattgttgttttccccactagcaagtatgacagcaaacttggcatgaaaagaagatggagcaacgcatgcattgtagtgatccacaagatacagatccaacaacattgcctgctcaaaggccggcaatctcaaacatagtagcttataagaaaagcactcaaggaaaggaatacatataatggggacgaagggggcccttgagcttagaagcacttccggtgaacaatcgctggtcctgactcatcgtactcagcctttgagatccacatctgttggaaggtgctcagggaggcaaggatggac

SEQ ID NO: 28568 - DNA, 575 bp, Zea mays
  Clone ID: cC-zmle189089a10d1
cggcggacaaccatgttccctggcatcgctgaccgtatgagctggacatttctcgccctgccccagcagctgggaatggggtggtgctccacccgaaggaaatacctgtctggataggagggtccatccttgcctccctgagcaccttccaacagatgtggatctcaaaggctgagtacgatgagtcaggaccagcgattgttcaccggaagtgcttctaagctcaagggcccccttcgtccccattctatgtattcctttccttgagtgcttttcttataagctactatgtttgagattgccggcctttgagcaggcaatgttgttggatctgtatcttgtggatcactacaatgcatgcgttgctccatcttcttttcatgccaagtttgctgtcatacttgctagtggggaaaacaacaatgacaacaatggtgagaacagcaaccacaaaaaaagagaggatggaaattattgaagttctaggatcgtattgtaactgtacttgtgcgagtaacatacttggtctctttgatatacatctctgagaacatgcaatctttttgattgttttg

SEQ ID NO: 28569 - DNA, 238 bp, Zea mays
  Clone ID: cC-zmle189089a11a1
cctctaacggcccccttttttttttttttttttttttttttttttagtttgtaattttccatacccccccaacccccaaaaaaccaatatcttttaaccccaaaaaatcaaaccacccttaaaaaaaaaaaaaccccaaaacaaaaaaacaaaaaaattcaaaaaaaaaccaaaaacccaaaacccaaaaaaacttcaaaaaaaaaaacccttctaaaccccaaaaaaaaaaccaaaa

SEQ ID NO: 28570 - DNA, 554 bp, Zea mays
  Clone ID: cC-zmle189089a12a1
tttcctttccgtttccgggcatgaacattgagcgatggaatcggtacaacggtgttcacgactgaatgcacgaacagtgaagcatccagctggatagtaatcacggtagcttacacgactactgacgactcggaaggagactgttctgacttgtttgacgtgtttcttgcgaggaattcaagaacatgttttgcggcctcccttggcttctccacgtgggggatatggccacactgccggacctgcctcagaatcgcgtctgggagttcctgatgcaacctatatgctagtttgctgcttattattccatcatcctctccccacaggatcaggcatttatgcttcacctgttttatttggtttatgacattataaccccctctaatcataaaatctactgtagcatcctcccaccagggaagtaggcaatgcagacggccaatttgcacccaatcaaagaattcatttggagtttttttaaatgccactcttgttgctaaaaatcgcagtggaagactcttcaatataaacaccccagcttatgaaacaaattt

SEQ ID NO: 28571 - DNA, 577 bp, Zea mays
  Clone ID: cC-zmle189089a12d1
cggcaaatcatacatcaaaaggcctatggtgttagtcggacccattcttggttttgctgttgccattgatttttcgggaactgccccgaatcggtctcgaaattgatcttcattggtgcaagtgtatactctgagggcccaaaagatatgaccaggatgcctaaatttgtttcatatgctggggtgtttatattgaagagtcttccactgcgatttttagcaacaagattggcatttaaaaaaactccaaatgaattctttgattgggtgcaaattggccgtctgcattgcctacttccctggtgggaggatgctacagtagattttatgattagagggggttataatgtcataaaccaaataaaacaggtgaagcataaatgcctcatcctgtggggagaggatgatggaataataagcagcaaactagcatataggttgcatcaggaactcccagacgctattctgaggcatgtccggcagtgtggccatattctccacgtggagaaaccaacggaggccgcaaaacatgttcttgcattcctcgcagagacaccttaaacaagtcagaacagtc

SEQ ID NO: 28572 - DNA, 550 bp, Zea mays
  Clone ID: cC-zmle189089b01a1
acccttcctcctttttttttttttttttttttttttttttttttttttttttttttttttttgtttttagtttattttaaaaatacctatccccccaatcaacattaaaaatttttattaaaaacataaaaaaaaataaaaaaattttttatttcccccccccaaaaaaaaaacctcttttttattaaaaaaaaataaaaaaacccctcctctaaaaaaaaaaaataattttttttaaaaaaattaaaaaaaaaatctaaaaaaacaacctcttaaaaaaaaaaatataacctcttcttttaaaaatcgtaaaaattataccaaaccccaacacccaaaaaaaaaaaaaaaaatttattcccaccaaaaagtcccaaaaaaaacctttttatttaaaaaaaaacccaaacccctttttaaaaaaaaaaaaaaaaaacccccccccccctcataaatataaaaaactaaaaattcaccccccccccaaaaaaacccaattttttaaaaaaaaaaaacttttttccccctaaaaattaaaaataatttatat

SEQ ID NO: 28573 - DNA, 605 bp, Zea mays
  unsure at all n locations
  Clone ID: cC-zmle189089b01d1
cgcccacgcgtccgggcaaggcttgcattttgcaagttcatggttttctccatttactctactcatcttggatgaagggacaaagcatcttgatatcccatcaaaagaaatgcttgaggaggcaatatcagaatatactggcaccgtcataacagtttctcatgaccggtacttcataaaacaaattgtcaacagagtcatcgaagtgaaagatcagactatccaagactatcaaggagattacaattactaccttgagaggaaccttgaagcccgagaaagggaacttgcccgcgaggaagagctcgaggagagagcccccaaagtaaaagccaagtccaagatgtcgaaggcagagaaagccgtcaggaagaagcagaagatgcaggccttccagcagagcaagcagaaatccaagtcgcttaagaactcgaagcggtggaactgagattttttcgtcgttcgtagaggcggcgttggcgttcgtcacaatgcagaatgccatctgagacaccttgcaatgcagataccaatgtttgctactctgcctgctgtgccggatgctataatagtcgccatatcagcagaagcactgcanatacatc

SEQ ID NO: 28574 - DNA, 408 bp, Zea mays
  unsure at all n locations
  Clone ID: cC-zmle189089b03a1
tttttatggggctatgcaatcacagttttcagagtaaaatgccttgcgcatggcaacaatgttcccactgtacacatcttacagtactctgctttcgcatctcttcgctcatgggggataaattgtgcattatagttaccccttcgacgncctcggatttatcaactctacacacacgatgacataaatacactgtcaagtgacgactcagaactgactaatatacatgtacagaactctggcttcacctattggctactttgatcttttcgacactcgtgacatcagatgagtaacggcaccgccaccaacatgggagttcatcatctcaccaggcttttgggatgagagaagagcccgaggcagatccttctcgcctgccctggcattcctggccactttccttga

SEQ ID NO: 28575 - DNA, 603 bp, Zea mays
  Clone ID: cC-zmle189089b03d1
tcggcattgcggggtaaggaggaggaaaatgtaatgctcaaacatcaattggttcagtatgagaggaaatggtcagagtatgaggccaaaatgaaatgtatggaagaggcatggaagaggcagctctcttctctgcagctgagccttgttgtcgctaagaagagcctagctgctgatgatgcagccactagagcagctcggactgattgtactcctacacatgcgcagtatgactctgaagatacattatccaccgggactcgtacacctgaagtgatcgagtcgaaacacgacaaccacaaccctgaagctaaagtttcagcaggaaactcggataggcgagtgaatgctgtgaaccacctagcaaaggagtttgaagacagacgacaggtgttcgaagacgatgcgggcttcctagttgcagtcaggtccggtcagattggttcaaatatgaacccagatgaggaactccggaagcttcaagaccgctttgcgacatggaaaaaagactacaaatcttcgttgaaggagacgaaggtaaaccctagttaggttggcacccatgatgagaaacacggaaaagatggtggggaaagaagagct

SEQ ID NO: 28576 - DNA, 383 bp, Zea mays
  unsure at all n locations
  Clone ID: cC-zmle189089b04a1
ccgaccgccctttttttttttttttttttttttttttttttttttttttttttttgcatgggttcaagagacttgaaattggcaaaggattacatccagtttgtancagggtaacaaacacaaacacttaacatttaccccccttaaaaaaaaaaagtttattttcttggggaatgttcttgccgacaatcttggccggcgttatgcggaggaggttcccgggcttccctggcacggcccccttgatcatgaacacccggaggttgttgtcgatcttgaccatcttgagcttcctgatcttggtcttggttcctcccatcctcccgggcatttttttccccttgtacacgcggcccggcgtcgtcccggctccaatggaaccc

SEQ ID NO: 28577 - DNA, 601 bp, Zea mays
  Clone ID: cC-zmle189089b04d1
gcccacgcgtccgcccacgcgtccgatcgaagcaagcatggcctttgcggtcgtgggcgtgggcggcgcagtgggggtcctggtcccgcagcgccgccagggcgccgtcccctggagcggcgggcggcggcgggcgcccgtggcggtgcgcgcgtcgtacgaggccggggtgggcgtgatggcgaccaaggtggggatgatgacctacttcgatccggagacggggaagccggtgccggtgaccgtggtcgggttccgggagggcggcaacgtggtgacgcaggtgaagacggccgccacggacgggtacgacgccgtccaggtcgggtaccacggcgtgcgcgaggacaagctcacccgcccggagctgggccacctgggcaaggccggcgccccgccgctgcgccacctgcaggagttccggctcaccgccgtcgacgccttcgagcccggccagcccctcgacttcgccgacctcttcaaggagggcgacctcatcgacgtttccggcaactccatcggcaaggggttccaaggtggcatcaagaggcacaacttcaagcgcgggctgatgacgcacggttccaagagccaccggcag

SEQ ID NO: 28578 - DNA, 84 bp, Zea mays
  Clone ID: cC-zmle189089b05a1
acacaacctaatacatttctattaagttccagttttttttttttcacaaaacaaaacccacaaaccctttaaccccccctaaaa

SEQ ID NO: 28579 - DNA, 526 bp, Zea mays
  Clone ID: cC-zmle189089b05d1
ccgcccactaccacgatattctgaagccactccaatgcaccattgtttcttgttccctatagaaactgatcaatttggagagtggggaaaaacaccttataaactccagccaaatgatactaccctaaacatagaaccaaaatcttctactaccatctggttactctctaaatcaggatcccttgaacttctccatataaaaacagctcatgaaaggctcgacagggaaaacaactcgaacttaataattactgcgccaagcgtgctataccagatgaactgtgcttactgttaaacctgaaaatgtacaaatccatcctttcttccttaacctattaagcggaggtctatataataaccatatgtgaatattgaaatgcttacaccaaaatattatattgctgtcaataatggaactgactcaagacagaacatgtgaattcaaagaaatgaactttatcacataaagcagggccaaacttatttatgagctaccactaacaaaaatggttggaaatttcttttt

SEQ ID NO: 28580 - DNA, 344 bp, Zea mays
  Clone ID: cC-zmle189089b06a1
ttttttttttttttggcattgcaagtgtatatatatagttgcacacggggggggatttagattgccgatacgacatctttctttgagccgtgaaacaacacaccttgggggagtgggggccaataaaaaacgatatgcagatgtcccactcggtttttacgatacaagtacacgggcaacttgcctcataaaccaccaaacagagagtagtaaaacacgttccgcgtgggggcgagatcaagaaaactactaacctaaccacagacggagcacaacagaacggcggccacagggggggagccctgtttattggaaacaaattgcatcgacgacgcccttcttcg

SEQ ID NO: 28581 - DNA, 537 bp, Zea mays
  Clone ID: cC-zmle189089b06d1
cgcccacgcgtccggtgctggtttccctgctggaaagtacctcttttctggttttgtggatggacgcaacatctggggtgatggtcttgctacatctctcagcactctccagtctcttgaggctgttgttgggaaggacaagcttgtcgtatcaacttcctgctcgctcatgcacaccgctgtggatcttgtgaacgagactaagcttgacagcgagattaagtcttggcttgcttttgctgcccagaaggttgttgaggttgatgctctcgctaaggcattggctggtcaaaaggatgaggcttacttcgcagcaaatgctgctgctcaggcctcgaggaaatcctcaccccgtgtgaccaatgaagaagtccagaaggctgctgctgctctcaagggctctgaccaccgccgtgcgaccaacgttagtgctagattggatgcccagcagaagaagcttaacctccccatccttcccaccactacaatcggttcgttcccacaaaccggtgagctcaggaaggtccgccgtgagta

SEQ ID NO: 28582 - DNA, 268 bp, Zea mays
  Clone ID: cC-zmle189089b08a1
gtgtggctgggggaacccggttctctacatggatctccacaaactcagaaagaatgggccgggactcgtctccggccagtgtctccttctcaatgagcacctcaacgattttgtcgatggccttccttgtggtttttaatgtgcctcaatgcgatctcgtaggcctcatctgacaactgcttcactgccgaatcaatgtcctccgcaagcttctctgacatggagttccttgccatcattcgcatgatgacgtccccactctgtgccc

SEQ ID NO: 28583 - DNA, 268 bp, Zea mays
  Clone ID: cC-zmle189089b08d1
cggccacagagtggggacgtcatcatgcgaatgatggcaaggatttccatgttatagaagcttgcggaggacatggggtcgggggtgaagcacttgtcagatgaggcctaccacatcgcattgaggcacattagaaacaacagggaggccatcgacaaaatcgttgaggtgctcattgagaaggagacactggccggagacgagttccgggcgattctttctgagtttgtggagatccctgtagagaaccgggttcccccagccacac

SEQ ID NO: 28584 - DNA, 514 bp, Zea mays
  Clone ID: cC-zmle189089b09a1
ttttcggattaatgccaatcgaacttgtattccctgttttttttttcttggggcatctctacttctacaattttgtacgcactggttattctagtaaatgtggcaaaaaaaattagttgcgcaattaccaaaactatatacctgtttgaggaccagaataatcgcactggaacatccggacatacttgtacgctggtgcaacataggatcgtcgtggctaacaactagataaaatacgagtgagtgggtagtaccggggcatgcaatgcatagatttcaggcatgccactacacataaaccaaaacagtcaggctccacggttctttgttgatctgtcgacaaaaaattcccccgaggcaagatatcatgcgtcaattccgggaccagggtaagctgggagactcattatcctcttgtcaagcacaggagcgcccactgtaaaatggtacaggctctgaaagtccaaacctttcaagccaagtgcctcgtgaacagtatcatcaaagtagcatc

SEQ ID NO: 28585 - DNA, 522 bp, Zea mays
  Clone ID: cC-zmle189089b09d1
cgcgtgggcaaatgcacttagtaatgatcatgtagtgtgtgatgtgatataccgcacagcagagcaagttgggaagcgtggccctgcaccgggggaacggttctttgtgatgccatggcagaagagtccagccttgtccaaaggattgtataaggaattaacagtgcaggaggtagtacgtcagaggagaagtgcggtggacatggatggtgtgcatgtgatgggaagggatacattttatcagatgctgatgcactgccttccatcaggggaggttggatcacgtgaacggcaaggggagcagagtgctctgccattccgagtattaccatgggaagcagaggtgcatgctgcactatttgtgcatcgtgtctcagggcttcatagggggatttatttcctggtgagaaatgatgagcactttgatgcgttgcaacgtgctatgaggcaggactttgagtgggttcaaccggaaggatgcccttatggtctcccactttacaggctgatgaaaggagattg

SEQ ID NO: 28586 - DNA, 520 bp, Zea mays
  Clone ID: cC-zmle189089b10a1
ttttgaatagtgtatcgatccagtgtgcattgctaaaaagccagacgcaaaaatatctatgattttctgtaaaaaaaggagaaaagaaaataaaaaaaaatctctacagctgttcttcccgagcgctcacctctgcttccttcacccggtcgtcctcatccgctccggttgctgggaacaaaaatctgtccgccggtggccgtgcttatcctcgcagccgacgctctgctcaagatttttctcaccgtcgttgcctcgttcccatccactcggccaccctggataaaaatcccatcggtgtccatattctgctctcaaccaagcgcccctgccttgctcctcggcctccctcttctgccgcagctcgccgagttcctctgctctctccctagcgcgcgcgagcttgcccctgcgcgcagctcgccgggatgcccctttccccagccgcggactccctctccagagctcctccctgtgcgcgctggagttttctctgctccaaaaatggctgccgcgagcc

SEQ ID NO: 28587 - DNA, 394 bp, Zea mays
  Clone ID: cC-zmle189089b10d1
ggccaagcatacgagagaacaaaggagctggacacacccaattatagactctatggggggctcgcggcagccatggttctaggggagaaactccaacgcgcacaggcaagagctctcgagagggagtacagggctgtggaaaggagcatcccgcagagctgagctcatgcgcactctcgagcgcgctaaggagatagcagaggaactctgcaagctgcaggacaagaggcagggcaaggacccttgcttgggcgcttggtttagagcacaatatggacaccgatgggagttttatacagggtggccgcgaggctgggaacgaggcaacaaccgtgagaaaaatcttgagctgaacgataactgctaggataagcacggacacctttggacagat

SEQ ID NO: 28588 - DNA, 420 bp, Zea mays
  Clone ID: cC-zmle189089b11a1
ttttatttttttttctttttttttttttttttttttttgggtttagggaaactgatccaaaacgtgattatatgctgacctttagtataaacagtctcctcatatttcaaagttccagattctaaaggggaaaaacatgaatggcctgtctatgtgcttctctcaaattctaggctatagcagagtacaatagtgttaagtgtacacgacttcactataatccttccaatatatgattcccatgcatctcacgaaaatttaccctggcaagtcggctagttttggtggcactacatacagatatctatgaaattattaatttgctgctacggtcttagaacacgacgaaagaattggccatgtcatacttcatcttctccaagttgggggagacagcgaactggatcattggcggtggcc

SEQ ID NO: 28589 - DNA, 449 bp, Zea mays
  Clone ID: cC-zmle189089b11d1
gcgtgcgacgacacgctggcccttgcctgcgggccacttctgatgttccagttcgctgtctcccccagcgtggagaggaggaattatgacatggccaattctttcttcctgttctaagaccgcagcatcaaattaataatttcatagatatctgtatgtagtgccaccaaaactagccgacttgccagcgtaaattttcgtgagatgcatgggaatcatatattggaaggattatagtgaagtcgtgtacacttaacactattgtactctgctatagcctaaaatttgagagaagcacataaacaggccattcatgtttttcccctttagaatctggaactttgaaatatgaggagactgcttatactaaaggtcagcatataatcacgttctggatcagtttcatttaaaaaaaataaaggttaatgaaattactcacaacttgtttc

SEQ ID NO: 28590 - DNA, 89 bp, Zea mays
  Clone ID: cC-zmle189089b12d1
aaaaaaaaaaaagaaaaaaaaaaaaaaaaaaaaggccgtatgattatttttgaaccaaacttacatacccctgcatcctggtgaatatt

SEQ ID NO: 28591 - DNA, 298 bp, Zea mays
  Clone ID: cC-zmle189089c01a1
cgaacccgaagttccacccggaaattccggaccgggaccctaaggactaaacaattttccctaaaaaaaaggacaaaaaaatcttccgagaaaaaaagccaaaataaggccccgggaaaaaactgaaactcccctacaatcccaaaaaaaaaacaaccccaaaaaaaaaaaacaaaagccccgccgcccaaaaaaagaagcaaactaacattaatctcggtactataaataccccatttaaaaccgtaaaacctgtccaccaatttgaataaaaaaaccccccaaccccccggaaaaa

SEQ ID NO: 28592 - DNA, 191 bp, Zea mays
  Clone ID: cC-zmle189089c01d1
aaaaaaaaaaaaaaaaaaaaaaaaaaaaaaaaaaaaaaattttaaaattataaaaaaaaaaaaaaaaaaaaaagaaaagtgtggcctttttaaaaaatccaacccttcctccccttacatacaaccactttaactttctcattttgccccctaaattcaatttattagccgtcccattaaaaactatttaa

SEQ ID NO: 28593 - DNA, 211 bp, Zea mays
  Clone ID: cC-zmle189089c02a1
tttttagctgcattcatttccacaccgacggtttctagtttattgaggagaggtgaataaatgtacaaaacgtgtcgggatcatgtacataccatgctcacctactgcaatgcgggttttaatttttaaaaaaaataataactacagacttggctacaggctacagccctactcttaggcaggaggatccacccatcgcccatggccctag

SEQ ID NO: 28594 - DNA, 205 bp, Zea mays
  Clone ID: cC-zmle189089c02d1
gccaggaccatggccgacgcgtggatcctactgccaaggagtattttctgttttctgcagccaagtctatacgatggatattggtgaaagctaaacacccaatgcataaacttaccatacgatgtacatcattcctacacatttcgtacatttatcgacatctgacaaataaactacaaaccgtacgtgacagcatgtctgcagc

SEQ ID NO: 28595 - DNA, 359 bp, Zea mays
  Clone ID: cC-zmle189089c03a1
tttactttttttttttttatagcactctatatagactttcgcgcaggggcccaaaatcccggacccgcccttccaaacccaacaccttgagagcttaaacacctcactaaaacccggggcccaccaaaaacacataaaatgttttaaatcagcatcggctatagaatctacaataccgcgtttgcatgataaacctttggtacatacccccttcacaaacggtaatcctcacataaaccttcctcgaacagcccttcatactcagttccattgacgacttattgctcaactccttcattcatttaacgctttggcttacgacaaccctcacttgtttagctccaacagcctttttgata

SEQ ID NO: 28596 - DNA, 421 bp, Zea mays
  Clone ID: cC-zmle189089c03d1
gatcccctcgctttttaatttcctagctccaaccgatcctcgcgggctctgtgccgataaggatttcttccccgccaccatcgacaccgtctgactccattaccgttatatggatgcaggacacgagcaaaaagtcaccaatgctactcttcaacgaagtacctacgatcaaagttgatggccttattaccgcttatgaatggggtacgctccaaagctgaatcacgcacactctatctggcatattgttaaaccgaagaacatataatacattttatgtaaaactgactgaacactgcacttgctgcactgttgtctctgctgaatgtcatgcgcttatccagcacccatcctgacattttgggggccctaaatgaaagcctatatagatgccttattcttaggatccataattgactca

SEQ ID NO: 28597 - DNA, 395 bp, Zea mays
  unsure at all n locations
  Clone ID: cC-zmle189089c04a1
tcctctagagcggccgccgcgccggcgagctgcgcgcagacctcggctaaggcggtgaggatggcggcgtggtggggcggggcgttgagggcgagcaggcggcgcagcatgccgcggaggccgtcccagtcgcacaancccattttcaaaaccatttgcaccatgctgtcgcggaagtccgcgcgcggttccgacgactccttctccaccgccacgcccaagccgtccgcctccgcctccgccttctcgccccgcttctccttctccttcttcttcttcttggtcgcctgctgcgccttggctgcggctccagctccgtatgcgacgcgcgaagggtagcagtagtagtagtcggaggagtaggccgacgcgtaaccgccggtgctgcgtgtggc

SEQ ID NO: 28598 - DNA, 221 bp, Zea mays
  Clone ID: cC-zmle189089c04d1
acccaaaaaacactgattagtggagatgggatcacggcagcgcttccatcttcccttttttgacttttttttaacgccctttgaccgttggagtggcacggtgcttaatatatgaacttcttgatccaaacctggaacaacagctcacaccctatcatcggtactatttctctttgactttataagaggaattttgctcgactttctggctctatttggtt

SEQ ID NO: 28599 - DNA, 447 bp, Zea mays
  Clone ID: cC-zmle189089c05a1
ttttttttttttttttttttttttttttttttttaatttaaatttgaaaaaagttcacttttaacctacccttctctccacccccaaattcccgaccctaacccacaaacctaccaacactttctcaaaaaaaaaacttatttaactttttcgtaaaaaaaaccaaacctccctcctctggaaaaattttatcctctcacaattccacacaacaaaccagccaaaaacaaaaaaattaaaacctgttttgcctaaaaaatcacctaactcacattaatccccttgcccccacctccccctttacaaactgaaaacccttctctccaactaaataaaataaatccccaaccccccatataaagcccctttcattatataacacccaaccacattttttttttaacatttaaacggccaaaaataaattccctctaacctcctgcccct

SEQ ID NO: 28600 - DNA, 624 bp, Zea mays
  Clone ID: cC-zmle189089c05d1
cgccacgcgtccggtttgagactttgattaaaaaaaaaaaatataaaaattataaaaaaaaaaaaaaaaaaaaaagagctatgtttatttaaaataccaagcttaccccctctctccatacaactattatatcttcttttattttcgtcctctaaattcaattcacttggccttcatttttcatcatccttaattgttaaacccctttctttacccaacttaattctctttcaccccattcccctttctccatctttctttttatgcaaatatgctccctacccatcccccttcccaacattttctcatacttaaataccatttggacccccccttttacttcttattaaacccctccttttttctttcttcccctcatatttattttttccctttcccagcgccctttctcccactcctttccctttattccctttttttttcccccctttttccttctttttccctcaatcttttaatttttgccccctcttaagttttcccttttatttctttaccgcaccttttccccctaaaatattttttattttcattttttccccatctggtcccttttccctccttaacctttttttaccccttttctttttatttccccttttt

SEQ ID NO: 28601 - DNA, 485 bp, Zea mays
  Clone ID: cC-zmle189089c06d1
gaccgagtacgccgtgtgcgcgctcaaggtgcaggtcatcgtgtttcattgtttcacagctgctgcggtggcatcaaggcgctggtctccctcaaggacggcgcgccacacaacttccacttcgtggaggactgggtcaggatcggcagccctgccaagaacaaggtgaagaaagagcacgcgtcggtgccgttcgatgaccagtgctccatcctggagaaggaggccgtgaacgtgtcgctccagaacctcaagagctaccccttcgtcaaggaagggctggccggcgggacgctcaagctggttggcgcccactacgacttcgtcaaagggcagttcgtcacatgggagccttcccaggacgccaatcagcgcttgacgagcgggttccagcagttcaaggtcaatgtctatgacaagaagccggagcttttcgggcctcttaagtccggccaggcccccaagtacatggtgttcgcttgctc

SEQ ID NO: 28602 - DNA, 328 bp, Zea mays
  unsure at all n locations
  Clone ID: cC-zmle189089c07a1
tttcacgacccttttaattttggcttgcatttatttgaaatttgacgacaaaggcattcattatattatgtcagcaagcaagccttaacactggctttgatccaagaccaaatcacttttttttccctttattggagaagcctcaaacacgcacttaaaatacgacccttaagagcaaacctcgagccagtccattactcgtcaatcgaaacctgagaactgncgtgaggaattgtgtccgatcatggctccccgcacacgttatacggctcttcccaaaccttctctacttaaaccagaccagtaggcgctctctgacaaccagccg

SEQ ID NO: 28603 - DNA, 415 bp, Zea mays
  Clone ID: cC-zmle189089c07d1
acggccgtacggttctattgaccacacctccctcctcagcttcttttttcaactttactgtcaaatacctctaccttgtggacgggagcaaacaaaacctgggactcactacttcaccggctgacagactcatactgatccttccataaaccaccataacactgaagaaggactatgcgttttccacgtactacgataaccattctgggcaccacctccacgcgcacgacgctgagcgccccacgaccaagtacaacatcctctttgtcaacctgtacctcttctacatgatgcacactgccgtaacgctccctatagattagcccaaagttctacttctacaccacgcgggaccgaaacgtctcaaacgggtacaagactaaccgacccaaaaacaacatcatcattaacgcca

SEQ ID NO: 28604 - DNA, 405 bp, Zea mays
  unsure at all n locations
  Clone ID: cC-zmle189089c08a1
gccagncataccaatctagccatttatatggaaacggaggaagacatcttacttcaacaaatgtccatacaaaccaaaaattaaaacacagcccattatattcttaaaacaaaagcttttaacagttttgacctaggccttgatagcatacttcctcatggggaagtacttntcacgcttcttttccctctcggncttcagagaaagctggtgcttggtcagacggcggcggatggcacgggtcttcttagggcggaggtcgagggggagcaggttcttcttcttgtacgcctcccgcaacgcctacttttgcttctgcgagatcactgtgagcacgcgcgcgatcgaggtgcgcaccaccttgatcttggagagcttgttgggtgcgccgccggtgaccttggc

SEQ ID NO: 28605 - DNA, 445 bp, Zea mays
  Clone ID: cC-zmle189089c08d1
cgcgtgaggcgcaactcaaggagctgaagtctgacctctttctcctttttgtagccaacgtcaccggcggcgcacccgtcaagctctccaagatcaatgtgctgcgcacctccatcgcgcgcgtgctcacagacatctctcagaagcagaagtcggcgttgcgggaggcgtacaagatgaagaacctgctccccctcgacctccgccctaagaagacccgttccatccgccgccgtctgaccaagcaccacctttctctgaagaccgagagggaaaagaagcgtgagaagtactttcccatgaggaagtatgctatcaaggcctacgtcagaactgtgagatgctgtgcttagcatattatcggctgcgttttaatatttgctttgtgtggacattacgctgaagtaccatgtattactctgctttcatataaatggctagattg

SEQ ID NO: 28606 - DNA, 174 bp, Zea mays
  Clone ID: cC-zmle189089c09a1
ttttgaactaatgtcaatatatgatattattctactccatgccccttcggcatgccccctttcatatccaagaagacttgtattgcatctcctctctccctctctttttaccaaaccaacctccttacgatttttacgaaagtcccctgttcttacaaatcaccccttaccaac

SEQ ID NO: 28607 - DNA, 190 bp, Zea mays
  Clone ID: cC-zmle189089c09d1
ggccgtaaggggtgatttgtaagaacacggacttacgtaaactttgtacgttctattgcaaacaacaaaaggagagaggaggtgcaatacaagtcttcttggatatcaaaaccggaatgccgatggggcatggagtacaataatatcatatattgttattagttcaaaaaaaaaaaaaaaggcctgccca

SEQ ID NO: 28608 - DNA, 498 bp, Zea mays
  unsure at all n locations
  Clone ID: cC-zmle189089c10a1
ttttgttttaacttgtagactggcttgaattacaaataggggaagagtctgtagcagcagttgtgtgctaatccatttgctaaagctttgttccggtctttactagcgccgaaagaatcgtgtacaatgcctatagtcctacgtatgacctacacaatatatgtgtaatactaactctgttctcgaatatttgtcgtctagttcatttttgaactaaaacaggataaataaaaatgaacaggggagtacatgagaaacagtgcccgccttatccgtggccaaataatactactccaggtatcggctgatttattcatcacaaaactgccatataatcctctatcttaatctggcgacctttagtctttgtctgtagaccaccaaaaatatcctgattactgacttgaggaggacgccgtgcagccgtcactcatacgagacctggcaacggagcatgcagcttctatgtgtagaagatgcattgacgacanatggatg

SEQ ID NO: 28609 - DNA, 489 bp, Zea mays
  Clone ID: cC-zmle189089c10d1
cgcgtgggcggacgcgtggggaaggatatgaatttatgattggaccttcaaaggtcataaacaagacaggggatgggggactactagagccttatgagatacctgctgttgaagtcccagaggagtccatgggatcagttgttgagcttttagggaaaaggcgtggacaaatggttgacatggaagctaacgggacggagggaacaacattgctgaaatacaagattcctaccagaggccttatcggacttcggaatgcaattcttacagcttctcgtggcagagctatattgaatacaatctttgacagctatggcccatgggctggagatcttagctcacgtgatcaggcatccttggttgcttttgaagatggaagcactacttcttatgcacttcttaatgcacaagaaagaggtatgttggtttgtccaaccagggcaggatgtttacaaaggtcaaattgttggtatccatcagagacctggt

SEQ ID NO: 28610 - DNA, 382 bp, Zea mays
  Clone ID: cC-zmle189089c11a1
ttttaacttcaaagtaaattcatataattcaagccatggttccacgatccctttgcacattttgatattttgcagggaaaatggaactgtggaagggcatacacccaatagtgtagtctaagtgtctaaccaatgccatttcaactcatccataacaatggaaatgcattgggccaattacgccagcttacatcacacatttatctgattataatacatcataaatcccaatgcaattaaacagcaaaaatctactctcaggaagtcaggttttccttccagtgctgcactgcaccagcgagcatgcttgcctccttcggtggtctgatctggagcacaaaaatggtggaagctgtacaaaaaaaaaacccggacgcgtggg

SEQ ID NO: 28611 - DNA, 382 bp, Zea mays
  Clone ID: cC-zmle189089c11d1
cgccacgcgtgcgggttttttttttgtacagcttccaccatttttttgctctttatcagaccaccgaaggaggcaggcatgcgtgctggttcagtgcagcactggaaggaaaacctgacttcctgagagtagatttttgctgcttaattgcattgggatttatgatgtattataatcagataaatgtgtgatgtaagctggcgtaattggcccaatgcatttccattgttatggatgagttgaaatggcattggttagacacttagactacactattggggtgaatgcccttccacagttccattttccttgcaaaatatcaaaatgtgcaaaagggtaagtggaaatcatggcttgaattatattaattttctttggtgtt

SEQ ID NO: 28612 - DNA, 556 bp, Zea mays
  unsure at all n locations
  Clone ID: cC-zmle189089c12a1
ggatcctctagagcggcgcctttttttttttttttacattgagaatcaataatgttactcgcacaagtagagttacggtacgatcctaggaacttcaataatttccatcctctctttttttgtggttgctgctctcaccactgttgtcattgttgttttccccactagcaagtatgacagcaaacttggcatgaaaagaagatggagcaacgcatgcattgtagtgatccacaagatacagatccaacaacattgcctgctcaaaggccggcaatctcaaacatagtagcttataagaaaagcactcaaggaaaggaatacatagaatggggacgaagggggcccttgagcttagaagcactttcggtgaacaatcgctggtcctgactcatcgtactcagcctttgagatccacatctgttggaaggtgctcagggaggcaaggatggaccctcctatccagacactgtatttcctttcgggtggagccaccaccttgattttcatgctgctcggnngcagggcggtgatctccttgctcataccgtcagcgatg

SEQ ID NO: 28613 - DNA, 458 bp, Zea mays
  Clone ID: cC-zmle189089c12d1
acggcatcctgcgtattgaccttgctgggcgtgacctgactgacttcttgattttgatcctcaccgagagagggtgctcctttgccaccactgccgaacggtaaatcgtacggcacatcaaggaaaagcttgcatacgtggcttttgactatgatcaggagctggagaacgccaagagcagctcatctgtggagaaaagctactagctgcctgatggccaggtgatcaccattggggcggagaggttccgatgccccgaggtcctcttacagccttccttcattggaatggaagctcctggcatccatgagaccacctacaactccatcatgaaatgcgacgtggatatcatgaaggacttctatggtaacattgttctcatgggtggcacaaccatgttccctggcatttctgaccgtatgatcaaggagatcaccgcccttgacccgagcagcatg

SEQ ID NO: 28614 - DNA, 251 bp, Zea mays
  Clone ID: cC-zmle189089d01a1
gcacacatattattcactttctttgcggctgaggaatctttacaatattcaacaatttaaaatccaccctttcttttaaatataaaccacaggggttataaaaccaaaaattttgaaaacgcaggcctcattggatatcaaattcccagaacctaaagatgaacgcacatggccctcctctaccattatatattctacctgggggcagatggagtcctacaaaaataaagttcttcattttcacacttttc

SEQ ID NO: 28615 - DNA, 555 bp, Zea mays
  Clone ID: cC-zmle189089d01d1
cgcatcactgaaagtgggcagagactaatgtcttgttgaaaggtttgcatttttaggacacgaatttaggtaccggttacggagggtccatcacaaattccctcacatcctaagagaattgcgcacgaggggatcgctgaacgcagtgaatctaaacaacgacgcgctatctgctgcttatgcatatgacatctgcatcaagttgaaggagagagtccttttagcgaaacccacacattacactataatccgacttgctcctcccctcacaatcattcctgaggagcttgcatattcatccaaggcgctttttgacgtgctggagcatgacttgccacagctgcagctgcaaaagcatataaaaaagccagaatctgaggcacagaagccattctgtgacagatgctgccgggacttgtacggatgaatgaagcctccgaacagagataacttcattttcgtaggcacccatctagccccacaagaaataataacagagcatgagatgccatctgcctagctacttggggtaccgttatgttatgcgacttgttg

SEQ ID NO: 28616 - DNA, 452 bp, Zea mays
  Clone ID: cC-zmle189089d02a1
ttttggggggaattacattttcatttcaggcgaaataaccagttgggggtggggtttaaccgacagaaagcattctgctaaaacacacaccaactttcgtgccggcagcgcattaccaaaaaaagagctatgcaggaaggattacagatccagacctagtaaatctatatcggccaatttctggtaaccttgattgctcgttactctctagcagttcttttcttcgtgcagccctctaacaacagacgtcgcatatggccaggccttgtaactctggaccttacaagcgcggggtatactcaaagctgctcagaggaatatgctcaaatgggccaaacgcaggaatagaaccgcacaaatcattacttgaaacatcaacaactttgagactagatattccatcaagctcccttgggatgggcccagtcaaatgattgccattgacactcaag

SEQ ID NO: 28617 - DNA, 478 bp, Zea mays
  Clone ID: cC-zmle189089d02d1
gccgacgcagaaaccaaccatactagacctattgcgaaccgtgttgcaactttcccctgctgacgttcccatacggcctcaggagtaccccccgctgctgccctccgcacgaatccacatacagtcaccaaccgagactgcgcccttcatcatgtcaatcgcgaccgcgaagcatgtgctagccctgactctggctctcgtgctcgcgctcccaaacaccacctaggagagcaaacctctctcggcgctacacccaaaccttactgaccccggcacatgtcagaacatatgataccccacccttgaaaacccctgtacccgggtgcacgtgaccttataccggaacaaccgacttacccgcctacatcttgaacaaccaaacttatctaggcaaatgatgcctgagcttgtgaaactgaaacatattcagtatccaaactttagtagaataacattcgaggaacaatccctgctgagc

SEQ ID NO: 28618 - DNA, 371 bp, Zea mays
  Clone ID: cC-zmle189089d04a1
ttttaaagggggaatcaatttctatttactcgggtcatatttttcgcttcttgatgaagcaggctgctgcttcttacatatcgtcactcattacaagccagagacaatgcttcaaaattttaaaaaaccctccagaaagcaaaatcttacgctacgcaaacgcttagatgagttgctggaacgcgcggtcgagaggagatcggagaggcttgacctccttgtagaagtcaatggtagccttagcacgcttggcaataccctcaggggtgaactcaaacttcttgtagacctccttgtatggtccagaggcaccgaagcggttaaaaccgaattgctcgtgcgagtacttcttccaacccatggtggacatg

SEQ ID NO: 28619 - DNA, 316 bp, Zea mays
  Clone ID: cC-zmle189089d05a1
gggggggatcttctttacaggggtgagccattactttgtacatacaaatgtacaataatatgtcctttgataaaccattacataaagtctttacccttttttttttgatacaaatgcaaatatttgtactgttaaagccatatatacaagccttagcctatataaagcatggctagaggctaggtttgtagcacaaaaaaacatttttatgctcacatcttgcatactttgtcatctttacattcgtctgcagctcttcgggatgccatgatctcttgtagcggaggtcaacctgtaatttacatacggtattttt

SEQ ID NO: 28620 - DNA, 447 bp, Zea mays
  Clone ID: cC-zmle189089d05d1
ctgccatggggaggatacatgcggttctttcagatggatttgttgttacagacgttgaggcatttagaaagctgtacgaggaagtatgacttggatgggttcatgctgttactaagtatgagcctgtagctagcatggcaaatgcagtatatggtgtgtgggcaaaataccgtatgcaaattacaggtcgacctccgctacaagagatcatggcatcccgaagagctgcagacgaatgtaaagatgacaaactatgcaagatgtgagcataaagatgttctactgtgctacatacctcgcctctagccatgctttatatacgctaaggctcgtatatatggctttaacagtacaaatagtcgcagttgtatcagaaaaaaaggtgaatagcttatgtaatggtttaataaagtacatattattgtacatttgtatagacactgtact

SEQ ID NO: 28621 - DNA, 266 bp, Zea mays
  Clone ID: cC-zmle189089d06a1
aaaaaaaaaaacatttccacgcgggtgtttttctccttctttcttgagacgggcgtttttgcaaattaactgaacaacaaccccccccagggttcgtccatttaaattacagctcgccttgacttttaaaagaagagacatgttcttgaccatacgcaacatggatgtcatccacaccaatggatcggacgtgtatatatgtatatataattaactagctagagcgcatcatatcccactttaactgatttctttcttagatgggt

SEQ ID NO: 28622 - DNA, 392 bp, Zea mays
  Clone ID: cC-zmle189089d06d1
aagaaccaaaggtagctagctagccgcgactcgttttctattttattcaagcagcagcgcaggatgggggcgcgggtggtgattgcgtcggccgggctgggcatgctggccggcgtggcgatggccaaccggtccctcgggaacgggctcccggcggcctccaggtgggacgcgcgcccgcgctgcgccacgtgcggcggctccggccgcgtggagtgcatctgcaaccgctggtccgacggcgactccggctgccggacctgcgctgggtcggggaggatgccctgccgcagctgcggcggctccggcacgggccgaccgctccctgcacggctcaccgttcaacaccagaagccgtcgacgacgtcgacgtccggtttcaactgatcgat

SEQ ID NO: 28623 - DNA, 384 bp, Zea mays
  Clone ID: cC-zmle189089d07a1
ttttaggaatgctttattattattgattacgaggacacaccgagggagtcagggaacgacacgtccttcttcttcagtggctcatcggcgctgtcgctggcgtgataatccctttgggggggcgctcatgggcggccatggtgggctgatatccatgcttagcgcttctcttggagaggagaagatgatggagagaggtgtcgttggctgcttgccgctgtagctgtaccgtcccgacgcctcgaaattcggccccagcaagcccttactcgcagtggctgtgccaaattcttgaacaatgaagtaggagattcaggcaccggtgaccagaacaggccgccgcttccgctggcgctgccggcaccaccaagcttggagaagctg

SEQ ID NO: 28624 - DNA, 525 bp, Zea mays
  Clone ID: cC-zmle189089d07d1
acgcgtggacttctctcccagccgtcgccgcctctatctttctctctttcctcttctctctcctcccttgcgtggcctggctcctttctgtcccggccgagcaccaaaccgcgagcggatgtcaagaatcactggcatgtcgtcatggctcgtcgcagccgcgagcgctccaagctccttgtcagggccgcgagctcatcctcctcgccgtccaccggtgggtacctcttaggcgctgtcacgccagcgactagctcgttctgcttcagcttcttcaagcttggtggtgccggcagcgccagccgaagcggcggcctgttctggtcaccggtgcctgaatctcctacttcattgttcaagaatttggcacagccactgctagtaacggcttgctggggcccaattttgaggcgtcggaacggtacagctacagcggcaagcaggcaacgacacctttatccatcatcttctcctctacaaagaagcgctaagcatggataataaacaccatggacgtcatgagca

SEQ ID NO: 28625 - DNA, 285 bp, Zea mays
  Clone ID: cC-zmle189089d08d1
aacacaccctctataatgataatttctgcaaccggcctgacttgaatcacctattgcaccactgtattatgagtggctaggcctatgaggctatgaaacttgctacatttgatacataatagatacacacacttgaggagtgtatgccaagggcttataattttccacaacttttgtacttgaatattagtaacaggacatcgctctaaaaattgcacacttacatttgcaaatactgtggtacatacatcatctataaaattacccacaatcaatttactgttg

SEQ ID NO: 28626 - DNA, 243 bp, Zea mays
  Clone ID: cC-zmle189089d09a1
ttttaatagtgatttcagatacaaatcaaatttatgtttaccttagtgactatgctgatattacacattattctagctctctacttctccaaatcaaaccaactcttgttgtatttattaacaaaacccccttccctcgcgcacggctatatgtataatacatcctcaactaccgttcataataacatgcactcgcattctttgttgaacgtgaagaagatatattactcgactatttcccct

SEQ ID NO: 28627 - DNA, 353 bp, Zea mays
  Clone ID: cC-zmle189089d09d1
tcatcctctcctttaccactcatttttcgagctttactgccgaccaattctccccggcgacatgtccgagttaaacaggcgaggcccacctccaaaaaactcccacacatcgaaaggtacccctctaaatacagacgcaacatacatctcttaccggaggccatatggcccgcgcccaacacctattggctcttgcgcacaaacttaatgaggtctttgtccttttgctccttcggttcacgttcttcaaccatcaactacacaacgcctccctttaaccactccagcgccgctacgagacaccctactaagacggccaataaggccacctagattatgagggcttgttccgg

SEQ ID NO: 28628 - DNA, 517 bp, Zea mays
  Clone ID: cC-zmle189089d10a1
ccgccgtcggcggtggtttcgcgagcgtggcggactccgggaagttgaggttagcgcggctgccgcggaacctgagcgccgccacgtcgtacgcccgggcggcggcctccgcggtgtcgaaggtgcctagccacacgcgcgccgccttgtgaggatcccggatctccgccgcccacttaccccacggccgctgccgcacaccgcggtaccgcctccgcggcgtgccggagccggtggaggacggcgagggggcctgcgagctagagctgggtgacgccgtcgtcgcgggaatccgtgccgctccgtgctcgtgagcggccggtgcaggaagagagggcggcggcggcggcggcgttacatctccggcgtagtagtcgctccaccactggccctcaggcgacacctgctgctgacgggcaccggccgttgccccgccagcgacgaccgtggccagcgcgtcgaccatcatggacgccttccggctccgctcgtaccccgatagcattcgccacgccgc

SEQ ID NO: 28629 - DNA, 441 bp, Zea mays
  Clone ID: cC-zmle189089d10d1
ggcccatacatactacattcatgtgctgcgcgcccaaggtggttttcgcggttggacgagggccctgtcgttggggcgccgggggtgaggaggacgactaggaccgccaacacccggcagcggcgtggcgaatgctatcgtggtactagcggagccgggaggcgttcatgatggtcgacgcgctggccacggtcgtcgctggcggggcaacggccggtgcccgtcagcatcaggtgtcgcctgagggccagtggtggagcgactactacgccggagatgtaacgccgtcgtcgtcgccggcctctctttctgcaccggccgctcacgagcacggagcggcacggattcccgcgacgacggcgtcacccagctctagctcgcaggccccctcgccgtactccaccggctccggcacgccgcggaggcggtaccgcggtgtgc

SEQ ID NO: 28630 - DNA, 445 bp, Zea mays
  Clone ID: cC-zmle189089d11a1
ttttttttttttttttttttttttttttttttttttttggttttttgtttttttttttcaaaacaatcgccttaaaccaccactggcaaaacattaaccagcaacaaacggtccttcttttatgcaggtctccaataatttcacctcccacccaaaaaagtctaccaaatgccatgaatttcccgcccccattcacaaaaatcccaaagtgtttttttccaacagggggtttttttaaatgatgctccaacccccccttcttttgaaacgttcgggtttttcccatttaaattccgggtcctggagggcagcattacaatccatgctgccccccccggaactgcaatttttctttttttccttaaaaacggggggaaacaacaccacggaggccccgaaaagcccccctttggctgtcaacaacaaaattttctttgctgccccc

SEQ ID NO: 28631 - DNA, 497 bp, Zea mays
  Clone ID: cC-zmle189089d11d1
gggcgtccctggccaagttgtgcagcgcccatttcaagtttttcttgccgtgcttgagttctggggggacgtcaactaaaatcttgtcgtcgacagccaaaggcgggctctccgcggcctccctggtgttgctcaccgccgttcttaaggaaagaacgaaagattgcagtcacgcggcgcgcagcatggattgtaatgctgccctccaggacccggaattaaaatgcgaaagacccgaacgttacaaacgaaggcgaggttgtagcatcatttaaaaaaacccgctgtcggaagaaatcactttggtatcttcgtgaatcgggaccggatattcatggcatttggtagacttttctggctgcgaggtgaaattactggagacctgcatagactaagtaccgtctgttgctcgttactgctctgccagtcgccgtttaacacgattgtttcgcataaaaaatactccccccataaatttttccctctctatattaatt

SEQ ID NO: 28632 - DNA, 110 bp, Zea mays
  Clone ID: cC-zmle189089d12a1
ggagattcatctgggtctatgggccaaatacatgctagaagataaataagaaaaagagaaagggtgtggtgtgccattttgtaccttccaaggctctttacccctttcat

SEQ ID NO: 28633 - DNA, 111 bp, Zea mays
  Clone ID: cC-zmle189089d12d1
acgacaaaggggtaaagagccttggaaggtacaaaatggcacactttacactttctctttttcttatttatcttctggcatgggtgtggcatatagatgcagatgaatctc

SEQ ID NO: 28634 - DNA, 459 bp, Zea mays
  Clone ID: cC-zmle189089e01a1
atcctctataccgtacagccttcgccctttttttttttttttttttttttttttactttatatactttctttttttttgtatatggttatatttattatataattacacatcatataaaattaattccatccaaaccaaaaaactacaaccaacccttttttttttttttccccaattctttaacaacccccctttatacattaaaatttttactacaccccaacacttttatcaaacctttgcacaattcttattcccctaaatttttctgcaaaaacatattatcctaaatactcctttaccacaccttcttacatatttttctaaaccacataccatgtcaacatttttaaccctatctttacgccaagaatatgccatggcacaactcttgccaaatcacttatgacattaaacatgtccaccatcatcattcttttgaccggaaaaactctttg

SEQ ID NO: 28635 - DNA, 532 bp, Zea mays
  Clone ID: cC-zmle189089e01d1
cacccgtccgcccacgcgtcctcccacgcttcccaaaattgctgtttttacttttaccattattaaccacacagatggacaaaagaggcatgcttgctacttgcctacatcatacgcgccaagtactgaacccaatggtgtttttagggagcgtggcactaactctgaggagcatcaacattctgtagagaacacagaaacttcacgacaagctggtggtgattgtataaaagacgggggcagtatgtctcccgtgaaggatgtaaatacgacaacgacaagtgattcggagccttattcagtaagatgactgactactacacagatggtttgttcctgtacccaacctgttctcttgccaacaggaaggaatcggaatgtgtttggctccaaaaattcatcgatatcaagctggaagcatgattggaggtgacatagatcggagctacctttacatcttacgtaaaatttcagttaccccttattgagcctgaaaaggtaattttgcacaaggaaagatctgacgaacatc

SEQ ID NO: 28636 - DNA, 392 bp, Zea mays
  unsure at all n locations
  Clone ID: cC-zmle189089e02a1
aataaagcccattagcacgaggggagggtatttgttttcacagatgaaccgtgtgctataattgtgagcagtaacattttacttgctcaaattaatcaagacacttccgtatcaactactatacatcgatgtggttcctacaagctgggctctccattgctttgtgattgctcgctctgacacaaaacaccgaaaagcatacgcaccgcaagccttgtgacatctcaagcgacaaacagctcggcctggccgtcaatgaacaagctcatgaattcctccccgtccacggtctccttctcgatcaggagctgggcgaacttgtggaggatgtcnatgtgcgtggtgattatctgccttgctctagagtagcggacgccgtgggtcgacccggg

SEQ ID NO: 28637 - DNA, 367 bp, Zea mays
  Clone ID: cC-zmle189089e02d1
gtactctagagcaaggcagataatcaccacgcacattgacattttccacaagctcgcccagctcctgagcgaggaggagaccgtggacggggaggaattcatgagcttgttcattgacggccaggccgagctgtttgtcgcttgagatgtcacaaggcttgcggtgcgtatgcttttcggtgttttgtgtcagagcgagcaatcacaaagcaatggagagcccagcttgtaggaaccacatcgatgtatagtagttgatacgcatgtactgactaatttgagcaagtaaaatgttactgctcacaattatagcacacggttcatctgtgaaaacaaatatgctcatctcgtgctaatgggctttatt

SEQ ID NO: 28638 - DNA, 248 bp, Zea mays
  Clone ID: cC-zmle189089e03a1
ggggacagacataaccacttataagggtgcccatatatgtatagtacaaactttttgtagttctgtaaagactaaaaaaagggcctttctgggcatattagtaaccactacgttattccaagccatggctgactatgggctatggcattcgagaataccagcacattacattacgattgtaggtaacagtttcatcacatggggcaagctcacgcattatcgtcgccttcaacaatgttgacaccctc

SEQ ID NO: 28639 - DNA, 257 bp, Zea mays
  Clone ID: cC-zmle189089e03d1
cacccgtccggagcgtgtcaacactgttgaaggcgacgatgatgcttgagctttccccatgtgatgaaactgttacggacaatggtaatgtaatgtgctggtattctcgaatgccatagcccatagtcagccatggcttggaataacgtagtggctgactgatatgccagtaggcaccttatctagtacttacagaactacaaaaagtttgtactatacatatatggacaaccttataagtggctatgtgtgtacct

SEQ ID NO: 28640 - DNA, 478 bp, Zea mays
  Clone ID: cC-zmle189089e04a1
acgccaacgtcagctcggatcctctagaggcccgccctttttttttttttttttttttttttttttttgaaaacaaaaccaccgtctggggaagcgttatttgaaaaacaaggcaaacaccgactttcaatctgacgatttgctcaattacacaactcgaccaccacactttccctctcacagaatgttttcttggacaagattttatttgaagtctatcagcagcttaagatgtaaaagacgaactaccacagttccaggctacttcattcaactcaatggaagggtcacatcacctctccaatccaggaacagcagcacgagaagcaaggcagcagcgccgctactccgccttgacggtcttcttgggctcgtggagttcaagcgggcgggcatccttgccccaacccacgccgggggtagcctctaggtattggtcgacgaggtggcggcactttggtggtggttgatgccctca

SEQ ID NO: 28641 - DNA, 576 bp, Zea mays
  Clone ID: cC-zmle189089e04d1
gtgcgatcctcacccaatcgaaggacctagcgagcggctttggctgtggcgatcggagaagatggtgcgcgaggcgagggttgagttcgacgagcagccgccggataacttcgacccgaagaacccgtatgccgacccggtggcgatgctcgagtaccgggaacacctggtgcgagagaagtggatccagatcgagaccgccaagatcatccgggagcgcctccgctggtgctaccgcatcgagggcatcaaccaccaccagaagtgccgccacctcgtcgaccaatacctagaggctacccgcggcgtgggttggggcaaggatgcccgcccgcctgaactccacgagcccaagaagaccgtcaaggcggagtagcggcgctgctgccttgcttctcgtgctgctgttcctggattggagaggtgatctgacccttccattgagttgaatgaagtagcctggaactgtggtagttccgtcttttacatcttaagctgctgatagactttaaataaaatcttgtccaagaaaacattctgtgagcgtacatgttgtcgtcgagctgtgtaattgag

SEQ ID NO: 28642 - DNA, 451 bp, Zea mays
  Clone ID: cC-zmle189089e05a1
tttttattgatctacgaatcaaatgatatttttgttctaagttctggcgcttcttctccctctgaatcaaacttttttttgccataatgtgccgttcctattattaccaagtatattggtcttattcctagatagaaaaataaatagcaaaaatctaaaaaggcggatcctccctctccatcaagagtaatgaactgggttctgatacagtacaaaaaaaaataactaaattaaccaaacttgcctgatgttgaggcaatcaagaaagctgcataagtgaatatataacccacggaaaagtgggctaatccgaccaatcttgcttgcacaatggaaagagccacgggcttatctctccagcgaattaaattaccaaaggtgtccgttcatgagcccatgctaaagtctcaattaattcctgccaatatccacgccaggaaattaagaacat

SEQ ID NO: 28643 - DNA, 614 bp, Zea mays
  unsure at all n locations
  Clone ID: cC-zmle189089e05d1
gcccacgcgtccgcacaaacacaaagtttgtggctgtccgatattgctcatcatcatttagctattgcgtgtattgttctcattgccggtcatatgtatcgaactaacttcggaattgggcacagtatcaaagatcttttagaagcacatactcctccggggggtcgattaggacgtgggcataaaggcctttatgatacaatcaataattcgattcattttcaattaggccttgctctagcttccttaggggttattacttccttagtagctcaacatatgtactctttacctgcttatgcattcatagcacaagactttactactcaagctgctttatatactcatcaccaatacattgcagggttcatcatgacaggggcttttgctcatggagctatttttttcattagggattacaatccggaacagaatgaagataatgtattggcaagaatgttagaccataaggaagctatcatatctcatttaagttgggctagcctcttctaggattccataccttgggcctttatgttcataacgacgttatgccttgcttttggtactccagaaaagcanatcttgaattgacctatatttgcccaatggat

SEQ ID NO: 28644 - DNA, 198 bp, Zea mays
  Clone ID: cC-zmle189089e06a1
ttttatatcaaacttggatattgtattagcttagtttgtaggatgcgattacacacgactctagctatagctagctcatatacaaaccatcacatgatatatagatacacatacgcctgccataatgcatgcacatatatatagtatgtagaaatctataatacttaattacacgcacgcgcgctatctctcgatcgt

SEQ ID NO: 28645 - DNA, 541 bp, Zea mays
  Clone ID: cC-zmle189089e06d1
cacccgtccggacgccgtcaaggtcaggaaggcggcgtcctgggatctcgccttggcgctgccccgcgcgcacgggggcaagcggtaccggtaccttgagggcgcgtcgtccctgccagcgttcgcgccgacggcgttcctgttctgatcatggcgtcggcgacggcggcgactcgtcgtcatccaccacgacgacgacggcggtgaagacaataagaaccaaccaaaaccactacacgaagcatatatacagattactgtcaacgtattgtagaaccaaggatctatgtatatatatgtgcctccatcatcatcggaccggaataaagctagcaatctctcttcttcacgatcgagagatagcgcgcgtgcgtgtaattaagtattatagattactacatactatatatatgtgcatgcatgatgcatgcgtatgtgtatctatatatcatgtgatggtttgtatatgagctagctatagcttgaatcgtgtgtaatagcatactacaaactaagctaatacaatatccaagtttgctat

SEQ ID NO: 28646 - DNA, 382 bp, Zea mays
  Clone ID: cC-zmle189089e07a1
tttttaaaaccatatattcacattgtcactagaaacataagcattcggtgtcatttacagctaaccacgacagtctgtggttcatcaaatcatcaggtggtggtagatatacctccatacacggttttcacgttggacggctacatgatgaaaccacaaaactcatcacgcttcagggcaccttggacaaacccagtggcatgcttcttcatggtctcctgccagactccattgactccaaaatagggctggtgtccctcaggacaatgtcaccatggtcatctggttcatcttcaaactctgtaagtcttatgttgattgagtttgcattaccattactgtggtgtctcagctagcttgtggaagtatgcgtgtggccata

SEQ ID NO: 28647 - DNA, 629 bp, Zea mays
  Clone ID: cC-zmle189089e07d1
acccgtgcgcgctggtctaggttttcttgcatggtacttggctgttaaacttttagcttttgatcgcaagggtcgcgttgcatgactgtgcttagtttttctgcctctacttgtcgcgtcacttgtggctgtttctcgagttgatgattactggcatcactggcaagatgtctttgccggcggcatcataggtcttacagttgcttcattctgttacctgcagttcttcccatatccctttgacaatgatgccctatggccacacgcatactttcaacagctagctgagacacacagtaatggtaatgcaaactcaatcaacataagacctacagagtttgaagatgaaccatatgaccatggtgacattgtcctgaaggacaccagccctatcttggagtcaatggaatctggcaggagaccatgaagaagcatgccactgggtttgtccaaggtgccctgaaccgtgatgagttttgtggtttcatcatgtagcccgccaacgataaaaacagtatgaggtatatctaccaccacctgatgatttgatgaaccacagactgtccgtgttagctgtaaatgacaaccaatgtttatgtttctagtgacaatgtgaatatttcgttttt

SEQ ID NO: 28648 - DNA, 518 bp, Zea mays
  unsure at all n locations
  Clone ID: cC-zmle189089e09a1
ttttccatcgattaatcgttgtttatttgcttgtttatccgtcattggttgtagtagccgactaggtaacagcaatatataggaggagaaaaaacatacaataactcggcttattaaatttttcctttgtacacctctatgcacatacatatacccatttcattagatctatataatacaggtgtctaaacttgttcaaatatatatacacacagactagcacagcaaacatacatcactccacgattgccacccgatccaagaacagtcttgcttcgtactgtcgtcgatcaagaatctgcgggccggccgggccgtctttcctgctagcgaaatcgaaaccacgccatcacttatttagcctcagccggttctgggagtgtgatcaattcggttgaagaagtcgtactccaactcagtgccacaacttgcacatttcacgctgttttttgagccaccgctaggcactgacagtatggtaccgaaaaagagaggttttcattcncgcagtttggaca

SEQ ID NO: 28649 - DNA, 533 bp, Zea mays
  Clone ID: cC-zmle189089e09d1
gcggatttcacgggatttgaaatcacatatcttcttgttttgccgttttcctttcagtttcatcttcacggggttcgtggcactgcctttaatattttgggtagcgcaggcgatcactaatgtcatagtgaaggacttcctgatcttgaagggtccgtgtccaaactgcgggaatgaaaacctctccttcttcggtaccatactgtcagtgcctaccggtggctcaaaaaacagcgtgaaatgtgcaacttgtggcactcagttggagtacgactcttcaacccgattgatcacactcccagaaccggctgaggctaaataagtgatggcgtggtttcgatttcgctagcaagaaatactgcccggccggcccgcagattcttgatcgacgacagtacgaagcaagactgttcttggatctggtggcaatcgtggagtgatgtatgttagctgtgctagtctgtttgtatatatatttgaacaagtttagacacctgtttatattgatttaatgaaaatggtatatgtatgtt

SEQ ID NO: 28650 - DNA, 342 bp, Zea mays
  Clone ID: cC-zmle189089e10a1
acggggaagaccttagcattcatgtgtccatggtcaattagtcgtcacaagggcataacaaatacataacatacaactttcccatcgtcttctgacaataagtgtacatttgagcacgaggtaccaaaaatccctatctagctttctagactgtcgactgatcgagttggcaacaatgatacaaaaccaaggcccatcggcgccttccccctgtatgctaccttgacgacatgtacagtatcccctatatgtacaactcaaaagcgcaataaaaaagaatgctatacggagagccccaaggctggccaagctgttaactctgtccatcccatcgtgttccca

SEQ ID NO: 28651 - DNA, 367 bp, Zea mays
  Clone ID: cC-zmle189089e10d1
gtgggaacacgatgggatggacagagttaacagcttttccagctttggggctctccgtatagcattcgtttttgtggcgcttttgagttgtacatataggggatactgtacatgtcgtcaaggtagcatacagggggaaggcgccgatgggccttggttttgtatcattgttgccaactcgatcagtcgacagtctagaaagctagatagggatttttggtacctcgtgctcaaatgtacacttattgtcagaagacgatgggaaagttgtatgttatgtatttgttatgcccttgtgacgactaattgaccatggacacatgaatggtaacgtgttcaccgtgtaaaaaaaaatcaaaaaatagca

SEQ ID NO: 28652 - DNA, 287 bp, Zea mays
  Clone ID: cC-zmle189089e11a1
gggggccacgggttcactattcctgcaacgacatggttcttacacactggcattaccgggaaaaaaaatagcatgcgatgcttgacacattacagcacaaagatggacccctattcaggaggaagactattagcacccaagcatttttgtaatgtccacctcttgcatcatggggttcacgaggagcaggacagcatgcccactccaggtctgtatgcccaagctggtggcaaccgggcatacttttccattcccggctggttgtcatacggattctgcattaccct

SEQ ID NO: 28653 - DNA, 459 bp, Zea mays
  Clone ID: cC-zmle189089e11d1
tccgcggacgcgtgggcggacgcgtgggcggacgcgttttcggacttttgggcggacgcgtgggcggacgcgtggggggacgcgttggattctccgcaactatctctgccagtctgctatcgacgcagctgagcaaggcgattacgaggaggttcggcgggtgcttagggtaatgcagaatccgtatgacgagcagccgggaatggagaagtatgcacggttgccaccagcctgggcatacagacctggagtgtgcatgctgtcctgctcctcgtgaaccccatgatgcaagacgtggacattacaaaaatgcttgggtgcttatagtcttcctcctgtataggggtccatctttgtgctgtaatgcgtcaagcatcgcatgctattttttttcccggtgatgccagtgtgtaagaaccatgtcgttgcaggaatagtgaaacagtgggaccaaataaa

SEQ ID NO: 28654 - DNA, 294 bp, Zea mays
  Clone ID: cC-zmle189089e12a1
aggattacgaaaaacttttattcaggtcacgagcttattgtcgtaattcgtacaggagctgagtgcgtgcacgtaccatagccaagtacgatgaccctgcacaaccagtcaaccacagacatacataaggcacgcaggcaagcaccaacgggcgtggatgccggccgccgggcggctcaattagccctggcgaggaagctctccctgcgctcggggacctcgccggtgcaggggttgatgtcctcttcgaccctggtctcgcgcaccacgaaaccgtggccgcccgggtgacca

SEQ ID NO: 28655 - DNA, 582 bp, Zea mays
  Clone ID: cC-zmle189089e12d1
gtgcgcccacgcgtccgtccacacaagcacttcgacgtctttcgggcttttgcgcacagacacaccaagcgtgggcaccagtggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcagggagagctttctcgccagggctaactgagccgcccggcggccggcatccacgcccgttcgtgcttgcctgcgtgccttatgtatgtctgtggatgactggttgtgcagggtcatcgtacttggctatcgtacgtgcacgcactcagcttctgtacgaattacgacaataagctcgtgacctgaataaaaactttttcgtaattctaaaaaaaaaaaaatggtatcacgtatttttttttgtctttttt

SEQ ID NO: 28656 - DNA, 331 bp, Zea mays
  Clone ID: cC-zmle189089f01a1
ggttccaaattttcaaccccaatcacttacacccacttttaactcttttctgaaaaaattcaagggggaaaaaattattttttaacaccaaaaaatacacctcacacaaacctaaaacccaacttttcaaatttacaaaataacactttcttggacaaacccccaaaaaataaattaaaaccccttaaaaaaacaaaaacccacatcataaggaaatacactttacatttaaaaaccaattttcttctaccaaataaaaaaccttaaatacaaataacactttggtcaaccccggaaattccgacccgtaccttcaaaactaccacctttt

SEQ ID NO: 28657 - DNA, 321 bp, Zea mays
  Clone ID: cC-zmle189089f01d1
cgctgtaattaaggctctctactcgacagcagcaacttcttcttttcatgtaaagtgtatatcctgatagtgtcgcgtattgtagttctacggtgatttcattcattcttttgtggtttgtccatgtagctgttaatctgtacagttcgatagttgggttctaggtttgtgtttgctgtattctttgtagttattagatgattttcccaccctgaagttgtacagaacagagctagaagtgagtgtaagtgaatggggttgcagttttggcaaaaaaaaaaaaaaaaaaaaaaaaaaaaaaaataaaaaataataaaaata

SEQ ID NO: 28658 - DNA, 440 bp, Zea mays
  Clone ID: cC-zmle189089f02d1
ggccacgcgtcctatgaaagcgctgcacacccttgtttcatcgtttacagaacaaggcactggctgggggacaaggtcagcttgtggagagtaaacctcagctacttctacctgaaccggatgtcgcagctcctcgagtcacacacataggagacaagattcttgacgctgcatgcatgaccgacgcactctctctcttggtgattacaagatcaaatagagagcgcattcacacatacatagcttaaaatttacctgtgtgctttgctccagagatggacaacccctaaagcgatcgaaacatactacaagcggacctttcctctgcccaggcaccgtatgggtccgaactacaccttctccttcgacatgtgctcgagcctcgatcgcgatgctgacctaaggcttctaccacaggactcaacaatgcagaatctttc

SEQ ID NO: 28659 - DNA, 431 bp, Zea mays
  Clone ID: cC-zmle189089f03d1
cacccgtgcgattatgtgttctgacacacgtcccttgatgagctttttgcactttccctgcaccctccttttcaacaggggagagacaaaataccatctccaagggtctacatgatcggagctctgccccttcattacagatggataggattagcatctacgacactttaccactagagctctatgacatgttggatgttgtacccactgtatgcacttactccttaaacactggccaatctatatcatactctctctgatcttacttatctatttggcgcgatcataggtcaaaaatgaacttacagtgcgacaaatattcaagaacggaagccgtatatcacttagacgtcactatagtgccccgcatgtagtcaacctctgttcgctctcgagaaataggagttcatgctctagtatcagcctctttg

SEQ ID NO: 28660 - DNA, 376 bp, Zea mays
  Clone ID: cC-zmle189089f04a1
gaggccaaaacatatttaatgacttcactaatctcgcattttgaccacattttaaaattttacccaaaccaaaatttttttccctcccccgctgtaggttgtaagcgtttcttaatctaaaaaaaagttattgtaaaactgaaagtaatcaacccaaaattggcttgcgtaaaaaaattttaaaacattattcctgcacgtgtccccatgctcaaaacaacaaaaaaccccccaaaaagacctaacaaaagttaaagttctattcaatacaaaacatttagcattggggaacccttatttcctcattcattcaactggacgagcggggcaacattcttttacaggggatcgaaaacgacttcttcaacttttttac

SEQ ID NO: 28661 - DNA, 554 bp, Zea mays
  Clone ID: cC-zmle189089f04d1
tccgcccacgcgtcctcggacgcgtgggcggacgcgtgtttgtgattttgggtgcctactgcctgctgcgggcttgcggcatcgatcccgagtgcatcattggccatcactctatcctcatggaaggttcgctggttgagaccaactcaatcctggaggctggctctgtattgcccccaggaaggcgaattccgactggtgaactctgggctggaagcccggctaggtttgttcggaagctgaccaacgaggacatcatggacattccaaagcttgcaactgccatcaacgatctgatgcaaagccatttctcggagttcctgccttactctaacgcttatttggaggtagagaagttgaaaaagtccttctcgatccccctgtaagagcatgttgccccgctcgtccagttgaatgaatgatgaaataaaggttccccaatgctagatgttttgtattgaatccaacttctacttctgttacgtctttttggggggctccttgttgttttgagcaatgggacacttgcaggaatcatgtactgataatctttt

SEQ ID NO: 28662 - DNA, 378 bp, Zea mays
  Clone ID: cC-zmle189089f05a1
ttttttttttttttttatacgggacgacgattcccatccgagcccgtgtttattccatttcattcatcccaactaattcccttatcaggtctttctgctccgctctgggtatatatattaaacatataaggccgcacgtcccttgtagtatcatctggacgatggccgggaccgggaccaccacctgatcctgaacatccatccagccccaagagagctgaacccgccatcaatggtggtggtgctgcgagaacggccaccatcttctcctcttggtcgtctgcgacctcggagcatctgcagcattcacaaaccacagaatcgtcttcaccagcttgtttggttgtgcttgcacatgattcctaccactactcgaac

SEQ ID NO: 28663 - DNA, 597 bp, Zea mays
  Clone ID: cC-zmle189089f05d1
tgcgcggacgcgtgggcgcgatccaattccggcgccggttaagacgttcgcaggccccacccagccgcctagagggttgtcgagctgtccttctcctcccgcgctccgctccggaacccctagcgtagctcgcttcgattgctccaaggccagcgctttgttctgtgtcctggccggcgagcaatccaatccggtccgaatctttcttagtcgccgccaggaatccagcccacccggctctgcgctccgctcccacagacggacagtttgagctcgacggatgagcatgtgtgagaaagatcagaatttgccatggggatacgacctgttccgcgacccttttgctcctcccaacgggtactacgggcctcctcccggttactgtgatggccactgttgtgacctccatcattacggtagagcatcacatccagatgagactcagttgcattcttctcaactcgcatatgatatgtacaacccatcagtaggcatctaccatcctggaagcacccatgagcacgagcacgaaacagtatatgtagaaccgtctaattcctcttcagaacaggtggtgacggttgttttgagatggag

SEQ ID NO: 28664 - DNA, 359 bp, Zea mays
  unsure at all n locations
  Clone ID: cC-zmle189089f06a1
ctcgcaaaggggctaggggttaaggcgtacgtagtctccaaacattattaacaggagaggatggatcttaaatgcaaatagcccttttttaattttcacaccgatgaccaccaccttgtttacattcagatcattaacaggagaggaggtggatctagagcgagaggccaccggactcctcgtcctcgtcgaggtcaaaggtgtaaatggtgtaaagggaccagatgaggccgaaaacccccaggaggatccaccccancaggttgttgctgagcccgaggctcaacccggtgccctccggggacatgcgctcgtccacaagcgccagcgcgggccccgccgacacggtcaccgcgccc

SEQ ID NO: 28665 - DNA, 547 bp, Zea mays
  Clone ID: cC-zmle189089f06d1
cgggcagcacactcagctatccagcaaaagagatcgatatgcagtgtttcatggccaccgtcagcgccggggtggttgccaccatcgttgcccgcgccgcgatcgccaggcccaatgctctagggctgcctgcgttgagggcgaggagcgagagggtgcggtgcagctacgccaaggatgccaagaacgcggccccagtcagcaccaagggcgcaggcgcgtcgctgctcgccgcagcgggcgcggtgaccgcgtcggcggggcccgcgctggcgctcgtggacgagcgcatgtccacggagggcaccgggctgagcctcgggctcagcaacaacctgctggggtggatccttctgggggtcttcggcctcatctggtccctctacaccatctacacctctgacctcgacgaggacgaggagtccggtggcctctcgctctagatccaccttctcttctgttaatgatctgaatgtaaacatgggtggtggtcatcggtgtaaatttagacatggctatttgcatctaagatccatcctcttctgtt

SEQ ID NO: 28666 - DNA, 304 bp, Zea mays
  Clone ID: cC-zmle189089f07a1
gtgggggacaatatggattgatggcgcagggaggaaatgcttttcatctccatctatttgtacagccatagttcataacaatccacacaacactctgcttttactgtaaggatattaatttcctgcagccacatcttgacatcctccgcatctctctcaagccatgcggctttggcactgatggcgtcgatgctctgagacagcgccatatcgaagcccttggtgctcttgctgctgaagaacgcctggatatcttcaatgtgttcccggtgagtgaagcccgatgttgtaatggcaacaaccg

SEQ ID NO: 28667 - DNA, 448 bp, Zea mays
  unsure at all n locations
  Clone ID: cC-zmle189089f07d1
cacccgtgcggccctcagtgacnaagtcaagggccaagacatctatttgcccattgctgccttaaggtcacacgcggggggcttgcacgcgctttggaagtgggtcacggacaactggtcggagctggagagaaggctgcctcctagcttgagcatgctaagttcggttgttgccattacaacatcgggcttcactcaccgggaacacattgaagatatccaggcgttcttcagcagcaagagcaccaagggcttcgatatggcgctgtctcagagcatcgacgccatcagtgccaaagccgcatggcttgagagagatgcggaggatgtcaagatgtggctgcaggaacatagatacctgcagtagaagcagagtgttgtgtggattgttatgaactatggctgtacaaatagatggagatgaaaagcatttactccctgcgccatc

SEQ ID NO: 28668 - DNA, 372 bp, Zea mays
  Clone ID: cC-zmle189089f08a1
ttttggatcaaaattgctttttttcttttctttcgatcgcggtacagactgcacatctatctacaaaaactgtacacatatgtagattggaggatcctctaaaacgcggaggccaatcgcaaggacgcgcgctaagagcggctacacctacacatgaagacgagaggaggatctacgagctaaggacgttgagtagggcgactctggtctggaccatcctcctgaacagaagctccgctccacgctcaagctctccaacgacgacgcgctccagcgccagcacctggccctcctcgcacacgaccgccttgcttctcctctgcaacgccttggagacaagggacctcctgggcgtcagagtcaccacctgct

SEQ ID NO: 28669 - DNA, 464 bp, Zea mays
  Clone ID: cC-zmle189089f08d1
acccgtgcggccacgcgtccgggagcgctctctggacctcatctttctctgtttacgcgacgcaggagagcctcggggggctgaaggccgccgtccaggacctgctggcgggtctcaggcggagggacgacgcgagcgtccaggccaaggtccagtcgtatgtccgcctggccaagaacgcacggaagcagctcacgaaggccggcaggagggccgctgccgcctctggcagggaggagcgcgagtgcagtctcgtcaggctgctgctcagggccaggctggtcgctgcatccctcctcggatcggcgctgcagtgcctcgcggccgtggcgaagcaggtggtgactctgacgcccaggaggtcccttgtctccaaggcgttgcagaggagaagcaaggccgtcgtgtgcgaagagggccaggagctggcgctggagcgcgtcctcattggagagcttgagcgt

SEQ ID NO: 28670 - DNA, 390 bp, Zea mays
  unsure at all n locations
  Clone ID: cC-zmle189089f09a1
tttttgagcttatcaaaaccatgcaatcacgagcacaccgggacagtgatatcagaaaatgttggatacacataatccggaaagcaagcttgggagcaacaacactaggactgactggccccccttccgaaaaagtgacacaatcttgagcgagaacacgagctgtgcttaggccagggcagggaactgagcctggtcttcgatcgctggagcagcagctggtccccgataaccgccgttgtaaccaccacggaaccccccacggcccctaccacggccacggccactagggttatagtacctttcgccttcagctggcttcaagaactcgttgatgctcagggacttcttgccccgttcttctcttccacgcgtccgcccacgcgtncg

SEQ ID NO: 28671 - DNA, 393 bp, Zea mays
  Clone ID: cC-zmle189089f09d1
gtgcgcggacgcgtgggcggacgcgtgggaagagaagaatttggcaataagtccctgagcatcaacgagttggtgaagccggctgaaggcgaaaggtactataaccctagtggccgtggccgtggtaggggccgtggggggttccgtggtggttacaacggcggttatcggggaccagctgctgctccagcgatcgaagaccaggctcagttccctgccctggcctaagcacagctcgtgttctcgctcaagattgtgtcacttttgcggagtgcgtcagtcagtcctagtgttgttgctcccaagcttgctttccggattatgtgtatccaacattttctgatattatgtactggcgtgctcgtgattgcatggctttgctaagctcaaaaa

SEQ ID NO: 28672 - DNA, 269 bp, Zea mays
  Clone ID: cC-zmle189089f10a1
aacaagtcctgtgcttatttttttaacacattaaaccccaccaccctaattaaacataacaaacaaattaaacctaatgaatttattaactcatacccatgctcacattatcctgccgttcaaaaactacacacaatcaactaacaaacaacctaacgatacaaaaaaaacttaaccccgacacctacgctcaccccaaaattccgaacccttacccccaaacataccaaccttccctatattcaatctaaaaaaaccttcccgtaaca

SEQ ID NO: 28673 - DNA, 179 bp, Zea mays
  Clone ID: cC-zmle189089f10d1
gtcgaactattcttgtatccttagattgtatccatgctagttttgtgtaatctttgaactgcacagaaatgttgtcctggttacgagcgaatatattcattacctttaatttgttcgttatgtttaatttacttgctatactttctatgttcgaaattataagtcccgtcattgttccc

SEQ ID NO: 28674 - DNA, 121 bp, Zea mays
  Clone ID: cC-zmle189089f11a1
gttgttcatatatatgtaagggttccgaaatgccccaatttcgtcaaggtgacaaggtgtcaatgctgcagataaccaaaaggccaatctgtcatagcctgagctgatcacgtcatgggac

SEQ ID NO: 28675 - DNA, 133 bp, Zea mays
  Clone ID: cC-zmle189089f11d1
accacccgtccggtcccatgacgtgatcagctcaggctatgacagattttcctttttgttatctgcagcattgacaccgtgtcacgttgacgaaattggggcatttcggaacatttacatatatatgaacaac

SEQ ID NO: 28676 - DNA, 558 bp, Zea mays
  Clone ID: cC-zmle189089f12a1
ttttcgttaccagacggttctccattttcagaattccgaattcgatacattattacaagataatgtattgatggtcaaaacacatttattctgccaaaaaggggtcatcaattgggccatacaaccaccaatcatccatatactcgtagcagccggtgcctggatgactacatccttgcagcaggaagcttccctgcactatgaacaccattctctagcattctggaacattcgcagccaagggctggggccactcttctcaacctgccattccttgggataccatggatattgccacatcatgaagcaacgctctggatgcggcatcatagccaggtgcctcccgtcaggtgagcaaagggctgctatacccagtggagaaccattagggttgaagggataggtctcagtaatattgttagaatcatcacaataccgcacaggagccagatttgacttcacaacagtagctagaacattttcatctgggaaaaaagctcttccctcaccatgagcactccaaacacctaaggtggaacctttcatccctttgaacat

SEQ ID NO: 28677 - DNA, 441 bp, Zea mays
  Clone ID: cC-zmle189089f12d1
accacccgtgcgctcttcttggctgggtgccacgatcaggtgttgttttttctttttgtacacgtggagatatgtcccggccgagttttattcacaatgaatctggtccctttgagtgccggtttaccagtgtgtccattggcgattctcctgctattatgttcaaagggatggaaggttccaccttaggtgtttggagtgctcatggtgagggaagagcttttttcccagatgaaaatgttctagctactgttgtgaagtcaaatctggctcctgtgcggtattgtgatgattctaacaatattactgagacctatcccttcaaccctaatggttctccactgggtatagcaaccctttgctcacctgactgtaggcacctggctattatgccgcattcagagcgttgctttatgatgtggcaatatccatggtatccca

SEQ ID NO: 28678 - DNA, 351 bp, Zea mays
  Clone ID: cC-zmle189089g01a1
attataaatttgggttaagtttaaatttaaatccacaaacacaaacaatcccacttaaattcacttacattcccctattatttttttttttccaaaaaaaaaatttttttttttcccaaaatttttctcccaaaaacaaaaaaattacccattgttaaacccctaccaacaaaaaaaataatttttttccccccaaaaaattttttaattatccccccactttcaaaaaaaaaaaaattttacaaaacccctccccaaaaaaaaaaaaacccaaccccaccttccttccccccggaaaataaaaaaaacccaactcaaaacctttttaatatttcaaaaaaacccaccctt

SEQ ID NO: 28679 - DNA, 453 bp, Zea mays
  Clone ID: cC-zmle189089g01d1
gtccggcgacaggttctaatagatttccaggagaacccatttgcggctttatgagcacctgaagaaccccgggggtatgggtaagattcagaagcttgtaagtgctgggatagttcagatgagatgatcgagcgatgcgatgattggctttgttcgttcacgtgcaccctggtcatacatatgttttaacaagcagcagcggcataagaatgaacctgttcgggggctaatcttattccttttggattgtaagtgcattgacattggataattcatgtttgtggcactgagtttcgagtatacgctactttctcatcctggaacaagacttgccacagctggagatgcagaagcaggtcaaaaagctctaatttgtggcacttaagccagttctgcggcagaatgcggccgggacttgtatcggttgaatgaagctctaaaaacaaagataac

SEQ ID NO: 28680 - DNA, 231 bp, Zea mays
  Clone ID: cC-zmle189089g02a1
ggcacaaaaccatcccccaaaaaaaccggaaacttttttttccctgaaaaacccggtccccaaaccaaaaacacttttttttgattccccacagaccccggcaacaaacattaaccaaaaacaaagaccccccccccggtccctaacttgcttttaagcaaattaaggaacccggccgggccccaaaccacaccaaggaccggcactaaaaaactttaacccctccaaaaa

SEQ ID NO: 28681 - DNA, 507 bp, Zea mays
  Clone ID: cC-zmle189089g02d1
cacccgtgcgagaccacagccagtcagccacatcactagctatcttttcagatgcaatggcgtccaaggttgagctgggggtggaggtcaagtccccggctgacaagctgtgggcggcgctgcgtgactcgacggagctgttccccaacatcttccccgagcagtacaagagcatcgagaccgtcgagggcgacggcaagtcggccggcaccgtccgcctcctcaagtacaccgaggcggtgccgatgctgacgttcgccaaggagaagcttgagacggcggacgacgagaacaaggtggtgtcgtacagcgtggtggacggcgagctggcggacttctacaagaacttcaagatcacgctgaatgtgactccggccaaggcagagggcgagggcggcgccctcgtcagctgggccatggagttcgacaaggccaacgaccaggtgcctgacccggacgtcatcaaggagaccgccaccaagacgttccacgacctcgacgactacc

SEQ ID NO: 28682 - DNA, 521 bp, Zea mays
  unsure at all n locations
  Clone ID: cC-zmle189089g03a1
ggctcgagcccctgtggaatttggaacacatatctcgctggcgacacagggtattgctggaatgtgcctgccgtgaaatacccggaaatcttggtctgcgagcacgttgtttcgccgcctttttaacacagttgtcgcatgaaaggcaagcatctgcggcatacgatatcccgacagtggatccaatactgggataagaaacgccttgcccttgcttcagaacaaagccgatgccttcgtgtcctccaatctggcctttgggagtcaatgctgggacggcatcgaactggttgaggcagaatccaacatctgtatgacagactccggagtaagatagtcgaataagaatttccccgggtccaggctccggnatcgttgtctcgacgatctcagtgcgaagcgaatttccggggtctgcatagactatagtcttgttcacttggacctcagccatggtcgtagatgtctctgtagctcttctgcgctgccgtacttttgaggtcgatgtaagtgctggatgt

SEQ ID NO: 28683 - DNA, 542 bp, Zea mays
  Clone ID: cC-zmle189089g03d1
caaccacccgtccggtgaagtcgagcgtattcatggtgaaattggcaacttcactgtttacgttctggtggtattggaggtggtatgccgaaatggcatccctttatgctcttgagggggcaacccagactgaccaaattaggatagtcaagccgagggtttgccatgacacccttcacgatctcctaagccgtttttcgttactctggggtcgagtcaggcccgtcatgtcagtgtcaattgaggagtttccccacacgagcctgttagccgagccacactgccttggtagactaacccgcactgtggccaaggatatcacttactagttatccctttcgttaaattcgtgggttcacggacttttccgaaatcaactgagttctactctgggcagcactcgctacgttcgtgaaccgatacgacatccagcacttacatcgacctcaaaagtacggcagcgcagaagagctacagagacatctacgaccatggctgaggtccaagtgaacaaaactatattctatgcagaccccggaaat

SEQ ID NO: 28684 - DNA, 324 bp, Zea mays
  Clone ID: cC-zmle189089g04d1
tccgcccacgcgtcctaaaaaaaacaaacaaaaaaaatttttaaattttttaaaaaaaaaaaaaaacaaaaagaaaaaagttttatattataaactttattaccccctttaccttcatcctaccctccacccttcccttcttttctcttttcctaattcctttttcttatcacctttcctttaccctctctccaccacttttcttatcctcaactttttttccttttctacctcctatctttacttctcctccatactacccctcctctttcataaaaccccctttcttcctctcctatccttccctaaccttcttccttccct

SEQ ID NO: 28685 - DNA, 460 bp, Zea mays
  unsure at all n locations
  Clone ID: cC-zmle189089g05a1
gcttgcatcctctagagcgcccgcccttccccccccccccccttttcttttttcccccccctcctctttctcctcccccagcctccagaccttctttttaatttcctcctccatacccttccatttcccctttacccaaaaaacccaaaccaccccaacaccagnagaaacccaccccttttaataaccccccccacccctcccccccccaaaaaacacccaccacctcccctccaaaaagggggccccaccccaccctaacaaaaacaaaaaaaaaacccccccaaaaaaaaacaaatccccccccaaattaaaaaaaaaaaccaacccaaaaacaaaaaaaaaaacccccggaaaccaaaaaaaaaaacccccccaaacaaaaatgaaatcccacacccccccctttccaaaaacaaaaacacccccttcccaataaaaaaaaaaaccccccaacacc

SEQ ID NO: 28686 - DNA, 222 bp, Zea mays
  Clone ID: cC-zmle189089g05d1
tccgccccgcgtcctacaaaaaaaaacataaaaaaaatttttaaattttaaacaaaaaaaaaaaaaaaaaaggctaaacgttaaaatataacatcaaataaccccctactcaaacggcgcctcatcttataaaattccgtttcacattccagtcctctccgtttaatctccttctcttttctcccctaatttcttttttctgtcccccaaatcacaacttcc

SEQ ID NO: 28687 - DNA, 352 bp, Zea mays
  unsure at all n locations
  Clone ID: cC-zmle189089g07a1
tttttttttttttttttttttttttttttttttttttttttgttttgtttttttttttaaaacccctaaaaacggcccccaattggcattacccatttgaaatttttttttgaaaaacaaaaaatttttgcccccaaaaaacaaaaaaaatgccgtctcttgttacagaacaaggggggatgaacatcagttctacaagggaactntaatcatgcctggtggtacttttgccctaccccacttaaacaagatttttgcaaaactttttttggtggggggggggggtccatgaaaaaaatttgaactttacacactttgggttgggctggatccgggcttccccggagtcgcc

SEQ ID NO: 28688 - DNA, 584 bp, Zea mays
  Clone ID: cC-zmle189089g07d1
aacacccgtgcggctccatttccctcacctcccgcagcagctagccgtcgccagtttacaaccgaaccaaccaaccaaggcacagggggcgaggaaagcgtccaatggtagcgatggcggccgtgcagcagcagcgccgcgacgcggaggcggagctcaacctgcccccgggcttccggttccacccgacggacgaggagctggtggcgcactacctctgcgcgcgcgccgcggggcgccgcccgccggtgtccatcatcgccgaggtcgacctgtaccgcttcgacccgtgggacctgccggagcgcgccctcttcgggcgccgcgagtggtacttcttcacgccgcgggaccgcaagtaccccaacggctcccgccccaaccgcgccgacgggtcgggctactggaaggccacgggcgcggacaagcccgtggagcacgggggccggacggcggggatcaagaaggcgctcgtgttctaccacggcaagccgccgcgcggtgtcaagacggaggtggatcatgcacgagtaccgcctcggcgaagccggcggcgcccgcgccaagaagtccggcgccggcac

SEQ ID NO: 28689 - DNA, 278 bp, Zea mays
  Clone ID: cC-zmle189089g08a1
agtacattggcatttgcttatgtaattctaagtagatcaagactttactttactcctatttattatattatttcttttttatattattccggaaattttgtatttatcgggacagacacaataccttaggaaccccaagaagggctgatttgagcatgatcaatttagaggatatgctcgccctcttccttcccgtccttagtttaggacagtggaaagtatttttccttttattttaggaattttgggaacatttcaacaaaggagatctttcacag

SEQ ID NO: 28690 - DNA, 274 bp, Zea mays
  Clone ID: cC-zmle189089g08d1
gtgaaagatctcctttgttgaaatgttcccaattttcctattataaaaggaaaaatactttccggtgtcctaggctaatgacgggaaggaagagggcgagcatatcctctaaattgatcatgctcaaatcagcccttcttggggttcctagggtattgtctgtcccgataaatacaaaatttccggaataatataaaaaagaaataatataataaataggagtaaagtaaagtattgatatacttagaattacataagcacatgccaatgtact

SEQ ID NO: 28691 - DNA, 302 bp, Zea mays
  Clone ID: cC-zmle189089g09a1
cttttttttttttttttcttttttttttttttttttttcttgctttagattttatttaaaatacctttcacatccaactccccccaatataatccccctcatttttcccaaaccgtaggaacaacgccccgccccccaataaaccccccacctcaaaaaacaaaaaaaggttctttttttacccataaaaaaccacatttaaaaataccccattcttcaataaacaaaaaaaataaaatctcccaaattcccaaaagcaaaaaaaacaaaaaaacacacaaatttctcctatcatattacac

SEQ ID NO: 28692 - DNA, 512 bp, Zea mays
  Clone ID: cC-zmle189089g09d1
acacccgtccgaggaaagtacggtccatgcaggatccagtctggttagacgattttgtgacataccaggacatcagcgaggaggccaacattgaaggtcctgaggtgagcgtggacaggctgatgatgcggcagcaggtgcgcagcttcctgacggggatcctgagcccccgggagaaggagatcatcgagcaccgcttcggcatccacgacggccagcccaagaccctgcatgtcatcggcgacatgtacggcctgtccaaggagaggatccgccaggtgcagaacaaggccctggacaagctcagaaacagcatctcagcacagggcttccacgtctactttgatttgctaacttaagactcttcaacacgcaaacattacatgtacaatgacattccattctgccaatgggtatattatgtatagatagacgaagaattcatgtttttttcctttcccttttgccatttgacattcattcatccttgtactcaacaatggaaactcata

SEQ ID NO: 28693 - DNA, 517 bp, Zea mays
  Clone ID: cC-zmle189089g10a1
ttttacatttttaggtagaagaagaatctttgagatgaaggtagtaaaaatgtaaaatataataaaaagtataggtagtgaaatatatatgggagaatatggctggagatagtcttatatacagacatggaaatgaacggtgtgaaataccgaaatatacagttctatgctcctacgttccaaacaaaacatacatattccgatagaggcaaagcatttcagcttgacagcaacctactattagaattctaaatacctaaaccttcattttaaactttcacgctttccatccttgcctggaatcctagtcacaccaagtatgtctaagcggatgatgcgaaatcgctggaaagtccatcattctcaatggtgtgcaggtgagcctcttcgtgtatgatgtctgcttcaagagagagcttggcaactccttgcccagagccttcatcaaaagcaacagaaggctcgggttcagaatcagagtcttcagcaaggcgaaactcgacaacggacttgaaat

SEQ ID NO: 28694 - DNA, 409 bp, Zea mays
  Clone ID: cC-zmle189089g10d1
gtccacgcgtccggatactggaggcacctgatgctttaaaaaatattatgcagggtctcaacatcgtggtccgtgtgtgattttaacacactttaccctcaacagccgtaatcctgctatgatattgttattatgttttactagcgtattcctcaggcgttcattatcttctacgctctgtccactttcttcgttggcggggcaacatttggtgcccgttaataataggtgtctcctgagggccagtgctttagcaactactactcacgagatgtaacgccttcttcgtcgtcgtcctttctttcttcacctgtctctcacgagcacgaaatcttacgtaatttcctcacgactgcttcacccatctttagctttcaagccctctttcctttcttcatcttcttctgca

SEQ ID NO: 28695 - DNA, 337 bp, Zea mays
  Clone ID: cC-zmle189089g11a1
ttttttttttttttttttttttttttttttggttttttgttttttttttttaaaaataattcttttaaaccacaatttttcatatcaagaacaaacaaaaaaaccccttttttaaccccaaaaattacaaaatttaaccttggagccaaaaaaattaaccaaaagcaataaaaaacaaacccccaataaaaaaaaaacaaaaattatttcttaaaaaaaaagattttttaaaaaaaacccaaaaaaaaacctacccaaaaacaaaaagggaaaacccaattaaaacaaaaggccgaaaaaaaaaaaaaaaaatccaagctgaaaaccccccaatttc

SEQ ID NO: 28696 - DNA, 53 bp, Zea mays
  Clone ID: cC-zmle189089g11d1
ccctcaaaaaaaaaaaaaaaaaaattttatttaaaaacaacaaaaaaatgaaa

SEQ ID NO: 28697 - DNA, 376 bp, Zea mays
  Clone ID: cC-zmle189089g12a1
ttttttttttttttttttttttttttttttggtgttttttttttttttttttttaaaaacaaacccccaacctttttgggaaaccccttgaaaattttaggtttaaaagtttgggaaatccaataggattttgggggaacccctcttaaaacttccaaaaatcaacctgccttcttgcaaaaaaaaacccccccctcctttggtatcacttggcaagccccccaatcattccatggcccccataaaacaacccatccttttgaagtaaagacaaaattcccccaagcagccttttttgaaaggattttttaaacctgcaggggcaacccgatcttgctgttcttaaaaccttggtggccttcaatctgccaatatc

SEQ ID NO: 28698 - DNA, 439 bp, Zea mays
  Clone ID: cC-zmle189089g12d1
gtccgcccacgcgtccggttctcatatagctcaactctatttgtttcttaactcttttttacaggttatgctgtctaacggttaatgttttcctcatgttcttttttgtcttgtttcccccctaacatttgttgtgtatgcaggaccatccacgttcaaatcgttcttgggaaatgtctcgttcttctttatataactatattgctaacttattttcatttgttaattattttgctttattttgatttgcaggtgaacatctatgcttctattttcatcgtcgggtaacaagaaactaatcacggagtctcttcccatttcttgcactggaagaatgtttagctacagcctcgcaacatgctttccagagcataaattggtggaagagacctttgatgctaccactttgccagaagaaccgagccagacacaataacat

SEQ ID NO: 28699 - DNA, 412 bp, Zea mays
  Clone ID: cC-zmle189089h01a1
atctcaaatgggaccaatatcagtgggaaatgtcaaccagacagaatcaccactcacgatcacgacgagatagcagagtactatctacaagggggggatgagataacacacaaccgacaccgtgacatggtatagaaaccctccctgcaccaaggaaaccagatccgaccaaaatgcgacgacgacacgacagcaccgaacaaatctcactactactagtactactggatagcactccaataaatagatctaggcggcggcggcggcggcgggggaagtactgctaggtagcctgcaggcacgaggccccatcggctcagtggcggacggcggcaaataggaaggcggcggcggaggcgacaagagccgcggcgaagggcgacgacgccgcgacggcggcggagacggggct

SEQ ID NO: 28700 - DNA, 504 bp, Zea mays
  Clone ID: cC-zmle189089h01d1
ggccacgcgtccgcatagatctcgtgctcgccactattattctttacagcaacgcatcagccttctggggccatcgcgccgtctccacaccacaatccacaacccgtcgaagcgaagcaagcaatggccggagtccgatcgaaggccctcgccgttgccgccgttctggcggccgtctccttcttggtggccgccgcggccgaggcgcccgcgcccagccccgtctccgccgccgtcgcggcgtcgtcgcccttcgccgcggctctcgtcgcctccgccgtcgcctttctcttcgccgccgtccgtcactgagccgatggggcctcgtgcctgcaggctacctagcagtactttccccgccgtcgacgtcggcgcctagatctatttattggagtgctatccagtagtactagtagtagtgagatttgttcggtgctgtcgtgtcgtcgtcgcattttggtcggatttggcttccttggtgcaaggagggtttttataccatgt

SEQ ID NO: 28701 - DNA, 417 bp, Zea mays
  Clone ID: cC-zmle189089h02a1
acagcaagtctcttttgggaggtgttggcgcccacgccagttctgaatcatgatcgcacggacaacagcagcagggaggaacaaaggtttttttttttgcaaaacaaattacacacatgattggcattccacacgcaaccgatcgatatgacgattatactcctatttattagcaccagctatatatatatagccatgtctggagtctggactagcaagcaaccgagatcgatgatacagagatagattcatcggtttgcatgagcatgacttgttggcagccactatgttacaccaccatccaccaacgcatgtacaaagttctgcatcatcatcgcatcgcctccgcctgatgatgatagatcagtgcagcgccgtcaggacagtagacccttccaccaccttgaaagtggcacc

SEQ ID NO: 28702 - DNA, 465 bp, Zea mays
  Clone ID: cC-zmle189089h02d1
cacccgtgcggtcatcagcagcttctgcttgctctggggggaaggttagagattgagagcgagagagagatctagtggggagagtggtaggtggtcctcgaacgaagatgttggcggcgttcagcgggcacgtggtggacgtgccggcggagctggtggcggcgggcagccggacgccgtcgcccaagacgaatgcgtctcagctggtggggcgcttcctggccgcgtccgagccggccgcgtccgtgcagctcggcgaccacggccacctcgcctactcccacaccaaccaggcgctcctccgccccacgtcgttcgcggccaaggacaaggtgttctgcctgttcgaaggggtgctggacaacctgggtcgtctgagccagcagcacgggctgtcaagcaagggcgccaacgaagtgctcctcgtcatcgaggcctacaagacgctgggcgaccgtgcgccct

SEQ ID NO: 28703 - DNA, 370 bp, Zea mays
  Clone ID: cC-zmle189089h04a1
aggaaaagtaggaataatgattggccaacaaatatacaccatgctggatttgcaaaaattatgtatcacagggccccctttaaccttcccactaaggtttaggtaacaccaaaccaccagttcggatacaacataattgggccctacaaatttcatgtttatagatctgggaatgctgcccacaagtttttagtatgtaactcgcataacctttttttacagctgttcccccaccgatggcaaactatgacgttcaccttttggctcgggagatcgttttaagtcaggtcatcctcttccaaggattcctcgccatcgtcagcttttttgatggcctgcagatcacctgttggtagctttcgtgcaagcc

SEQ ID NO: 28704 - DNA, 445 bp, Zea mays
  Clone ID: cC-zmle189089h04d1
ccacgcgtccgcacagagcttcagaattataccgttaatgtttaaggccacaacctgcatctgatggtctagcgtagggtgccagtgcattggaggacaaatctccagaagaagctatcaaaatgtatgatgaggcttgttcagttctagaagaagatgggaaggaacagatggcttttgacttgtaccgtgccgcagcagctttgtatatcaagatggagaaatattcagatgccgctgctttgtttttaagacttggttcagctgctgataagtgcaatgccatcaatagccaatgcaaggcctatctgagtgcgatcatcatctatctttacgcacatgatttttagcaagctcaaaaatgctacaatgactgctcagaagttcaagcctttctcaatatcgaccagaatcgatgtgcaacgaagctattgtctgcttatga

SEQ ID NO: 28705 - DNA, 257 bp, Zea mays
  unsure at all n locations
  Clone ID: cC-zmle189089h05a1
tttttgtagntatttgcttcctgatacaatatcaacagaagatggtgcattgccttgccgggtccatatgaacaaacacaagtccgaaattacatggccattattagcccttgtcgttaagccaaactttgggagaacatcgccaagagcatctttggttgctgcgaagtatttctcggcctctggggtgctcttgatcttcgcggcatggtcaagatcgtcgatggtgctgaaaagcttgccggtgagctccttga

SEQ ID NO: 28706 - DNA, 392 bp, Zea mays
  unsure at all n locations
  Clone ID: cC-zmle189089h05d1
gacgaagcgcacagaaagagaacaacctcggagtttatatgtttcaagccatggcgtcnataaccagcctctcgtagggcttcctgcccagcaggcgcacccacagcataaccaggacggccgtcgtcatcttcagggcgtccgctgagggcgacgccgttgcgcacgcgggccgccgcgccgtgatcgggctggtggccactggcatcgttggcggagccttgtcgcaggctgcgcgcgccgagaccgttaagaccattaagattggagccccgccgccgccctacataggactcctctggactctcaactctgaccatgcgagggacttctacctccccttgaaggagccgttctacctgcaatcgctgacaacggtggatgccgtatct

SEQ ID NO: 28707 - DNA, 474 bp, Zea mays
  Clone ID: cC-zmle189089h06a1
ttttgttataagttcaaatcttttaaaatgcagtcacctgagacatggaagtgtttaactccattaacacaaagagatggaaaatacaatccctatttaagccgtcttcggcttgggctttaagtcgctagagctgtgagtacaggaaaactccggcaagtgcaatcgcagtaccgagagagttgataggagaaacaggtgtcctgaagaacagcactgatgttacaatgaccacaacacgttaacacagttgcccacagaatgagtgacaggagacaccatcgccaaaatcatgtaaaacacctgttggtattgcatggaaacacagtccagcgaaaagacaccttgtaaggacttggtttacattcaaaccctacaaacacaaagccaatcaaaattaaccctgacagttctgcaaggtgcagtttcctgtcttgatttcttactttcgtgagcaatgggtttaaatttgac

SEQ ID NO: 28708 - DNA, 454 bp, Zea mays
  Clone ID: cC-zmle189089h06d1
gtccgcccacgcgtccggatttctggagcacagcttgtagttatcctttctctggctattgttcatactatgggcaatcgcttcaccaacatgagccttgggaaagttgcactgtcatttacgcacaccatcaaggctatggagcctttcttttctgttattctttctgcaattttacttggcgagctacctactatttgggtagtatcttctcttcttccaattgttggtggtgttgcattggcatctcttactgaggcatcctttaactgctctggcttttggagtgcaatggcttcaaatgttacctttcaataccgaaatgtctttagcaagaagcttatgcgtaagaaagaagaatccttggacaaccttaatctcttctctatcattacagtgatgtcatttttccttttggcccctgttaccttctttacagaaggtggcaaaatta

SEQ ID NO: 28709 - DNA, 347 bp, Zea mays
  Clone ID: cC-zmle189089h07a1
ccaaaaaaaaaaaaaccttttacaaccacccccataaattttttttggggccttttttttttttggctctaaaaaggtccaaaaccacaatttttaaaaaacacaaaatttcctaaaatctctttttaacctaaacccctttaaaaggaaacccccccccctcccctccaaaacccaaggcaaccccctcaataaaggcctcccccctccaggccaatacccctaaacaccttttgattcccttaaaaaaaaaatcccccttccttaagggttccccgaaaaaaggctttcctaccataaggtctttttttttcaaaaaccccaacaccttttttttttttgcaggg

SEQ ID NO: 28710 - DNA, 411 bp, Zea mays
  Clone ID: cC-zmle189089h07d1
acacccgtgcgggacgcgtggccacatatgagctattcacatattatacatttattttctacacagccctcacgcgtgttatggctctgtaccgtgtatctctgacacaaaacgctgtagatgcgcctgagatcttagccgtaattggcaaagtacctcacctctcaaagtttctaaattccctgtacaattgccagtacaagtcattttttattgcattctctggctcgactgaaccaatcaagttagagcgattcttgcagcctcattatcgttactacaatgcgtgaagtgcgcactgttgtctactcacagattctgtaatcgtacaccagtgtcacaatggaagccatggttgctgcatatggcgttacagtccactttatagaccactaactgtcaccctatatt

SEQ ID NO: 28711 - DNA, 327 bp, Zea mays
  unsure at all n locations
  Clone ID: cC-zmle189089h08a1
atgttggatgtaccattgtaggggcaagtgtagttttgcaattctgcaaacaatgtcttgttacaaataatcaagtacaaaagttgtggaaaattataataccccctgggaatacactcctccagtgtgtgtattcttttatgtaccaattgcagcaaatttcatagcctcataggcctagccactcatactacagtcgtgcaaaaactgattcagtcacgcccgttgcagaacatccattatccatactgngtattccagtaagggctgagactggaattaattgtcccaacantggtgttttcattggaacgaattcactgaccg

SEQ ID NO: 28712 - DNA, 381 bp, Zea mays
  Clone ID: cC-zmle189089h08d1
gacgcgtgggcggacgcgtggggccacggtcagtgaattttttccaatgaatacaccactgctgggacaatgagttccattctcagcccttactggactacacagtatggataatggatgttctgcaacgggcgtgactgaatcagtttttgcacgactgtagtatgagtggctaggcctatgaggctatgaaatttgctgcaattggtacataaaagatacacacactggaggagtgtatgccgagggcttataattttccacaacttttgtacttgattatttgtaacaagacattgtttgcagaattgcacaactacatttgcaaatacaatggtacatacaacatataaaaaaaaagaccaaaacaattgcctttgg

SEQ ID NO: 28713 - DNA, 219 bp, Zea mays
  Clone ID: cC-zmle189089h09a1
caaaaaaacgaaacccttccaaatcctccttttgtatccccattacactaaaattacatgggttttaaaaaaaacacccggggggcaacaaacaaatattttttagacggtttttggacgccgatttacaataagagagtgtgcaaacaaataaatttagtcgacataaaccacacgggggcaaaggcaacacctaccaagaggccaacgacctttttt

SEQ ID NO: 28714 - DNA, 454 bp, Zea mays
  Clone ID: cC-zmle189089h09d1
cgagaaggtgcttcccttttgtactggtttcgcagtttggtgctttatatggattgatatagcggggggtctttgtcaatatgtagaagtaagcatgttacatataaaaggggcacatgcaagtaaagttattcttgttgttggaataatgactcttcattcttttggagaaggctctggtgtgcgtgtttcctttgctggctcaaaagggttctctcagggacttctacttactatagctatagcagtgcacaacataccacaaggcttagcagtaagcatggttctcgcgtctagaggggtgtccccccaaaacgcaatgatgtggagtatcattacatctttaccacagccaattgttgctgttcctgcattcctttgtgccgatgcattccagaaggtgctatcctttgtactggtttcgcagcagggtgcatgatatggattgttatag

SEQ ID NO: 28715 - DNA, 377 bp, Zea mays
  Clone ID: cC-zmle189089h10a1
cggacaccaacatataccggatgggggtagtttctgtttcatggaaaaaacacaaatgacatgaaaagcttgttaaggacttaagatgttagagcattcaacacggtatcctacattagacgaacaatagattacatggtcatatatatatgctacaattttcacattgacttgttggaacgactggccaacctaaactgcgatgtcatgctggatgtgccgcattaagacatgagttacgatgattggagagctaagctagtgaagatggccttcacagggcatcacctccaccatggagacaccaccaaggtgcctgtgcaggtacttatacaccacaactggcaccccaagattcttgctgatccgacacctgg

SEQ ID NO: 28716 - DNA, 395 bp, Zea mays
  unsure at all n locations
  Clone ID: cC-zmle189089h10d1
cccgtccgagcaccaaggatctcgcggtgccagttgtggtgttttagtacttgcacaggcaccttggtggcgaggccatcggtgaggtgatgccctctgaaggccatcttccccagcttagctctccagacatcgtaacccctgtcttactccggcacatccagcatgacatcgcagtctaggttggccagtccttccaacaagacaatgtggaaattgtagcatatatatatgaccatgtaatctattcgttcgtctaatgtaggataccgcgttggatgctctgacatcttaagtccttgagaagctcttcatgtcatttgtgttttttccatgaaacagaaactactaccatgtggtatatgttggagtccaagcncacaagccccctcacc

SEQ ID NO: 28717 - DNA, 348 bp, Zea mays
  Clone ID: cC-zmle189089h11a1
gtgacattcaaatccccctatatatccaaaccatcacttttgcaaatcccacaaacagaagttaaaaggtccccacctatgcctgggtagcattttttatgttgcagcaaaaaaggatacattccccgcttgcaaggtcgatttacctttctatttcccagctcggcgacagcaaaaccagagatcactcccatgctttaagggcaccacccctcccaattgccttgataatagtcttcttactgttgcccccactgcactttttgggctcccccccgaattttgttgtccttctaatacccctcctgggcaatgtgagctttcttcctgcgcatttttttcttgatg

SEQ ID NO: 28718 - DNA, 550 bp, Zea mays
  Clone ID: cC-zmle189089h11d1
ccggggacgcgtgggctccgctgggccaccagcttttttcgccgttttccttcccctccgctactgctgggccccagcgcactcccccgcaggagcggcggcggcggccgcgaggtcgtaccccacatcggcgagcggcggcggcaccgccggaggcaaaggcaagatgttcgggcgcgcgccgaagaagagcgacaacaccaagtactacgagatcctcggggtgcccaagtcggcgtcccaggacgatctcaagaaggcctaccgcaaggctgctatcaagaaccaccccgacaagggcggtgaccccgagaagttcaaggagctcgcacaagcctatgaggttttgagtgatccatagaaacgtgagatttatgatcagtatggcgaagatgcccttaatgaaggaatgggcggcggaggatcccatgttgatccatttgacatcttttcatcattttttggaccctctcttggaagaagtggtggaagcagcatgggaagaaagcaaatgaggggagaagatgtatttcacccacttaaagtttct

SEQ ID NO: 28719 - DNA, 244 bp, Zea mays
  Clone ID: cC-zmle189089h12a1
tttttattttaatctcattagttattatttgattttatagtgctgttaaagaaaaccaacgtatcatttcgctgccaagtgcaagagttgggatcaaaactgcaaaaagctatatttctgtacatgatattaatcgcaagaatgacttccattggccattaccaatagaatacaaattgacccaaatatatttgagtgcagtggccaccaaagactaagcctttcttatatttgtggggggggg

SEQ ID NO: 28720 - DNA, 390 bp, Zea mays
  Clone ID: cC-zmle189089h12d1
gcgcccacgcgttctcttgattacacaaatatacactttttaactctttaatacaacataaaaactttcgtgcaatattgtttgatatataaaatgcaaaatgcaccctcatcccccaaaattataaaaaatcacaattttttttctaccccttgtccgcccctctttaaaacaattcaaactttacatacccattctatactaacatcatacgctcttttataatcgttacctaaattcaataaacttgtcctatctcctttacaacatcctttacttataaaaacctctctctttacccaactttaataaccctttctacacatcccccctttctctcatctttcaataataaacaaaaaaatccctcaccaatttttccttcccaac

SEQ ID NO: 28721 - DNA, 359 bp, Zea mays
  Clone ID: cC-zmle189090a01a1
aagggcaaaacctatcccccatttatatcggttaaaacggtgtctgttttttccgaaccttacaaccctttcaaaaaaaaacactttgagtttacaacaatccccacccaaaacagggggtggtcaccacccatccaataatttttttttaattcaggggcgaaatcattccccaattttttcaaaattatcattaaactaatattttcatgaacctaaccccctaaaataaagcctggcccctttttttttaacaccccggttgaaacacctttttgcacatatttttaattaaccaggccatcctttccttgatccccttaaaatcctcctcctttttcaccttaaggttggtaaac

SEQ ID NO: 28722 - DNA, 458 bp, Zea mays
  Clone ID: cC-zmle189090a02a1
gaaccaacaggggaacgaatggtcgctgggtctaatttaatttaaatccaccaaaaggatgtacaaaactaatcacctctgccaagcgtgaccactactactctactgccttataacaatagcaaatgaaaaacgtgggcacttaagcacattctcggtggaaacaaaaacaaaacaaaacaaaacaaaacaaaaagaaccgtcactacgctacagctatacacaccttgtcactcaacggtcaagccactatgaaggaggtgtcaaaaaaggaggtggctggatttcaaataagatgccagggccgcccgccatggtcgatcagaatttacagcacatgatccctttcctccagacgcgatgccgtccaccgatgcgcctgcgctctgcctttgccattctgacggggctgatggtccactccctctgcaacactggaaatgcaaaggactgggtgc

SEQ ID NO: 28723 - DNA, 296 bp, Zea mays
  Clone ID: cC-zmle189090a03a1
cctcccacggaaactctagcctcaaacaactcactacccttcacatattggaccattctaacacactaccccacaaaaataaaaacattcatctttatcaaccaaaaaactaaacgaacgctcgctaaataaatttcacaatacacactactttgaaaaccccatttttacaacgaacttttattttgctcacgaaaaatgaactaatttaccttcgacaaataaaaatccctacacaaaattacgctcccaaactattcctaaccaaccctatttttataaaaaaatttttattt

SEQ ID NO: 28724 - DNA, 407 bp, Zea mays
  Clone ID: cC-zmle189090a04a1
gaccatgtatacaatgcatatctcgttagggctcttgtcttctcacacacttatgcttgggtggatacaagtttggcgccctctggggcgttcttgttgccgggtccgtaccagtcggcaaagccaaagtcggttccccaagctggggtgttgactctctgctgcttgccagcggcggcgagtccgtcaagagctttgacgtcctcgctgtcaagcttgatgaccttcaagttggactcgattcgagatggagtgacactctttggcagaacaatgacacctcggttgacctggtacgagatcaggacggtggcgggctcgacgtcgtgctttttggcaattctgacgacttcctcgtctttactcaatggcgaaccggtcgagccgagcggggagtaggcctggag

SEQ ID NO: 28725 - DNA, 345 bp, Zea mays
  Clone ID: cC-zmle189090a05a1
aaaaacaaaatttttttatttccccacataatacccacaataatgtccattcccaatccacccaatgataatactaatttacccctattaaatacccccacctattaataaaaaacccatccaccaaaataaaataaaaatcccccctcaacaaaaaaacaaaaaaaaaatccatcaaattcattaaccttaccttttttcaaccaaaattttacccccccattcaccaaaaaaattacaaaaattttctacaatattcaatcccctccccctaaaaaaaaaacaacaattcaaacccccctaaaaaaaaaaccctcccccccccctaaaaatggcaccccaaaa

SEQ ID NO: 28726 - DNA, 391 bp, Zea mays
  Clone ID: cC-zmle189090a07a1
catcactgccagttgcgcaaggcttgggggtgctaatcttaccaagttgcacaataattttgactaactaatttaattactattatatggtcgaggagagactgaaattaaaatcgtgtacaaatgaaacatctaggtgccgtatactcaatcctttaacggatgaataactaaaatatcttttacttataccaagggagaggcgccttttacgtactaatgaagcccccccgaagattagcggatggctgaaggcaggcagagcaactggtgtaccacccgggcgatcgccggcgctaacctgtccccgccccatcattcaatagacaaattaaaaactgccctggaagacggtccttctcaccgaacacgcgtgagccggcccaggccg

SEQ ID NO: 28727 - DNA, 384 bp, Zea mays
  Clone ID: cC-zmle189090a08a1
gataaccgggatacaccacggttgaaggtgatccggaaacaactttttcatatgtgcttaagtattaaaaatggagtgggaaaacacatgtcacgaacggaagaccattccaggccagttcgaacacccacatgctaatagcatttaggcataacagatttaaggaccatgacatgtggctatccagacaaaaacaaccggtatgaaaaaaaaaaacatgaccccgggagtccaagtgtataccaaaggcctggtattcaaaggaaggcgtccttttcgagcaacttcagaaccttgttctggttattcagcttggcgacatcgataggtgtcttcccgcccacgttatggagcgttacaggagcaccgagcttcaaaagaaga

SEQ ID NO: 28728 - DNA, 145 bp, Zea mays
  Clone ID: cC-zmle189090a09a1
aaacacacaataataatcaaactacaagcggtgcaggcacgatatcctcctaaaattacacgacagtgtcatgattattaacttatggatgctctcctcctcttgggtgtcaccacatgctgcatcatcgtttcccacgcgtccg

SEQ ID NO: 28729 - DNA, 549 bp, Zea mays
  Clone ID: cC-zmle189090a10a1
gttattggttttttttataaatttttttataaaaaaaaataaaaattttataataaaaaaaacaaaaaaaaataataatcaaataaaataaaaaaattaaatcaaaaaaaaaaaaaaaaaaaaatatataaaaaaaaacaaataaaaaaaaaaaaaaaaaaaaaaaaaaaaaataaaaaaaaaaaaaaaaaaaaaaaaaataaaatatttaataaaaaaactcttcaaaatacattcaaaaaaaaaaaaaataacaaaactccaccacttaaaaaaaaaaaaattttaaaaaaaattacatcttcaaaataaatactactattaaaacctaaaatctaatattcaaaaaaaaaataattattcaacaaaaaaaataaaaaattatctttactataaaaacacatttataataaaaaaaaaacaaaataatacatcaaaaaaaaaatcacctatactataaaaaaataaaaatacaaaaaattataaaaataacaaacaataaaaattacttataaaaataaaatcatatattattaaaaacaaaaaata

SEQ ID NO: 28730 - DNA, 386 bp, Zea mays
  Clone ID: cC-zmle189090a10d1
gttctccgcctttccagagcctctgcatcaaccgagaacaggggcaccattggactcgcgcatcttcaggcagcgcaaacacatggcgaggatactcttcaaagtgcccgcaggctctggctcgccggaggactccatcaactcggacatgatcctcatcctcgccggcctgctctgcgcgctggtctgcgtcctcggcctgggcctcgtcgcccgctgcgcgtgctcgtggtgctgggccaccgagtccggccgggcgcagacggacgccgtcaaagcctctaacaggggcgttaagaaggaggtgctgcgctcgctcccgaccgtcacgtacagttcctacagcggcaaggctgagggaggggccgacaagtgcgccatctgtc

SEQ ID NO: 28731 - DNA, 503 bp, Zea mays
  Clone ID: cC-zmle189090a11a1
gagggtagtttcattctctagtaaattagaggagttcgggcaatccgtatcaatctcatacaatccatatagattgaaaataaccggacaaacctgtactgagcgagcgacgaggacctatttattaaaaattacacttaactccctgccgtcccctgggtgacagacaactcaaaatataattttcaaaagtcgagatataaaactatttttttatttttaaataaaaaggatatgaacaaccccttgcccctaccgactttacagaatgcagccaaactcctcgcagatggatttgtcatatgatctggttccgtctgaatagactgagaattcaagtactagtcttggagtcctggagatcaggttgatcgagcgagtttcgaaatagtacttcgattcagctcagagcctccatgcctgacccccatgcatgctgaacttcttgagcctgccatagaacatgatggccatgagcgtgagcttcccttcacacttcactt

SEQ ID NO: 28732 - DNA, 419 bp, Zea mays
  Clone ID: cC-zmle189090a11d1
ggcggagacctaatcaacttcaccgtcctcaacatcaacttttaggttatcaccgcctatggcaacgtgagggttcattgctcgggtacaacttcagcaaacacgttgaacgtctacactgcattttgaataacatacttgaattacctagtcctacacagtagctatgaggaatactaaatttacacttataaacttcatgttctatggcaacctcaataaattcagcattcatatgtgtcaagcataaaggctttgacctgaatctactttctctttaaaaactcattctaacaacctgatctctataactccaatactattactctaattctaaaaactattgggaggggaccacattatattacaaattcatcttattgcagtatgtctgcattctgtaaagtccgtaaaggcaa

SEQ ID NO: 28733 - DNA, 415 bp, Zea mays
  Clone ID: cC-zmle189090a12a1
agcttggatcctctagagcccgcccccttttttttttttttttttttttttttttttttttttttttttttttttggtttttgtttttttttttttttaaaaaaaaaaaaacttttttttttaaccttatctctaaaaaccttaaaaaaagggcccccccccaatggggttttgggaaaaaaacttttgggttttaaaaaaaaaattggtcaaaagggaaaaaatttttcacttgaaaaaaggggcccccattttgccccccgtgtccataaaaacccaacaaatttttttttttaaaaaaaagacaagggctcacaaaaaatttttctttaaaaaggaaaaacttttttttttctacaaaaacacataaaacctatgttccccctcggggaaaaaaaaaaaaattcccgggggg

SEQ ID NO: 28734 - DNA, 491 bp, Zea mays
  Clone ID: cC-zmle189090a12d1
gattgagaccaactagcaacatagaaagcacattattgtttcaataatggcagccaaaatatggtgcctggttatgctccttggtctttctgcaagtgctcctacggcgagcattttccctcaatgctcacaagctcctatagcttcccttcttcccccatacctctcaccagcgatgtcttcagtatgtgaaaatccaattcttctaccctacaggatccaacaggcaatcgcagcacgcatcttacctttatcacccttgttcctccaacaatcatcagccctattacagcacgcacctttggtacatttattgtcacaaaacattagggcgcaacaactacaacaactcttgctaacaaaccttgctgcctactcttagcaacagccgttacctttggtgcaatttgtggcacagaacatcatggcacaacaactacaacaacttttgctaacaaaccttgctgcctacttctaacaacaaacaattt

SEQ ID NO: 28735 - DNA, 470 bp, Zea mays
  Clone ID: cC-zmle189090b01a1
ttttgattttaggtgttgatcacacccagtccaaatatgggattaaaaatatataattgtacagcaccagttggttgagttaagtacagttgttacatttatctccacaccacctcacacaggtcacagctgtatcatcttcttcttcctctctctctctctctctaccaacccaaagtcacaaattatcttctttccccgcccctacatgctacatgtcagatttggtcaagctaccattcactgagattttatctcgtctatacaaataaaaaaattaaattagacacaaaagatgcatctgaagaacttatttccctctctggtattttctgtttctttctttagaaaattaaccgtttttatggacatcaactaatgcagcctatgtatgtataccaaccgtgaaaaagtcaaaagagaagagacaaaaaaaaaagaagccccgtgatattttacatcgttgagtg

SEQ ID NO: 28736 - DNA, 419 bp, Zea mays
  Clone ID: cC-zmle189090b02a1
agatgttaccatcttacttattactgagggtttaatgcatggggtcattgcatacagaatgcatattttccatggcgatagttttgcttcacaatatccattatctcattcagaattttactgctgtctaacttgtttacctaacaaaagagataaaaggaggaaaaatctgtacattattttctggtgcgcttccttttggcataactagtgtagcgaaactactgagacagtgttatctcattcagaattacaaaatgatgaagcacagtatcatcaaagctggttctgaacatttttcaatcccattggcttcaaatcagaagagcctgatcctcgtggttatgtgttgctggcacagagggcagcgctccaaatctctcccgcattcatagcaagactgatgtccacacccaaat

SEQ ID NO: 28737 - DNA, 265 bp, Zea mays
  Clone ID: cC-zmle189090b04a1
ggggccgggcggcatagagtttatgttgaagcgcaaaagtagcatcatacattacattcgacgaaatcggaaccctatacagcaaaggttcgattgcggcgagcacgcacgcaacgcaacgcagcgcagcaccagggatgatggataggatcttaaccgcttcacttctcgaagtagtcctcggtcctgcccttgaatccgatctggccgaaggtgagcacgatgaacaggcccaggtgccacgtcactagccacagccagaact

SEQ ID NO: 28738 - DNA, 507 bp, Zea mays
  Clone ID: cC-zmle189090b05a1
ccccccccccccccctttcccctttccccccccccccctcctcccgtaatgcacctctcccccacccccccccaccaacacaccaaacccccaacctacacccactaaaaaaaaaaaatacccccctttcacaaaaaacaaaaaaaacacaaaaaaaacacacacccccccctttccccccctaaacaaaaaaccctaaccaaaaaaaaaaaaaacccaaaaccccctaaaaaaaaaaaacaacccaaaaaactcccccataaaaaaaaacgccaaaaacaaaaaaaaaaaaaatcccctgcccccccccccccccccaaaaaaaaaaaaaaacctaaaaaaaaaaaccccctaaaaccccccccccaaaaaaaaatcaaaaccaaaaaaaaaaaacccccaaaaacataaaaaatttcccctcccataacccactaaaaaaaccccaaccctccaacccccttcaaaaaaaaaaacccccaaaaaaaaaaaacaccccccccaccc

SEQ ID NO: 28739 - DNA, 346 bp, Zea mays
  Clone ID: cC-zmle189090b06a1
ggtagtaacaaaactagtaaccatagatggctgaccagatgttcggataagtcttaaataacactctggttttaacgaaaataaccattctaaatcgaccaggcaaacgttgcgagcatagttcagacaatgacgtgaacaagacgagatattttatgtttccactaggtttccctcaagcaaacacagaaccagccagacacatcatttcttctttgcggcagccttggtcaccttggctccagttggatccttcttctccacactcttgatgactccgacagccaccgtttgcctcatgtcacggacagcaaagcgaccaagaggaggatattcagaaaaggtc

SEQ ID NO: 28740 - DNA, 508 bp, Zea mays
  unsure at all n locations
  Clone ID: cC-zmle189090b07a1
ttttcaatatgtggacatgtgtgcttaccgaatattggggtggggttgtactagttgactattaattgacaaggaaagccaacttttttgtcgaatggcatgtgcaagtccaccaaacggatgcgcccttaaaccgcaacaatgtattgtcaaccacagaatacgtagtaccagtaacgactacgtataagatttgctaaatttaaacacgcaacagtacgcatgcagacaatggatcgaacaagaagcaagcagcaagcttgaaactatgcatagtccacgagctaagctgcctctgcctacttgcagctgttcgcttagccgagcagcttcttgacggcctggaacctggcgtccttgtcgccgaacttggtgccctggtagtagtcgaggtagtccccgaacctgtagggaccggngtacgccgcggcgtcggcgtcctgatccctgcggggcgccggcgcgacacggcgtcggtgccgggttgtagaacgtggcccggacaggc

SEQ ID NO: 28741 - DNA, 450 bp, Zea mays
  Clone ID: cC-zmle189090b08a1
aaaaataattggcgtgtggctttattgatcacgtaaactgcatgcacaattgcacacgtttcacaaattccgcgttttctccctgtctctctctaataaaaagaggacattgaacatgcttagttatttcattgagaggttcactgctaatacagatgaacgaagtactctaggtattagttccttctttcttgatatatcatatcatatcatggccgatagataattgattattctgatactacgacggcaattcattacaagcggccggcggggcaaacactggtgtggcgtggtgtctacaggacgaactgcttgcgggaaatgtcaaacgtctccgaagaggacaggttaggctcctgcacgccgctgaagttggcgaccgtgcggatgggtgcgcctatggccccctgcaaatcgcagcccccgcccgggttcttaatgatggcc

SEQ ID NO: 28742 - DNA, 299 bp, Zea mays
  Clone ID: cC-zmle189090b09a1
aaaacaaaaaactttttttcagggcacgagcttattggcgtaattcccacaggaactgagggcgtgcccctaccaaagccaagaaccaagaccctgcccaacccgtcaaccccaaacatacataaggccccccggcaggccccaacgggcgtggattcccgcccccgggcggttcaattagccctggggaggaagctttccctgccctcggggaccttccccgggcagggggtgatgtcctccttgaccctgggttcccgccccacaaaaccctggccccccgggtgaccatggggggg

SEQ ID NO: 28743 - DNA, 239 bp, Zea mays
  Clone ID: cC-zmle189090b10a1
aaaggagaggggcgcaacgccattttaattattgtatgtatgccaaaaagtacacaatagcggaatggcaaatattccaaattatgaacagcgtaacaacaagatagagagatgatccatgacgattgcgacggatcgaccggcgcttgcagtacaaagcaagctactagaccatgcaaatggagaagctgagcttaaattttgccgcgcgggcccggctgcgggggccggacccgtgg

SEQ ID NO: 28744 - DNA, 271 bp, Zea mays
  Clone ID: cC-zmle189090b10d1
ccgcagacaaaacccaaacggcaagatctaagctcagcttttccattttcatggtctagtagcttgctttgggctgggggcgccggtcgatccgacgcaatcgtcatgcatcatctctctatcttgtcgttacgctgatcataatttggtatatttgccattccgctattgtgtactctttggcatacatacaataattaaaatggcgttgcgtggctctcatataaaaaaaaaaaaataaaaaaaataaaaaaaacacactaaaacaagg

SEQ ID NO: 28745 - DNA, 444 bp, Zea mays
  Clone ID: cC-zmle189090b12a1
ttttgaattttctgtcatccatttcattttaccgatgggggtctgatataaatataaccgtatgacagcaaagactcaagtttctgacatgcgactctggtacaagatgcaaccctcgctaacttggttcagatgactaggcagattccgacttggtgtacatccttacagcaacagccaggcccagtattgccagggggaccaaaaactggaggatcttgatgacgaactccggggtcttatcctggttgtagtgcggctgcttggggggcgtgtacttcaccttactgggtatcgtggccgcatcaatctcaccgacgaggtactcgtccatcattgcacgggcggtggtgctgtgccccacatcttcgaaatcatcggtagcatccttggcaggggaagacagcaggacattatcaccttcagggtggtccctccagaaac

SEQ ID NO: 28746 - DNA, 455 bp, Zea mays
  unsure at all n locations
  Clone ID: cC-zmle189090b12d1
caaagcaagcagcagcagccggctccgcctcccgcagcattctacatttttgtccgncaccagaggaagagggagaggagtatgtcttcgtcgaaggtgtacacccttgaggaggtggccaaccacaacaccaaggatgactgctggctcgtcatcggcggcaaggtgtacaatgtgaccaagtttctggaggaccaccctggaggtgatgatgtcctgctgtcttccactgccaaggatgctaccgatgatttcgaagatgtggggcacagcaccaccgcccgtgcaatgatggacgagtacctcgtcggtgagattgattcggccacgatacccagtagggtgaagtacacaccctccaagcaaccgcactacaaccaggataagaccccggagttcgtcattaacatcctacagtttttggttcccctggcaatactgggcctggctgatgc

SEQ ID NO: 28747 - DNA, 260 bp, Zea mays
  Clone ID: cC-zmle189090c01a1
acagcaaccgcaaaaatttccgggacatcggcagactacgcaagggccaattacatcaaaaaacatgcataaaccactctctaacatagcacattggaatctggtccaaccaggaatgcgcctaccaaactgcttatgctcaccacaaacaaacttttgacctgggacacccccattaccccaaaatgtgctatgtccccactacagacaaagattacacattatagctaccaagtaaaaaacactcccatgcccaaggc

SEQ ID NO: 28748 - DNA, 343 bp, Zea mays
  Clone ID: cC-zmle189090c02a1
cccacttacctttttttgtgtttttgtgttttttttctcctgtttcccctctaaaaaaaaaaaaaccccccttttcccttgccccatttcatttttctaaaaaactggtactaaattaaaaacccggtttttgtgtatcaaacccatgcccctttatttcatttttacccactagccccccccttttggataaaaaaaccccccaaaaattggggggtttttttttattcccaggttttgttgaaccccccccccccggtgttacccccttttttttttcctcaaccaacttttgatcttttagggcctccttcgagaccgtggcccctcttttttgtcaaaa

SEQ ID NO: 28749 - DNA, 345 bp, Zea mays
  Clone ID: cC-zmle189090c03a1
accttcattattttttttttttttaccgataaagcggacatgtatattccagcgaacactggagcagagttatatgacaactctgccatggatggctgttaatacacattcagaacccatactagcacctgctattcatgatattacttattacacatggcaccggacttaaagatattacattaacagcactgattttatgaaaatacgcaagggtgcatgctctggcatgttgcgaaacagcttcttattctggcacttacatttgtgctttaggcaagacattgcacagggagacaacagagccttaggcgctagcaccctgtaaaacaggctcgaattcct

SEQ ID NO: 28750 - DNA, 110 bp, Zea mays
  Clone ID: cC-zmle189090c05a1
ttttagtttatatatagtatcaaatcatatcatcgggggccaagggatatatggttacagcagatgcaatcggatcaaccaacatgcaggtagacacacgtacgtacatg

SEQ ID NO: 28751 - DNA, 345 bp, Zea mays
  Clone ID: cC-zmle189090c06a1
ccaataaaattaatgcgattaaacatggtcggaggatacattccgatgttcagcacaagataggcaagttcacataaggcactgtaataccctcaaaacacttgaaattcatgttccacgaagcaaagtaagatacgctaaagcaaaacgtcaggattcgcatccgcacttaagcaacggcatcgaggaaagccttcccaggagcacgcttctcaagtctgccgtggttgccgagcagctttgcgttgacaccatcaggaacaattctgccctcgctcttgtacttcaggtagtcagcgcggctgaacttggtgaagccccactttctgctctcaatgatctttt

SEQ ID NO: 28752 - DNA, 343 bp, Zea mays
  Clone ID: cC-zmle189090c07a1
ttttatttttttatttatctttagaaagaaaaggtgtgggataggtgataaattcatgacagacagatatccctataatttacagaggcgatacaggagacgtgtaaagaaacaaatagtgtggcagtgcgcgtgcaaagactaattaacagctttgactagggggtggaagtactaaatttatacatgaatttcttttaaaagcgatggctctactaaaaacctaggtaggtcgaccatagaccgaccatatatatgtaccacgtacgctttattatacatagtttatggagcaagctgaaccagggggggatctagaattcatttatgacccggactaaat

SEQ ID NO: 28753 - DNA, 377 bp, Zea mays
  Clone ID: cC-zmle189090c08a1
aacaagtccatccaatgggctgggatattgagtaatgattacaaaacagcatgcagattgtacgatgcttattattacaatatgtataatatgccaagattttccacttggacttgacaacaagagtgaatataaagaggcaggaaattccatttgcatagggaaaaaaaccctggccagttgggcatttccttccaaaactgacaaaacgccaccttccggagattgttattgtggggcgctcttttaaggagagagaagaaaacccccttacccagtgttttgtgtgccggggggtatgcctttaatggtgaggatgagctgtttttttcaggccgggggggtattttttcggcggttacagcttgaccagtccg

SEQ ID NO: 28754 - DNA, 352 bp, Zea mays
  Clone ID: cC-zmle189090c09a1
gggaagaacaactgggggggtccgtcgttattgatgcttgtagtatttacatttacactggacctgccacagatgtaacaggagtcttaaggagtaacatagttgagttgtttacatacagccagccaggcccaggtggccaggcaggaactcaactattatgtagccagggccaagggtgttggtttgtagccagcagccaccacacttcatccaggggctgctgttcctcctcaatactggccagatgccaccgttacagttactattggtacacgtccaattctcggaacaggtttgtttttgaaggtttccatttggacatctttaaaaccacgccttaaaaaccttt

SEQ ID NO: 28755 - DNA, 349 bp, Zea mays
  Clone ID: cC-zmle189090c10a1
ttttaatttaaaattaatttactgatgaaaaggagttgggcaatggtttgccatggatgaatgatgatacaaattagtacacgcctattggtacaagcttacgctacagaagtacaattgaaagttcggttttttttgccaattccaagcctctgtaaaaagtgcataaaagggagggcggcgagagctgtaacaaatggatggccgctcctctatatcacctgaaaaggctgaaactcgggcatggcttggcacaaatgctttctctcaggattgcagacatctcttgcactgaccaatggccatgaggaccttaagtttcgcataacgctttggcatttccctgtta

SEQ ID NO: 28756 - DNA, 179 bp, Zea mays
  Clone ID: cC-zmle189090c11a1
ataaaaaacaaaaatattggggtacgttatttaaaagggtgttgtaacacacaagtctaattattgctagattaccgatcccccatggcataaaatttcaatatcctttctcattcaaccagcttgcttgttaacctaattaggggttatatttaaatcttatttccaagaaaaaatac

SEQ ID NO: 28757 - DNA, 274 bp, Zea mays
  Clone ID: cC-zmle189090c11d1
cggatcacctaaccactcaagcctcctctttactattttcccagctctcacgcttctcacgggcgaggaaaatcttggaatgaccttcataaaaacctgtcccttcttctaaaggacacgaacatcctcatgactcagcgacatatgcttccttcagacagcatgccgcttccaaatacacaacctattttcaagctcaataaatcattgccccgtataaatcatcccttcactgtgacggctgtaaccgatcccgacccaacgagatcttctg

SEQ ID NO: 28758 - DNA, 114 bp, Zea mays
  Clone ID: cC-zmle189090c12a1
gtgcgaaagtgttattttttatttctaggaagccacatacataaattaaaaaactttattatttaaattaaaataaaaatctaatttaaaaatagccacttccaatatattttt

SEQ ID NO: 28759 - DNA, 325 bp, Zea mays
  Clone ID: cC-zmle189090c12d1
ttccatttaaccaattctccgcactgaacccctctttttatttccagcagcaaatactactaccatttggcgagctagctacaacaagccccgcttccttcttgacacaacaacaattgcttccgttctaccagcagcttgtggctaaccccgcaacccttttacaactgcaacagttgctgccctatgtccaacttgctttgacaaacccagcagccttctaccaacaacacatcattggcggtgccctcttttagattgcttattagttgtcatttaataatgaagctttttggctgatgtatgtggcctcctaaaaataaaa

SEQ ID NO: 28760 - DNA, 406 bp, Zea mays
  Clone ID: cC-zmle189090d01a1
ttttgatttacttgttacagcatttccaatctttcgccggaaaataggcatggaggtcagtatgattctggtattgctttgtgaaacatagcacgaataacataaaaacaagatgggacgctgtatctaaatccagaaaatgtgagcatccattcatgtggtgagaccggtaatacaactctgggaaaggtttatttctcgactgacaagtgacaactggaactggtaggttgatcaatcattttaaccattcactttcgaaaggggtagaggcatccagcagttccacatccttgttcggagcttcaactacccattccccttcttcagataaacaaatgccaatagtagcagtacatcatgcatccatcgtcagaatgctgcccatccagatcctgtgctcttt

SEQ ID NO: 28761 - DNA, 451 bp, Zea mays
  Clone ID: cC-zmle189090d05a1
agaaaacaatcactgaccaatatggagcacatgcgagaaacaagattaccatacgtgttctatatagacagagagtacataaacttagcagtagcactagcaaggccgtagctgcactatacatttgttcaatgcaacatctgtgattacaagtggcgctcttgatttcttgaagtacgactaggtcgaggtagtaccaccaggtctaggtgggtgtcatgcccagatcagcgccttcaaagagaccagccacgatggtgccaacatcttcaaagcctacaccgatgcagagtgggtttccctttgtagaacctttcgcagaggcatcggttctaaaccgtacgttgggacctaggccgcactttcccaggcacttgtagtcgacgaccgcaccttcggtgcccacagtcttctcgaactcctggagaagagcaaccgcgcctgacttttt

SEQ ID NO: 28762 - DNA, 465 bp, Zea mays
  Clone ID: cC-zmle189090d06a1
gataatctggaacaattccatatgggacaatggcttggaagacagcccctttcactgggcacaggcgcaaagctgataatttgttattatctccttgcaagatcaacatcaggcctgcacatttcgcagccaacacaacagtttatctgactgctagttcatcaggtttagactagtaaccacccctcagagcaaggacaagatggaggacagatccaccctcgatgttgtagtcctttgcggtcttgtcatcagcaagctgcttaccagcataaatgagcctttgctgcacgggaggaatgccttctttcttttcaacacgctccttgatcctgtcaatcgagtcagtgggttcaatgtcgatctcgatctctttcccagtgagagatttgaccttgatcatgggtccacccctaagcctgaggaccaaatgaagagttgactccttttggatgttgaagtcag

SEQ ID NO: 28763 - DNA, 255 bp, Zea mays
  Clone ID: cC-zmle189090d07a1
tttttatattagcacttgcatcttatcaatctgcaaggcgggcggggaactgttggtggcaacagaagtaaaacatcaactactcaatcgcatgaaagaagtacaacgtttgcattgttcgccgacatgaagctccactgcagcaaagattattcatggtggatgagtaagagtagcttctcaatatattgcctacgtaaagcaaaatctcctgttgcccggacgcgtgggcggacgcctgggcggacgcctggg

SEQ ID NO: 28764 - DNA, 444 bp, Zea mays
  Clone ID: cC-zmle189090d08a1
cttaaaaaacaaatatggggggaggggtattcattaatatccgattacattcctactaaccgacgagataaaaatggaccgcactacttaaaaaatgtgttacataatcaatccctcttgacatcagggaaaaaacacaagcaaacttgaaaacaattaacattttactttcattagcaaaagattgttcattgctgtcaggaaaaaaaaacagaacccaatttgacaacaattaacagttttctttatgtagcatcaggttatttattattgtcaggtgttatcaacaacactgtacttataaacagcccacaaaggtatgccctaacccaggcaagataaaaggtgaattcttttgattaaacaaaaactacagggccccacgatgacactaacaacattaacagcaattttagtcctagaaaagcttgttttttttcaaaa

SEQ ID NO: 28765 - DNA, 269 bp, Zea mays
  Clone ID: cC-zmle189090d09a1
cccccccccccctccttatttaaaaaccccgcggttttttacaaacaaaaatacaaacttggaaaaaagctcttccccctttaaaaaaaaaattggggggagggggacatttaaaccttcccaataccccccccacatacccccccgggagcactcccaaaaaaaaattccccctttctttcctattaagcccttcctttttcccccttaaaaaaatttttttatcccccccaccccctttttcaatataaaactttttttccttaaaa

SEQ ID NO: 28766 - DNA, 395 bp, Zea mays
  Clone ID: cC-zmle189090d10a1
caagaaattccattgcacggggtccggagttctgcaatgacatttctatacctcctagctcgccatatatcccaacagatgcgaaggttgttactcccattgagttcggagagctgtacttttaggacatctgaatgcatagatcgttaaacttttgctgcttccgctggtacaccagccctttcagcaacaatctgttcatagaggtctctaatcttcagtccaatgatggtctggaagagacctgtcccgttgttgctacctgggaagtctgcatgctttagcattttgtgtgtcacctctccgtagaacttggttgaaaggttgcttacatggctcttcacgtagatgagctcatctagtctgtcgaattgcccatccatctccagaacaga

SEQ ID NO: 28767 - DNA, 440 bp, Zea mays
  Clone ID: cC-zmle189090d10d1
ccacgcgtccgggtctgcacccaatgttcgatgagcgagtgtttgacttcttagatttcagtatctacttggacatcagggatgaagttaagtttgcatggaaaatccaccgggacatggcagagcgtgggcacagccttgaaagcatcaaggccagtatcgaggccaggaaaccagattttgatgcctttattgatccgcagaagcagtatgctgatgctgtgattgaagttctgccgacccagttgattcccgacgacaacgaaggaaaggtgctgcgtgttaagctcatcatgaaagaaggggtgaagaacttcaacccggtttatctctttgacgaaggatcgaccatcacctgggtgcctcgtggaagaaagctcacatgctcttaccctggcatcaaatttttcctatggcccggacacttacttcggaaacga

SEQ ID NO: 28768 - DNA, 184 bp, Zea mays
  Clone ID: cC-zmle189090d12a1
gcaccggcaaggagccgattacgcttgagaacctcgaagacgtctccccgggctggtcgctccacgggcgcccagcccccggtgagcctgtccagcgggcaggagaagagctttctactggctgcgccacggcgtgccgacctttcaaagggcgaaaacggtggcggaggccatattggggctc

SEQ ID NO: 28769 - DNA, 507 bp, Zea mays
  unsure at all n locations
  Clone ID: cC-zmle189090d12d1
aacaccaggcgcaccaacccaccccccaatccgccatgcccggcggctcctttccgtcccggccgcggaagcgcagctccggccggcgatccaccacctgccgccggacgcgctccacaacgtgctgctccggctgcagctgcgcgacgccgtcgcgtgccgcctcgtctcgcgcctcttccacgagaccctctcgccgcagctcctcgcgctgctgcccaccctgcgccttctccttctccgccacccgcgccccgacggtggcggctgtcttcacgcctttgaccccgcgcgccgcacctggctccgcctccccttcgctcacttcctcccctaccagtccttctgccccgtcgcctcatccacgtcccctcctctacctctgggtcgagaccttctcctncaccttgcccctagcccttcagtccaccactacgtttttcttcggcgccttgctcgcgcacccgcttaaatcgctcgccgtctgcaaccccttcgtcggaacgt

SEQ ID NO: 28770 - DNA, 387 bp, Zea mays
  Clone ID: cC-zmle189090e01a1
agcacccctgacattacattaattaccccctggcaaaaaatgcctatggaaaaaaaaaagtaccatactacacataccaacttggcactcactatttttttctaggagggccgggccaaatattacccactccataacaaaggacaaaataaacgggggggacccccgccgaacaagaacaacaattcccaaaccccattttatatatagggattactttctataaaaaagcatcccttccttaaaaaaaaccccaaggaccaacaaacagggcctttttaatgaacatacatctcccccaaagaaacaggggatgcacccggtctatgccttccaaacccaaacaaaaaccgggggggaaaatggctcccgccaatccaaaaggtt

SEQ ID NO: 28771 - DNA, 485 bp, Zea mays
  Clone ID: cC-zmle189090e02a1
ggggttgaggtatttttttatttttttacatagggcatggtaaacaccattatgataaccactttcattacccaaagccgaactaacaacaacaaaaaaaaggcctcaaaaaccaggaaacctataaaaaatgggcaaaaaacagggcgtaacttacatagggaaaaacaaactgaaaaaataacaacaatatatctgctgacaacccaaatggctgattgagaattacaaaatgatgaagcacagtagcatcaaagctggttctgaacatttttcaatcccattggcttcaaatcagtagagcctgaacctcgtggttatgtgttgctggcacagaaggcagcgctccaaatcttttccgcattcatagcaagtctgatgtccaaacccaaatgcaaggtcctttccatttatacatgcagatggggcacagaattttgtcctccagagcaatttttgatacgtaagtgtcaggtccctttggg

SEQ ID NO: 28772 - DNA, 332 bp, Zea mays
  Clone ID: cC-zmle189090e03a1
ttttttttttttttttttttttttttttttggttttttgtttattttttttttcttttttttcatcattccctttttttttaaagcagttagcccccacaaaaaatgccaaaacaaaaaaaccccatttgatggaaccacccttaagaggggctttaaaaaaaaacaaaagtaatttcccgccctttcccattccaaaaaaaaaccatgggattggacaccaaattttttctaaacataaaaaactatccggggaaaagtaacggcaacaattaaaaacggaaggttggaaaatggccacttgaccggcccagggggactctacaacatttc

SEQ ID NO: 28773 - DNA, 408 bp, Zea mays
  unsure at all n locations
  Clone ID: cC-zmle189090e04a1
aataatagcggataggggtatagtactgtattattacactcggcttgtacacacgatggtacatacggcgagtacgttacgtgaacacggccattattttagttattactaggctgacacgcacgtctcagcgctcaccactttattccgtacacacagataacgactacggtcacacggtcgccgcagcagcagcactcactcgcacacgtcgnacgcctcctgcctgcttgcactttattatgtagcactaggattcgtgtgcggtgcacgtgtgcgaagcgagaccgagggtgatgttttgattcgtttcggtcgcttcacttccacttgttgaacttgccgccgccgaacgcgccgctcttgcggttgccgccgccgaacatgccgccgccgcgcttgtgcttg

SEQ ID NO: 28774 - DNA, 500 bp, Zea mays
  unsure at all n locations
  Clone ID: cC-zmle189090e05a1
ttttaaattacaagacgtgtaagcctgtatcgtagtagacaaggagatggtgtatttgctgtattacagtggaagactggaagctcgaaaaatatagattcacagcacgtctgctggtacacgagttatacgttcatcaaacaacctggacatacatccttccagacacaccaagaaaaaaaaaagagaacttgcaaatccgagcaaagtgtgtccttatttcagatgtgacaagcaggtcaaatgcaaagaaaacatagcgaccgagaaatagcaggagcatgcttcacttggtccaccagtgaaggaaatccttacgcctgttgatcttcttttggagctgaagaacgccgtacagcagtgcctcagcagttggtgggcacccagngacgtagatgtccacagggactatacggtcacatccacgtacaacagagtaggagtaatggtagtatccaccaccgttggcacagctgcccattgaaataacccacctaggc

SEQ ID NO: 28775 - DNA, 294 bp, Zea mays
  Clone ID: cC-zmle189090e06a1
aaaaaaaaaatttaaaaaaacttgtatctttccaaaccctaaaaccccttgatacccgcgcctttcccgaacccccccacccccctacaaaccttttgggctttaaactcctgcccgcgttcaccccctaaaaaataaacacccttatgaaagacccttacccaaaaacccatcctctaaccatctcgaaacctaggcccccatatatcccctccacttcaaaacccctccaaaacacagggggcgcgcccctaaaaatccccctacgtggcccaaccctatattgccctccac

SEQ ID NO: 28776 - DNA, 535 bp, Zea mays
  unsure at all n locations
  Clone ID: cC-zmle189090e07a1
ttttgattacataagcatattcttagaagagtgaacaggcgaatcgttgtgagtcaagcgaagtacatagctttagcaagaaacaattctgccatacttctataaccaataggtttgagctaccaagctcgcaaaacctgaagaaacaaattcagaagaaacctaagggaccaagttttgaggtatatctgattgatggaaaatcttggaactttaacagatgatatagttcttccagctgataacaattgactaactcaattcatcgatgatttggatatccagcctacaaatacgcagaactgaatattttaagaggcacctccaacagtgatatcaactgcaaccttatactcttatcctggtcctcaacttcttgatcttgacatctgatttctccaccttgatcttcttatctccctgcatttcctcagtaccgacttcaccatcaccgntcatgctcttcttcttcctctgctcagtcttccccatcttaaccttcttgttgtccaaactggcttcgttcaccttattt

SEQ ID NO: 28777 - DNA, 522 bp, Zea mays
  unsure at all n locations
  Clone ID: cC-zmle189090e08a1
aaacgttgtacaggggggccagggttaatccttgacacaatcgtttgtttgtacaattgtagagcacacagtgaaagaacacgagacgagagacgggtgtgccaatgtgtggtcatctaagaatctgataacatgcatacggtacatgtatgtcgcacagtttcgtatgcgacaatgatacaatgtaaatctccacaaagaatatgatagtcatcaaaatcgcagttgggaagccttattgtggatgctcatcaccctaactaacattacagagtacaactacattcgcccaataccaattctgtctagctatgcttgtcaccgatacgatctggatgcctgtccttgcgccatgcatgctgcaggtgcaaccgtaaacaaaataattcatatgggatgttgttntggctcgagctacgatcacagtacatggaaaaggaagacagtactaaggggtggtctgtgccgctgcttgtaaatctgccgaagcatcggcagcttggaagtaatcttgcaaggcga

SEQ ID NO: 28778 - DNA, 375 bp, Zea mays
  Clone ID: cC-zmle189090e09a1
aaaagcttatgaaatgtttactttgaaaaaagaaataacccatcttcttaccccttacttttgggaaaaaaaataaaataggttgaccccccataatttttttcctcataggttaataattagtcataatatgaggaataaatttattctaccaaatttggggaatgaacttatgatacctcccctcatttaaaataaattgattattcaaaccaaacatttctttaaattgctgcggccctaagggtcaaactttgcaactccctctttaaatgggaccgcaccatttttaacgttttttaccttaagcgtaccaattccaccctttcaaaaatctggcctgttcctttgaactcctaaacggacccctgggtc

SEQ ID NO: 28779 - DNA, 384 bp, Zea mays
  Clone ID: cC-zmle189090e10a1
aataccttggataccgttacattaaatgaaacaaattaatgcttcaacttgagatacagttctaaaaaagtacacctaatgtcgtgagggtaatgcagctaagctgaagaacgcacacctatatgtatcactgcttccatgctgttcccaaactccattaccatataacagaaccaactcatctgtacttcctgtgctataggtacactcgatatggtcacaatgtccaggaacagggtgtgacactctttctgcacgagatgaaggtcccccaaagtcacctatatgtttttgagtatatggttctgtcctgttaatacgtactgtctgggtaagccttggtaggtcacaattactaatgggctgtgttgctctttctgcaac

SEQ ID NO: 28780 - DNA, 522 bp, Zea mays
  Clone ID: cC-zmle189090e10d1
gaaataactaaactcaacttttatatttttatccaacacctaaaaagaaccgggatgggggctcttttcacatagatgcaccttgaaaaggtgaaaagactccaccatggtggcagattgcttactaggaccagctggcttcactggttgcagaaagagcaacacagcacattgagaattgtgacctaccaaggcctacccatacagtacgcattaacaggacagaaccatatactcaaaaacatataggggactttgggggaccttcatctactgcaagaagagcgtcacaccctgttcctggacattgtgaccatatcgcgtgtacctataacacaggaagtacatatgacttggttactttatatggccatggagtttgcaaacaaaatggaagcagtgatacatatattgtgtgcgttcttcaccttacctgcattaccctcacgacattacgtgtacttttttcgaactgtttttaacttgcagctcattccttttcttttatgtatgggtatatga

SEQ ID NO: 28781 - DNA, 309 bp, Zea mays
  Clone ID: cC-zmle189090e11a1
gccccaaaccaaaatttctttaaaattggaaaatttaccaatttgatacccaaaaattacacggaaatattaatatttccatagggaaaaaaaaaaaaaggtttaaaaaaaaatcaaaaggggggggaaaaaaatttttttcaaacaaattttatttcacttgaatggtaaaaaacggggaaacttttttttaaaggaaaacaacattgccctcctcacattcttgggccggaaaacccggatttccttgaacctgggggaaaaccctgggaaaggaaatttaacttccacaccaaaaataatcctttt

SEQ ID NO: 28782 - DNA, 447 bp, Zea mays
  Clone ID: cC-zmle189090e11d1
acccgtccgcgctctttaagggcataatcatcgcaaagcacaaagttggtgtttacaccacaatccgtgtcagaaggagcatgggtggtgtaggagttgagattaccttcccagtgtactcacccaggatcaaggaaatcacggttatcaggcacaagaaagtgaggagagcaaagttgtactacctgaaagacaagcttccccgcttttcaacattcaagtgaaatcagatatgctgacagaacaacttttcccaccaccatctcgatttctcttaaaccttttttttcacttccctatcgatatcatcatatttcactgtaatctctgggtatcagatatgtaatatctacaactttatagcatacttggcttagcgcaaaaaaaaaaaaataaattaatatttattgatattatattaaaatacatttttttttaataataaaa

SEQ ID NO: 28783 - DNA, 430 bp, Zea mays
  Clone ID: cC-zmle189090e12a1
ttttaatttcaggtcccatattagcgagcgggtctgggcagatggtagcaggaagggaagcaaaagtgcaaaacatgtccagactcagcatgaacctggcgacccagaggcacgcgccatccacatttattctcggcatacacaagcagcaaccatccatgagaagcagggggaaaaaacccctctactgggtcttgaacatgtggcggatcaggtcgacgacgcggttgctgtagccccactcgttgtcgtaccacgagacgagcttgacgaagtggtcgttcagagcgatcccggccttggcgtcgaagatgctcgacctgctgtcaccaaggaagtcggtagaaaccagatcctcctccgcataacccatgatacccttgagtggaccctcggaagcagccttaatagctttcttgatatccctata

SEQ ID NO: 28784 - DNA, 503 bp, Zea mays
  Clone ID: cC-zmle189090e12d1
tcatgacaacttcggcattgtagagggtttgatgttaacttttcatgccatcactgccacccaggggactggggacggaccctcaaccaaggactggagaggtggcagggctgccagctttaacatcattcctagcagcaccggtgctgccaaggctgttggtaaagttcttcctgatctgaatggcaagctcactggtatgtccttccgtgttcctactgtggatgtctcggttgttgacctcaccgtcagaatcgagaagggggcctcctatgaggatatcaagaaagctattaaggctgcttccgagggtccactcaagggtatcatgggttatgcggaggaggatctggtttctaccgacttccttggtgacagcaggtcgagcatctttgacgccaaggccgggatcgctttgaacgaccacttccgtcaagctcgtctcgtgggacgacaacgagtggggctaccagcaccgcgttctcgacctgatccgccacatg

SEQ ID NO: 28785 - DNA, 450 bp, Zea mays
  Clone ID: cC-zmle189090f01a1
tttgcatttacaacttggcatctgctgtggagaatacgttacattacaattccagtcgcactagtcaccaaagattgacagttatggacatcacaagtacacattcaacttcccacgttatttttggtttcaagatttttcagcatacaataagatctccttttctcattcctgagatcatctcccattgaaattctttatacctggcacagctcgacatttgatttattccctccttgatctggtttcttgatcatatcaatggattcctattgacatctttgtacagcaagtatctagctctggtcttaccaagggcagcataccactgaggaacaaacggtgccatccaaaatgtacccccagcttgcacgggataccaactctctcccacgcggtatattccttgcccctatacaaaaagaagaccatgttgattataatgaacct

SEQ ID NO: 28786 - DNA, 411 bp, Zea mays
  Clone ID: cC-zmle189090f02a1
tttagcttaaaagtcccggttagattcacggtaggttgcacatctataacgaagctaatccatggtgaatctcagatatacattttttttatctagctttgccaaacaggccattaataaatacgagggaaactggagctttaaataaataactagagttcaggttttggaccattataacacactacccctaaaaatgaagctttagctttcctcagagaaaaaaaaacgaaggttcgcttgataaatttcacattaagcactagtttgaaaactccatttttacaaggaatttttattttgctaaggaaaaatgaactaatttaccttgctgaaatagaaatccctccaaaaaatgacgttcccaaactagtcctaagcaaccctatttttttaaaagaatttttattt

SEQ ID NO: 28787 - DNA, 331 bp, Zea mays
  Clone ID: cC-zmle189090f03a1
ttacctttttacctaaccttttctatttttggaaaaattgtggaaatacaccccctgacacccccaatacccccaaacgtacaaaaaaaacgccctttgaacccacacgaacacaccacagcaagacaaacacaaacccccctactaaaaaagcaacccaaacacacgcccccaatcttcgacaccaaccccctgcccaaaaaaaccatcacatgcattaataaccacgcactgaacaaaacgtatccctgcactgtaaaccccttaaaacaattcaccaaaacaaacacaccagcaaaatgagtaaaattgcaaaaaactccaataccac

SEQ ID NO: 28788 - DNA, 442 bp, Zea mays
  Clone ID: cC-zmle189090f04a1
ttttagtttagcaacaggagctatatgtccagtggaagcaagatggatgcaatgtacacgtacgcacgcacacacgttacaaagtcaccacctgcaggcacctgccggccggcggcgccatcgaggctgctgagtctgatcttaacaacgacgacgtagggatctagccgatgatctggtcgagggcgccggtgttcttgagcccgagcacgatgccgacgccgaggatgtggccgacggcgccgcaggccagcgtgtcggcgagggtgaacccggcggggtcacctgtctgcaggccggagtcgcgcgccttcagcttcagccccgccgtcgccttgcggttcgccgacggcgccagcccgaaccgtcccgcgaacagcatcagcgtcttctgctgtcaccatgatcaggttggtggcggagcctatgtagtcgcagcgga

SEQ ID NO: 28789 - DNA, 410 bp, Zea mays
  Clone ID: cC-zmle189090f06a1
acaaatgtaatgtgggattttgcttttgtttaccatcatatggggctttcacatacgtacgttgaggttttagaagtcgtgcttaattataagcctatatatctactagcagttcttgtactaataatacatgtgcttccacaatgaatcgtgaaaagcacaaaacaaaacccatcgggacagatgatatacactgatgaaacaatctctacaccctttatagcctccgcttcaactaatgtacatataccagtacgtcacattccttagccctcagtcgattaagaacgcatcacacgaactgtcttcgagtctcggcctttcagctcggaccacatgacctgatggaccgtcgactcaacccgacagggtctggatgatggtgttgtgccatgggtcggacaggtgct

SEQ ID NO: 28790 - DNA, 528 bp, Zea mays
  Clone ID: cC-zmle189090f07a1
ttttaattcacacaagatagttactaagtgggtcgcgggttcagttcacggaagaacagaacggtatacattggtcagacgaagaaaccaacaaatctactggagcaacagggaggaagaaggatgacaatctcacggaccagcagaacggcgccgcaagcgcgatcaggtcacgcgatgacaaacaccctgagctcccccctgtccccgcgggtgacgcgcgtgtcgtcgtcgaggtaggtcacctcgaactcgccgctcccggtgttggacggcggccggaggttgtccgggatgcggggcacctccagcggaggaagctgcgacaggttgcccttggtcttcaccgtcgtcttctcgaacgtgatcttgatgcccgaggtcccgatgatctcgaacttgtgcgcagcgtccgccggggcctctagcggcggcagaggccacggcgcgccgagctccagctcacgatgttgtccgaaatcgcggctcaccacgtcgatccgctggaacacctggccaacgtgatgg

SEQ ID NO: 28791 - DNA, 483 bp, Zea mays
  Clone ID: cC-zmle189090f08a1
acaatacgcaggggctcgtgataatttaacaaacccaagtagtacacaacatccagaagcaaataaagcccatacgtaccaaagcctacacaagcagcaacactcactgccagtgccggtgggtctttaaagcacacggaccttgaccacgccatccaccttgaaacaaacttggtaaaattaaagcaaaccagaagcacacacacgccaacgcaacgcttttgatcgcgcgcccaaggcccggccggccagaacgtacgacggacacgcacacgctgcgaccttaggagctggtcttgtgctcgccggcggcgtccttgcggtcttcttcacccgagctcttgtggtagccgggtatcttgtccatgatcttgcccagcaagcccttcttgccatccgggctgctgacgtcgacctctgcgtggggcgccggcggcggtggcgcttggaccgccggcccggcggcggcggcagcaacttctt

SEQ ID NO: 28792 - DNA, 375 bp, Zea mays
  Clone ID: cC-zmle189090f10a1
ggcgagaaaggggttttttttgcctgtataaacaccaccttgtttttttatatcatgtatggaactatgggtgatctaaaaggcctgcctcactatgattctatcatgatcaagtgtggatctgataatttgattagggtatacatatgtgaagagaggaatttgaattggttcaaaaatattgggtagtttaatttcctcattgagtatgctttcagctatgtttatgctccaggtattctacttgttattggaatgcatgtagtcctgaactatttgttgataacagcgatctgctgaataagtgaacatttatcagtatttgattgcaatttacacccattcattgtatgggaaaccccaaaaccctgcgga

SEQ ID NO: 28793 - DNA, 380 bp, Zea mays
  unsure at all n locations
  Clone ID: cC-zmle189090f10d1
cccgtccgcagggttttggggtttcccatactatgaatgggtgtaaattgttatcagatactgataaatgttcactgattcaggagatcgctgttatcaacaaatagttcaggactacatgcattccaataacaagtagaatacctggagcataaacatagctgaaagcatactcaatgaggaaattaaactacacaatatttttgaaccaattcaaattcctctcttcacatatgtataccctaatcagattatcagatccacacttgatcatgatagaatcatagtgaggcaggccttctagatcacccatagttccatacatgatataaaaaaacaaggtggtgtttatacaggcaaagaaaacgagtatattgcnt

SEQ ID NO: 28794 - DNA, 368 bp, Zea mays
  Clone ID: cC-zmle189090f11a1
aaacccaacattgacccctttttttttttaatttaaacaaacacaaccaaccaagttggtttaaacttaaaaaatcttcttacccaataaattaaaaacccttttacaatgctttaaaaaaaaaaccaaatggacttcaaaaaataccagggggcccccacccagggcttttattaaggaatcgggggaacccctcaaatggctcccaaactttcaggcctttaaattcctcggctttttaaaaccaaaactctaaagtatccaaagggttaaaattctgctttccccgggccaaaaaaaccccgtctttcaccccccccctgaaaaaaaaacttttcaccccccccctgtttggcttttatttttta

SEQ ID NO: 28795 - DNA, 531 bp, Zea mays
  unsure at all n locations
  Clone ID: cC-zmle189090f11d1
gtgcgggacgcgtggggaggatttggagaaagacctaaagttgttgttgtctccagtaagagtaggcgcaggggcctggtcatgggcagctaagaagatagagccaaacaaggtgggcctgccaacgtctccttccacgacggcggtgaaagaccgggttcttcaggccgcggcgaagcacgagtcgcagccatcggatgccgacgagtcgtcggtccaaacagccgaggcatgacacgcgccgaaagcttgggagccagtcgagcggtcccgccgaatcctcaataagagcactcggtgggcgctccctggtaatttgtgaagtccatgtcgtttatgatgtaaagcactgtaaagcggctgtaaattatttgcgtgagcagcatctgtaagttgacatcaacttggttggttgtgtgtgtgtagattatagagaaagaggtgtcaatgtaacgttaaaaaaaaaaaatatattttttattttttanttaattttttattttttttattattatttaatatataaaaagg

SEQ ID NO: 28796 - DNA, 432 bp, Zea mays
  Clone ID: cC-zmle189090f12a1
gccggagccccggttggaggtagttgacccagcggaggcggcgggtcttggcggtgcgcctcagacctgcacgagtacaccgccgacacatgcgcatgcacagagaagaagcagggcacgcacaagagagagagaaaagaaatggttaatcaacacccatcgccatagcccatcctacatcaatccatccccacgcacgcatgcatctacatatgcatgcatgcatgcatgctaggggatcggatgcacccgccaccgcgcaaacctgagacctttgctaagaaatcccaccggcgttcaccaaacaagcgggcgaaccataccagctgagcgtctttctcctatggccacggacctcttcctcatagacggcgccggcacctgttgcttatgactgatgtcactgcccctactactactgccactactacg

SEQ ID NO: 28797 - DNA, 517 bp, Zea mays
  Clone ID: cC-zmle189090f12d1
cgagaggatctggtaagcaactaaacaagtgtactgatgtacggtttcatccatccagcgttccagctagggcgcagtcagccagcacccagcacccagcagtataatctatatatcgtacgcaagtagtggatcgaggcatctatctgcagtccctttcttcttcttcctcttgattgataggtgcgccgaagcttgttttgttgggtggcctttgtctctgtcgtctcgtctcgtctcgtcttccgcccggccgtcaccacctgcaggctatactagctagctattaagtccggccaaccaagcagctctatcaggtcggtcgacggcggcgacagttcggagggaagaggctgtcggagaccgaatgacgcctaccatcaactcgcggtcctggccgcgctgccgaaaaattaaaggaagaggacgaaagctgaccgatggacgatcgttatcctcatcatcagtcgtcgatggcgacaccggcagcagcgagcaagatgagcaagaacctgca

SEQ ID NO: 28798 - DNA, 315 bp, Zea mays
  Clone ID: cC-zmle189090g01a1
gggaaaattggtttaaaaaagcacacaaatgcctggtacccccacaaaacccagctcgacactatatttgaaactgagaccacctttttgtgcttgccgacaaacctgccttacaatatggggagggaacgccaaatccaaacgtagaaacccctggcaaaactccaggccatttcctaatattgccttgggagcgaagattccttgcaaccataaacacccttagcggaaacaggcctcctgtaggactttaacttaaatccgggcccctgccacaccccctcattcgcccctgccttatttaccatgacatgc

SEQ ID NO: 28799 - DNA, 201 bp, Zea mays
  unsure at all n locations
  Clone ID: cC-zmle189090g02a1
tttngnctagnnntaacactagcctatttagtttgcttgaggctaaaatactcttgatccaacttgatccagactaagaccgtattcaacaattcacccatatagttatctaaaatattgttactttttccgcagaatgggttttgaatattggaatgaggataagtaaggtgatggagatagcctaaaaggctctcggcg

SEQ ID NO: 28800 - DNA, 388 bp, Zea mays
  Clone ID: cC-zmle189090g03a1
gtaacggggaccgcctttccagcacgtgatattttaacagcgcaacgattttttacagagtaattaagcatattccagtgaaaatccaaagccacctttgtgttaaccaagcgaatgagcccgaccttttggttggaactttgaacacggaacggaactgttagatcgcaacaactaaaccatacaacccgttatatttggaacaactacaacggggcctcatgacctacacatagcccgcctgcccttaaaacttgaattcctttttcttagactggccttccttctcttgcttcctcttcctcttgggagcattctctgccaccatgtcactgaaggcctccttttggtttcaaagcttttatttctttcgagcttattgatactt

SEQ ID NO: 28801 - DNA, 369 bp, Zea mays
  Clone ID: cC-zmle189090g04a1
aaactcaggcttaggctcaggcactttaaccacgcaatcgttgggaaggaaaatttaaagcacaacttgtctctagtacactccctacagatccttgttcttcagtgttggtacttgctcagaacttagttgaaaaagacagaaaagtagaaaaaaagacttccatcttttcacagcgcaatatagaacaaactttcctacacccaaccagctccaggagctcaggcttcagccactgtgcgtgaagggatgcgctagctgcccagggccttctcccttctgagggacaggtaggccagcacccggtacccgatgaccatggcgacgagagctgccacctcggggccaccgctgtccatgtgtctcgtg

SEQ ID NO: 28802 - DNA, 366 bp, Zea mays
  Clone ID: cC-zmle189090g05a1
acagcaacaaaggggcaatgggagacctatgagatgtttcctcataacaaaacaaacaataaactcttcaaaaaaaattcatgtaacctggcccatctaccacattcacacactatacaaactaaaaacaacaacaaaaaaaactgcttcttacgcccacactttcacatggatgactgcgtgggcgtctttgacaacaagaatggttcggtggtggtgaatgatttcatcgtaggagttgtcgtgggagagcgtgtctcgcctgggctttgctccttgttgctgatcttgaaatcagcaaaatcagtgatcatggcaggcctagtgatctggtctaccttgattctcttcttccctgagagcatc

SEQ ID NO: 28803 - DNA, 158 bp, Zea mays
  Clone ID: cC-zmle189090g06a1
gaagggggggttcatttctcatagcattatcatgaaactcaaaacataacaggggaaacactaattaagcaaaggcgccatggggttcacagatccacacctaaaccgctaaattaaactgcgagccatacatgataaactaaaaccaccactcaaat

SEQ ID NO: 28804 - DNA, 270 bp, Zea mays
  Clone ID: cC-zmle189090g07a1
tttttgttaacacaacacaagatttccttttctgattggaattgatacaaaaatgagtgctttgagtaagaaaaaggaaggaaaagaattccaaaaggaaaaattgtaaaaggtccgaagggaataaaggatttaaaaattttttaagaaacctgaaacaccttgctacttggtttttagggcaacagatttgcatataggacaccggttctttttgccaaacccgtgctttattcaagaaaggggggaggaggggttacacgccatttt

SEQ ID NO: 28805 - DNA, 399 bp, Zea mays
  Clone ID: cC-zmle189090g09a1
tttttttttttttttttaatatttatttttttgtttttgtttttattaatttttttaatattcacattaacacataaccttacaaaaaataaacaaacattttaatcaaataaaaaaaatttcaacactttaaaaacaaacaacaccccacaaataaaaatacaataattaaaaaaataattaaaaaaaaccaaaaatattactaaaaaaaaaacaaccaacaaattcaatatactactttcttttactacataataatatccaaaatccacccattacaataacaacttttaatacctccaattttataaacaataacttctattaaaattctacatatttataatttataaaaaccaccccataaaaaaacttaaaaaactacaattttaacccacc

SEQ ID NO: 28806 - DNA, 230 bp, Zea mays
  Clone ID: cC-zmle189090g11a1
acgaactcgatcgtcaacactcctaaattcaccgaccctaacctccacacttaacaaatatatcacaacataaaatattccaacaaataattcatattaaaaattaaccaaaaatttttaccactcaaaaaaaataaatcccctaaaaatcccaaaaataaaaataaccaaaataaaaaaaaaaaaaccctagaaactctaaaaaaaaaacaaacccacaaaaaatacct

SEQ ID NO: 28807 - DNA, 397 bp, Zea mays
  Clone ID: cC-zmle189090h01a1
gacaccaatataccataatggagaaaaaggagaggtgcatttcgttcacaaaacaacaagtttaacgcaccataatacttatgctacgtactagccacctcaagagcaaggacaattaactacaatacaaacatctcatctacctctccctactgcgtggtcacgctcttcgccagattccttggttggtccacgtcgaatccccggagaacagtcagatggtacgcgagcaactgtaatggaattatgttgatcactggctggagacagtctgcaacctgtggaacttcaatgactctgcacgacccaccgctagggcacacagccgaggcatctcccctggagcacatcactatcaggcgccccctacgcgagaggagctgcttgatcaccgact

SEQ ID NO: 28808 - DNA, 244 bp, Zea mays
  Clone ID: cC-zmle189090h02a1
gaaccgtcatcgtttcatcatttatcaaacaccacatgtcattcattcgtataacaaaatatctagggtttcgtgcaaactgttaactggcacacacagcggtggcatgagcacattgcagatagcaaatcttattcggcggtactaggagttgtagggtgtaaaacacaaaaggctgaaacggcaggaggacatttaaaggggcccccctaaacaagctttcacggtttggtttcccggaccc

SEQ ID NO: 28809 - DNA, 379 bp, Zea mays
  Clone ID: cC-zmle189090h05a1
tttaccttttccaccacttaataaagcctttgggaaggaaacccatttaagcacccacctgccatttattacacagggcgacgactttttacactctaaagaaagggacgccccaccctctatgagatattggaaaataaaacccctttttatatacacccccccactattcctttttgtgtctattatccaccggttagagctccacagcacggtgtgccactcaactcctacttgggggggtaatctgggccatcgaccttgtttttcacaaaggcaactcaaattttgggccgcatcccttctgcagtggtagcatactgctcaacgcttgaagtagcaacagctaaagctggttttttgaattgaaccacaataa

SEQ ID NO: 28810 - DNA, 294 bp, Zea mays
  Clone ID: cC-zmle189090h06a1
ttttactttagaaacactccttgccgttctggtgaagggcaccataatcattattcatccgacaagatcatttttgttaaacagttcgtaaaaaggtttggaatgcaaacgaagaagcatggtcacagcatacaaaacgacatgctcactaaagcagttcaaaagaatgtggtgtcttcccatgggccaaaatcaggccaacgagagctcttcagcgggaatattcctctttaccaatttctcccatgattcgttggtctcttgaatgaccttcagggcgtattccttgcttgc

SEQ ID NO: 28811 - DNA, 357 bp, Zea mays
  Clone ID: cC-zmle189090h07a1
aaaataggcaatccctgctcaaaggctgggggaaatgtcacaaaacacttgaatcatgtaaaaaagcaactaccaagcaattattggagaacgaaagttacacaggactacataaccgcataaaacgacagacaatcacaggtaaactgcggcaactatttcaaactatatttacattttacaacaccagaacagtcctgttagtgcatacaatgagaagatgaccctgactaatcctcattgtcgtagtcctcatcttcaacctgcactgtcagatgtccaaaaccagatggcacgacaccgatgctttcaatggcatctggcataggccaatctgactgatgatcactgttcgct

SEQ ID NO: 28812 - DNA, 162 bp, Zea mays
  Clone ID: cC-zmle189090h08a1
ataagggggttgttgttttatattttatgtgaaccttttacacaaacaatcatgtattaaaaaaatatcttataacacagttttaaaattaatataaaacttaccatattcaaaaaaaaaaaaaactatcatttaacccacattttttaaaatatataaaaa

SEQ ID NO: 28813 - DNA, 455 bp, Zea mays
  Clone ID: cC-zmle189090h09a1
ttttacattttacaacaaatttacattatctgtatcggggttattacaaaagtgattcaaagaaatatactttgaaatgttacaaattatttataagtttgaaatatatgctagctcaagtgactatcctcaataagaagtatagaagaggtacttagacttataagaaggtcgagcccaccggcacttagcaccatccacagcaacacaattctattttcggttcttcctcctgcttgggaaccacctttgcacaaaaagtagcaaagctccgcaggctcttcaccagcatcaaacgtgactcaatacttgtgagaacgctgataaattctggtttgagcttgtcgtcgaacatctgacaggtgttgagatctttcgcccacatgacccagacgggactgattatcaggaggcgaagcatggcaaggcgcgtattggaagagctattgagatta

SEQ ID NO: 28814 - DNA, 403 bp, Zea mays
  Clone ID: cC-zmle189090h09d1
gggggaaccacccgtgcggcgacgtcgtgcgcgtcgcggcagccgtcctggccgcaaagctttccgcgccatcgaattcgcccaggtgcgagcgcgccttgttccatgccgcgctcgcctccgtggccgctgcctagcccatctccttgatgtcgcacgagcccccgttgcctagtcccggtgctcgtgcttaccctcggctagcgtcgacgctcgcgcgcctcctcgtcgtctctgcggtgcacccgctctcatccatcgggttcgcgcgtgctcgcgtttgctgtcgggccgttgaacccattttctcctgctcgacctcgtcttcgtccttctggtggccatcgtcaatatagtgctggacgtttgctgtcgggccgttgaacccatttttttctgctcg

SEQ ID NO: 28815 - DNA, 290 bp, Zea mays
  Clone ID: cC-zmle189090h10a1
ttttttttttttttttattttttttttttttggtttttggtttttttttttttttttaaaaaaattattttaaaaaaatttcatccaatatttttatttttttaaaaaaccaattcccgtaatggggcccccttttccaagcccttttttattttaatcaaaaaaacgccctcctccaccatatggttttttttctaaaaaaaatattttttaaaaaaaaaatttttttttttctaaaaaattttttttttttaaaaaaagcacacacaaagggtaaaccctatttttat

SEQ ID NO: 28816 - DNA, 512 bp, Zea mays
  Clone ID: cC-zmle189090h10d1
cacccgtccggctgtgcaagcctataggctacaacaagcaattgcggtgagctttttacaacaaccaatttcccagtggcacagcaatccttggcacatctaacaatacaaaccatcgcaacgcaacagcaacaacaattcctaccagcactgagccacctagccatggtgaaccctgccgcctacttgcaacagcagttgcttgcatcaaacccacttgctctggcaaacgtagttgcaaaccagccacaacaacagctgcaacagtttctgccagcgctcagtcaactagccatggtgaaccctgtcgcctacctacaacagcaacaactgctttcatctagcccgctcgctgtggccaatgcacctacatacctgcaacaacaattgttgcaacagattgtaccagctctgactcaactagttgtggcaaaccctgctgcctacttgcaacagctgcttacattcaaccaactgactatgtcgaactctgctgcgtacctacaacagcg

SEQ ID NO: 28817 - DNA, 379 bp, Zea mays
  Clone ID: cC-zmle189090h11a1
attaaaaccaaaactttattatggggatgggtatattattggtcataccacacatgataatgtgtgtcgtcttactgcattattacagatatagatagagagggatggatagaggagatttcccaaatatcatgaatcaatagtagggcggaatggcagcggagacgccacaggaggtggtgcggtagctgggcagttggtactggtagagtccacccatggccggcatgttctgggccatcatcatggccatggggttgagaccctgagctgccaacagctgttgttgctggtgaataaaactggctcgtacaggctgctgttggcggcagcggcacgctcaagctgcatcatcatttgcagctgttgcgcgacggac

SEQ ID NO: 28818 - DNA, 480 bp, Zea mays
  Clone ID: cC-zmle189090h11d1
ccacgcgtccgcatcagcaaagcggcagtgcgtagtttggattttcgaacagaacagcatgaagaggggcatgtgtctcttcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggagccctactacgccgggtgtgggcagacgagcgccatgtaccagccgctccggcaacagtgctgccagcatcagatgaggatgatggactttcaatcctgttcgcagcagctgcagatgatgaagcagcttgagcgtgccgctgccgccagcagcaacccgttcgagccagctctgatgcagcatcagcagcacctgttgggagcttaaggtcttaaccccat

SEQ ID NO: 28819 - DNA, 55 bp, Zea mays
  unsure at all n locations
  Clone ID: cC-zmle189092a01d1
gggggggaaannaaggggggaaagaaaaaaaagcaaaaacagtaagaaggagggg

SEQ ID NO: 28820 - DNA, 430 bp, Zea mays
  unsure at all n locations
  Clone ID: cC-zmle189092a02d1
gtccggccacgcgtncgagcacgcgtacgcccacgcgtccgtgactggttatgctttccgcagttaggcagcacgaatgccgggtccatctcctgctgagatgcttcccttctctttgttgatcaaacactttacacccaaataagcaactgcatcgacattaattttggctgcaccaaagttacatgaactgaagaaacttgtggcctgcgtgacgcggatcaatcagaacataaagttacggcttctggttggtaaattatgctactcttcagagtctgctcccgcattgtggacgtatcttgatctggactggctctgccgaaactagtttaccgggctttccatgtagtttttctatggttgtgcaacttctcgccgggaccagtttaatgtttatcgactttgattggagatgacccgatgcttt

SEQ ID NO: 28821 - DNA, 424 bp, Zea mays
  Clone ID: cC-zmle189092a03d1
ggagagatcaaatgggaggatcgccaccaagaaaagatgctggcttacgctactgaaatctagaggtctccgccgctatatactagaagtgcacacccatcactatcgttaatgaatcaaatgccttacctgctggaacgtgagcaagctattctactcaatcttggttcgtagccagcaatagctatgtatgcgcgtgtctttatattcaactataacagcccatgagggaaggcctttctagggttatgactgtctaagtataaatccaagaaacatcaatggcgggcctgcaatggcttttcagcttaatgttactgaaactcctcttatttctagaggacagggatcgtatcatatactaatgaacattgaacactatgtggctacattgctagaagatctgcaaatcggttgacagctg

SEQ ID NO: 28822 - DNA, 71 bp, Zea mays
  Clone ID: cC-zmle189092a04d1
gaaaaaaaaaaaaaaaaaaaaaaagataatttttaaaaaaaaaaaaaaaaaaaaaaaagtgcgggtttttt

SEQ ID NO: 28823 - DNA, 428 bp, Zea mays
  Clone ID: cC-zmle189092a05d1
gctgaccccacccacgtcggcgatcagtgcttcagggtcaccatccaccattgcttgttcgattctttctgcaaaggcacccccgcctccgctccggaaaggttcacctctacaacaactacacgcgcaactggggcatctacgccgtatgcgcaggcgtagaggcccagatcgtgtcccagtgcaacatctacaaggcaggtggagggcccccaaagaagacaactgtattcaagtacatgccggagaaggccggcgaccgagaggacgtgaaggctaggtcgatcagctcggaaggggacgcctacctcaatggcacgctgccctgcgtgagcgataaccctggatctgtcttcaggccagaggactactaccagcagtggaccatggagccagcgtcggcggcgctcaaggacataatacagctc

SEQ ID NO: 28824 - DNA, 535 bp, Zea mays
  Clone ID: cC-zmle189092a06d1
cgcgtccggccccaactccagatgttgctgaagctagtccccagctgctgaggaggaggacgatgagggtggggtcctttttggtgaggagaccgaacaccagaagaaggctgctgaagagcgtgctgcagctgccaaggcttctggcaagaagaaagaatctgggaagtcatcagttttacttgatgtgaagccatgggacgatgagactgacatggccaagcttgaggaagctgttaggagtgtccagatggaagggctgctctggggcgcatccaagcttgtcccagtcggatatggtatcaagaagctgcaaatcatgatgaccatagtcgacgatcttgtctctgtcgacactctcattgaggactatctgtgcgctgagccagttaacgagtacgtccagagctgcgacatcgttgccttcaacaagatctaggcgtgactttcgatcagtccttcccctggggtgctggcgatggtggtggcttggcaatgcaccagcctaatttatccatagctatatgtctgcttt

SEQ ID NO: 28825 - DNA, 450 bp, Zea mays
  Clone ID: cC-zmle189092a07a1
ttttggtaccaaaggagtctgggcagattcgatgaagggatagaactacaaactggattcaactgcaatcagtgtccagaacacgcaaagccgtacagattcacacagcaggggaagcaaggagtttcgatgacacaaatggagataagggtggcagcagggggactcaaacgttcagcagctacagctagtacggtttcttcatggggaagacgaaggaaacaagacctgcactgcctttctaatatgcgatgcacggtttggtttcctccttcaattcccgcggggtactataccgttaccgcaggctttactcacttggccatcatgaccttgacgaactcctcgtagttgatctggccatcgccatcgacgtcggcctcgcggatcatctcatcgacctcctcgtcggtcagcttctcgccgaggttggtcatcacgtggcggagc

SEQ ID NO: 28826 - DNA, 601 bp, Zea mays
  Clone ID: cC-zmle189092a07d1
ccgcccacgcgtccgaaatcgctccctgcctctggtcacctttcttttcgctcccggctcccctccggctacccaggcagggttcgtgcgctcgccaagagacaggaccggagaccatggcggaccagctcaccgacgaccagatcgccgagttcaaggaggccttcagcctcttcgacaaggacggcgacggttgcatcacaaccaaggagctcggaactgtcatgcgatcactgggtcagaacccaaccgaggctgagctccaggacatgatcaacgaggtcgatgcggacggcaacggcaccatcgacttcccggagttcctcaacctcatggcccgcaagatgaaggacaccgactccgaagaggagctcaaggaggcgttcagggtgttcgacaaggaccagaacggcttcatctctgcggcggagctccgccacgtgatgaccaacctcggcgagaagctgaccgacgaggaggtcgatgagatgatccgcgaggccgacgtcgatggcgatggccagatcaactacgaggagttcgtcaaggtcatgatggccaagtgagtaaagcctgcgggtacggtatagtaccccgcggg

SEQ ID NO: 28827 - DNA, 453 bp, Zea mays
  Clone ID: cC-zmle189092a08a1
ggaaaagcatattacggaggtaaggcgcaaaacattctgagaacaagttcacatgatggaaaatttattagcggtcaccaagccaccgtttcaacgtcagcttgcaaaagctctttgccaggggtcatcagaccacaattggaataggtttgcaacaaaactctcaagtgaggcgcatctagcttcaatgacatactatggccacaagtagcgcaatatccagcatgaaacaaccggtacttcacacatacaaaaactccaccgagatggaccaatccaacagcaagggtttacttatctcccccatcagagtgtgcagaggtaatagttgagactttgggtgaacactttggagcaccattgaataagtatgagcattcagtgtatgcagcccctatccccacaccagctccaagggcaactgatgcccagcgagtagtagggctacggaag

SEQ ID NO: 28828 - DNA, 580 bp, Zea mays
  Clone ID: cC-zmle189092a08d1
ggagcaacccacgccgccccgctgtctccgccggtccgctccttccctcccctcccccgaatcgcgtcgtccggtgggctgctgccgcggaaccctcgccatggcggaggcgcccgagaccgccgcccccacccagccgcctcccgcgccggcggcttcgtccccgcctcccaagtcggggatcccgccgcggtacgacctggacgccaagtgggacgcgtgcctcgacctctccatccgccgcgtcgcctactcctccctcggcggcgcctttgcgggcctcctcctcttccgtagccctactactcgctgggcatcagttgcccttggagctggtgtggggataggggctgcatacactgaatgctcatacttattcaatggtgctccaaagtgttcacccaaagtctcaactattacctttgcacactctgatgggggagataagtaaacccttgctgttggattggtccatctcggtggagcttttgtatgtgtgaagtaccggttggttcatgctggatattgcgctacttgtggccatagtatgtcattgaagctagatgcgcctcacttgaga

SEQ ID NO: 28829 - DNA, 548 bp, Zea mays
  Clone ID: cC-zmle189092a09a1
tccctccttttttaggcaagaacattctgggctccagttggcattttctgatcatagtgttccagcccggctcatagtcataggcatatacggatatacaaaactcatactcaaaacctactgaatgaacttcccttcagctacagcaagcaactcaagacgcagcatatacaacgatggtggagcaccagcgcaatttcctgggcacccaccgttacatgcagaatagtttgcttgaaaggatggtgcacaaaatagtttgccattcctcctctctgaggttctgctaagaagcatgttgcgtttgaagatcgtcggatttccagacgacgtccttcaaggtcttggaaaggttcttgtaaaacttatgaaattccagagtgtcaccctttgcttttcggacttctaccatgtggagagagggcgcaacttgcagtatctgaatcaatatgaataataaatgttaggcagaagacgttacaaaaaaatattgcagttagggaaaacgttaagcatgacctcagtagcaacgttgaggttccctttct

SEQ ID NO: 28830 - DNA, 367 bp, Zea mays
  unsure at all n locations
  Clone ID: cC-zmle189092a10d1
aaaaaaaaaaacgaaaaaaaaaaaaaaaaaaaataatattaaaaacgaaaaaaaaaccaacaacatcagacttttattataaanganaccgtgtatacctccactcaattgatctcaaatattaaaaaattttataaatttaaatatttaatcttattattattattttttataaaaaaaaaatgtattttaataatttaattacaattaagtaattgtaccaattattgttcacaattatttttgttaaaattttgacattttatacaattgtaactattaaagtgacattattctttactttctaattaactgattattttattattgatatttttatttgattgttgtgattatttttttacat

SEQ ID NO: 28831 - DNA, 481 bp, Zea mays
  Clone ID: cC-zmle189092a11a1
tctctttttttttttttttttttttttttttttttggggggatttcacataattgatacattgatcaacaaatattgggcatttcagctccattcagcattatttgaaattctagagtactatacatattcactccatcagttcaggaaagggggcaaattacaagtgaaactagataatacacattctaaacttgatgttcaatcttgggctctggaaaaggaaaactaaatcaatcagagatcatatatgtactctattcatctttcccctgacagggctatattcatgtatctatacataattttggttctgaggaaactttcatgtgtttttagtgaaacagtttattccccttggcgggaatctaaaccggctccatatttccaagcttccaggtaccgtttccactgatatttgtcccgtgggggcaaggattccacccaagacctcaggatcggatcaatataggtagaaagga

SEQ ID NO: 28832 - DNA, 603 bp, Zea mays
  unsure at all n locations
  Clone ID: cC-zmle189092a11d1
ggacgcgtgggcaaagcttctaaattatggattcctttattgccttggttgagtgacctgcagactctgtggaggcaacaagacaatgccctccttgtacctttattcgacctttctagaggaacctcttctaattttatcaatgactttaaaaactcattcagagcagcgcaaatacggagaggctactttgaacccgttacctgactcagtgagacaactcttaccagtgcaccagacctgcccttctgcagtatcactttattgatgatgaattttggatagctctacatgtgctggtttcttatcatttgatttcacatacttcttttttttattttggggttaaggtatatgtgaagcagttgaaggtgatttcctggatgctcatagtttgcagctgctcaacccttacatggttagtgtatgccatagccatttcgatacaatttgaagtggaagcttattcggttttggtattgcagccaaacttaagtgcatcatgggtgttccaacgagcgatgtcagtaaggccacatgtgaatgtttcaccaacctgtatcaatgagcttctctttgctaatttcagncaatgcagaaact

SEQ ID NO: 28833 - DNA, 445 bp, Zea mays
  Clone ID: cC-zmle189092a12a1
tccctccttttttttttttttttttttttttttttggtgggttttttttttaggccaccccgagaaaaacaccaacgaaccaccaaattttttttatacggcccaacattaaaggaagaaaaagaaaatgggtcacgtgcatatgtaacactagctttacaaccgggggactggtttttgaatataccggaactacaactttattgctcagcaggggaacggacacctttgcagctttgccatatggcccatttcttgaccagggctttcctttccattcttcccggggaggaatatcaaaagacgggggaccctaaaacaacatgatcattttcaccaaaaaaagaacccaccctggatatttgaaaaaaccgagcaagctttaaccgggactccaaaccccgaatggagtgacccaggagcatgcaccaaaacagaaaacgtg

SEQ ID NO: 28834 - DNA, 393 bp, Zea mays
  Clone ID: cC-zmle189092a12d1
gacgtttgctgttctggtgcatgctgctgggtcacttcttattgtttctggagtaccgcctagagcttgctcccgttgtgttaatatacagcgcggcttctccctctcgtggagatgatcatgttgtttgagggtaccacgtctactgatattcctcaccggaaagaatgcaaaggaaagccctggtcaagaaatgggccatatggcagatctgcagaggtgtccgttacactgctgagctatatagttgtaattcctgtatattcagaaaacagacactcggttgtaaagctaatgttacatatgcacgtgaaccattttatttttcttcctttgatgttgtgccgtataaaaagaatttcttggttcctcggtgtttatcttgcggtcgcg

SEQ ID NO: 28835 - DNA, 564 bp, Zea mays
  Clone ID: cC-zmle189092b01d1
gaaccaaacccgcacgacacgacaccaagtcgaggagcgctagggcaccaatcatggccggcgtgaactccacgcgggtttggctcaagcccgccgcggcagccccgcaggccgccgccgcctcatcgccggcgaagcgggtgcagctggccgcgcccgagggccgacgcgccgctctgctcggcctggcggccgtcttcgccgtcacggccaccaccgggtcggccaaggccacgatcttcgatgagtacctcgagaagagcaaggccaacaaggagctgaacgacaagaagaggctggccaccagtggcgccaactttgcgcgcgcctacaccggggagttcggcagctgccagttcccctacaacttcactgggtgccaggacctcgccaagcagaagaaagtccccttcatcagcgacgacctcgagattgagtgcgaggggaaggagaagttcaagtgcggctccaacgttttctggaagtggtgaagcagctagcagcagcgtctgatgggaatggaggagatcatcacctgtcttgtcgccctagatatgtccaact

SEQ ID NO: 28836 - DNA, 605 bp, Zea mays
  unsure at all n locations
  Clone ID: cC-zmle189092b02d1
gtccggtgcgatgtgcagagcaagacttggagggtgattgagaacttgtctgggggtcttaatggagtgagcgggncagccgcacttgttgcagtggttaagaatgacctcgcatgctgctgattacagcgggaaggatgtgaagaagtatgacaagcagaataatgggtggatcacacttggtaaattgcctgagcggtctgtgtccatgaatggatggggccttgcattcagggcatgtggtgagaggcttattgtcattggtggcccaagaacaccagttgggggcatgattgagctgacctcatggactcctgatgacaagccacctgtgtggaatttgatggacagacggccatctggaaattttgtgtataattgcgctgtgatgggctgctgagctcgcttcatcaagggtctgcatagtgatgtttacaaagagaggtatgcacaggcaggcttgtttagcttcagcactccttgatgggtttctgcctttgaccttgtagctgatgtagttggcatccacaggaacaggatctttgaacctttttcatacatcagttctgcccagctaatcatttcttcattacatttgatcagtc

SEQ ID NO: 28837 - DNA, 531 bp, Zea mays
  Clone ID: cC-zmle189092b04d1
cggccgcgcgaaccaggcccgactccccatgttgctgaatcactggctccagctgctgaggaggaggacgatgagtgatggtgtcctttttggtgaggagaccgaacaccccaagaaggctgctgaagagcgtgctgcagctgccaaggcttgtggcaagaagaaagaatctgggaagtcatcagtcttacttgatgtgaagccatgggacgatgagactgacatggccaagctagaggaagctgttaggagtgtccagatggaagggctgctctggggcgcatgcaagcttgtcccactcggatatggtatcaagaagctgcaaatcatgatgaccatagtcgacgatcttgtctctgtcgacactctcattgaggactatctgcgcgctgagccagttaacgagtacgtgcagagctgcgacatccttgccttcaacacgatctaggcgtgactttcgatcaggccttcccctggggtgctggcgatggtggtggctgggcaatgcaccaacctaatttttccatagct

SEQ ID NO: 28838 - DNA, 539 bp, Zea mays
  Clone ID: cC-zmle189092b05d1
ccaactccacatgttgctgaatcactagccccagctgctgaggaggaggacgatgatcaggttgtcctttttggtgaggagaccgaacctcacaagaaggctgctgaagagcgtgctgcagctgccaaggcttctggcaagaagaaagaatctgggaagtcatcagttttacttgatgtgaagccatgggacgatgagactgacatggccaagcttgaggaagctgttaggagtgtccatatggaagggctgctctggggcgcatccaagcttgtcccagtcggatatggtatcaagaagctgcaaatcatgatgaccataggcggcgatcttgtctctgtcgacactctcattgaggactatctgtgcgctgagccaattaacgagtacgtccagagctgctacatcgttgccttaacaagatctaggcgtgactttcgatcagtccttcccctggggtgctggcgatggtggtggctgggcaatgcaccagcctaatttttccatagccttatgtctgctttgtgcggccagagatt

SEQ ID NO: 28839 - DNA, 379 bp, Zea mays
  Clone ID: cC-zmle189092b06d1
ggagtatagtattagcttagctcgaggcaaataaacagtaattttaatgaattaaagggttagggttggggggcgggcattaattccctttttgcatcacggccacaccgatcagacaatcatgcatatagtactggggcacacgatgacgtcctaccagtacgaccgatcgagctagtaaccgctgctgcagagatcacgcgcgagttgggcaggtctattgtaagtacgatcacatgccacttgtccgagcctcgtgtcagtgtcacggctgagatgaagagaagccgagaggggtaccccttgacgccggtcgctaacacaacacgcaaaagagggaattattgaacccagtcgctaacacaacggaacttgaaaa

SEQ ID NO: 28840 - DNA, 406 bp, Zea mays
  Clone ID: cC-zmle189092b07a1
attagggacgggaggaaactagtaaccaaatggggggaaccaaaacttcggataagccttaaataacactttggctttaacgaaaatgacagttctaaatagcccacccaaacctggcgagcatagtttatacaatgacgtgaacaagacgagaagttttacgctcacactaggaatccctaaagcaaactccgaaccagccagacacatcctttcttctttgaggcttccttggacaccatggctccagggggatacttcttctccccactcttgaagactgcaacaaccaccgtttgcctaatgtcccggccagcaaagctaccaagaggaggatattcaaaaaacggcttcactaccaagggcctaatgggaaccatattcaccataccagcatctgcattgt

SEQ ID NO: 28841 - DNA, 537 bp, Zea mays
  unsure at all n locations
  Clone ID: cC-zmle189092b07d1
actttatcaagaacatgattactgccactttttatctgactgcgctgttcttatcattgactcggcgggtggtggttttgaggctgggatctacaagcatggacagacccgcgagcatgctctccttgctttcacgctcggagtgaagcatatgattcgctgttgcaacaagatggatgccaccacacccaagtactccaaggcccgttctgatgagatcgcgaaggaagcctcttcctacctgaagaaggttggatacaaccctgacaacgatccactttgttcccatcactggtttcgaaggtgacaacatgattaaaaggtccaccaaccttgactggtacaagggcccaaccctacttgaggctttggacttgatcaatgagccgaagaggccttcagacaagcccctgcgtcttcccctacaggatgtgtacaagattggtggcattggaactgctcctgtcgggcgagttgagactggcatcatcaagcctggtatggacgttacctttggtcctagnggccctactactg

SEQ ID NO: 28842 - DNA, 480 bp, Zea mays
  Clone ID: cC-zmle189092b08a1
tctcttttttttttttttttttttctgaatgcatggggcggacttttattattcctatattgccagcgtacacattctgcaaatttccctacatggtaaaaccgcaacctcacagttccggcaatgttccgatgagaaaatcagtcaactcgccgagccaaagataagaaagaaagaatggaacctcaaaattcttttcacaacttcaagtgccgtgtatccacaacatgattccccccaaaaaagtgaggcaggcatccgcggcgagttgcacttctctgtcctatgtaccaagtcaatttgcaagcaggaaatacggggaaaccaaacttttgatttccctaaccactcattcacctgtgggcagccgatacagaataaatctcatcttttccatcataatttcctgaatttctccatgacactgtctagtcacaataagatgtgaaaaagcgcggcaggatatgccaagcaacacgg

SEQ ID NO: 28843 - DNA, 545 bp, Zea mays
  unsure at all n locations
  Clone ID: cC-zmle189092b08d1
ccgggagggaggaagcatttgtgcgacggatgaaggacatcgctcactcagagcttgatagattgggtgctaggcttggggttaaggaattagttcatgctattcctgccaatgctgatccaaaggatgctggagattttcttgcctacctgcggaaatcttctaagggtggtggtttctggttctcagagtctaagataaagaaaggcggagttttggcacacttgaaaccaattgctgatgaaaatgatttccatagttgcctaacattgtattttgggccagaagttagtccgatcaggagtgcaattgacagtaaatgcaaaaatatcctggatgatctgttaagctttgtggaatcacataattcagccccatggctgaaggagttggtgccatacctccaggagaaatgctacaggaccatctcgggagtattgaaagaattagaagctgagctcagaaagctttctgctctgttgggaaccacaaagganggtaacgacatacctgcagcttctattatagcggagaggtctctcttc

SEQ ID NO: 28844 - DNA, 333 bp, Zea mays
  Clone ID: cC-zmle189092b09d1
ctgcagcccaaccgtggcggatctatgactttttaaataccttctacgaacgttccccacacgcagagcgccggggcgttccggccatgccccactccgctgttggtgagcagcccttgtcgcaaaaatatctaggaccgccacgctcgcgcctccgccgctggcgccgacgctaccagaagcaacgccgagggcccaaacggcctggggctcggcctgctgccagccgcgcacgagcgggatggcaagagccgccagcgacaggtgacatgcaacgcggccgacgaggctgcggcgggcgcgaagacaaagaaggacgcggtctcatgaaga

SEQ ID NO: 28845 - DNA, 504 bp, Zea mays
  Clone ID: cC-zmle189092b10a1
tttgttctgaaccctctcatatgcatattattgctggggggatatctgtataaatagatacatgtacctatcaaatatgcgccagagaatgcgccaatctgccacagataatatatcaaatacaccccacccaaatataaccaaaggccaccagatcaaatacacgtacatatacatatatatataaatatatacatatacccgattacccgtcatcttattaatttccacccggccgggtcgagatcacattcttctcccaccggttccggactccctctggcagttgaagtagacggcggcgaccggcaagccgaggttgtagagctcggcgaagtcgcgggtgctgaagttctgccgccaccccggggcgtacaccgtctgccggccgagctgctggaagagcagaaacacgacccggtggatccccagcaccggccgtgggctctcgtagcacacgacctcggtcccaaaagatactccagtcgtcgccggaatatcagt

SEQ ID NO: 28846 - DNA, 488 bp, Zea mays
  Clone ID: cC-zmle189092b10d1
atctagatcgccgaccaaccgcgcgtcgaggtcttcgtatcccgacatgcgcaccttctacaccctgtggagggtagatcctgatgcgccgagccccacccatcccaacctcagggagtacctgcactggctggtcactgatattccggcgacgactggagtatcttttgggaccgaggtcgcgtgctacgagagcccacggccggtgctggggatccaccgggtcgtgtttctgctcttccagcagctcggccggcagacggtgtacgccccggggtggcggcagaacttcagcacccgcgacttcgccgagctatacaacctcggcttgccggtcgccgccgtctacttcaactgccaaagggagttctgaaccggtgggagaagaatgtgatctcgacccggccgggtggaaattaataagatgacgggtaatcggacatacgtatatatgtatatatatactgctatgtacgcgtatttgatct

SEQ ID NO: 28847 - DNA, 461 bp, Zea mays
  unsure at all n locations
  Clone ID: cC-zmle189092b11a1
gtatatatatagtatcaaatcatatcatcggggggcaattaatatatggttacagcagatgcaatcggatcaaccaacatgcaggtagacacacgtacgtacatgagcacaaagactgacgccaaacatgcagagagagatagcaaactgaagaactctgtttctctctctctcacacacaccacacaatacctatgtatggcagccagctcggcctcgcttattattgttcaaccaccaccacaagctagatagataataatcatatccatggtcgtcgatcgatgtgatcagcagttgcaggggtcgcacttgcagttgccaccgcagctgcagccgtgggcggcctcgccggactccgccgcggcctcgacgaactcgggcgcggccttcttctccggggccacgccgaggacgacggtggcctgcgcggcggtgctcgtctcctccccacgcgtncg

SEQ ID NO: 28848 - DNA, 465 bp, Zea mays
  unsure at all n locations
  Clone ID: cC-zmle189092b11d1
gacgcgtggggaggagacgagcaccgccgcgcaggccatcgncgtcctcggcgtggccccggagaagaaggcggcgcccgagttcgtcgaggccgcggcgcaccccggcgaggccgcccacggctgcagctgcggtggcaactgcaagtgcgacccctgcaactgctgatcacatcgatcgacgaccatggatatgattattatctatctagctcgcggaggtggatgaacaataataagcgaggccgagctggctgccatacataggtattgagtggtgtgcgtgagagagagagaaacagagttcttcagcttgctatctctctctgcatagttggcgtgaggctttgtgctcatgtacgtacgtgtgtctacctgcatgttggttgatccgattgcatctgctgcaaccatatattaattggtccacgatgatatgagttgacactatatatatactaaaaa

SEQ ID NO: 28849 - DNA, 539 bp, Zea mays
  unsure at all n locations
  Clone ID: cC-zmle189092c02d1
gtccgcccacgcgtccgcccacgcgtccgcccacgcgtccgtanataactcagtgcaagcagaagcagcgcaatggcgagggggaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagctgctcgcccgcaacggcgtcaagttcggcgaggccgtgtggttcaaggccgggtcgcagatcttcagcgagggtgggctggactaccttcgcaacccgagcctgatccacgcgcagag

SEQ ID NO: 28850 - DNA, 498 bp, Zea mays
  unsure at all n locations
  Clone ID: cC-zmle189092c03d1
ggagcaacanagcagaagcaaagcgcagagctagtaagtgaccgaccgagagcaaataggcaaggcaacggagggaagattgtgcagcaagccgcgaagccgccatcccgctgctgacgccttacaagatggggcagttcgagctctctcaccgggtggtgctggcgccgctgacgaggtgccgctcctacggcaacgtgccgcagccacacgccgccgtgtactactcgcaacgcgccaccaggggtggcctgctcatcgcggaggccacgggggtgtcggccaccgcgcaggggttcccggagtctcctggcatctggacgcatgagcaggtcgaggcgtggaagcccatcgtcgacgccgtccaccgcaagggcgccatcttcgtctgccagatctggcatgtgggcagggtcttcaccaacgagcttcagcccaacggcgacgcgcctatctcgagcacggacaagcagatcttccccgacgccaagtccggaa

SEQ ID NO: 28851 - DNA, 249 bp, Zea mays
  Clone ID: cC-zmle189092c04d1
cgacagcctcttgtaaatatgtagatgtgcccgggcatggcgttcctgagtagcagcaaagagatctaccatgtgtaggagtttttccttgtaaataaaagtagcacgccaggagactccatcccaggttccgcactgcttgcgcgaccagatgctgtaaactagccagatacttgaagaccaatataaatggatatgtctaacaaaaaaaagaagacaccgtggttacgaaaaccaaaaataaaaagg

SEQ ID NO: 28852 - DNA, 541 bp, Zea mays
  Clone ID: cC-zmle189092c05d1
ccggtcctcgcctccctcgattccgggttcagcgaattctgactaacccggcgtgtccgtgtcgaccgacccttgccgctgcaagtctgcgacgagtctcctgccgctcttcccggccgggcgaaatggacggtgtcgttgtcaggagggtcatcccttcagataacagttgcctcttcaacgctgtgggctacgtgatggagcacaaccgaaataaggcttctgagctcagacaggtcatagcagcaacagtcgctggtgatcctgagaaattcaatgaagtgtttcttggcaaaccaaatgaagcgtatcgtgcttggattttggatcctgaaaagtggggaggagccattgaactctctattctatctgaatactacgggcgtgaaatcgcagcatatgacattcagaccacccgctgtgatctctatggccaggagaagaattacagtgaaagggccatgctcatttatgatggtttgcattatgaagctctcgctattgtttcggctgaaggagcaccttaagaacttgaccagac

SEQ ID NO: 28853 - DNA, 223 bp, Zea mays
  Clone ID: cC-zmle189092c06d1
aaaaaaaaagaaaacaaaaaaacaaaaagataaatacaaaccaaaaccacaaaaaaaaacaaaaagaacgttaaaaaaaaaaaaccaaacacacccacaccaaaagaacaaaaaaacagacacgaaaacaacaacaacccaaaaaaacaaaacaaaaaaccaacacaccaacaaaaagcgcacacccacacaaaacaaactaaacaaaacaaaaaacaacacc

SEQ ID NO: 28854 - DNA, 401 bp, Zea mays
  Clone ID: cC-zmle189092c07a1
tctcttttttttttttttttttttttttttttttttggtgtgttttaatcaaagattaagcggaaaccccgcaaatctcaatggaatgaaccccggaaatccggaacgcgaacgagacagctgacaaacattcccctaaaaaagggaaccaaaacagcttggatgaaaaaagaacataacaggaacctgggagaaaaccgagtcagcctacaatttcagccaacatacgggacagaaacataaaaagtaaaaaatcggggcgcataaagcaggggcaaaaacaaataaaatgcacgggggtccttagcaggggggcaaaacgaaaaacttcactggccactaacttaaagaatatcaaaaaggaacggaaaaaggcggctgcggaattgagaccacgggaa

SEQ ID NO: 28855 - DNA, 424 bp, Zea mays
  Clone ID: cC-zmle189092c07d1
cgcccacgcgtccgcggacgcgcggcaaaaaaaaaaaaaataaataaaaaaaaaaaaaaaaaaaaaaaaaaaagaaagaaagaaaaaacaaccaacccaaaggcccccacccaaacgaacacgcgcgtgcaacgccaaaacacccacaactcccaaccaaaatcaataacctgaccgccgtaaaacagagtcaacaccaacaaaacccggccgccacccaacccaaaacgccaggcaggaaaaccccctaccccccccagaggaaatcacgaaaaggacaacccccatccccacccccaaacaatgccaaaaacaaccggccaaagggacccccccctgagcgccgcatcaagaccgaaaacccaaccccccctcccagagaccccgatacactggccagccggcgaaacccccaaaccttacc

SEQ ID NO: 28856 - DNA, 501 bp, Zea mays
  Clone ID: cC-zmle189092c08a1
ggagcaacaggagctatatgtccattggaacgaagatggatgcaatgtacacgtacgcacgcacacacgttacaaagtcaccacctgcaggcacctgccggccggcggcgcgatcgaggctgctgagtctgatcttaacaacgacgacgtagggatctagccgatgatctggtcgagggcgccggtgttcttgagcccgagcacgatgccgacgccgaggatgtggccgacggcgccgcaggccagcgtgtcggcgagggtgaacccggcggggtcacccgtctgcaggccggagtcgcgcgcctccagcttcagccccgccgtcgccttgcggttcgccgacggcgccagcccgaaccgccccgcgaacagcatcagcgtcgtcgtcgtcaccatgatcaggttggtggcggagccgatgtagtcgcagcggatgccctgcgacgacgacctcttcctgcccaccctcacggacggcagcgctgccaccgcggacctggg

SEQ ID NO: 28857 - DNA, 626 bp, Zea mays
  unsure at all n locations
  Clone ID: cC-zmle189092c08d1
tccggctgctgaggacggacagcgtttctatgtgcgacgtacgacgacgacgacgcaggggcgacacatggcatcccagctctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtcggcgaaccgcaaggcgacggcggggctgaagctggaggcgcgcgactccggcctgcagacgggtgaccccgccgggttcaccctcgccgacacgctggcctgcggcgccgtcggccacatcctcggcgtcggcatcgtgctcgggctcaagaacaccggcgccctcgaccagatcatcggctagatccctacgtcgtcgttgttaagatcagactcagcagcctcgatcgcgccgncggccgcaggtgcctgcaggtggtgactntgtaacgtgtgtgcgtgcgtacgtgtacattgcatccatcttggttccatggacatataactnctgttgctcc

SEQ ID NO: 28858 - DNA, 506 bp, Zea mays
  Clone ID: cC-zmle189092c10a1
tctcctctttttttttttttttttttaatgcaagagggggatgatcggatgttgagatgattgaaacacaatgagcacaattacacatgaagatttaatttccctgcagtttggacatatctagggtcgacaagacaggtgatgatctcctccattcccatcaaacgctgctgctagctgcttcaccacttccagaaaacgttggagccgcacttgaacttttccttcccctggcactcaatctcgaggtcgtcgctgatgaaggggactttcttctgcttggcgaggtcctggcacccagtgaagttgtaggggaactggcagctgccgaactccacggtgtaagcgcgcgcaaagttggctccactggtggccagcctcttcttgtcgttcagctccttggtggccttgctcttctcgaggtactcatcgaagatcggggccttggccgacccggtggtggccgtgacggctaagacggccgccatgccgagcatagcggcgcg

SEQ ID NO: 28859 - DNA, 633 bp, Zea mays
  unsure at all n locations
  Clone ID: cC-zmle189092c10d1
ccgaagcccgcacgacacgacaccaagtcgaggagctcgagagtgcaccaataatggccggcgtgaactccagcggcggggggctcaagcccgccgcggcagtgccgcacgccgccgccgcctcatcgccggcgaagcgggtgcagcttggcgcgcccgagggccgccgcgccgctctgctcggcctggcggccgtcttcgccgtcacggccaccaccgggtcggccaaggccacgatcttcgatgagtacctcgagaagagcaaggccaacaaggagctgaacgacaagaagaggctggccaccagtggagccaactttgcgcgcgcctacaccgtggagttcggcagctgccacttcccctacaacttcactgggtgccaggacctcgccaagcagaagaaagtccccttcatcagcgacgacctcgagattgagtgcgaggggaaggagaagttcaagtgcggctccaacgttttctggaagtggtgaagcagctagcagcagcgtctgatgggaatggaggagatcatcacctgtcttgtcgaccctagatatgttcaaactgcanggaaattaaatcttcatgtgtaattgggctcattctgtttcatcatctcaacatccgatcatg

SEQ ID NO: 28860 - DNA, 444 bp, Zea mays
  Clone ID: cC-zmle189092c11a1
tctgttttttttccttaagattaacttataataagtggtggagggtggtaacagtattccatcgatcccaacaaaaagctggggaagcatgggtttgctgaaaccgaggaggagcacagcactaacaacggacacggagcgaccttgcaatcaaaaacagagatgggcaacaacaaacacgacacgaacgaagataaaccctctggactagggtaaacataacggtagcgaacaggataacttggccgcgcgggccccaccggtcagtacctccagttcccgtcggaattgccggaaccagcggtacggtggccaccgtcgtatccgccgccaccaccaccgtagccgccgacgccaccgttgccgacgccaccgccgtagccgccaccgaaataacggagcccgccaccgtcggatccgacgcctgcacggccaccaccgggc

SEQ ID NO: 28861 - DNA, 269 bp, Zea mays
  unsure at all n locations
  Clone ID: cC-zmle189092c11d1
ggttctgatgttttccggggaacggcttcgaggaaggtgttgtggttatggaggcgtagggtggtgaccacccctgcttagtcggaggactcgcctgggtcacggccgaccaatccgtggacaacgccttcaagaacctacggagaggttctcgagtccaagagcatcctnnntcgggagacgcataggtcctgaggaatacgattggtcaccttntncactgaagaggcgatgcggaacaccatcgagggcatgaacggacaaggagc

SEQ ID NO: 28862 - DNA, 484 bp, Zea mays
  unsure at all n locations
  Clone ID: cC-zmle189092c12a1
ccaacatnangaaaagacattcatgacagacttttatatgacacggtttagaactccaccacgctaccactgaccataggctaaaatgctcctatagttcttacaatgaattgaacaaacattccatctacatttcacacaaatagcactgcacgtgagccagaactttgcgcctgatactgcgagctgctgcgcaagacttaactagatcaaagcgtacagaatcacctagtaactggtgcagagcacttgaacagcaaacaaattagctttttttttaatctaagagactaaagcggatcttataagaataatagtaccgaacaaactaccacttccactgtgctaccagaacagcataattttggggaataagtgctcgaatcgttgttgggaaataacaacaggtacgggagccaacaaatattccccattttggaacgacccatgcagcacgaagagaaattcggacaagatagcccca

SEQ ID NO: 28863 - DNA, 490 bp, Zea mays
  unsure at all n locations
  Clone ID: cC-zmle189092d01d1
gaatgactgccgatatgcgctgtaagtcnatgattctactactggagagaatgcgcacaagancagtattttattcattgcctggtccccacccacatcccgcatacgtgctaagatgctgtactccacgtcgaaggaccgcatcaagtacgagcttgacgggttccactacgaaatccaggcgaccgacccatcggaggtggacatcgaggttctccgggagcgggctcactgaagctggttctccttttgaagggacctgtggagggccgtgaaccttcagccagatgcaaattcaattatcaacgatgaagctcccgccgtggtgttgggtaataagttcctgcaagcatatcatttagtcgctatgcatgacactagctgaagcgctatctaagctctataggtatgaggtttgcttgccgcgttgccgagcctgtaaacgaagcaagatttgcaaaacttgttatattgagggatcgatgatact

SEQ ID NO: 28864 - DNA, 519 bp, Zea mays
  Clone ID: cC-zmle189092d02d1
cgcccgcgtcgccacgctccgcatctcgacagactacatatcgatcgatcgtgtcacgccagcagagcaggagcactgtgctccaatccagagccatgtccaagccagcgtcgtcttcgttcctcctcctgctgctgtcggcgacgctgctcgccaccgtctgccgcgccgacccggacccggtgcaggacttctgcgtggccgtggcgccgggcggccacaacaacgcgtcctcctcctccagcacctacccgggcttcccgtgcaagccggcgtcgacggtggtctcggacgacttcttcttcgcggcgcacgcgggcggcgcgagcacggacaacccgatgggcgcgggcgtgacgccgggcaacgtggaggcgttcccggggctcaacacgctgggcctgtccatcaaccgcgtcgacctcgcccccggcggcgtcaacccgctgcacacccacccgcggtccgcccagctcgtgcacgtggaggccggcgagatgctggtcggcttcgtcagca

SEQ ID NO: 28865 - DNA, 460 bp, Zea mays
  unsure at all n locations
  Clone ID: cC-zmle189092d03d1
agaggaagaagacttacatgcttgctctgccctcaccggatggttcgatgcagactgttggtggggagcccttcttggcgtcccttgccgtgccacccccgtcctatgtgcagatggcagatttggagaagaagcaacagctcttgacgcaggagcaaattatgtggcagcagtaccagagagacggcatgcaagggcaatcgagcctgaacaggctcgaccgcgcccccaacccggccatgccctacgggatgcccatggcatacaacacgaaccccatgccaatggcttacaccgggaacactgggtattactaccctacttactgaggaggcctgttctttaatcatccttacagttgctgggaatttttgttctgtgttgtgatcttccccgccctgcggntgtgtccagcatcagctgttgttcccctgtccctggatcaaaccttttggtcttg

SEQ ID NO: 28866 - DNA, 368 bp, Zea mays
  Clone ID: cC-zmle189092d04d1
acgcgagaacaaaaccgggatccaggcaggagaacactcatgtaatgcatgcgctcgaaagcgctcatcggggggagttggggtcagagatctccactaccactccgatgagagggcccctagagaaacctgaaaaagaatggagaggaggacgatcagatgagtatggaggcgcgactcccagccaaagagagacagagctggagcgaaaccacatacaaggaaggccggctatgcaatgggaacagagtcagggaaataaaggcgaagagcacggacgatctctgcagggccaaacgaaccttatagacaaaccccgccaatgaacttggaagagactgacggaacccacagaaataaaggagcac

SEQ ID NO: 28867 - DNA, 563 bp, Zea mays
  unsure at all n locations
  Clone ID: cC-zmle189092d05d1
cgattgggagctctgatttccctaatgctcggactgcgattacttcccctttggctaagtcgctttttgctatggatggagtaaccagggtattctttggatctgattctgtaactgttacaaaatcagaagaaacttcctgggattgcctcanacctgaggtttttgctgcaataatggacttctactcatctgggcaaccactttttctggactcaaatgctgcagcttctatggacacagcaattcacgaggatgattctgaaatagttgccatgataaaagaattattggagactcgtattcgaccagctgttcaagatgacggcggtgacattgaataccgaggattcgacccagaaacaggaacagttaagcttaaaatgcaaggtgcctgcagcggctgtccaagttcgtcagtcacattgaagtctgggatagaaaacatgcttatgcactatgtgcctgaggtgaaaggagtagaacaggagttcgatggtgatgaggaagctgaagtggctggatagatcgagagagtttttacaggttttgagggtcaacac

SEQ ID NO: 28868 - DNA, 348 bp, Zea mays
  Clone ID: cC-zmle189092d07a1
tctctgtcttaaatgactagagttttttttttttgggatggagattcagtaaagatgacacagaaaccccccaaatgtaaaaaatgatcactgtgaaaaggaaatgcatgcgatccgcaggctaacaacaccgaaaagagggaacctttgcgccgccatgggagcaacaacggacacatcacatccaacagacacctgctaggaagcaagggtgccacgggaggggaaaagaacagaaaaacaggaaaagggggaagaatataccaagcaagcaaagggtacacagcgacacgaaccttaagcggaagacggagacaaccgacgggactagctacaaacttacgcacg

SEQ ID NO: 28869 - DNA, 324 bp, Zea mays
  Clone ID: cC-zmle189092d08a1
tttttctcttttttttttttttttttttttttttggggtgtgtttatttttaaatttgagagggggacccccccgacgaaatacttacaacaattagaaagagaaatgaaaatatacacatggaagaaaaaagatgattactgtacgaaattaaaaactagagacatttgcaaaaatcagaggatttgaaaatacaaatcaaaaaaaaaaaaaaatgaaaagaggaagaaaagagaaaaaaaaaaagaaaggagtaggaataatattcccctcaataaatataaaacccccacggaaataaaggggggggaaacacccaacaag

SEQ ID NO: 28870 - DNA, 472 bp, Zea mays
  Clone ID: cC-zmle189092d09a1
aaaaaacaaatggggtgggttaaaaatattcattgatttctcgaccatttgccaaaaaaaaaacaagatcgtgcttgggaaatcaaaggtaaggagcagggtaaacaaaatcaggagaccgaattatatgcatttggcaccacgcacgggaccacaaattagctcactcgctggattggacagtgcctcccgctcctgctgctggctcgtcgaaatcatcgaagctcaagcttagagtttgcagcttgaacccctccctggatagcttccaccaggttcgaggctactccagtagcttgcacagttgtctcctttgttaacacaacgctccctatgccttcttcaatgagcacctccaggtccttgactccctccataccctaaagagattctgtgatcttgggaatggccctctccttcatggtgccctccgccttgaagtaaaggatgagggaatcggaggtgtaggcgg

SEQ ID NO: 28871 - DNA, 559 bp, Zea mays
  unsure at all n locations
  Clone ID: cC-zmle189092d09d1
ccgaactagccggacaagcgaacaaaaggtgtaagagctttttattacgcggccaaatcgagataagagcaagagggcgtcgtcgacggcgttcagccaactgttcccttccgccgctgcggtatcccccgtccctcgctgcgtctccctgcagctcttctgcgccagcggtggagttgtccctggatggaggagaagatgccgccgcatggccatggtgcgcgcggccaccgtggatgctgcggcgcccgcctacacctccgattccctcatcctctacttcaaggcggagggcaccatggaggagagggccattcccaagatcacagaatctcttgagggtatggagggagtcaaggacctggaggtgctcattgaagaaggcatantgagcgttgtgttaacaaaggagacaactgtgcaagctactggagtagcctcgaacctggtggaagctatccagggaggggttcaagctgcaaactctaagctggagcttcgatgatttcgacgagccagcagcaggagcgggaggcactgtccaatccagcgagtgagc

SEQ ID NO: 28872 - DNA, 528 bp, Zea mays
  Clone ID: cC-zmle189092d11a1
tttggttatatgtttgcaggcacggtggccgtacaggtgagttttatggtttattgtgtgtaacatgtacaggagatatatagaatcacgatgacgtatctgttttttttaacaacaaacaatatgccaacacgaacacaccacacgtgtgtgtgttcatggggaaatccagtgacgatgcatgggctcatggcaagccacacacacatggatcaggagacctgcaccccggcgttgaggttgaggttgaggatgcgtgcggtggacctgatctccagggcggggctgatggagagcaggcccaccaagctctccggcggcacccgcatcccgcccacgttgatgcactccagccgccggcacttgttcaccagcgccaccagcccgccctccgtcacgtggcggcagctccacaggatgatgctcttaagatttgcgcagctgtttgcgactgcgtagagggattcatctgtgatgaacgttccaccgatattcaggtgctgcagagaataagccctcaaaccagac

SEQ ID NO: 28873 - DNA, 548 bp, Zea mays
  unsure at all n locations
  Clone ID: cC-zmle189092d11d1
cgcgtggttggagttcacgaagctgctggggctgccgaattcctttgatggcctgatcaagatttcgtccgcggatggcgtcggcaacctgacgtccatatcgctctggggattggccgggatcaccgataagggcgtggtccgtctggtttcgagggcttattctctgcagcacctgaatatcggtggaacgttcatcacagatgaatccctctacgcagtcgcaaacagctgcgcaaatcttaagagcatcatcctgtggagctgccgccacgtgacggagggcgggctggtggcgctggtgaacaagtgccggcggctggagtgcatcaacgtgggcgggatgcgggtgccgccggagagcttggtgggcctgctctccatcagccccgccctggagatcaggtccaccgcacgcatcctcaacctcaagcctaacgccggggtgcaggtctcctgatccatgtgtgtgtggcttgccatgagcccatgcatcgtcactggatttncccatgaacacacacacgtgtggtgtgtgcgtgtggcat

SEQ ID NO: 28874 - DNA, 537 bp, Zea mays
  Clone ID: cC-zmle189092d12a1
atgcttaaatcagagtctacgagataaagggttgaaagcagtctaccgggctgcttcacaagtactaaaatacagcacacaacagtttcatgaagcattgcattgcaaggtctttaagtcctatactagtttagatgtaaatacaactttgtcataaacttcatggcggcagaggaagtccgagcggtaaccatgtagaaatcgctcatgttgatgcttcactatcaagacgaatcctcttggtaccaacctcgtcgctagccggcaccctattctccttcgcttccacagaacatctcttgtatggtttgaagcctgttcggcgcaatttcagcttcaggggcgacagttcattgggaaaggaagcccttggctcaccaattgtgtcgaggtcatgatcaatgcttgtggtactcttgttgaggtcaactgccactgtggtgacttcatcttcctcctccttgccaactttcttcgagccttctgcttgtgggggagaaaaagcttgcggaagcttttctctactgaacagcgcat

SEQ ID NO: 28875 - DNA, 564 bp, Zea mays
  Clone ID: cC-zmle189092d12d1
tttccatgcgctgttcagtagagaaaagctttctcaatgcttttctcccccacaagcagaaggctcggggagacgttgtaaggaggaggaagatgaactcaccacagtggcagttgacctcaacaagagtaccacaagcattgatcatgacctcgacacaattggtgagccaagggcttcctttcccaatgaactgtcgcccctgaagctgaaattgcgccgaacaggcttcaaaccatacaagagatgttctgtggaagcgaaggagaatagggtgccggctagcgacgaggttggtaccaagaggattcgtcttgatagtgaagcatcaacatgagcgatttctacatggttaccgctcggacttcctctgccgccatgaagtttatgacaaagttgtatttacatctaaactagtataggacttaaagaccttgcaatgcaatgcttcatgaaactgttgtgtgctgtattttagtacttgtgaagcagcccggtagactgcttttaaaccttcatctcgtagactctgatttaagcatcagaaaaaaaaaaaaagggcgg

SEQ ID NO: 28876 - DNA, 355 bp, Zea mays
  unsure at all n locations
  Clone ID: cC-zmle189092e01d1
cgtgcgcattgttcatcggcatggcactagtgttgacttcatagaatgaggggcctgcgcatacagccaaggacgctatttatatcgaacccgggagataaccccccgctgatcactagaaacatatatataaaaagactgctagagaacatgaggtggcaacagctagccactcaacatgagagtgaaggagtagcaaactgataacgaccacaggctaactagagatatagtctcagtgcataacctatgctatcaaaacccacaagcaggttgaaaagcgaacgaaacataattgacaaaaccaacattctataaaaaaaaacactggcgccagggcgagggaacaaanacg

SEQ ID NO: 28877 - DNA, 498 bp, Zea mays
  Clone ID: cC-zmle189092e02d1
ttttaggggcaaaaaaactggttatttaggatgccttttgcaaatactgggtgcctgtgagacaacatgcacgagtaattctacatgtctacggcatattgcttcatttagagctgatttggtgacccaggatctcggaagaattggaggggattaagaggaaaattagtttattttccccttaatccctctaatcctcccgtgatccctttatcaccaaatccacccttatggtttagtgaggaggcattttaaagcacggtgatgtccatctattgtatctttagttacatcgctagttgagtactgaagatcactgatcagggtcctagaggaccacgttcaccccgtgaagaatcttcgccaagactgccatggaagaaaaccacctgcggaagaaacatggagagcaaaccattgtcacatttgattctccacaagtatgccatcatggggctcttcttaccacactcttggcatcgaacgtaatagtcgttc

SEQ ID NO: 28878 - DNA, 280 bp, Zea mays
  unsure at all n locations
  Clone ID: cC-zmle189092e03d1
gcgtccgcccacgcgtccgacgaaggcttactgcagtgcctncgtaatagctgccatcaagtacaagtaggcaagggggcaacttagtgtgtcccatgttgtttttcttactcgtccgctgctgtaggctttccggcggcggtcgtttgtgtggttggcatccgtggccatgcctgtgcgtgcgtggccgcgcttgtcgtgtgcgtctgtcgtcgcgttggcgtcgtctcttcgtgctccccgtgtgttgttgtaaaacaagaagatgttttctggtgtc

SEQ ID NO: 28879 - DNA, 545 bp, Zea mays
  Clone ID: cC-zmle189092e04d1
cggcggctcctcgctgattcccagcgcgtcgcactaaatagattcgatcgggttcgccggttcgcgccgggcgcatggcgacttcctcaggaccaaaggaggcgccagcgaataaccctgggctccagaccgaggtcgaccccgccaccaaaggctacttcttgcaacaaacgatgttacgtgtgaaggacccaaaagtgagccttgacttctactcacgtgtgatgggcatgtcgttgctgaaaaggttggattttgaagagatgaaattcagtttgtattttctaggttacgaggatgtgaccttagcccctgatgatcatatcaagcggactgaatggacttttaggcaaaaagctactcttgagctcacccacaactggggcacggaaaatgaccctgaattcaaaggttaccataatgggaactcagaccctcgtggtcttggtcatataggagtaactgtggatgatgtccacaaggcatgtgaacgctttgaacgtcttggggttgagtttgtgaagatacctgatgatggaaaaatc

SEQ ID NO: 28880 - DNA, 407 bp, Zea mays
  unsure at all n locations
  Clone ID: cC-zmle189092e05d1
gagaatgtgctatgatttgtactgctgtgttactgaatccnacacctacagaatgtgctatgatttggactgtataatttttaacgaagatacaaacttctacaaaaaaaaaaaaaaaaaaaaaaaaaaaaaaaaaaaaaaaaaaaaaaaaaaaaaaaaaaaataaaaaaaaaaaaaaaaaaaaaaaaaaaaaaaaaaaaaaaaaaaaaaaaaggggggggccgttaaaaagaaaaaaagtttataaacgggggatggaaaagaaaaaactttttaaaggggtcactaaaattaaataaaagggccgctttttaaaaactcataaaatggaaaaaccgggggggaccaaaatataaacctttaaaaaaaaaccccttttcgacagtggggaaaaaaataaaaaggcc

SEQ ID NO: 28881 - DNA, 330 bp, Zea mays
  Clone ID: cC-zmle189092e06d1
cggccgagaacgagctgtgaaccgaacagcagggtaactgaatgcatcacctacagaatgggctaggatagggactgctggaatttggaaagaagaggcggacgccccaccacaaaaaagaataaagcaagaaagggacaaaaggcaacggctgctgccaaaggaggagaatgaaaggcagcgacggaaaacgggtgaagaagaacaggtgacaaaaaagggggcgtggtgaatggaggaaaaagaccaatggacgcggagagagagagtcacaaggagttacagaagggacactgtgaccagatggacatgggcaccaatatacagcat

SEQ ID NO: 28882 - DNA, 294 bp, Zea mays
  Clone ID: cC-zmle189092e07a1
cccttctttttaatattatttttttttttttttggggggggtatctttaaacaacatttgagcagacaccatgcaaagatgaaggaagtcaagatttaacccttattgcaggtggtggctgctgtaaacacaacctaacgtgaggaacattatcgcttcttatgttgcaatattactacatatatctttgatagaaaattcacatcttatcggtatgcaatcatgccgatttcaaacctaagaactttaacagctgggctcgtatgccgtgtaaacaacatttgaacaccttca

SEQ ID NO: 28883 - DNA, 329 bp, Zea mays
  Clone ID: cC-zmle189092e07d1
cgtccgagaacgaattctggaactatcagtaaaacaacttttagtatatcccaggcaatggccccagttagcggatgtaagagtttttagagaacagggagaagacccccacaaaaaagaataagcatgatgagggccaagactccgactgttgccaaagtatgataactatccgcaacgactgaaaactggtgaatcagaacaagagcgaaaaaaggatgcttgctaaatgggggatagaacacaaccgacgctgatatatagaatacaatcatctatgcatgtgcggtctgaattgacaacatggactccatcatcttcctaaaaag

SEQ ID NO: 28884 - DNA, 303 bp, Zea mays
  Clone ID: cC-zmle189092e08a1
cctcttttttttttttttttttttttttttttggtggtgtttttttaattttttttgaaaaaacgcccatgcaaatgttattgcggccaagggtaaaaccattttgctttccacccgccgggaaacaccaccaaaaggatggggacttgtggttttttttgtgccctaatagaacatactttggtgctggcaaaaatatgccggggcgaaggttgtcggacccgttgccaacccaaaaactttaactgttggccccatattctgttaaaaaattatccgaacagcaaaatttccggggggggg

SEQ ID NO: 28885 - DNA, 504 bp, Zea mays
  Clone ID: cC-zmle189092e08d1
cgtccgggaatgaatatggcaacctatgtgcgtgattatatacgtggtggccagctcgatgggcctagctcaacagatgcgagttccttgagaaaatgaagaaacctgcctctccagggtttgatcctgatgagcatcttgatatcgtgggaatcgcaaatcaaacaacaatgctcaaaggagaaactgaagagattgggaagcttatcgaaaagacgatgatgcataaatatggggttgaaaacgtaaaccaccacttcatggccttcaatactatatgtgaggccactcaggaaagacaagatgctatgtatcatctgctgaaaaagaaagatgaccttattcttgttgttggacgattcaactcaagtaacacctctcatctgcaagatatcggagaactcagtggaattccatcatactggattgacagtgaacaaaggataggaccaggaaacaagatcagctacacgtacatcatggggaactggttgagaaaaataa

SEQ ID NO: 28886 - DNA, 279 bp, Zea mays
  Clone ID: cC-zmle189092e09a1
tttcgtttttattttttttttttttttttttttggtgtttttttttttttttttttttttaaaaaaactttattattgaactttaactcataaaaaatctaaaagagggcccccccaatgatgggttgttggtaaaacactgctgggtttgtcaaaacaagttggttgaatggcaacaattgttgcacttgtaaaagggtgccagcgttaggcccaacgtgctggtaaaacggcaacaactggggttgtgtcaaaaaggtaacagggccggacccgtgg

SEQ ID NO: 28887 - DNA, 204 bp, Zea mays
  Clone ID: cC-zmle189092e09d1
gcggccggccctgctaccttcttgacacaaccacagttgtttccgttctaccagcacgttgcgcctaacgctggcgcccgcttacaactgcaacaattgctgccattcaaccaacttgctttgacaaacccagcagtgttctaccaacaacccatcattggtggtgccctcttttagatttcttatgagttatagttcaataat

SEQ ID NO: 28888 - DNA, 544 bp, Zea mays
  Clone ID: cC-zmle189092e10a1
tctctttttttttttttttggattaagaacgagggggagccggtcactgcactcacttgcacttgcacagcaaacaagcgccacatgtggttcgcgagtgctcatgcaagagctcacactcggcgggaattacgcgaacatgttgcgtccaggtgaactggaaggcatcgatgtgtaggtattcttgatgcaagttgtacatgcaatcaagaaatagcaactgtctagagccaaagccaaggattgaaggtttttcttgacctgcccaacgggccatggctcaggcccgtgcaggggccggggccgggacggcggcttctgctggaggcagtgacaccgagcgcagcagctccagggagctcgccaccccaaggaaatgcgacaggatggtgttcgctgaagcctgaactaggaaaacatctaaagccaagacagggctttggccagcagcctgataatagggtactgcagaggttgtgagagcttttgtaccaaagcaccaacagtagcttgcatgccgagaacagcagcgcccatcccaaga

SEQ ID NO: 28889 - DNA, 531 bp, Zea mays
  unsure at all n locations
  Clone ID: cC-zmle189092e10d1
cggccgcggacgcgtgggcggaagcgttcggcggcacctcactgnggcggtggcggcggccccgccctcgcctggggggtcaccttcgtcgggaccgctctacccgacgcctccacccaccgagcaggaggtggagagggtcaagctcgagcaggttatgaggagactagagaaaacagcaaggtatttcaagaatttgggtaccctggggttctggtcccaattggtgtgcacaattatttctgctggaattttggcattctctacagttgtaacggggaaggtgacatcaccctttacattctatgcaactgctgctggtattgctgctgcttttatttcagtcttctggtcatttggttacatccgtctctctgaaaggcttagaaaaacatccaaagaacctgctaaggctcctccacgtgctgatgttgttaagagccttaaaaatggcatcgtggttaatattcttgggatgggcgctgctgttctcgggatgcaagctactggtggtgctttggtagcaaaagc

SEQ ID NO: 28890 - DNA, 457 bp, Zea mays
  Clone ID: cC-zmle189092e11a1
tctcttttttttttttttttttgcagatcaacggtgtgttagtacaagctagcagcaccgtgcagcagccataatttaagtaggagtgtacaagatcacatggcaaacaaaccatccctgactggtatttcttttttctttttgattataatagcacgatacatgcatgacaccagtgaaacactacatcagcatcagctggtatgaatcctccatccagcaagcatacatgtgttgcacctgtgctgcgacaccagatctcaatcgctgtcgctgctgctgctactgtggccgccgtcgtggtcgtggccctcgccgggcttcttctttttcttggccttcttttccttggggtcgccggacttgtcgccgtgctcgccggtgatcttgtccttgatcttctccacgatgccttccttgtgctccccgccgtccttcttgtggtgctccccctcct

SEQ ID NO: 28891 - DNA, 467 bp, Zea mays
  Clone ID: cC-zmle189092e11d1
gcgtccggctcacatggggggcgaccacaagaataaggagttggtgcaccacaagaaggccgaggagcaccacaggagggaggagggggagcaccacaagaaggacggcggggagcacaaggaaggcatcgtggagaagatcaaggacaagatcaccggcgagcacggcgacaagtccggcgaccacaaggaaaagaaggacaagaaaaagaagaagcacggcgagggccacgaccacgacggcggccacagtagcagcagcagcgacagcgactgagatctggtgtcgcagcacaggtgcaacacatgtatgcttgctggatggaggattcataccagctgatgctgatgtagtgtttcactggtgtcatgcatgtatcgtgctattataatcaaaaagaaaaaagaaataacagtcagggatggtttgtttgccatgtgatcttgtacactcctacttaattatg

SEQ ID NO: 28892 - DNA, 463 bp, Zea mays
  Clone ID: cC-zmle189092e12a1
tctctactcagtaacaggggtaccaatatgatggatgctactgttccatttaagtttcaacctcagacagatctaaatgagatacaatttgagtaaccaacatctgaatgcttgataggttggcggataaagcaaatcggggcaagcaattacgccttctggttgtagacataggtgaggccgcacttgccgcagtagtggcggtcgaagtggttggccatgaagacgcccgcgccgcactctgtgttggggcactccttgcggaggcgggtcaccttgcctgtggcgtcttccaccttatagaactgcagcacggagagcttcaccttcttgtgcttgtgcttgatcttcttgggcttggtgtacgtcttcttcttacgcttcttggcgccaccgcggaggcggagcaccaggtggagggtggactccttctgaatgttgtattcggcgagggtgcgaccgt

SEQ ID NO: 28893 - DNA, 515 bp, Zea mays
  Clone ID: cC-zmle189092e12d1
cgtccgcccgcaccaggcaaaacctacctacccgccgtctttcgtggccccgcatcggcgcccagacgcacaaggggggggagactatgacggagaagaccaacacttcctacggggagtacgaggacaccattgacaacgcgaacgccatgatccagcacaaggagggcatccacccggaccagcagcgggtcatcttcgccgacgagcacatcgaggacggcggcaccctcgacgactacaacattcataaggagtacaccctccacctggtgctccggctccagagcggcgccaagaagcgcatgaagaacacctacaccaaggccaacaagatcaagcacgagctcactaacgtgaatctctccgcgctgcagttctataaggtggacgacgccacatgcaaggcgacccgccttacgaggagtgccgcaacacagaggcggcgcggacgtactagtggtcaccacttgcagcgactctactgctgtacgagcggcctcacctatgtctac

SEQ ID NO: 28894 - DNA, 391 bp, Zea mays
  Clone ID: cC-zmle189092f01d1
caacatgcacgagtaaccccccatgtgtacggcatatcgcttcatttatagctgatttgatgacccaagatctcggaagaattggaggggattaaaaggaaaactattacatttgcccctaaatccctcgaatgattacgcgaaccctgtatcaccaaaggcacccttatggtgaaatgaggaggcattttaaagcacggtgagaggcatctatcgtatatgtaatcacatccttagatgagtactggagagaacggggcggggtcctaaaggaccaccttcaccccgtgaagaatcttcgcacagactgccatggcaaaaaaccatcagctgacgatacatgagaagcaaaccatcgacacattaggttctaaaaggtaagccttatggg

SEQ ID NO: 28895 - DNA, 88 bp, Zea mays
  unsure at all n locations
  Clone ID: cC-zmle189092f02d1
gcgtccggtacctgtccatgcatatatgatatatatatgttngatcgttgtgaaagcaaacaatcttgggtaccagggggtgttattc

SEQ ID NO: 28896 - DNA, 144 bp, Zea mays
  Clone ID: cC-zmle189092f03d1
gagcggaggcacaaaaaacattttgtaaggggcaagcggggccacagaagggggggacgcggcaataaacggaaagagacggagcccccccccaagggggagtaaaaagggaaggcctgggggaccacagctgaaagcacgaga

SEQ ID NO: 28897 - DNA, 536 bp, Zea mays
  Clone ID: cC-zmle189092f04d1
cgcggccgcacagcaatccacacaagcacttcgacgtcacacgggtcgctgcgcacagacacaccaagcgtcggcaccaagggcttactaccaggaggtggactactgctcgcaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcagggagagcttcctcgccagggctaactgagccgcccggcggccggcatccacgcccgttcgtgcttgcctgcgtgccttatgtatgtctgtggttgactggttgtgcagggtcatcgtacttggctatcgtacgtgcacgcactcagctcctgtacgaattacgacaataagctcgtgacctgaataaaacttcttcgtaatac

SEQ ID NO: 28898 - DNA, 592 bp, Zea mays
  unsure at all n locations
  Clone ID: cC-zmle189092f05d1
gcgtccgggaggacagaagacaatcatgtcttactggagaaacttacnttgagcagactaatgggttagtttggttggcggatagttcagacataaggaggcttgatgattgccgtgctgaactccacaacctcttgaaagaagaggtatgctattacggtatcagcagacctctaagcaatggtgatgaacttaatttctataatgatcgaaatggtagaggtcctgtaattgatataaatgaataatgttactggattagtatcaaagcccatttacttaatgatagaggtctcttggttaatgaactggaatagatatttttctctcgatggtatcaagctctatatctttgtgcatagaaattgtaaaccacaaagcaagtacaatgccatttatttggtagtaaagaatgatgtctctttgacactgtaggataaaggtttacctatctaggcagtgttctattgttgatttttgcaaataagcaagacatgcaaggagctctaaaaccaactggaatcgtgaaagtagcgaacttcagtcatttattatatgcattagagacattgtttcctgtctatgacatcat

SEQ ID NO: 28899 - DNA, 534 bp, Zea mays
  unsure at all n locations
  Clone ID: cC-zmle189092f06d1
gcgtccgaattgcgtgaactctttgctgagtatggcaatattacttcctgcaaggttatgcgggattcgaatggggtcggcagaggttctggatttgttgctttcaaatctgctgaagatgctaaccgagctcttacggagatgaatggcaaaatggttggaagcaagcccctttatgtagctcttgcgcagcgtaaagaagacagaaaggcaaagctacaggcacaattttcacaaatgcgtcctgttgcaatggcgccttcagtaggtcctcgcatgcccatgtttccacctggtgtccctggagttggtcagcagctgttctatggtcagccaccaccagccttcatcaaccctcaggctggatttgctttccagcaacctctgatgcctggtatgaggcctggtggtccaatgccgaactntatgatgcctatggttcagcaaggacagcaaccacagcgttctgctggtagacgtgctggtggaatgcagcagnccatgccaatgggtgttcagcaacaggtgttccct

SEQ ID NO: 28900 - DNA, 483 bp, Zea mays
  unsure at all n locations
  Clone ID: cC-zmle189092f07a1
ctcttttagggaatgacagttgtcaactttattggggagaggatctcttatatacaatggatgcaccgtctcccaaggggtgtgtcctttgggagaaaactgtcagataggggttgatcactttgtacacaatattttgtaacaaaatccaaccatggcttgcatgcatgtgtagtagttgtatatgatataattaatacaccttttcttgaatttcaatctttgtaaatcgaaaatgcattaattagccatttgtatttttaagacttatttccagcttattaatttattagaataatttgatgaagttagaatgtgagcgctatagctgcctagattatccgatatctgataatgccatgttgagctcctcgaccttggcaccgacgaccctgcgctgctcctcgccctccttgatcaagaggaacgtcggcagagccttcactctgaacttctctacgacatctntaaacttatcaaagt

SEQ ID NO: 28901 - DNA, 531 bp, Zea mays
  Clone ID: cC-zmle189092f07d1
gcgtgcgcccacgcgtccgcacgcagtgaaagcaaggcagtagtccgtcgtcgttgaccacaaaagtgtttggggggcgccagccagggtggtacagggtttattacatcattaataatattcaagagttagtaaccgctctgacccaagagcatccggtggtgctgatgttctgggcggactggaaccagccaagcaaggccacgtactgggatctggccatcgctaaaaaggatgaggccgtattctgccagctggactttgataagtttaaagatgtcgtagagaagttcagagtgaaggctctgccgacgttcctcctgatcaaggaaggcgaggagcagcgcagggtcgttcgtgccaaagtcgaggagctcaacatggcattatcagatatcggataatctaggcagctatagcgctcacattctaacttcattaaattattctaatacattaataagctggaaataagtcttaaaaatacaaatgggctattaatgcattttcgatttacaaagattgaaattc

SEQ ID NO: 28902 - DNA, 442 bp, Zea mays
  Clone ID: cC-zmle189092f08a1
ctctttttttttttttttttttttgcagctaacacgtcccactttttaaatatatatctgcaaaggcgtggcgtccaaattaatgcaatgaaatcgatccatactatacattacatggtacatacatacacagaaaagaaaaaaaaaaaaacagagaggaacaccccatctggttcacgcacgttacccagaagaaaccaccaacacagacaggagattgctgctacgctcttctttagcctccaatctgcgaggcaaggcgtttgatccgctgcagccgtacgtccctaggagctcacccaccccgggcgcaatcgagaactgactcggtcgccggcagcatgcaaatcataggccgagcgcgccgagcggcgtcttgccctgcccggcctttaagtaaaaggcgagcatggcaagcatggcgatgcgggcgtgcttgatc

SEQ ID NO: 28903 - DNA, 501 bp, Zea mays
  unsure at all n locations
  Clone ID: cC-zmle189092f08d1
cgcgtgcgccttcgggtcgctgctgggcacgcagctgctgtttttttggtgggtggagtcgaagcggngggtgggcgtcgggaacccggactcccaggccgtggagcgggccacgccgtggtcgcgcaccgccgagaacttcgccaacttcaccggcgagcagggctacccgggcggcaagttcttcgacccgctcggcctcgccggcaccgtcaaggacggcgtctacatccccgacgtcgacaagctcgagcggctcaagctggcagagatcaagcacgcccgcatcgccatgcttgccatgctcgccttctacttcgaggccgggcagggcaagacgccgctcggcgcgctcggcctatgatttgcatgctgccggcgaccgagtcagttctcgattgcgcgcggggtgggtgagctcctagggacgtacggctgcagcggatcagacgccttgcctcgcagattggaggctaaagaagagcgtancagcaatctact

SEQ ID NO: 28904 - DNA, 443 bp, Zea mays
  Clone ID: cC-zmle189092f09a1
ctttatatatatatagcatcaaaattatgtaaggaagagtagcactgattattgttacatgacgaaggttgagcatccatggaggctagattatagacagacaccctgattttacatgacgaatcgcaagaagcgcatgcattggatatccttagccggagagggcgctggtgttgtagacgaggagggcgccgccgccgaggatcccagcgagggtgacggcccacatcagaagcccagtggttccaccgacgtagacgtcgccggtgggagaccagtcatcctcgttgtagattgggctgtatccgtcgacgttcgcgccgtacttgtcgacgaactggtacacgcccttgcccttgccctttctcccgttggcgtcgacgtcgacggtcaggccacccccaatcccgtagggcttgtcggtcttgatcttcttcttggag

SEQ ID NO: 28905 - DNA, 549 bp, Zea mays
  Clone ID: cC-zmle189092f09d1
gcgtccgagcgactcagcgagcgagagcagcacacactgctttcatctagctaggagcagcagcagcggcggcggggggggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccctctccggctaaggatatccaatgcatgcgcttcttgcgattcgtcatgtaaaatcagggtgtctgtctataatctagcctccatggatgctcaaccttc

SEQ ID NO: 28906 - DNA, 557 bp, Zea mays
  unsure at all n locations
  Clone ID: cC-zmle189092f10d1
aaaatgtcctacttgtacctccatacaacctttttaaataaacctattttaatttaattaatgactttaaaaactcatttatatctatttcaatacatatatgctattttaaaaccattatctgactcattaatacaactcttaccaatgcaccagacctgcccttcttcattatcactttattgatcatcaatttttgatagcataacatatactcctttcttatcattttatttcacataacttattttttttattttggtggtaaaatatatataaaacatataaatctaaattcttttaaaaactataattatcagtttcttaacccttacattgttattttatgccataatcatttcaatacaatttcaaatataaacttattcatttttnnatttctttaaaacttaatctcagattaatttctcatctattattttattaaatcacattttatatttcactaactttttaaataccttaattttataattttattatcaaaaatatattattaattttttttatttttacttacataattattttatttt

SEQ ID NO: 28907 - DNA, 488 bp, Zea mays
  Clone ID: cC-zmle189092f12a1
ctcttttttttttttttttttttttattgatgggcggcgactttatttgtactagcagttcaatacatgtgtatcataaacatgtgctttggaaactactgagaatccaaagcttcatagttatgctataccacatggaaaacgccatcacactgtagtacaacttgtaatacacaacttggtactacacacatccacacaagtacaacatatgattattagatatgttgttttgatagttggttcccttatagatacctattggtcattaataactgatgatttgattgccctaatatgaatcactcgatcatcatggggggctgatcttactgccttggaacccgtggatctcgtagccacggtggctaccttgggtagtggtcacctttgaggtaaaggctgtagcgcttgacatatcgttgtctgtgccggtttcagagttgctagatgcctgtccagatatactgctaaccggagaattcact

SEQ ID NO: 28908 - DNA, 557 bp, Zea mays
  Clone ID: cC-zmle189092f12d1
gcgtccgcggacgcgtgggcggtagtgcagcagacatgatgttattaacgcttccacgcaaaggtctaaaggaagagatgaagctcgccatcaatggagtgaattctccggttagcagtatatctggacaggcatctagcaactctgaaaccggcacagacaacgatatgtcaagcgctacagcctttacctcaaaggtgaccactacccaaggtagccaccgtggctacgagatccacgggttccaaggcagtaagatcagccccccatgatgatcgagtgattcatattagggcaatcaaatcatcagttattaatgaacaataggtatctataagggaaccaactatcaaaacaacatatctaataatcatatgttgtacttgtgtggatgtgtgtagtaccaagttgtgtattacaagttgtactacagtgtgatggcgttttccatgtggtatagcataactatgaagctttggattctcagtagtttccaaagcacatgtttatgatacacatgtattgaactgctagtacaaataaagtcgatgtctatc

SEQ ID NO: 28909 - DNA, 571 bp, Zea mays
  Clone ID: cC-zmle189092g01d1
gcgtccgggtggcatcacttgcttatgccagaatccaaggtaatacagccctgattgctcatttccagaactctggttggatgaatgaggacaaacgctgccgccccatacttttccactcagatggtcctaatgcaggagatcaggaacctttccccatgggttcaaacatccgagccaggtctgggagatcccggacttcttcgggtgaagaaaatcaccatgacatccagacagtcttgaccaacggtgacacttcttccaatggagctgacaattcaggtcccaccaaggatactgagtagctgaactgcagcttgctgcatcgctaaccacaaaggcccaagttattactttttgcagacctattttcagttctagcccctcccttcccatttcgattttgtttgttaagtcctcccgatctgtatttattaacttgcatgatgcgggtcaccgaagacttacgctgctgcagaagttctgtctctggcgggaagctatatgcaagagggtggtaccggttcgttccccagaatctatgtgctggttaacctgaaggccgacaaag

SEQ ID NO: 28910 - DNA, 579 bp, Zea mays
  unsure at all n locations
  Clone ID: cC-zmle189092g02d1
gcgtgcgcgccggtctcctgctcatcttctcctccttcctgcataacatgcaggaggagccagaagcagcgaggaggancggtacttgccggtgcgcagggtgccgtaccggtccatgacaccggcggcggcgagtgcggtgacgacggcagaggcagcggcagcggcggcatcgtacgagccgttcgaggtgtgcgaggggtgccggtgctgcgcgccgtcgtcgtcgtcgtccaacggcagcagcagctgcgtggacacgagctgctgctacgccatcgactgcgacctccccggcaagcccttcggcacctgcgccttcaccccgcaaacctgcggctgcggcggcgccagcagcaactgcacccagccctcgtcctgatgatgactcctctttgctgcaacttggctacttcttctggatcatccatcgtcttacgttacgttacgacctgatgacagaggatgacatgattagctagcacgcaaattagatgactcacgtgtactcgatcatgatggatagattatccagttaattcccagatagagagttctgcatgaggataatatacaatg

SEQ ID NO: 28911 - DNA, 446 bp, Zea mays
  Clone ID: cC-zmle189092g03d1
aaaatatttggcttccttatgctccttggtcgttccgtcaagtgttgctaccgcaaccattttcgggacggactcacaagctcctatagcttcccttctccccccatacctctcaccagcggtgtcttcaatgtgtgaaaacccaattgttcaaccctacaggatccaacaggcaatcgcaacaggcatcttaccattatcacccttgttcctccaacaaccgtcagccctattacagcagttacctttggtccatttggtggcacaaaacatcagggcacaacaactacaacaacttgtgctagcaaaccttgctgcatactctcagcaacatcgaggttgttgcattcaaccaactggctgcattgaactctgctgcttatttgcaacaacaattaccattcagccagctagttgctgcctaccctcagcaatttctttcattc

SEQ ID NO: 28912 - DNA, 108 bp, Zea mays
  Clone ID: cC-zmle189092g04d1
gacaagctcaggcattttctgttcgagcgatgactagtactggatctatcatgtatgaaacgagcggcggagtaaattctaaaataatattgaaaacacccccagaag

SEQ ID NO: 28913 - DNA, 524 bp, Zea mays
  unsure at all n locations
  Clone ID: cC-zmle189092g06d1
cgtccgcacagacagcatccattccacagtcaccagagctctagtgtagagcaacaaccgacaagagcagagtgggatggtcgtcagcgagcccagcagatacgagagagaggatggcggacatcgcgttgctggtggcggagcagttcgagaagacggcaaggcgaggcgcccccggcggggacagcggcagcagcagcgggagcggcggcgagacaaggaacttcggggccgtggccaaggtgtggagctcgtgggtggagtccgcctccgccgccgcgtccggggtcagattcaccgtcgcggtgcagctggagcccaagaccgggctcgcgctggccgctgccgacggcctcttctccgcctagcttgctgcctgcttccatgtctttctcctgagcagtgccagtgatcgagcgagtcctgctcctgcaccccgtactatgcttgtgcgacctgtacatttcgttcgtcgttgcgcgggtgcgcctgcgctctaatccggaacanaatactattcatat

SEQ ID NO: 28914 - DNA, 495 bp, Zea mays
  Clone ID: cC-zmle189092g07a1
tttggtcggcgcctcggcggatttatatatatggggggtatccatattacatgtatatgatagccggagcttgcattcacatgttcctcaccccaagtatatataggcgttgcagtagttttgtagcaggtatagaggtagccaatgcaaggccatgattgcaacaatggatacatcacatccagcagagaactgctggaaagcaaaggaaccatggccggggaaaagaagaaaaaaaaaggaaaaaaggaaagaagaaaccaagcaagcaaagggtacacggtgacccgaagcaaaaccgaacgacagagacgacgcatggcactagctactagctcacgcaggagctagctagctagctagccggcggggggcggccggcgggcgcggtctagtcgctgcccgggggcttgtaggcgatgaagctgacgcactgcgtctgcttgatgttgtcgaagccgatgacgcggtggaaggcgtccgggtaggatttga

SEQ ID NO: 28915 - DNA, 607 bp, Zea mays
  Clone ID: cC-zmle189092g07d1
gagcaagcaagcaagcagcgagtacatacatactattcatcctggcagccatggcgcccaccgtgatggggggggcgtcggtcaccgccgtcgctccgttccacgggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgatactggaccatgtggaagctgcccatgttcggctgcaacgacgccacccaggtgtacaaggagctgcaggaggccatcaaatcctacccggacgccttccaccgcgtcatcggcttcgcaacatcaagcagacgcagtgcgtcagcttcatcgcctacaagccccccggcagcgactagaccgtgcccgccggcgcccccgccgttagctagtagctagcttct

SEQ ID NO: 28916 - DNA, 416 bp, Zea mays
  Clone ID: cC-zmle189092g08a1
tctcttttttctcgcaaagttgctattgcattgcttggggcgtacgtagtctccaaacattattaacaggagaggatggatcttagatgcaaatagccatgtctaaatttacaccgatgaccgccaccatgtttacattcagatcattaacaggagagggtggatctagagcgagaggccaccggactcctcgtcctcgtcgaggtcagaggtgtagatggtgtagagggaccagatgaggccgaagacccccaggaggatccaccccagcaggttgttgctgagcccgaggctcagcccggtgccctccgtggacatgcgctcgtccacgagcgccagcgcgggccccgccgacgcggtcaccgcgcccgctgcggcgagcagcgacgcgcctgcgcccttggtgctgactgggg

SEQ ID NO: 28917 - DNA, 533 bp, Zea mays
  Clone ID: cC-zmle189092g08d1
cgcgtccggagcaaaggcagcacactcagttattcagcaaaagagatcgagacgcaggagtcatggccgccgtcagcgccgccgtggtgaccaccatccttgcccgcgccgcgatcgccaggcccaatgctctagggctgcctgcgctgagggcgaggagcgagagggtgcggtgcagctacgccaaggacgcggccccagtcagcaccaagggcgcaggcgcgtcgctgctcgccgcagcgggcgcggtgaccgcgtcggcggggcccgcgctggcgctcgtggacgagcgcatgtccacggagggcaccgggctgagcctcgggctcagcaacaacctgctggggtggatcctcctgggggtcttcggcctcatctggtccctctacaccatctacacctctgacctcgacgaggacgaggagtccggtggcctctcgctctagatccaccctctcctgttaatgatctgaatgtaaacatggtggcggtcatcggtgtaaacttagacatggctatttgcatctaagatc

SEQ ID NO: 28918 - DNA, 469 bp, Zea mays
  unsure at all n locations
  Clone ID: cC-zmle189092g09a1
tctcttttttttttttttttttttttttttttggttgtttttattacgaaaaagttttattcaggccacgagcttattggcgtaattcgtacaggagctgagtgcgtgcacgtacgatagccaagtacgatgaccctgcacaaccagtcaaccacagacatacataaggcacgcaggcaagcaccaacgggcgtggatgccggccgccgggcggctcaattagccctggggaggaagctttccctgcgctcggggacctcgccggggcaggggttgatgtcctcttcgaccctggtctcgcgcaccacgaaaccggggccgccggggtgaccatggggggggggggggttggcgccggcccctgaaaccgtgtcnacctccttgaacttttccttgacgacgtgctggtggaccccgccgccgtggcggccgaagccgggcggggccaccgacctaaccttcttcgagc

SEQ ID NO: 28919 - DNA, 427 bp, Zea mays
  Clone ID: cC-zmle189092g09d1
cgtccggctcggaggaggtgaggtcggtggccccggccggaatgagtcccacggcggcggcgtccagcagcagggggcattgagaagttcgaggaggtcgacacggcctcacgcgccggcgccaaccaccaccaccaccatggtcaccacggcggccacggcttcgtggtgcgcgagaccagggtcgaagaggacatcaacacctgcaccggcgaggtccacgagcgcagggagagcttcctcgccagggctaactgagccgcccggcggccggcatccacgcccgttcgtgcttgcctgcgtgccttatgtatgtctgtggttgactggttgtgcagggtcatcgtacttggctatcgtacgtgcacgcactcagctcctgtacgaattacgacaataagctcgtgacctgaataaaacttcttcg

SEQ ID NO: 28920 - DNA, 239 bp, Zea mays
  unsure at all n locations
  Clone ID: cC-zmle189092g10a1
aagaaaaaaaaaaaggaacaaaacaacacaacaaacatttaatanatcacaacgaaacacaacacaaaaaacaaaacaaggcgggagacataaaaaaagnaaaaacgaaaccccccccaagaaaaaaaaaaaaacaaaaaaaaaacacaacaaaagacaaaacaaacaagcacaaaaaaaaaagacaaaaaaaccaaaaaacacaccaaacacaaacaaaaaaaaaaacacaacaacac

SEQ ID NO: 28921 - DNA, 248 bp, Zea mays
  Clone ID: cC-zmle189092g11d1
tttttaggtatggacgctggcacacccaaacaatggccccaaaaggccataattactccattttgatcgacacaagcttattagggtgatgcagctgcatcagcggtgcagactgaatcaaggtgaattcatctaccggatcgtcaagcaggttactcagtttttaggatcacggtcataggcagcatatgctacgtgctggacggccgcatccttgcacgggtcaagactggccacaatccttaatc

SEQ ID NO: 28922 - DNA, 467 bp, Zea mays
  Clone ID: cC-zmle189092g12a1
tttcaaccaacattatgaaatgtcattcatgacgcaggttcagatgacacggtttagaactctaccaggctaccactgcccataggctaaaatgctcctatagttcttacaatgaattgaacaaacattccatctacatttcacacaaatagcactgcaagtgagccagaactttgcgcctgatactgcgagctgctgcgcaagacttaactagatcaaagcgtacagaagcacctagtaactggtgcagagcacttgaacagcaaacaaattagctttttttttaatctaagagactaaagcaaatcttataagaataatagtaccgaacaaactaccacttccactgtgctaccagaacagcataattttggggaataagtgctcgaatcgttgttgggaaatatcaacaggtacggtagccaacaaatattccccattttgaagcgacccatgcagcacgagga

SEQ ID NO: 28923 - DNA, 541 bp, Zea mays
  Clone ID: cC-zmle189092g12d1
gcgtccgcggacgcgtgggcccgtcgacgcgcacgcgcagagctccgcatccgcaccggccaccgcccgcccggcggcgggggccgtcggcggcgtggatggggaagctctccgccctgaagcgggaagcggtcggggtggactaggcgctcggtgacttcctagtttagaagcggtaggtggaggcgatgcggggcggggcgatgaaggccctgcggcgatccagcacctcctcggcgccatcgccaagggtgccgtcttccccgcggtcttattcgtggatccaccgccggtcgcttctcgttacctcgccggcctcgccggcgacgtcctctgtgtctgaatcggcgaatttgcccgcggagggttcggattcagcgccagcgtcagtggtggcagcttcctcgtcgccctcgctggctgcttcgtctccgaacatggaatggtggggctatcctgtccggacttctcctcgtgctgcatgggtcgcttcacaatggggaatatttgttggctaccgtaccctgtgatatttccaaca

SEQ ID NO: 28924 - DNA, 396 bp, Zea mays
  unsure at all n locations
  Clone ID: cC-zmle189092h01d1
gcgtccgcaaagttccagaagaacatcacaaagaggggtttngtgcctgagaccacggtgaaaaagagcaatgacggccgtgttggacctatagttcttggattcttcactttttgtggtcattggatcatccttgttccagataatcaggacagcgacaagcggtgggctggcctgaattcactgagctaaaaccagaaatttatctgtccgtgagctgggaggcagtatctgtgttgtgtagcaaacttgttcatggatatgtagtgcgaatgtcactactgttctgtttgcagtatcaaaagagtttaaactgatgttgtaaccatgcaaaggctgaaaattttaaagagtatgggagaaaccttaatctaaagaagagtggctctgtaaaaa

SEQ ID NO: 28925 - DNA, 657 bp, Zea mays
  Clone ID: cC-zmle189092h02d1
cttttgtgaggaatggtataaagcttttggcagttggatctactgcttctttgattggcactagggtgaggaatgcttcgctcaaagcaaacgagggctcgccgataaggaccttgaggacgaagtcatggaaattccagtcgtctcaactagtgttgcctatggtgtatacatgtccatttctagtaacctcaggtatcagcttctggctggtgtgatcgagcagaggatgctggagccgttgctgcataaccagaagctactgctgagtgcaatgtgcttcatcgttcgtacgggcaacacattccttggctctttgctgtgggttgactatgccagatggataggcgttcagaagtctcacgaagaggcctaaagttctagcagcttgcctgcatgttccgctgtcactgcctcactaggcacgttcacaataccatcgatggcttgcctgcctctatagaatgctgatctactcttcactggaggcccccttatatataggacaaaaatcccaattttgtttggaaaccacagtagggatatatctgtcgattctcgtatgcaacggaaacccgtttaccctcaactttttttcctttattactttgacatgcacagggctgtcatgtcaaattaaattatgtacatgggaat

SEQ ID NO: 28926 - DNA, 566 bp, Zea mays
  unsure at all n locations
  Clone ID: cC-zmle189092h04d1
ggagggacttatcgctccctgcaagtgcaaggggactncctgnacgtgcaccgcgactgcctcgaccactgggtggcggtaaaggagggatttgcattttctcattgtactacctgcaaggctccatattacttgagggttcattcgcacactgacaggaaatggcgaacactgaagtttcgtttctttgttactagagatatattattcatctttgctctagtccagattatcatctctgcattggcatatttggtacattttattgatgggtgccaacaatattggttgaggacagcctgggcttttgataatgaagttagtttttattatatctgcggtgcattaatgttttttgctttgttgggactatcgggatgcttcataacctgttatgaccgaagagtacggaacgacctgnctcagccttgtcgagaattatgtctttgttgctgtcagccagggatgtgtgcggattgccacctacctggcacgctgtgcatgtggactgactgcactacctgcttcgaaggctgtgctaccaccaccggcgagtgcggtggttg

SEQ ID NO: 28927 - DNA, 478 bp, Zea mays
  Clone ID: cC-zmle189092h05d1
cgtacggtccatgtcgcggggccagaagcctacgcgcagtcgtgagagaccatcccgccacggcagcaagcgagggtggcctagccagccaaaccggggccagcccacgccgccagggggacgggacgggaaggaaaccgaggcaagcggcggcagcggcagcggcagcggtagcagcagcgcagggcgcacgcgcttctcgtttcgtgtcgccaggggaaggaggaggagcgagtgggttgggggatcggctggcggccgagggtccgggagctgcgggcggcatggggagggacgagatgctacggcgtagcctcgtggcgctggcggcggccgtggcgctcacggggctggccacggcgtcgctgcgcaaggcggcggtcacgtacggcttcggcatcctcgccatcgccggcgtcctgctcccggactgggagttcttcgaccgcgactactcccagtggctaacccccatgcc

SEQ ID NO: 28928 - DNA, 495 bp, Zea mays
  Clone ID: cC-zmle189092h06d1
cggccggtctcacctagatgtaagttgttcatcattttgctcgtagattcctgtacctctcagtgattgtcgaattgtacgcctgaccgtcatagcgatggattcctacgcatctcctctcttaccgcagggttccaggtctgccactcgctgggaggaggtactggttcaggaatgggcaccctgctcatctctaagatcagggaggagtacccgcatcggatgatgttaacattctctgttttcccgtcgcccaaggtgtctgatactgtagtggagccctacaacgcaacgctctctgttcaccagctcgttgagaacgcagacgagtgcatggtgctcgacaacgaggctctctatgacatctgcttccgcacgctcaagctttccacaccaacctttggtgatctcaaccacctcatctctgcaacaatgagtggtgttacatgctgccttcgtttccctggtcagctgaattctgaccttcggaacttg

SEQ ID NO: 28929 - DNA, 440 bp, Zea mays
  Clone ID: cC-zmle189092h07a1
tctctttttttttttttttttttttttgatgcgtcgggatcaaagtaaaaaaaaattaacagttccaagttacatcccaatccatccatgtgcagaggaattgcatgtatccacgatgctcgtcactgctgaaatggcatacctttgcacgcaaagaggaggatcggaggcggagctatattatatatatgcatctttatgaatttgtattctacttgaagtagtaggggaggtcgagcacgtagaggaggaagtatgcccagagcacgccggagataccaccgaagaagaaccctccggtgaacttggcccagccgtcggcggtctgcagcttgtcggcctccttcttccggccggtgagcgtgagcgtgggccccgtggacgggtcgccctcgttgaaggaggcgacgccgtacatggtgaggcagacgctgaggatg

SEQ ID NO: 28930 - DNA, 463 bp, Zea mays
  Clone ID: cC-zmle189092h07d1
gcgtccgcccacgcgtccgatcttgcagcaggcggagccgttcgatccgatccgtgcgtgtgtgttggtagagagggcggcagcagcttacgctcccatggcgagccaggtgatgaagagcagcccggtgcactcgaggccgaggggcctgtcaggcgctgcgctcacgcggccccggccccggttcagcgtcgtcaaggccgccatccagcccgagaaggcaacgtaccaggtggtgcagcccatcaacggcgacccgttcatcggcagcctggagacgcccgtcacctccagcccgctcatcgcgtggtacctctccaacctgccggcctaccgcaccgccgtgagcccgctgctgcggggcgtcgaggtcggcctcgcccacggctacctcctcgtcgggcccttcgcgctcaccggcccgctccgcaacacgcccgtgcacggccaggcgggcgcgctc

SEQ ID NO: 28931 - DNA, 405 bp, Zea mays
  Clone ID: cC-zmle189092h08a1
tctcttttttttttttttttttttttttttggggttgttttttattataaaaattcttagtttccccccgtttttttccatttttttcatgggggaggaaaacgcaaaaaaccagggggcccggaaatgattaaatggcccccccaaacagagaaaaaccccgctgatcggacgcggggtgttataaaaaagccccccgaggaatttgatttttcccggggggggttgaacaaaaaaaaaaaattaagggtgcaaaaagggggggcccccccaaatataacacccgagaaaaaaaaggggggggggggaaaccgggggggttcaaaccggggccggggggcgggaaacatgggccggggagaaacagccaggaggccggcgaaaacacccccggggttaaggacg

SEQ ID NO: 28932 - DNA, 538 bp, Zea mays
  Clone ID: cC-zmle189092h08d1
cggacgaacacttccatcttcccgagctcgcattcgatctacctccatttcaaataataatataacaacaatgggggtgcccgtcatcgacttctccaagctggacggccctgagagggccgaaaccctggcgcacatcgccaatggctgcgaggagtggggattcttccagctcgtgaaccacggcatcccgctggagctgctcgagcgcgtcaagaaggtgtgctccgactgctaccgcctccgggaggccgggttcaaggcgtcggagccggtgcgcacgctggaggcgctcgtcgacgcggaacggcgcggcgaggttgtggcgccggtggacgacctggactgggaggacatcttctacatccacgacggatgccagtggccgtccgacccgccggcgttcaaggagaccatgcgcgagtaccgcgccgagctgaggaagctcgccgagcgcgttatggaggccatggacgagaaccttggcctcgccaggggcaccatcaaaggcgccttctccagcggcggacggcacgag

SEQ ID NO: 28933 - DNA, 475 bp, Zea mays
  Clone ID: cC-zmle189092h09a1
tcttttaggtattagtattacgaagaagttttattggggtcacgagcttattgtcgtaattcgtacaggagctgagtgcgtgcacgtacgatagccaagtacgatgaccctgcacaaccagtcaaccacagacatacataaggcacgcaggcaagcacgaacgggcgtggatgccggccgccgggcggctcagttagccctggcgaggaagctctccctgcgctcgtggacctcgccggtgcaggtgttgatgtcctcttcgaccctggtctcgcgcaccacgaagccgtggccgccgtggtgaccatggtggtggtggtggttggcgccggcgcgtgagaccgtgtcgacctcctcgaacttctccttgacgacgtgctgctggacgccgccgccgtggcggccgaagccggccggggccaccgacctcaccttctccgagcagtagtccaccttctggtagtaagccattggt

SEQ ID NO: 28934 - DNA, 547 bp, Zea mays
  Clone ID: cC-zmle189092h09d1
cgcgtccgcggacgcgtgggcggacgcgtgggcgacgtcactctggtgctgcgcacagacacaccaagcgtcggcacgcaggggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcagggagagcttcctcgccagggctaactgagccgcccggcggccggcatccacgcccgttcgtgcttgcctgcgtgccttatgtatgtctgtggttgactggctgtgcagggtcatcgtacttggctatcgtacgtgcacgcactcagcttctgtacgaattacgacaataagctcgtgacctgaataaaacttcttcgtaatactaatacctaa

SEQ ID NO: 28935 - DNA, 374 bp, Zea mays
  Clone ID: cC-zmle189092h10a1
tctcttttgttttttttttattaataattttgggtcgtgttactagtctattgtgggaggccccacaggagcggagccgcggcacgcaccaaagccaagaacgatgaccctgcgcaaacagccaaccaccagacatacagtaaggcacccaacgtaagcaaaaaaagggcgagaaagccggccggcgggaaaatgacatagccctggcgaggaagaaataactgcgcccggggacataaacagaacaggcggggatgaccaataaaagcctgaactcgcgcaccacgaagcacggcgccaccgcggagaccaagggggtgaacccggccggccccttcgagtgagaaaacggccaaccccccgaaaaaaaccaa

SEQ ID NO: 28936 - DNA, 355 bp, Zea mays
  Clone ID: cC-zmle189092h10d1
cgtccgccccgcgtccgcccacgcgtccgcggacgcgttttaatataaaaaaaaaaaaaaaaaaaaaaaaaaaagaaaaagaaaaatacaaaaaaaaaaaagaccccacccggcaggcgacgtagatgacccaggccggctctcgccggcagggcaaggaaaatccatcactgcaccgacatgtaaaaccaagaggcggccaaaacctttgcactccccaactgaaaaaccaccgccaatatcgaccttaaggcgcttgcagcacttcccaacatcccaccatggatcaatatgacatagaccccaacaccttccatgtccaaaaacactcgcacaccaaaggggcacgggcccc

SEQ ID NO: 28937 - DNA, 287 bp, Zea mays
  Clone ID: cC-zmle189092h11a1
cacaatactggcttgggggcctggtaatgttcacaggagtcataatgcaaacggcctccaaaattgaacgaaacaaaataaaattagagtgacccaggactttggatctgcagtaacgcagggacaggactaacaacaaactcttttttctcttttgcactcaacttcagctcacgtctgagtatgacgctttacaccgggcacgctggtacttcaagtgttgtacctgcctggatctggccccatccgatcccacgcgtccgcccacgcgtccgcccacgcgtccg

SEQ ID NO: 28938 - DNA, 292 bp, Zea mays
  unsure at all n locations
  Clone ID: cC-zmle189092h11d1
cgtccgcggacgcgtgggcggacgcgtgggcggacgcgtgtgnatggatggggccagatccaggcaggtacaaggctggaagtaccagcgtgcccggtgtaaagcgtcatactcagacgtgagctgaagttgagtgcaaaagagaaaaaagagtttgttgttagtcctgtccctgcgttactgcagatccaaagtcctgggtcactctaattttattttgtttcgttcaattttggaggccgtttgcattatgactcctgtgaacattaccaggtcggaagccagtattgtg

SEQ ID NO: 28939 - DNA, 349 bp, Zea mays
  Clone ID: cC-zmle189092h12a1
tttctcttttttttttttttttttttttttttgttttgtttttttttggaatttttccatgcccccccattagccatgcaataaaaacaaaagggggttaaaaaaggaaaggaacggatcggaaaaaagtagggcccatggatgaataagacccttcaaagcattgtaatttgtaaaacctgggatttgaagactgttaatcaaggatttctttcaagcatatgctcattacaaaatcctactcgagacgaaaacgtttaggggagggcgagccactttcaagtgtgaaccataaccttgcttgggggggtgtactaactttataggtgaacgaactttttcaaaatcc

SEQ ID NO: 28940 - DNA, 483 bp, Zea mays
  Clone ID: cC-zmle189093a03d1
gcccggggaggggaaaaccaatggatgaagttttgacaatcaagaacatttatatcgcgaagcacttgtcccttccaccagtagggctccattgcagcatgcttgccgaggatgcgattaaagctgctgtaaaagactacgaagccaagaagtcgaagatggggcagaagggtgaagacagcccttcagagaaggctgctgaagcatgaaaggttctgccgtgaagtatattgtgctgatacgtttctcagtccatgactatccgccgcatattgccaaagataaatgattctgtttgtgaggcgagggattgtgtgtaatgttcacgaagtgtggtagtgcggcatgtggctcaactgttttaaggatggtgacgactgatttcaaataaatttgctgtcatcgtagaattagaagaaagtactatgtggatttacaggagctgtttctggaatttgtgatatcatggtactttctttttgc

SEQ ID NO: 28941 - DNA, 389 bp, Zea mays
  Clone ID: cC-zmle189093a04a1
aaaaaaaaaacacatccctcttaccaaaaaaattacaaaaaaaaaaaattttttttttagtaaaacatcacaaaacttaaaaaattcctttcacaaaaaagactaccacaaaaatttaacaaaaaaacccctaaaaactaaaaaaaaaaaaaaaactccaaactttttttttttaaaaaaaaaaaaaaaatttataaagggatattaaaaattccctttaccaaaaaaccttttatgctacaccaccccccaatgattttcccccctcacccttaaaaaacattttccccttttaaaaaaaaaaaacttttaaaaaactaaaaacccattttttaaaagcaaaaatgcacccacccttacccccataatttaaaaaacctttttaaccc

SEQ ID NO: 28942 - DNA, 524 bp, Zea mays
  unsure at all n locations
  Clone ID: cC-zmle189093a04d1
ccggggacgcgtgggcggacgcgtgggtgcctggtgaccgtatcatgtgttttgttcagctcatccagcctgttgctggtgggcatggtatgaggtttgctatccgtgagggtggtaagactgttggtgctggtgtcatcaacaaaatcattgagtaaactggatatatcacatccaccacgagaattttccttgtttactcaaagcgaaatgctctgtagttgttattatgtgttgagttttaggggttgttcatgtgaaattgtagtatgacactctttcgccaagtgaatttgcataatttatgacattcacgacaaagatacacttatctggttgcaactgatttggctaagaggtaccatctactgttnaaaaaaataaaaaaaatctgctcgcttcgtacaattaaaataaagttctatgtggatatacaggagctgggggggggcttttttaaagaatcaaacttttctttctgcgggtgggaagaaaataatttttttatgggggccccgaaataa

SEQ ID NO: 28943 - DNA, 206 bp, Zea mays
  Clone ID: cC-zmle189093a05a1
aacaccaaaattatccaaaaaaaaataccccttattatttttacattaccaaaggtttaacatccatggaggctaaattataaacaaacccccttattttacataacaaatcccaaaaaacccctccctttgatatccctaacccgaaaaggccctttttttttaaacaaaaaaggcccccccccccaaaatcccccgaccccttg

SEQ ID NO: 28944 - DNA, 197 bp, Zea mays
  Clone ID: cC-zmle189093a05d1
cggggatcctcggcggcggcgccctcctcgtctacaacaccagcgtcctttccggctaaggatatccaatgcatgcggctggtgcgattcgtcatgtaaaatcagggtgtctgtctataatctagcctccatggatgctcaaccttcgtcatgtaacaataatcagtgctactcttcattacataattttgatgctt

SEQ ID NO: 28945 - DNA, 482 bp, Zea mays
  Clone ID: cC-zmle189093a06a1
tttttaaattaattcgttctttcggcctccactctggcggactgagtacatacgtatacagcttctcgcaactaaaaatacagcaaaatttgagcaaaatacagcatttccaccgcgaactttcgacctccgtatacttcgttcgttgtaaactttacaatgaacctcccatctgcaccttctatggctcaggtgcatcagcattcagcagcatgttctactctcaaagaacttgtgcagaacgaagggaagacacaacactgcctgtacatccacgccatctggcccttgagggtttagatctttcaagtacgcggcttcccatacagacctgcgtacacgaccttcgtccgatagaccaggatcaagctcaagccgaacgcgacgacgcataacccggccatgatcagggacgagaggaagaaacagatggcgccctcgcacttcagcgccggagctgctttagagactacgctcaccac

SEQ ID NO: 28946 - DNA, 604 bp, Zea mays
  Clone ID: cC-zmle189093a06d1
cgcgggtgagtgataatcttgggcaaatgagccagtcgttgggttacttgtataactcacatctttgtgtcaatgattgggggtggaactttcttggacgcatcggtggagggtacttctcagagatcattgtcaaagactatgcgtacccaagggctatcgcgctaggaatagcccaaatcctgatagcgatcgggcacttcaacttcgccatggcgtggcccgggacaatgtacgtcggcacgctgctcgtgggggtaggctacggcgcgcactgggccatcgtgccagccgcggcctctgagctgttcggggtgaagaacttcggggcgttgtacaacttcctcacggtcgcgaacccggccggctcgctggtgttctcgggggtcatcgccagcggcatctacgacgccgaagcagcgaagcaggcccagcagcgccacagcacctctaagctgctggcgacaagtgggagagtggtgagcgtaatctctgaagcagctccggcgctgaagtgcgagggcgccatctgtttcttcctctcgtccctgatcatggccgggttctgcgttcgcgcgttcggcttgagcttgatcctggtcta

SEQ ID NO: 28947 - DNA, 512 bp, Zea mays
  Clone ID: cC-zmle189093a07a1
ttttggatttgaattgatcggagtacgtgcttaaccatggtcagggcacacttatctctcggaggggcggcggtatcccgggtgatggccgggcgattaattaataagctgtagttcttgacgaacattccctccttggcctcggcggcctcgccgtcggaggtgtacttgccgagctgcgccagggagttggccttggcgcgcagcagcagcgcgtcctgcgccgccttgaccttgtccggctggccgccccaggtcttgaggcaggtgttctgcagcgcccgcgcgtaggagaaggacacgtgccacgggttgggcccctggttatggcgttgaggttctgcgtcgcctccaccttcgactgcccgccggagaggaacatgatcccgggcacggagggtgggatccggcggtggaggagcttgagggtgtacgcggccacctgctccggggtggccctgtccttggcctccgcgccgggcgtcaccatggacggctttagcaggatgccc

SEQ ID NO: 28948 - DNA, 534 bp, Zea mays
  Clone ID: cC-zmle189093a07d1
ggacagcaacaagagatcgatggcctctgccaccgtgctcaagttttttttccttcccaagaagtccgaatggggcgcgggcaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtccatcgggctggagaacacggaggccaaccggcaggcgtaccgcacgctgctggtcacggcgccgggcctgggccagtacatctccggcgccatcctcttcgaggagacgctgtaccagtccgccgtcgacggccgcaagatcgtggacatcctggcggagcagggcatcgtgccggggatcaaggtggacaagggccttgtcccgctcgccggctccaacaacgagtcgtggtgccagggcctggacggcctggcgtcccgcgaggccgcctactaccagcagggcgcgcg

SEQ ID NO: 28949 - DNA, 545 bp, Zea mays
  unsure at all n locations
  Clone ID: cC-zmle189093a08a1
ttttggatttgcttaatcaacttctgttttagctaaaaagcgagggattgcaaagtctggtggcaaaatagcctgcacagtattgactacacaggctacgcggtctcaccaaatctgaaaaatgatgattgaacctttgactctacaaaaaaaaatgcagaacaatctcaaatcctatcaaccaatcacctactgtatctttgaaccctatgtatgtttcgctatcaacccccgttgctatgttcccaacttattacaatttcattcaagcgaaaaaaacggtgaaagattgctgagcctcgtggcgtcgtcttctctgattccgccgagaaagcgagctgcttttccttgctcccgccgtcagagttcaattgaaggcgaacctggggccggcggcggcgctgctactgctgctgcggtgangaagttgtgggcgatgttgtcgcgcgcggcgacggccgccgtggagcgccggtgttctcggccaccattcgtcgtcaagagctgaacgcgatgtcgggtcacggcgtttccgcgcgctccaa

SEQ ID NO: 28950 - DNA, 558 bp, Zea mays
  unsure at all n locations
  Clone ID: cC-zmle189093a08d1
gcgcggggccgccatcaaggccgtgctcatgcccaaggccgtgcagtgtgtcttaggcgcccgacgccgccgcggccgagggcggcaggttcgaggccgcgtcggggatcccgggcgtcgtgggcgccatgtacaccacgcacatccccatcatcgcgcccaaggccaacgtcgccgcctactacaaccgccgccacacggagcgcaaccagaagacgtcctactccatcacggtgcagggcgtcgtggacgcgggcggtgccttcacggacgtctgcatcggctggccgggctccatgtccgacgccgacgtgctcgaccgctccgcgctctacctgcagcgaggcgccgcgggcctgctgcangggcagcgcctggtgggcggcgccgggtacccgctcatggactggctgctggtgccctacacgcaccacaacatgacgtgggcgcagcacgtgttcaacgagcgggtggacggcgtgcgcgccgtggccagggacgccttccagcgcctcaagtnccgctggggctgtctccagaagcgcaccgaggtgaagc

SEQ ID NO: 28951 - DNA, 419 bp, Zea mays
  Clone ID: cC-zmle189093a09a1
ctgggatcctctacatcggacgccctttccttttttttttgctttatcttattaatatgcatattattaccacctgaatagttttattaaaacatacctctcactatcaaatatccacaaaataattcaccactcttccacatataaaataacatatacaccccacccaaatataaccaaagcccaccacatcatatacacgtacatatacatatatatataaatatatacatataccctattacccttcatcttatcaatttccaccttcccgcttcgacatcacattcttttcccaccgattccttactacctctggcaattaacataatacgtcctaacctgtaaaccaacgtttccaaactcaccaaattcaccttttctaaaattaatccaacaacccaatccttacacccctt

SEQ ID NO: 28952 - DNA, 501 bp, Zea mays
  Clone ID: cC-zmle189093a10a1
aaggcatgatcgattattctgttgtgcgagggacagatcccaacgctacaggggaaatgaaacaagagctacacatccacttgatctacaaaaattcgacgaaatagcatgtagacgaatcatccatacatctaccacacgatttcctcaaggcagagctccacaacaccgctcattggtactgctaatccaaccgagctaaactactggacgacaggcgggcaggcttcacatgtaaaaaatcttagcctgcactctgctaccatgggaagctacaacctgtacacaccaagaaccgcggaactatacagaacggaagcatctaatcatcctcatgataacctcatatgcatttcatcttcctgacgagaccagcctgacctctcctcggaccccagcctgaccaaaggctttggagccgcaggaagctttgcaggctcgggagcaacgacctccccaggagcatctcccctgggatcagttctggttcctgcttcgcgt

SEQ ID NO: 28953 - DNA, 284 bp, Zea mays
  Clone ID: cC-zmle189093a12a1
aatgcattgattcatcactggttggatcgtatattacaaaccaccaagtcccatccgtagctctcctaattaacgacatctccattaaacaaaagatcgatcttgccatcctatctctcccactcatcacaaaacgagaccacgcacgacgggttgatccatccccatgctcatagagatcgtatttaattaatccaataacacatttcggccggtccatctgacacacccatgcaatggcatacttaacaggacccttctaacttatccaatataccttcctc

SEQ ID NO: 28954 - DNA, 553 bp, Zea mays
  Clone ID: cC-zmle189093b02d1
gggaggagcccaaggcggagccggcggcggaggccacctcccgtatttcgccgtggaggagaagaaggaggagggcgggccagctgcagcgacggaggcggcaccggcgccggcagagacaccgtcggaggcggcggtggtagaggagaagaaggaagaagagaagaaggaagaggaggataagccggctgccgaagaggcggcgccgccagcagaagcagcagctgctgctgaggagaagtgatcctgttgacggatcgagcatgcaaagctctccctcctcgctcccttgcttgcttgcttgcttgctgctggtaaattaaattaagttgccgtgatacttaagcgtggccgcacggagtgaaaagttattaagtaaaagcagacaaacacttggcatgcatggacattaatttgttattctttgtaccgtcgccgtctcgatgaaccgcgtgtacatttgtagtgtggggttttctttgttttcgatttgggggtggtcattacaagaatgtgtaattatttatgttcatatgtattgtttgttgatgat

SEQ ID NO: 28955 - DNA, 554 bp, Zea mays
  Clone ID: cC-zmle189093b03d1
gaacatcagcttcactgtctgggatgtcgggggccaggacattattaggccactgtggaggcattacttccagggggcgcagggtctcatctttgttgtggacagcaatgatagggaccgtgttgttgaagcaagggatgagctccaccgaatgctgaatgaggatgagttacgtgatgctgtgttgcttgtttttgctaacaagcaagatcttccaaatgctatgaatgccgctgagatcactgataagcttggactgcattcacttcgccaacgtcattggtacattcaaagcacttgtgctacaacgggtgagggattgtatgaaggcctggactggctgtccagcaacattgcaaccaagtcctaaattgtcaagcgaggtttggatcatctaggagcttttggatgatgatgatgatgatggtgctggatatttagggttgggttggtatttccgtatgtaagatgtatgcccctgagctcggcagtttttgagctctgcttaagattttaacagttaaattgttttatgtaaatttgggccttgagat

SEQ ID NO: 28956 - DNA, 387 bp, Zea mays
  Clone ID: cC-zmle189093b04a1
atcctatacatctagacgccctttccttttttttttttgtttttttttaacaattccatatcatacaataacgtggtgagacagttcccttccactgggcacaggcgcaaagctgataatttgttattatctccttgcaaagttcaacatcaggcctgcacatttcgcagccaacacaacagtttatctgactgctagttcatcaggtttagactagtaaccacccctcatagcaaggacaagatggaggacacatccaccctcgatgttgtagtcctttgcggtcttgtcatcagcaagctgcttaccagcatagatgagcctttgctgcacgggaggaatgccttctttctcttcaacacgctccttgatcctgctgacgcgtgt

SEQ ID NO: 28957 - DNA, 336 bp, Zea mays
  unsure at all n locations
  Clone ID: cC-zmle189093b04d1
cggggatcaaggatcgtgtggaagagaaagaaggcattcctccttttttttaaaggctcatctatgctggtaagcaggttngttattacaagaccgcaaaggactacaacatcgagggtgcatctgtcctccatcttgtccttgctctgaggggtggttactagtctaaacctgatgaactagcagtcagataaactgttgtgttggctgcgaaatgtgcaggcctgatgttgaacttgcaaggagataataacaaattatcagctttgcgcctgtgcccagtggaaggggctgtcttccaagttattgtctgatatggaattgttccagattatc

SEQ ID NO: 28958 - DNA, 391 bp, Zea mays
  Clone ID: cC-zmle189093b05a1
aaaaaactgggaaggctcttttttatttttgggaacccacaaacatcaacaaaaaaactttattattgaactataactcaataaccaatctaaaagagggcaccaccaatgatgggttgttggtaaaaccctgttgggtttgtcaaaacatgttggttgaatggcaacaattgttgcaattgtaaaaaggtgccaaccttaggcccagcgtgcaggtaaaaccgcaacaactgttgctttgtcaaaaaagcagcagggctcacaacaactaactggctgaatggtaatagttgttgttgtacataaacaggaaagttcaatgctgccagttggttgaatggaaaaaattgctggtggtaggcaacaactagctggctgaatggtaataatt

SEQ ID NO: 28959 - DNA, 571 bp, Zea mays
  Clone ID: cC-zmle189093b05d1
gagtgagaccaactagcaacatagaaagcacaatagtgtaccaattattttagccaaaatattttgcctccttatggtcgtgggtctttctgcaagtgctgctacgacgaccattttcccgcaatgctcacaagctcctatagcttctcttcttcccccatacctctcaccagcgttgtcttcagtatgtgaaaacccaattcttcaaccctacaggatccaacaggcaatcacagcaggcatcttacctttatcacccttgttcctccaacaatcatcagccctattacatcaattacctttggtgcatttattggcacaaaacatcagggcacaacaactacaacaactcgtgctagcaaaccttgctgcctacgctcagcaacagcagttacctttggtgcaattgttggcacaaaacatcagggcacaacaactacaacaactcgtgctagcaaaccttgctgcctactctcagcaacagcagtttctgccattcaaccaactagctgcattgaactctgctgcttatttgcaacaacaacaactactaccattcagccagctagct

SEQ ID NO: 28960 - DNA, 361 bp, Zea mays
  Clone ID: cC-zmle189093b06a1
caaactctctccttctaacccgtccagctttaatcaaggacaagaggaaacttcgaaaggatttgtccaatcaagcgagatatattgcacaataatagagttcatctgaccaagatacatacaacagatttacagaccttcacaaataataaagcattttccagtgcaaatgaagatgcgcgcgcacacacacaagatcacatcaaacagacactaatgcatttctaacgtgcgtgcatataagtacagcattttattcggcggtgggtgtcccgcatggccacatttccacgatgatggacgcccatgccctccaagcagaactagcatcagcagcatatgtccttgaggcagcactcac

SEQ ID NO: 28961 - DNA, 428 bp, Zea mays
  Clone ID: cC-zmle189093b07a1
aaaaaaaaaaaaaattttttttaatctgggaggggggaagataacacttaatttttgggggaaaaaaacccctttttttttttccccacgggattcccctggtttccccaaaaaaaaaaaaaaaacccccacctgaaattaaaaacccccccccccaatttggattaaaagttacaaacacaattcctccccctttttaaaaaattttccaaaacggccccccccctttaaaagttaaaacaaattttttgaggtgggcgtaccaaaccccctggatttttacatccttgggccccttaaccccaaggtggtggtcccacgggttccccctttcaaaaaccccaaaaacccccccggtttcccggtttcttttggtgaccctcaactgtatttttcccctgaaaaagcggctttttttatatttttcc

SEQ ID NO: 28962 - DNA, 574 bp, Zea mays
  unsure at all n locations
  Clone ID: cC-zmle189093b07d1
cgcgtccgggcagaaggcaacaccgcccgcgacgaccacgttgtttagcctcgctccaagtccaagccgcntcgcccttgatgcaaccggccaagatcggcggccgggcgccgtccgcctcgctgccgtcgtcccgcccgtcgtcgcaactcgccagggcgttcggcgtcgacgccggcgccgccaggatcacgtgctccctccagtccgacgtcagggacgtcgccagcaagtgcgtcgacgccgccaagctcgccggcttcgcgctcgccacctcggcgctcctcgtctcgggcgcgagcgcggagggcacgcccaagaggctgacctacgacgagatccagagcaggacgtacctggaggtgaagggcacgggcacggcgaaccagtgcccgaccatcgacggcggcgtggactcgttcccgttcaagcccggcaagtaccagatgaagaagctgtgcctggagccgacgtccttcaccgtcaaggcggagggcatcgtcaagaacgcgcctgccgagttccagaagaccaagctcatgacccgcctcacctacacgctggacgagatcga

SEQ ID NO: 28963 - DNA, 431 bp, Zea mays
  Clone ID: cC-zmle189093b08a1
ttttaggctctaaattacaaatctgaatacataattgatcgacaggggatacagaatgcggacgctacattctgcatggttttaccacttcatctgcatggttttacccacttcatcagcacataaatgttcagtgactacagacaaatgtgatgactccaacatgaattccttgcagggttttaccacttctgcggccattgaagatctatatagttcgtttcacttggaccaagcctgcaacgcaaatcccatgacctgcgagtgcctccaccagcgatttgttcgtgagctgacagcgtcatccatgctgcttgcttcatgctctcgatccccagcctcccagtctcacttggaggcggcaacagaattcggtttgccaataagaaatatatccagcacatcagtggtgacaacatagtgaccaaact

SEQ ID NO: 28964 - DNA, 498 bp, Zea mays
  unsure at all n locations
  Clone ID: cC-zmle189093b09a1
gcgccgtcgtcgtcgtttattgtttagttcaccctggagcagtcggtgggggtggggatggtgtaggggatgctgacgccgcacttggaggggatgctggcggcgttgaagccgctgacgccggcggcggcgttcttgaggcagttgcaggcggcgcggcggtcggcggtggtgcgggcggcgttgttgaggctcctgacgccgctgcagcagccggcggagggccccgagccctggccgcgcgcgtaggagatgcagggcgcgatggccgacgccacctgcccgcagctgatggccgcctccgaggtcgccgccgccagcagcaccaaggccacncacggcggtcgccactactgccaactgctgcgtgcgggccatgttccttgaggaagggaggtgcctgccgctctgctagctctagctcgctcgggctgtttggaaatgcggaggtcacaggtcagtagatggcaatggcagctggtgggactagttctagcc

SEQ ID NO: 28965 - DNA, 477 bp, Zea mays
  unsure at all n locations
  Clone ID: cC-zmle189093b09d1
gaactagtcccaccagctgccattgccatctactgacctgttatttccgcatttccaaacagcccgagcgatgtagggctagcagagcggcaggcacctccctcctcaaggaacatggcccgcacgcagcagttggcagtagtggcgaccgccgtggtggccttggtgctgctggcggcggcgacctcggaggcggccatcagctgcgggcaggtggcgtcggccatcgcgccctgcatctcctacgcgcgcggccagggctcggggccctccgccggctgctgcagcggcgtcaggagctctaacaacgctcgccgcaccaccgccgaccgncgngccgtctgcaactgccttaagaacgccgccgccggcgtcagcggccttaacgccggcagcattccctccagtgcggcgtcagcattccctacaccattagcaccttcaacgacttgttcagggtgaactgaaccctaaacg

SEQ ID NO: 28966 - DNA, 365 bp, Zea mays
  Clone ID: cC-zmle189093b10a1
atgaactccttcacacaacatctaccacattagaaacgtttttacccacaattccttaaccacttaatatccttttacactataacccatgctaaaccataccaacaccattccagtacacgtcacattacaataaacttagccgcacacacaagctgaaaaacacgctactcaacaatccatatatccttaaccttcaacacattaatcacatcctatagaagtcctcctacataaatccgatgtacacttttccctactacccttcctcagtaccactcccacttacacctctccttttcctaagcgttccactaacctacctctaaaccttctacacactaccaccgcattctatttacttt

SEQ ID NO: 28967 - DNA, 436 bp, Zea mays
  Clone ID: cC-zmle189093b11a1
tttttttttttttttttttttttttttttttttttttttgtgttgttttttttttttttttcaaaaaaagcccgtccccttatttaaaaaaactttatttaattcggataaaacccggcccccttcattaaattccctaaaaaccaaaactttttttacaaaacaacccaaaaacatttttttttccccaaaaaaaaccaatttcttaaacttactttaaaaaaaaccttttttaactctgcccactttccaaaaaaaaacccggcccttaattttggctccttaacccccccaaaaacttttccaaaagcgccccactttttgtcaaaaaaacaaaaacaactgtccctctcctatacaatcggccaaacctaaaaatactcccccttaaactattttaaaaattgccttcttttcacaccgatcttttttcttt

SEQ ID NO: 28968 - DNA, 110 bp, Zea mays
  Clone ID: cC-zmle189093b12a1
tcctatacatcagcccccccttccttttttttttcacctcttttttacaaaaacaaaacatttttaaagaaaaattttaattcaacatccccatacatccaaaccccaaa

SEQ ID NO: 28969 - DNA, 218 bp, Zea mays
  unsure at all n locations
  Clone ID: cC-zmle189093c01d1
aaaaaaacggacaaacaaaaaaaaccaacaaccaaaataataccaaaacacaaacacccaaacancccgccctttaaaaaaaaaaaacccccccaccccccccacaaacaaaacacataaaaacaaaacaaaaaaaaacccaaacacacaaaaacacaaccaacaaacataatcaaataaaaaaaaaaaaaaaacaacaccaaaaataaaccacaaac

SEQ ID NO: 28970 - DNA, 572 bp, Zea mays
  Clone ID: cC-zmle189093c03d1
ggaggggctcaccggcgtcacctggcaggacgccggcaaggtggttctggtggacgggtcctcctacctgggccaggcggggtcgttctccatctcgacgctcatctggatcgaggtgctcgtgatcggctacatcgagttccagcgcaacgccgagctcgacccggagaagaggctgtaccccggcggctcctacttcgacccgctcggcctggcggccgaccctgagaagaaggagcggctgcagctggcggagatcaagcacgcgcgcctcgccatggtcgccttcctcggcttcgccgtgcaggccgccgccaccggcaaggggccgctcaacaactgggccacccacctgagcgacccgctccacactaccatcttcgacacgttcggagggtcctcttaagcccgccattgctccgccccgtccatcgaccggaacgtgttcttggattaattaactacgatctctatgagcctggggatggatcaacccgtcgtgcgtggtctcgttttgtgatgagtgggagagagaggatgacaagatcgatcctttgttaatggagatctcg

SEQ ID NO: 28971 - DNA, 362 bp, Zea mays
  Clone ID: cC-zmle189093c04a1
gtatgacaccacccatatttctttattcttattaaaattcgggcccaaaaaaatcccccaaatcccctacctaggtacgacgtatacccccctacatacaaatgcctgcacctttaatgcaccctcatatatattttattgggcaaacccaaatcaaaattattcctgcaaaatccaaattactaccccatgcatgcaaagcctattcccgccgatcacgggcaaaaagggacttggtagatgctcttgcccccacaggcatgggtcttcatttccggggggcttttggtacccctaggggcatccaaggtccgtacacaccaaccccacccccgtgcttaaagagaaagccctggtaaagt

SEQ ID NO: 28972 - DNA, 576 bp, Zea mays
  Clone ID: cC-zmle189093c04d1
acgcgtccggcctagctctatagctcgagtattgcttgctttttacaagaaacaaggcagagcaccaacaatggcgcgttgtctcctcgtcctcggtcctcctgctgctcctggccgccgccttggctggcatgagcgccaacgccgccaccttcaccatcaccaacaactgcgggttcaccgtgtggcccgcggccaccccggtgggcgggggcacgcagctgaacccgggcgggacgtggaccgtcaacgtgccggccggcaccagctccggccgcgtgtggggccgcaccggctgctccttcaacggcaacagcgggagctgccagacgggcgactgcggcggcgcgctggcctgcacgctgtctgggcagccgccgctgacgctggccgagttcaccatcggcggcagccaggacttctacgacatctcggtcatcgacggctacaacctcgccatggccttctcctgcagcaccggcgtgcggctggtgtgcacggaccctgtatgccccgacgcgtaccacaacccccccgacatgaagacccatgcctgtggcggcaacagcaactacc

SEQ ID NO: 28973 - DNA, 420 bp, Zea mays
  Clone ID: cC-zmle189093c05a1
aaatgccacccaaccctttaaaaccataaaatttgatccccttccataatttacaaacctggggctagttcaaccctccatttgcaagctgctttgataatttcattaccttaacaaacaaaaacccccccttcgttacaagcttgtacacaggcttttaaaaccacaccattagctgctgcaccaggtgcatttccccaaggatgtcctaaaattcccccaccaaattgtaataccgaatcatctccaaaaatttcggtcaaaacttgcatattccaaacatgaatacccccaaaaacccccggtataacacctggcatggatacccaacccttagtgaaaaaaataccgcgagaaccatctttttcaataaaatcatcgcccaataaatcaacaaaacctaaagttttttggggtccc

SEQ ID NO: 28974 - DNA, 594 bp, Zea mays
  Clone ID: cC-zmle189093c05d1
gtttaataacgaaccgtgttaacttaccataacaacatcttatttcctatcgaattccttcctatccagttggtatagtaaaattcctataggatagaacgtacacagggtgtacacattatatatgaatgaaacatattcattaacttaagcatactcctttttttatttaatgagttgatattaattaaatatctttttttttagatttttgcaaaggtttcatttacgcctaatccatatcgagtagaccctgtcgttgtgagaattcttaattcatgagttgtagggagggacttatgtcaccacaaacagaaactaaagcaagtgttggatttaaagctggtgttaaggattataaattgacttactacaccccggagtacgaaaccaaggatactgatatcttggcagcattccgagtaactcctcagctcggggttccgcctgaaaagcaggagctgcagtagctgcggaatcttctactggtacatggactaactgttggactgatggacttaccagtcttgatcgtttacaaagacgatgctatcacatcgagcccgttcctggggacccagatcaatatatctg

SEQ ID NO: 28975 - DNA, 380 bp, Zea mays
  Clone ID: cC-zmle189093c06a1
ttttcaactttctttaaggttgcagtttattttagaaacgacgagggcgatacaatatagcaaactaaatagtgataacaataggctaaccctaggacttcttttgcagtgtagtacatacatactacgaagttagcctccacagaggtgatgtgcacggcaggaaaggggcggcaaacaagcacctggagcaacagcggtcacgatgctaaatattctacaactctcgccttatttacagagccgggctgctgatgagatctcgttagcggtcaaatgggaactcattgtcatcctctaccaccttgaatggctccgggtggcgactggagcagtaaaggttccacatcttgtagtatgccctttcaaggttgcgcacc

SEQ ID NO: 28976 - DNA, 381 bp, Zea mays
  unsure at all n locations
  Clone ID: cC-zmle189093c06d1
gggtgcgcaaccttgaaggggcatactacaagatgtggaacctttttttttccagtcgccacccggagccattcaacgtnnttgaggatgacaatgagttcccatttgaccgctaacgagatctcatcagcagcccggctctgtaaataaggcgagagttgtagaatatttagcatcgtgaccgctgttgctccaggtgcttgtttgccgcccctttcctgccgtgcacatcacctctgtggaggctaacttcgtagtatgtatgtactacactgcaaaagaagtcctagggttagcctattgttatcactatttagtttgctatattgtatcgcggtcgtggtttgtaaaataaactgcaacctttaggagtgttgaaaa

SEQ ID NO: 28977 - DNA, 418 bp, Zea mays
  Clone ID: cC-zmle189093c07a1
atgaattgttctctgagtggggtgttatgatcaacataataaatatggaacacccatcgcctccttttatttgcaaaaaaaaaaaacctttgaaaaatggggaattaacattccattatcctcttgcatagaatgcaagcaaaaggactagcagagtttattgcagcaactgacgtgaaaagtgagttagcttaaaaagccgggaactccatccggttgccgcagggcctgccgctggggaggacggggcaatcgacgaaactttcgccggcggcgtcgacgcaaaagtagagctggtaaaactggctgttgccggcctcgtcgcggttgcactccacgtagggctcgaaaccggtgccctggcggatggcgcccttgatctggctcaacgtgtagtaaccgccgtcgggcttgaccc

SEQ ID NO: 28978 - DNA, 469 bp, Zea mays
  Clone ID: cC-zmle189093c07d1
caacaaagttctactctgcatctccgtccatctagcttcttgaaacaacccgtaccagcgctatccggccggccatggcggcggcgcgccggctctccctgcccctcgtcctgctggtcgtcctggccgtcgccgggcgcgcggcggcgcaggactacgacttcttctacctcgtgctgcagtggccgggggcctactgcgacaccaagcagagctgctgctaccccaagtccggcaagccggcggcggacttcgggatccacggcctctggcccaaccgcgacgacggcacgtacccgcagaactgcagccccgacaacgccttcaacccgtcgaaggtgagcgacctgctgagcagcctccgcgccaagtggccgacgctggcgtgcccgtccaacgacgggctgcgcttctggggccacgagtgggagaagcacggcacctgcgcagccgacgtcttcgacgagca

SEQ ID NO: 28979 - DNA, 446 bp, Zea mays
  Clone ID: cC-zmle189093c09a1
gttcactaaacaagaaaatctgaattaggccaggggggatggtgtaattcctttgaactatgcctctttatgtatctgtggtgtagccacaaggctttaacatgaacaagctatacaacatgccacatcacgtttagctaacaatatttctctactctagttgttgcaagtggttgccgcggcctcggtctcctttccagtcgcgaaagatttgccgcacccacaggtttttgttgcgtttggattctggaacaagaagccgccaccaatgagggcgtcgctgtagtccagctccattccaaacatgaaaagaaggcttttggggtcacagactattgcaaaaccatcatactctacaacagaatcatcagggctggcattctctcgattttcaaattccatggtgtaagacatgcctgagcatccaccctgtttcactccaattc

SEQ ID NO: 28980 - DNA, 540 bp, Zea mays
  Clone ID: cC-zmle189093c09d1
acggcggatgttcagattgcttcctcggctggtttccttttttcgccgcgtcgcctgcttcttccccgagccggagacacgaatcagccatggcgctcgcctccgccacgtcccgccccctcctcggtcgccccgccggcaccgcgcggccccacctcgccgtttcctcatcctcccccgcctcctcgatccgcttcccccgcggcgccgacggcggcgccagcagagcggccgtctctctccgcgcccccacgcctccagcggcggcaacagcaacatctggtagcattgctccagcaatttcattgactgaaaaggccttgaaacatctgaaccaaatgagagctgaacggaatgaagttttgtgcttgagaattggagtgaaacagggtggatgctcaggcatgtcttacaccatggaatttgaaaatcgagagaatgccagccctgatgattcttgtgtagagtatgatgggtttgcaatagtctgtgaccccaaaagccttctttttatgtttggaatggagctggactacagcg

SEQ ID NO: 28981 - DNA, 471 bp, Zea mays
  Clone ID: cC-zmle189093c10a1
tttttttttttttttttttttttttttttttttttttttggtttgttttttttttaaaaaaaaggcccaaacctttttggagcacacattggggcccttttattaaaacccttttttaatcttttaaccgaaactttacagtatcatttacattttgtacataaaaaccaaaaaaaaggggttccacttttccaataccatggccaaaaaacaaaaagcgagcccccccccccgggtttaaactccatcttttaaaaaagggaaaattcctcccgtaaaaacttttgaagccgtccactaaaatccagggtgaagccaaaaaaagggaattccataagctggcatcaaccaaacctggatcacggccattttatttacctttcacaaagttttcttctttgacggccttaatttggtgggattctttaaagcaaacaaaatgcaccaaaacctgtccatttggatttattg

SEQ ID NO: 28982 - DNA, 432 bp, Zea mays
  Clone ID: cC-zmle189093c11a1
ttttaattttaaataaaacattttcacgtttatgtggtggggagggcgccaaacacgaccaccttattattctgtactgtacacagctgacagctgccgacggggcttttgttgctcaaacggtgatgctgttgggtatgccacggagcaccagtccgggctgtgccgtcggcttgagcagcgtatagggcacctccacctgccccgtccggttcttcagcgcagggtccgcgttccgcctgtcgatgttgcccgcgacctcctccaacctcgcccggaactccgccagcgcctcggccgccctccgctcgcgcgtccactgcttcgtgtccgggcgctgccccaggtacacctccgtgcccttgagccccatcggccccgaggcgatggacatgaagccgagcgcctcggtgaacggcgtgacgctcgcag

SEQ ID NO: 28983 - DNA, 355 bp, Zea mays
  Clone ID: cC-zmle189093c12a1
atctagataagtttacttacacataacaattattacaaaaccccctataagcaatttaaacaaaaacaccttattttaattgttccctttaaaaaaaactttatttcctgtaactcaaaaaaaaaaataactccatttaaaaaaacatattatcccacaatctttttctttctgcatgaatatatacaaataaacactttggattacaaaaaaaaaaaacctttttattttcaacacccccaaaacaaacttggaaaaaataataaatttttggaactcccctgctcacccttaatacccaaacccaatcctttttttatctaaaaaaaaaaaaacctttaactcccccctaaaa

SEQ ID NO: 28984 - DNA, 235 bp, Zea mays
  Clone ID: cC-zmle189093d02d1
ggacgcgtgggaaaaaaaaaaaaaaaaaaaaaaaaaaactaaaaataattaaaaaaaaaaaaaaaaaaaataaatctgccgtttaaataaaaaaaaaatcgggccgcctctctaaagaacctaaacttactttctcgtcccatccacttcaaaccactttttttctttcacctaattctaattccctggccatcctttcacaacccaaaaactgggaaaaccatgactttcccca

SEQ ID NO: 28985 - DNA, 375 bp, Zea mays
  Clone ID: cC-zmle189093d04a1
aaaaaaaaaaaagggggctttttataaaaaaaaaaacccccccccaaccccttttttggggggggaaccataaataaaaaacccccaaaaaaaaccttttttacaaaaatttaaaattttcggtcttattctttcaaaccaccgggataacccccctcatccctccaaaaaacaagcctgaaacccttttaaaccccaaataatggcggggaacttttccccccctgaaaaaaatacagccccaaagaaaaaaccccccttttttttccaaaaaaaaaacccccaaaaaaaaaaaattcccctcccccccaaaattttgggggaaaaaaaaacccccttttattttccaaactttttttgccaccaaaatttttt

SEQ ID NO: 28986 - DNA, 582 bp, Zea mays
  Clone ID: cC-zmle189093d04d1
gggtggaggttgtttctgtccacactgtgtcgaaagggtactgttattttgcggacaacgtggtggatacttgcgatgacaaatcttcctcccaagacagtagatgacatctacaaggttgcatcaatagcactgagtccaaacgttcctgggcaaatttttatgggagtaatggttaaccctcctaaacctggagatatctcgtacctgaagttcgctgctgaaagcaagtccatccatgaatctttgaggaggagagcacgcatgatgacagatggtttcaacagttgccgaaacgtcgtgtgcaatttcactgaaggagctatgtactctttcccccaaatacgtctgccaccgagagctattgaggcggcaagaagagccggcaaatcagcggacgtcttctactgcctcaagctcctggaggcgacaggaatcttcactgttccgggctctggttttgggcaaaaggaaggggtgttccaccttcggaccactatcctttcagcggaggaagactttcctgccatcatgtcgagcttcaagaggttcaacgactccgtcatggagcagtacgagggc

SEQ ID NO: 28987 - DNA, 594 bp, Zea mays
  unsure at all n locations
  Clone ID: cC-zmle189093d06a1
ttttaaattttaatttttcttaatcacgatgaagcgttagaaaggcttatccaatctgttaactataatgcatgcatctatacacactagacggcaggagccatggcaggctaaaggtaaaaatccaagcaattattggtctaactcaaccccatcaactacctatttggctgcactctacaatatcgtcgatttactgcacaggactaggccgccagagtcgatcctttgtttctgcatccacgtctccaagaggagatcctcactctgccttaaatgcaaatagtcgtcgatgtgaaacgacaaggttcgagcataatcagacaagctgcttcggcaaatcccaacctcaccaaatctggtcagtaaactatctttggaggcaactgatgaagtggcatggtctccagggctccaactcccacggctgctcgcagtctgaatgctagtgctgcctctggtactttctccctgggccttcggtttgcacggngaggtctgaaggtcattggtagtttcccattgcagccagggaaagacaacgccatctgcctctgcaggtaaagcaacttctgggagctaaactggagttct

SEQ ID NO: 28988 - DNA, 490 bp, Zea mays
  unsure at all n locations
  Clone ID: cC-zmle189093d06d1
tgacttttntggttttgatggagagagaagtgactcaattttataccaggaaagacctgttgttacttcatgtatgttcagaaactccagctaagctcccagaagttgctttacctgcagaggcagatggcgttgtccttccctggctgcaatgggaaactaccaatgaccttcagacctccccgngcaaaaccaaggcccagggagaaagtaccagaggcagcactagcaatcagactgcgagcagccgtgggagttggagccctggagaccatgccacttcatcagttgcctccaaagatagtttactgaccagattcggtgaggttgggatttgccgggcagcgtgtctgattatgctcgaaccttgtcgtttcacatcgacgactatttgcatctaaggcagagtgaggatcttctcttggagacgtggatgcagaaacataggatcgactctgggggcctagtccctggcagtatatcgacgata

SEQ ID NO: 28989 - DNA, 408 bp, Zea mays
  Clone ID: cC-zmle189093d07a1
aattacctcaaaaatgtattattacagacgtgcacacaaaaccattgatctcactgaattcaaccaaacgctaacaccagtgcagggaacatatgaaacatacaaaatagaaccatgccaacacgaatagatgacagtcacataggaaaactggtcaatgaaactcccgaattaactgcttaatagcaaggattaaccacacaaaaaatacactgatcaacacacttttctcctacagtcacggatctgctgtctttctgaggaaccagctactgccaataccacacactagcttgctgaggaaactgtctcgctcgaatcaactgcctcctgtatccctacatctgctccagggctccttccctatccctcgccgacgcagtccgagccctggaacgagccaccacc

SEQ ID NO: 28990 - DNA, 467 bp, Zea mays
  Clone ID: cC-zmle189093d07d1
agacggcgctgaacctggcaggaggaggaggtggattgaagaagaaggacacggcatggcgcgtggggttatctaaaggaactccagtcagccactaacaatttcaattacgacaacaagctcggcgagggcgggttcggcagcgtgtactggggccagctctgggacggatcacagatcgccctgaagaggctcaagagctggagcaacatggccgaaacggagatcgctgtcgaggtggacgttctgacacgcgagcggcacaggagccttctaagcctgcgcgggtactgcgccgaatgccatgagcgcctgattgtctactattacatgccgaacgtgagcatacactctcagctccatggacagcacgcggtggagtgcaaccttatctcagagaggaggatgaggatccccgtggacttcgtgaagggacccctacctgcacacagcgcgacgccgcacat

SEQ ID NO: 28991 - DNA, 387 bp, Zea mays
  Clone ID: cC-zmle189093d08a1
agggcaaccaaaggtaatgcacgggtgctggttctcacatgcttgagaagagaagcaggaggaagagaacatagctcatgaaacaatcgcctgtctgactgtctctgatgcgaagcagggaaggggaagcaacatgatgaacagctagcccatcttaatttaccaaaaaaagaaagaaagatggcaagacattactatggagtagtagtacatagattagacgctcctactgtacaaccacgagtcttccagtgatcttgcctccgccgccgcaccttcaggtaacctcgccttgccctgcgtcggcgccttcctcggcaccggggcccttgggcaccgtgacgacgagctggccgttgacgtacccggccaccgccatggccggac

SEQ ID NO: 28992 - DNA, 464 bp, Zea mays
  unsure at all n locations
  Clone ID: cC-zmle189093d08d1
agactacaacgaagagggaaaggaactctaagagaaacgatctttgaatgagnnaggagccttcgctttttggactttgggcgggggcgtgatctgtcctcgcgaccacatgagcgatcctacccagcatcttcccacctgccggcggcaagaaaggactctccggcgctctgccgcactgtgtacagcaanggtgctggagcttgccgctcccggcggacactcgacgtccacggtgttcgaaggcccagacgccttccacttcgtcgcggcgccggccgccggtgcgcgtgccgccgccaccgtgcgggtgcgcaccgtcaggatccaccccggggtcaccaaggtcgtggtgcaggccggagccgccgaacgggccgcttacgacgacgccgccagcgacagcatggagctcgacaggtggcggtcccggctggccgagccgacctgtccggccatggcgg

SEQ ID NO: 28993 - DNA, 229 bp, Zea mays
  unsure at all n locations
  Clone ID: cC-zmle189093d09d1
aaaacaaaaaaaaaaaaaaannaaacaanaaaccaccaacttaatatttacaancaaaacaaacccctccacgctgtttataataaanatccctcccctaacccaattaattacctacaaaaaccactcacaaaatcataaaactcaccttaacttacaacaatattattcaaaaacatttcactttccccaacttaataaaaacccaatacatccccactaaacaaca

SEQ ID NO: 28994 - DNA, 439 bp, Zea mays
  Clone ID: cC-zmle189093d10a1
cagaacagctgggtaactgattgagccttggattgaataggaagaccacacacatctcataataaaataaggtcacttaggtacatgttaccattcagaagctcaggaagaaaaaaaaaaaggatagggatcatcagcattcgtcagagcaaatgccaagcagtgggtgtttctgaggttactgtagcacttctgcaaataccaagatgttcatcagcagctactaacggcaatatgtacaaggacagagatatgcctagtactgcaaagtgcactggagctccgataacacaattcagcaagagtggaagcgctccgtggtccaagttgatgctcaatgtaacaatcgtgattcttgtctcttcaggtcattgttcccaactacagtttatatagaaccaaagcatacaggaagtctatgcaggaagcaagaattact

SEQ ID NO: 28995 - DNA, 381 bp, Zea mays
  Clone ID: cC-zmle189093d11a1
acatcctctagagcaaccgcccttccctttcttccccctctccttttttttttatttttttttttttttaagttagttttaatttaaattaccactccctcccacccccaaaaaattacaaaaaaaaaaaaataaaaaaaaaaacatcacaaaaaaaaaacaaaaaacactcttaacaaaaaaacataaacaaaaaaaaaacttaaaaaaaaaaaaaaaaacaaaaaaaaaaaacaaaccaacactcaaactatacacaacaacaatatcctaaaataaaccataaccaaaaaataaaaaaaaacttatccataaaaaaaacaattacaatcattacccaaaaccaaaaaaaccaaaatataaccacccccaaaataaaca

SEQ ID NO: 28996 - DNA, 397 bp, Zea mays
  Clone ID: cC-zmle189093d12a1
ctcttaacctgagggtaaggttttcaataacacagtccaagtctattgctcacttattaataccatgcatataagcctatttccctttttcttattcatgcccggaaaaagggcattgcaataaccttcttacaaaaaaattcaatgatccactaatgacggtatggaaatacctaccatagcgacttttacattacttacacgcgtggaaaccgcgcaacatgcccagtaacagagtgttcttccatcatatacagcaactgcatgctgcgaagccgagaagaaggaaacagaaattacaaaacttacagcaacaacacggccttgctgtgtaccataccatacgccgtgtgttctggcctgagtcgtcctactggtacaggctcggcaccgccct

SEQ ID NO: 28997 - DNA, 650 bp, Zea mays
  unsure at all n locations
  Clone ID: cC-zmle189093e01d1
ttttatatcatattttttttctataattttatttttacccaccccatccccacttctgtttgtttttttttttaaaaaaacctccccaaacaatcccanacacancattttaaantatttaatttttatatcttctctcttcttattcacctttcttttttaataataatttatttttcattaatatacctttttttttttacattctattttttttttatattttttttttattttttatttctacttttttatttctttttatatttctatatattacttatttaatttttcattttttttttattctatttttccttatctatttttttttttttttgtgctttattattttttttattattattatttttatttatcttttttacaattatatctcttacttttttttttttttctattaattatcttatttcttattatatctttatttattatttttttattttctatcatttctttattattatattcctattatccttatctttattattatatttttttctatatttttctttttattttatttactaatttctcttatattattttctcttatatatcttttattttaatttatattattaataaattttttcattttctttctttcattctattatttt

SEQ ID NO: 28998 - DNA, 610 bp, Zea mays
  Clone ID: cC-zmle189093e02d1
cacgcgtccgcgcagagatccgagcgagcatagagtagattttataaaaaaaaccataccaacatggtggcgctggaaaacctacgccgcatatatggccatgtagtggagagggcgaccctggcgcgcgacctcctggcccccgccgccggccaactctccggcaatctgcacagccgttgtattctggcccagcaactcgacctgtccttccccgagaaagacgacgacttgcgtgccgatctggagaagttcggcgccattgaggcgatcgctttatgccgacacctgttcatggcggtgattgtcttcagggacgaagcgagcgtgccggtcgctttccggaggcaagaggaaatatcatctgggctgtacagcgccgtcccgccttcccaccttgcgctctccacgagttttattcatccaaacagtatcaaggttaatttgtactccaacacatcaactgcgtcgtctggagattcaacaactgcaaaacatagcacggagccaactactacagaggcagcaacaagcatcggacaatcaatgatgccgctatggatggaatcgaggccagcgactgtgttccaaaactaccttggcgatggca

SEQ ID NO: 28999 - DNA, 506 bp, Zea mays
  unsure at all n locations
  Clone ID: cC-zmle189093e03d1
gggacgcgtggacggacgcgtgancccagaaaacaaaaggttctttttcgattcgagatcgcggcgccagcagcatgctgtttaagaatcgccgcgaagccgtgacggcgacagtgctcgtggccgtatcagtcctggcgaccctggcgcgcaccgacggcgccctctgcgacaagtccgacaaggcagccctgcttgccgtgaagtcggcgctgggcaacccaccggcgctctccggctggaactccaccgtggcctgctgctcctgggagggcatctcctgcaacgccaccaccggccgcgtcaccgacctgaccgtcttcgcgctcaacatctcggcgccggtcccggtcgccatcgccaacctcaccgcgctgcagagcgtcaacctggcctacaaccagctgtacggcagcattccggcgttcctgggcccgcgcgcgctgccggacctcaccttccttcgtctttacggcaaccggcttttgggcgccatcccggccaca

SEQ ID NO: 29000 - DNA, 227 bp, Zea mays
  Clone ID: cC-zmle189093e04a1
atacatctagaccgcccgccctttttttttttttatatttttttttattttttttttttacattttgtttttttttttttataaaaaaatatcccatcattattataaggggaccatttttatcatacttagcaaatgggaaggttgaaacatcttttgataaaccaaccaactgcaaaattgggtaacacaaaacaaaagaggtcccactgttaccggacccgtgg

SEQ ID NO: 29001 - DNA, 138 bp, Zea mays
  Clone ID: cC-zmle189093e04d1
cggaacagtggtacctcttgtgttctgtgttccgcgatgttttattcggttgcttgatcgaaagatgtttcaacgtcccattttttagctatgatacagatggtcccctgataataatgatgacatattctgtgatgg

SEQ ID NO: 29002 - DNA, 335 bp, Zea mays
  Clone ID: cC-zmle189093e05a1
aaacacaaggatgggcattttttaacattatttattcacctacacttccaaataaatcgcacaaccctcttcagccaaaattattggtaggaaaccatctgccaattacaagggagtaaactgaaacagcaagaaacatggttcatgtgaaaaaaaaaattgccaaaaaaaaccacatggttatgaagtaattggactgagactcctgacaggctaataagcgaaggacggttcactgggccggaagctcctgtaaatggaggctgcaaccggtacgagacccaaaagtgccatctggacctgctccgaggtgcttgtcctgaccgtgatctgcc

SEQ ID NO: 29003 - DNA, 353 bp, Zea mays
  unsure at all n locations
  Clone ID: cC-zmle189093e05d1
aaaaaaaaaagccacaaaaccacaacaacacaccacttaattaccccctaacatatccaccccacaccctgctttttattaaaaaaanaacaccccccccccccactaaaacctaacccccacaaaccccaaaacttcaccatttaacaacaaacaccccaccaccccaatacacaatccttaacctcccaaaacaacaaccacacaacaaacaaaaatcaaacaaataaacaaaccaaaacaaaaaaacccatgtcccccccaccacaaaaaaacccaacaaactcaccaccccttccaaccccaaaatccccaaaaaaacatatcctaaacaaaaaacaccaacccccccc

SEQ ID NO: 29004 - DNA, 421 bp, Zea mays
  Clone ID: cC-zmle189093e06a1
aaccaaatgaaagtgtggcagcctgcccggggataattataggcgaggaaataattacttaaaatatgtagtatttgatttggtacaaactaggcccatttaagctcagggcaaatataaagcaaggcagaactcggacaacctattccaggatgtcctcgtcaatctcgattgaaatgatctccccatcatcgaactgatccttccttggaggagcaggaggggcaaagagccgcgcaagcccagttcccttcttcttgttgcgcggcctcccattgccatatgaatggttgaaccttttgccccttttcgttttcttgtcccctctcccgcagtagacgtcaagaactggagtgacggtggccgacaagaccgcgcctacggagaacgcatcccgttcgcggtggaaggcggcggaggc

SEQ ID NO: 29005 - DNA, 586 bp, Zea mays
  unsure at all n locations
  Clone ID: cC-zmle189093e06d1
cggagcacactantctctcttccctgcgcttgctcgctcctttttgcccccatggcgctgctcgccgtccagggcgtttgcatgtacaccgccgccgcggccctcccatctcacaaccacggcgccgtctcatcctacgtctccacctcctcctacgcgctcgcagcctccgccgccttcccccgcgcccgggctgcgttcgccgtcggcgccgtcttgtcggccaccgtcactccagttcttgacgtctactgcgggagaggggacaagaaaacgaaaaggggcaaaaggttcaaccattcatatggcaatgcgaggccgcgcaacaagaaaaagggaactgggcctgcgcggctctttgcccctcctgctcctccaaggaaggatcacttcgatgatggggagatcatttcaatccagattgacgaggacatcctggaatacgttgtccgagttctgccttgctttatatttgccctgagcttaattggcctagtttgtaccaaatcaaatactacatattttaaagaactatttccttgcctataaatatcgatgggtaaggctgcacctttcatttgctagt

SEQ ID NO: 29006 - DNA, 403 bp, Zea mays
  Clone ID: cC-zmle189093e07a1
ctagaccgcccgccctttcttttttcttttttattttatcccctctctttcttttctacagtcacgccacatcttatatttttccacccccccctttcctccaaattaaaacaatacaccacccatcaaaaccccaaaaaccccacaaaaaacccctcaaaaaaaccaccccccccaaaaaaaaaaaacacaaccccctcaaaaacaaaaaaaaaaaaaaataccccaaaaaaaaaaaaaaacccccaaaaaacaaaaaaaaaaaaaaacccaaaaaaaaaaaaaaaaaaccctgctaaaccaaaaaaacaaaccacaaccacccaaaaaaaaggaaccaacccccccaaattaagtaaaaaaaaaccccccccaaaaaaaaaaaaaaaactccccaaccccc

SEQ ID NO: 29007 - DNA, 429 bp, Zea mays
  Clone ID: cC-zmle189093e07d1
gtccgaaaaaaaaaaaaaaaaaaaaaaaaaaaaaaaaaaaaaaaataataataaaaaaaaaaaaaaaaaaaaaaaaaaacgatttttaattaaaaaaaaaaaccttgcccccccttctaaaaaaacccagctttccccccctttcaccccccatcattacactcccttttctttcccccaaaacttctttttttaccccctttctttccccatctcatctggaaaacccctcactttccccacttaaatccctttttttcccatcccccttttcccacttgcccttttccccattaccccctcccccatcacccttacaacccctccccaaacccttttccaaaatgataccccccctggttctcccctttaaccccccccttcttggcctttacccccacgtccaccctttccctttccaacccctta

SEQ ID NO: 29008 - DNA, 322 bp, Zea mays
  Clone ID: cC-zmle189093e08a1
ttttgctgtataacgtttttaatcacaatgcatgcggtccgttgtttgaagttacttatgacaagacgcgaggaacaagacaataagctggacagtttcttgctgtctgggtacaaaaccaacgaccaaagtaacatgactccagtagctcaacagcagaagaaaacagaagccatcagcctgaatggaccccatgaaagtcacccgtcctcccgcgctgccggcgagggacggggcagcggatctagtgcttcccaccggtcctctccatctcctcgaggtgggcgaggtgggcgcgctcccagggcagattgacgaagta

SEQ ID NO: 29009 - DNA, 326 bp, Zea mays
  Clone ID: cC-zmle189093e08d1
gggcggacttcgtcaatctgccctgggagcgcgcccacctcgccctttttgaggagatggagaggaccggtgggaggcagtagatccgctgccccgtccctcgccggcagcgcgggaggacgggtgactttcatggggtccattcaggctgatggcttctgttttcttctgctgttgagctactggagtcatgttactttggtcgttggttttgtacccagacagcaagaaactgtccagcttattgtcttgttcctcgcgtcttgtcataagtaacttcaaacaaaggagtgcatgcattgtgattaaaaacgttttcagcaaaa

SEQ ID NO: 29010 - DNA, 425 bp, Zea mays
  Clone ID: cC-zmle189093e10a1
ctcttaccatccgacaacctcccatgggtgggtacttaacatcatacaaattcgccttgtacacaataatttgggacgatatccctgaaccatatatacgctcacaaagctaacaacacataatcatgcacgttgtacacgatattttggtccaagacaacatactctccctgtacggatatagtaaaattgttgtagaggtatttaacgcctaaacctactctaccatctgcacaatcagttatatttactaaatatacaatgttgcgttgtaaaaggaaggcaaccggagctatccagcagtgatttacatactttggacatgtttggttctttacctcacttgccacattttgcctaactctgctgcctaaagttagttatttaattcaaacgactaaccttacgcaaagtgtggcacattt

SEQ ID NO: 29011 - DNA, 87 bp, Zea mays
  Clone ID: cC-zmle189093e11a1
aacgcaagctaggcagggatacacgttcaaatctgtatctgaaaatccccaaacaaaacaaaacaaaactggctctgaacaataaac

SEQ ID NO: 29012 - DNA, 554 bp, Zea mays
  unsure at all n locations
  Clone ID: cC-zmle189093e12a1
tttttgcattttagtagctcagatatgattttttgggaacgcatacagcaggattcacatagcattcagcaagataataatatgcttcagtttccctgccagatatgtcactcattaaagataaaacttgagacgtacaccgaataaaaaataataaactacaatcgctatttcatacatcaaaattttcgttggctccaaactcgtgcttgctcaaaattctcggttgcccttacacacccatcaaatttcattggggcctgtggacatctgaatactccttcataccttcctcctcttgtcacctttcttttcagcttcccaatcacgcctcagcttgaattgccatttctttttccgcttcttgtcactgacctgtctcttctctttgacacccgagaagctctcggngccagattttttggatctatcagaagcaaacttnctcttgtgactcattttcttggtttgttcgcgatgctcttctttcccacctctatttgtttcactgctctcagagccatcaatttctttggtagcattattcttatttt

SEQ ID NO: 29013 - DNA, 492 bp, Zea mays
  Clone ID: cC-zmle189093f02d1
gtggcggaaaggcttgccgtacatggaggctcatgctgaaccatacttttttcacttggttgctggtgatgtggtgtctggcgcactaatcaccttttctggggttgagaaggtggggaacattgttcatgcattaaggttaacgggccacaatggtttccctgtgcttgatgagccacccataacggaaaccccggaactggttgggcttgtgactaggtctcatttattagttttgctgaacagcaagaatttcatgaagggacgggttaaaactagtggtagcttcgttctgcgaagatttggtgcatttgactttgcgaaaccaggttcaggtaaaggtttgaaaattgaggacctggatttcactgatgaggagatggacatgtatgtggatctccacccgatcacaaatacatcaccttacacagtggttgagacgatgttactggcaaaagcagcaatccttttccgggaacttggtttgaggca

SEQ ID NO: 29014 - DNA, 281 bp, Zea mays
  Clone ID: cC-zmle189093f03d1
aacctcaaaaaaaacaaaaaaaccaaaaaaaataattaaaaaaaaaaaaaaaaaaaaacctcgcacttttaataaaaaaaaactaaccctccccaccaataaaccccttatacaacaatcaataaaaaaatctccccccatccttaataaacatcattcaccacaaacaaaattcctctttaatacaaacaaaatacaccttacatattcttttaattccccctttatcacatataaactttaacttcaatcactacaccaaccacacaattacattttaa

SEQ ID NO: 29015 - DNA, 502 bp, Zea mays
  unsure at all n locations
  Clone ID: cC-zmle189093f04a1
aaactcctaacctctagaccgcccgccctttttttttttttttattctcttttttttttttttttttttttttagtttgttttttttttaatttcataacccaccccccccaaaataaaacccaaaaaaactccaaaaaaaaaaanataccattccattacatttaacaaccaacacaaaacaaaataaaacaaaaaaaaaaaaaaaaaaacaaaaaaaaaaaaaaccaaaaccaaaaaaaacacataaaaaaaaaaaaaacaaaaacccaaaaaaaaaaaaatcaaaacaacctccacccccccaccaaaataaaaaaaccaccaattcacaacccctttccccaaaatcacattaaaactcacccttaacctatttataccaaaaacaaccccttaaaaaaataaaaataccctcaaaaaaacaaaacacacctaaacctaaaaaaaaaaaaaccaaccccaccaacacaattaattgaaccaccacaaaaccttttaaa

SEQ ID NO: 29016 - DNA, 601 bp, Zea mays
  Clone ID: cC-zmle189093f04d1
cgcggacgcgtgggatttcccgtctccacttgttcctcctctgtgttttcgcctttccattcctccaccggcgctcgtccgccaactccgtcgagcattaccgtcagagggcggcggcgcggcgcggcgccgccggcgacggggaccgcgtgaggcaggctcccctcaaggctcgtcctcctcgtcgggaggcgtcgccgttgccccgccctctgggctggcgcggcgtggaggggacagctggagatccgcccgtctctgcttggattgcttccttctcccgcagagggtatgagcaatgtactcaccaaaaccagagtctagttttggcccaaatcccaactcaggtacacaccagcagcaaatggaattaactggggccaacatgggtcctggtaatggagcaaataacaataccaacatggctgggaggcaacgcttacgctggacaaatgaactgcatgaaagatttgttgaggctgttactcaacttgggggtcctgatagggcaactcctaaaggagttctgagaattatgggtgtaccaggattaacaatataccatgtaaaaagtcacttgcagaaatacagactagcaaag

SEQ ID NO: 29017 - DNA, 384 bp, Zea mays
  Clone ID: cC-zmle189093f05a1
taagcttctatcctctagaccgcccgcccttttttttttttttttttatcttttttttttttttttttttttttagttttgtttattttaattttttttttcttaactaaaaatttcatttaaatttttatcaaaatacatcatttataaccaaacctaaaaaactccccaaacaccattcgcccaaactttacacccaacaaattattaaaccattctctttttaaaacacacaatttttcaaaaatataaatctaaaaaaaaataactctcacaaaacaaaaacaacacacaccactaaattttattaaaaaaaaatattccaaaaaaaaaaaaaccctaaaaaaaaaaataaaccatccggaccttaataaaaaaccttaa

SEQ ID NO: 29018 - DNA, 426 bp, Zea mays
  Clone ID: cC-zmle189093f05d1
gtccgcccacgcgtcctaaaaaaaaaaaaaaaaaaaaaaaaaaaataataataaaaaaaaaaaaaaaaaaaaaaaaaaagacaaatttttaaaaaaaaaactaacaaaaaacaccacataacccacaaaacacacaaaactccaataactcctcatattcgccccctcttttaaacatccaaatttcccccctcccccatcccaattctttttcctttctttatctccccaaaaatttacatcatcccccttttttttaccccccttatttctaaaaaccccttccgccccccactttaaatccctttcacaccccccctttttcccaactatcctaaaacaaaaaatccccccccccggcccccttcccccatttttctcccctcaacaacgaaaatacccccccccctatcccccccataaaac

SEQ ID NO: 29019 - DNA, 247 bp, Zea mays
  Clone ID: cC-zmle189093f06a1
aaaaatcatcttttttattggtaagctcaatttttcaaaaaatccaaaccaaccccctcattataaaacccaaactactaattctaaccaaaaccacccacaaacataccatcaactaactccgcaaccaaccactcaaaaaaattcattacactctacaccaggcatttttccatcactttcatgaaatacttccctaacatcacatacattccctttcaggtacacaccacaccatcattcaatg

SEQ ID NO: 29020 - DNA, 296 bp, Zea mays
  Clone ID: cC-zmle189093f06d1
cgtaccacagggaaaaaaaaacaaaaagaaaacaatttgtatagataaacggaatacaaaaaggtgggaagacaggttttgaaaaagaagcttgcaaatctcccgactatgctacccaacctcttacagaaaaaaatggcaaaatggggggaagccagaccacttaatggatctctagcaccgcgcattcaagacagaaaggcaaagaaacgggcccgattttaacaaatgcgcaccattgtactggagccctcagaaggcacacgcacgcccataccaacacctgttgttcctgg

SEQ ID NO: 29021 - DNA, 303 bp, Zea mays
  Clone ID: cC-zmle189093f07a1
ttttacgttttactatacacgaaaaaccactatcggggagggaatcttattgaactaatttgcacacgatctgagctcgtgaacgtacaattgacaaattctatgaccggtgctcaatcatgcaactacagacattcattgcgaactcatgcaactaataacgcacctggttgcctgccgaatgactgttcacctaaccctggtctgagaatctcttccttcgctatcatgacctatgactgaccacgccatctatgtgctctatcatccatgatatgacccaccaccaatctcagacactac

SEQ ID NO: 29022 - DNA, 423 bp, Zea mays
  Clone ID: cC-zmle189093f07d1
cgggaatccatacaagcactcacacgtcacacgggcactgcttttttacacaccaagcgaatgaaaccaatcgcggtcgtaccaactaggtggactactcagtcgtaggattctgaagtacatagactcattgctcttcttagacacggcacggtgggatgcatccaacatgacgtacacaaggagaaattcgaggaggttcgacacttatcttacacgccggcactaaccaccaccacacaccatggacaccaccgtgatcacggctataaggtgccctagaccacagtcgaagaggacatcaacacctgcaccgttaaggtccacgatcacacagagagcttcctcaccaaggctaactgagccgcccggctggcggcattcactcccagacctgcttgcctgcgtaccttatgtatgtct

SEQ ID NO: 29023 - DNA, 463 bp, Zea mays
  Clone ID: cC-zmle189093f08a1
tttttcatttggaagtagagtatatatatcacatggtgaggtcaaagatcactggtcacaccaccacacgtccacaaatatatatatgcaaccatttccccctcaaaaagccaaatccagctttgagttcgacaatccataaacaacgccacacttggcacgttcagctgcttttcttggcgaagagcccgccgaggccgccgaggttgaaccccccgccgctgccgctgtcgtcgccgccggtagccttcttgccgccggtcgtcttggcgcgggaggcggcggccggcgcggcgccgaccttgttgaggagcggttccatctccaccagctggtccttcttgaagatgaagccgaagatggtctcgccgaggcccttctcctccttggccggcgccgggccgcccctgctggcagcgggcggcacgaccagctacggaccggcgcgcccgccgcgtcctcc

SEQ ID NO: 29024 - DNA, 512 bp, Zea mays
  Clone ID: cC-zmle189093f08d1
gggcgtctctggcgttcggcagcaccgtagcggcggccgtgtgtgtctacctcagggaggacgcggccggcgggccggtccgtgctggtcgtgccgcccgctgccagcaggggcggcccggcgccggccaaggaggagaagggcctcggcgagaccatcttcggcttcatcttcaagaaggaccagctggtggagatggacccgctcctcaacaaggtcggcgccgcgccggccgccgcctcccgcgccaagacgaccggcggcaagaaggctaccggcggcgacgacagcggcagcggcggggggttcaacctcggcggcctcggcgggctcttcgccaagaaaagcagctgaacgtgccaagtgtggcgttgtttatggattgtcgaactcaaagctggatttggcttttgagggggaaatggttgcatatatatatttgtggacgtgtggtggtgtgaccagcgatctttgatgtcataatgtgatatatatactctacttccagctgc

SEQ ID NO: 29025 - DNA, 323 bp, Zea mays
  Clone ID: cC-zmle189093f09a1
attctattttctagcccgccctcccttcattacctttcttttgatctcccaccaagcggaagcctccaatgggttgatcttttataatatacttctccacctagaaacaatggacccgaaacgccattattactccatttgtacggtcacaaactcataaagctaatccatcaacatcatccacgctatctgaatcatggagaactcactctccccatccccttttattacccattttttcgagttactttactaggcaacaatcccttccatctgaacattcacatatcttaacttcatctgcctttccacaattcgcaact

SEQ ID NO: 29026 - DNA, 190 bp, Zea mays
  unsure at all n locations
  Clone ID: cC-zmle189093f09d1
cacactctacccaacgtaaataaattcgaatagaataacgaaccttaggccgaaatgttttttaaaannatccaccttaccccccccaaccaaacatnccctaaatactaaaatcattattgaataaccccccccacctcccttttactacccaacactttacatttattaaatataactaacttttact

SEQ ID NO: 29027 - DNA, 389 bp, Zea mays
  Clone ID: cC-zmle189093f10a1
ttttacgttcaatgagcttaatcactattctgggggtgggttcttatatatatgtgtgcacttatataaactccgaaaatgctatgattgtggctggggatggatgccccccattgcccagtgcccaccatctatgaatctatgatgtccagtccagctgcagttggagcggcacgccgggcgtggggtggaggacctgcgcctcgggaagcgcctccgatagcagggcctggaaggactgcgtcgtcccctgtttggtgagcacggttgccaggagtccgccggcgtccacgtcgccgttgctcatgggtaccacgtacctggctcgcagcagcctggccaggtccaccgcgtcctcctggccggagacgacggtgaagttggccggg

SEQ ID NO: 29028 - DNA, 495 bp, Zea mays
  Clone ID: cC-zmle189093f12a1
gctcataacatgcattccaaatggaagggatggattctgcattattatgatgctaaatgacaaaattgataccaattcaagctccagatattatttaaacagcagaacattatgaaagtaacagaacaagagggttcccgccaaaaattgtgactaaggaacatttacctcaagaacaatctagctaaagacttcataaaacttctcaatgacaagtaaacccgagtcaatggattcaagcggatccttgcggagccgatgcctcaagcagtttggaatgacagtagcaatgtcctccacggtgacgctgtcccttcctttcaacgcagccagcgccttggcagccctgttagtcacaatgtcacctctgagtccattaacgttcaactcagaacacaccttggatatcttgaacggaggtcatggtcaatctgcacagcccaaggttactccgtgcagatgatatctgctgctggagcttctcctgctcgtcat

SEQ ID NO: 29029 - DNA, 476 bp, Zea mays
  Clone ID: cC-zmle189093g02d1
tgaatccaccaaaggttggggacgaatcatatgcttcctacttggcagagaaagatggaatccttcaggggtggctcgccgtgcaaaggcactggaagatgcattcaacacgcttgagggattttcatgtaacaaggctgaaggagcaatgtaccttttccctcagatccatctgccacataaggcaattgaggctgctaaagctgccaagaaagcacctgatgcattctatgcgctccgtctccttgaatcaactggaattgttgtggttcctggatctggatttggccaagttcctggaacatggcacgtcagatgcacgatcctgccgcaggaagacaaaatccccgcggtgatcacccgcttcaaggctttccatgaggcgttcatggctgagtaccgtgactgaactgttacagtggctgagtaccatcgtgtagaccgaaacaaaataaagctccactctctctctctct

SEQ ID NO: 29030 - DNA, 109 bp, Zea mays
  unsure at all n locations
  Clone ID: cC-zmle189093g03d1
ggggaaaaaaaaaaaagngaaaacccaaaaaaaccacaaataatagatcaacccacccaacaaaccaccacctcgccatttaaaaaaaacaccccccccaacccccccc

SEQ ID NO: 29031 - DNA, 517 bp, Zea mays
  Clone ID: cC-zmle189093g05a1
gaacaagccctcaatgagaatgggtaggatcaacactagcatagttaccacagcaagcacaagtcatctcattacccaaggcaatggtaggttaaaggttggactagaactcggatcctagagatggatcggagaatgcacaaggaacagaagaacatacgtccccgataacagtttcatgggcaacaccacaatcgtctgcatttagccagtaacgccgaacatttcatcccatggcgtacttctgggtccagctgcgggctgtcgcctcgtacttaggccgatccgtcttgtacatgtgagcaatctcagggacaagagggtcgtctgggttgggatcagtaagcagggagcagatagaaagcaaaaccttagagattgtcaaagcagggctccactgctccttaagaatgtcaagacatatgcttccattactattgatgtttggatggaagaccttcgtcttaaaagatacctttggaggcttgaaggtgtaagtctggcgggaaatgaatgt

SEQ ID NO: 29032 - DNA, 579 bp, Zea mays
  unsure at all n locations
  Clone ID: cC-zmle189093g05d1
cggaggccacaggccaccaccattccttccttgttccttccttagtttcgcaggctgctcatcgccctccctcgggggcctcgatccagatccagatccaggggcttgtcatggcatccaaacgtatcctcaaggaattaaaggacttgcaaaaggaccctccaacatcatgcagtgcaggtcctgctggtgaggatatgttccactggcaggcaaccatcatgggtcctcctgatagtccatatgctggaggtgttttcttggtgaacattcatttcccgccagactaccccttcaagcctccaaaggtatcttttaagacgaaggtcttccatccaaacatcaatagtaatggaagcatatgtcttgacattcttaaggagcagtggagccctgctttgacaatctctaaggttttgctttctatctgctccctgcttactgatcccaacccagacgaccctcttgtccctgagattgctcacatgtacaagacggatcggnctaagtacgaggcgacagtccgcagcttgacccagaagtacgccatgggatgaaatgttcgggcgtactggctaa

SEQ ID NO: 29033 - DNA, 361 bp, Zea mays
  Clone ID: cC-zmle189093g07a1
ctaagcattcatcctctagagcgcccgcccttcctccccccttttttttttccccccttctttctttttctcttcccgtcagcttaaactcattttacccactccatccccaaacaactaacaccaaaaaatttaacacactcaatccccaaaaaaaaaaccaaaaaaacaccaagagaaaacatacacacaaaaaaacagggcaagccaccccaaaaaaaactcccaaaaaacaacaaataaccacacacaaaaaacacacatcaacacacccctctcccaaacccccacaaaaaaaaaatatctcaaaaccacctaccccccacaccacatagtaactcccccctcaaacaatctaaaa

SEQ ID NO: 29034 - DNA, 430 bp, Zea mays
  Clone ID: cC-zmle189093g07d1
tgcgcgtaataagtggaaagggaggacatgctgcacttcctcattattttatacatccgatattggctgcctcaaaggttattgtgagccttcagcaacttgtttctcgagaagctgatcccttggactcacaggttgtgacagttggaaagtttcaaggaggtggagccttcaatgtgatccctgattcggtaactataggtggcaccttccgagcctttctgaaagagagttttaatcaattgaagcagcggattgaagagtgtggactgtcgtgcagaggagactgcgagtggacctcagtaagctactctgtttctcatgtctcacgtgattgtgtctcaagctagcgtgcagcgcttcatcgctgccgtggactttctcaacaaggaccggcctttctttccgccgaccatcaacaggcccgagc

SEQ ID NO: 29035 - DNA, 462 bp, Zea mays
  Clone ID: cC-zmle189093g08a1
ccctcccccccttctcttctccccccccccctccctttttttccgcccgtttcttttttcttccccccccccacacccacaccccccccttaaatataacaataccctccaaaaaccatccgcccccccaaacccccccccctaacaacccaatcatgtaaaaccccaatcaacctcaatcccaacctccccccctccccaaccccaaaaataacccaatatcccaaaccactcccaccaactacaaaaccataaatcccaccctcctactgtacaaccaccaaactcccaaacaactttcctcctccaccccacactcaaaaaaccccccccctcccctaccaaattccccctccccaccaccttacccccctgacacccccaccaccaaccttcccaccccttaccccccccccccccaaaacaaacaccccccccctatcaacccccacccccaccttt

SEQ ID NO: 29036 - DNA, 175 bp, Zea mays
  Clone ID: cC-zmle189093g08d1
ccgcccacgcgtccgaaaaaaaaaaaaaaaaaaaaaaaaaaaaaaataaataaaaaaaaaaaaaaaaaaaaaaaacatgtaattttattaaaaacaaaacctccatacccctccaaaaaactacatcccctttcaatagttcccccttttttaagggcccaaccctccttccccc

SEQ ID NO: 29037 - DNA, 218 bp, Zea mays
  Clone ID: cC-zmle189093g09a1
gtcgccggccaccgtttcgtttagggccgcgaactcgggcaggctgatgaaggcgtcgccgtccgcgtccgcctcggccatcatgcgcgccacctcgtcgtccgacgcgccgtggcccatgctctcgaacagcgccgccagctccgaccgcgagatccgcccgtcgccgttcgcgtcgaacttgcggaacacgcgcgccatctcctcctccgccgtcg

SEQ ID NO: 29038 - DNA, 216 bp, Zea mays
  Clone ID: cC-zmle189093g09d1
acggcggaggaggagatggcgcgcgtgttccgcaagttttattcgaacggcgacgggcggatctcgcgggcggggctggcggcgctgttcgagagcctgggccacggcgcgtcggacgacgaggtggcgcgcatgatggccgaggcggacgcggacggcgacggcttcatcagcctgcccgagttcgcggccctcaacgccacggtggccggcgac

SEQ ID NO: 29039 - DNA, 350 bp, Zea mays
  Clone ID: cC-zmle189093g10a1
gagctcggtttttttttttttttacctttcgcaccaaaccttgaaataaaatctcttaatttaaaatttccccccgttggcacacgagaaaaaaaacctccctccctgcttattttttttttttccatcaaattttaaaaccaccctttttatttccttcccgggccgctttttttttttccaaaaaaaacaaccgcccctctaacggtattacttacaaaaacaaagagatgcctacccccttaaaccgctctagaactaccataacacagtggaccccaagtgaaatctctccccaacccacggggacacttaatgtaacaaaagaaactcttgtctctccaggtcat

SEQ ID NO: 29040 - DNA, 409 bp, Zea mays
  Clone ID: cC-zmle189093g12a1
ggaaaaactgccattgcggagtggagccatggcagattaacacgtaaggctttgtttggacactctagtattaatcctaatccacatatggtaaacgtaaattagtgtgtaaattagtttaagttacactccaatctacttcaatacatatggattaaagtcaatactagagaatccaaactacgcctaatgcattttttgcactatcaattggcaagtgatcttgcaatacaatataagcatattcgagtggaacaaccagcttcagttccttagatttcacgcgcttgtgctttgagccgtaggcaactgcaatcggtttcttgaacagcgaagcatcggaggtctggtaactggccaaaaataggtatgccggagcagaatattgtgtatgtgtatcttgtttaga

SEQ ID NO: 29041 - DNA, 525 bp, Zea mays
  unsure at all n locations
  Clone ID: cC-zmle189093h01d1
catcagatctagcagaactctctcgacctcatcggcgtttttggagcgcgtgttgaccggagatggcgcggggcgggtggaggaggagcgcggcggcgcgggtcgcctggcgcccggccacggtttgcctgtggctcgcgctcgccgccgccgcactgacgctcgcccaggctaagaaggacctgacggaggttacccacaaggtctacttcgacatcgagatcgacggcaagcccgcaggccggattgtcatggggctttttgggaagactgttcctaagacggcagagaacttccgagctctttgcacaggagagaaaggggtcggcaagagtggcaaagccctccactacaagggaagtaagttccacagaatcatccccagcttcatgctccaaggaggtgacttcactctcggngacgggaggngtggtgaatctatctacggcttgcagtttgcggatgagaacttcaagatcaagcacactggtccaggccttctgtccatggccatgccgggagaga

SEQ ID NO: 29042 - DNA, 394 bp, Zea mays
  Clone ID: cC-zmle189093h02d1
ggcgaccccccgtgcgacaagggtctgacggcgcgagagattccttctgacgatctattatttctcaatgttacccgtgttttgggcggcgtgaagctccgatttggaccaagaagaaacactcagtaacttagaaacaatattgtccctgatacgatgcaatcagtaatttgtctttgttaggtttctggatgcgaaggcatgtttacagtccgaaaaaccaaggaagttcatcaggatgacgtaaagcagaaccaccaggcatttgaggggcatggcaggtgtgggaatcaaggtccggaaacggaagccagttgtttccagggtttttctcgagaaatctttacctgccaagcctgaagacctgaactcggatgcactgcgttttgatttg

SEQ ID NO: 29043 - DNA, 95 bp, Zea mays
  unsure at all n locations
  Clone ID: cC-zmle189093h03d1
gtccgcccacgcgtccgcggacgcgtgggcggacgcgtgggaaatcatccacggacctggtggtgagattgacgattagcntttatttgggggga

SEQ ID NO: 29044 - DNA, 343 bp, Zea mays
  Clone ID: cC-zmle189093h05d1
cggccacgcgtccgaacaaggaatccccctatgactcatcattcgtatctcctactctctctcgcctctgcctccgcagttgttttcaccatctactcactaaaccccttcaaccagcagttgctttctcgcaggatattacaacgatctctagcttaactcaaaattccacttactgagcttcgtgcagacgatcaccaagttctacacagacccccacaagcactcgtaccgcttgtacggatccaaggtcaacctgctccgcgcgcgccgtaaccagatgatggacccgtcggaggagcacggcgtcactaagatctactacctcaccccggcagagttt

SEQ ID NO: 29045 - DNA, 260 bp, Zea mays
  unsure at all n locations
  Clone ID: cC-zmle189093h06a1
atctatcttatttttttcttgtgtgattttttctcatcgactcctccacacataaacaatggcccccaaaggccatgattacaccaatatcactgacactaactcatnaaggttatccagcatcatcagcgaaactgactgaatcatggcgaactcacacaccaatcgcctacattacccatttttcggtacaaacacagcttatccttccgctcctaccatcctcaagctaagcctgtgacattctaatcttttccatc

SEQ ID NO: 29046 - DNA, 192 bp, Zea mays
  Clone ID: cC-zmle189093h06d1
tgggaaaaaaaaaaaaaaaaaaaaatcaaactaaataaaaaacaacacaaacaaaaaatataccccgcttttttttttccaaaattcccacctcactcctaccgacctactacttatcttatcttcccatcaacatccccccaacagcccaacacttcaactttttctacctcttcaaaccctgctctaacc

SEQ ID NO: 29047 - DNA, 486 bp, Zea mays
  unsure at all n locations
  Clone ID: cC-zmle189093h07a1
agtagattttagatgatcccttccccggcgcgcatcagggctatgggggcgaggcttggcggatcactaaactagaaggcccgtgcgtcggccgtgccggcgctggccatcatcatgcgcgcgaagtcctggaagccgacgaagccgtcgccgtcagcgtcgacgccgccgatcatgcggcggcagtcgtcgaggctgcacccgccgccgaggacggcgtccaggacggcgcggagctcctcggcggtgatgcggccgtcgccgtccgcgtcgaacacgcggaacgcctccatgaggtcgccgtcggcgtcggcgtcggcgtcgcacggcgggggctgcgcggcgagcgcggccacggcgtcgagctcggcgtcggacggctccgcgtggcccaggcgccgcagcacggcctccagctcccgcgnngggatctccagcgccggcgccggcgccgccgccagcacggacgcggcgtcntggtggcgg

SEQ ID NO: 29048 - DNA, 525 bp, Zea mays
  unsure at all n locations
  Clone ID: cC-zmle189093h07d1
cggccacgcgtccgcaaagcccctcggatcggatccggtcttttttgtgtcccattcgccacgcagcggcgccacgttggacggagacggagatgaagctgtccatccagtcgctcgccaggaagctgtccctgccgtccccgaagcggggcggcggcggcatcgtcgaggacgggaagaagaagaagaagcgctcgctgtcgcgcggcgaggcgccgtcgttcgcgtcctcttcttcctcctcctcctcctcctccgccaccacgacgccgcggtccgtgctgctgccggcgccggcgccggcgctggagatcccgcggcgggagctggaggccgtgctgcggcgcctgggccacgcggagcccttcgacgccgagctcgacgccgtggtcgtgcttcgcgcgcagnccccggcgtgcgacgccgacgccgacgccgaccgcgacctcatggaggcggttcgcgtgttcgacgcggacggcgacgggcgcatcaccgtcgaggagctccgcgccgtcctggacg

SEQ ID NO: 29049 - DNA, 533 bp, Zea mays
  unsure at all n locations
  Clone ID: cC-zmle189093h08a1
ttttgggatgaacagaggtttgttatttgccaacggattgcacacatgattggcattccacacgcaaccgatcgatatgacgattatactcctatttattaacacccagctatatatatatagccatgtctggagtctggactagcaagcaaccgagatcgatgatacagagatagattcatcggtttgcatgagcatgacttgttggcagccactatgttacaccaccatccaccaacgcatgtacaaagttctgcatcatcatcgcatcgcctccgcctgatgatgatagtatcagtgcagcgccgtcaggacagtagacccttccaccaccttgaaagtggcaccgcagatctcttcttcgtcggcggggacagcggtgaccttgtgcttggggtgtctcgtagcacttgagccctccggggcgttggagtagaagcagccttgcgggaacggcgcgagcgacttgccgcatgagcctttgagcatgtcgatgtcgtcggagaaggcgacgcanccgtcggcggtgatcc

SEQ ID NO: 29050 - DNA, 479 bp, Zea mays
  Clone ID: cC-zmle189093h08d1
cggccacgcgtccgaccaaccaggcgctcctgccccaggtcgtttttggccaaggacgaggtgttctgcctgtgcggaggggtgctggacaacctgggtcgtctgagccagcagcacgggctgtcaagcaagggcgccaacgaggtgctcctcgtcatcgaggcctacaagacgctgcgcgaccgcgcgccctacccggccagcttcatgctcgcccagctcaccggctcctacgccttcgtcctcttcgacaagtccaccaactccctgctagtcgcatccgaccccgagggcagggtgccgctcttctgggggatcaccgccgacggctgcgtcgccttctgcgacgacatcgacatgctcaaaggctcatgcggcaagtcgctcgcgccgttcccgcaaggctgcttctactccaacgccctcggagggctcaagtgctaccagaaccccaagcacaaggtcacccgttgtccccg

SEQ ID NO: 29051 - DNA, 433 bp, Zea mays
  unsure at all n locations
  Clone ID: cC-zmle189093h09a1
ttttgggcttcataacaaccgatagcaccttactgaccggataggatccaaccagagtgcaagcacttcgagtacatggttacaattcgaggggagggggggtggtccagggaatactagctatgagcatgcaaaaaaaaaacacttataaagtaagatttaagataagagataagagtgagtaagagacattaacacaactcttgcacaagccttgaagatagtaacacaactcctacacaagcatctgttgcttcactttgccgtattacttcctccgttcttttttatttgncatgttttagttcaaaaataaactagcggacggcaaatattcgaaatggaggtagtattgcatcccttggtagttggtatgcttggtgacacttttgatcactttgccgactttcagcaacanaacatgaagtataat

SEQ ID NO: 29052 - DNA, 442 bp, Zea mays
  Clone ID: cC-zmle189093h09d1
cgcggacgcgtgggcagaaaggcgtccaacaaagcacatgcctacatctgaacagtggaccaatgtgttcaacgcgtgcgtttcatattatgcgtactactgctatgctaacttattcaccctaaacaagctgcgtgagtcaaagggaatgaccactatcaaattccgtccacatgctggagaggctggagatgttgatcacttggcagcgacatttcttctctgtcacaacatatcacatggaattaatctaaggaagtctcctgtgcttcagtacttgtactatcttggtcagattggtctggcgatgtcctcattgagcaacaactccttatttcttgactatcatcgcaaccctttttcaacgttcttccaacgaggtctgaatgtctcattatctacggatgaccctttgcaaattcacctgacaaaagaaacaatt

SEQ ID NO: 29053 - DNA, 249 bp, Zea mays
  Clone ID: cC-zmle189093h10a1
attatataaattttataatataataaatttaaaaatctacaatttacatttggaaccaaacgaagaaaaaaaaaaaatttccccaacataaaaataaaaaaaaccaaaaaaaaaaaaaaaaacaaaaataaaaaaaaaaaaacacttttaaaaaaaccaataaaaaaaaaaacttctaataacaaaaatatctacaatgacaaacaaatccctcacacaaaaaaaaccactacaaactcccataacaca

SEQ ID NO: 29054 - DNA, 285 bp, Zea mays
  Clone ID: cC-zmle189093h11a1
gtggataaaaacattatctttttggggttgtttcatgtaaacccatgattttcgcaagtagtcaaacgcgtccttagcacagacagctactgtgatctgggtcgacggcgtgacgctacgttcagtagcaatgtagcatacatcgtccgcagtctcgcgatggaaatggtatgctttgcccatctacgtacctacagtcctactatacactactacagtggcctgatatataccagtgccatgggggtggtcacagcttctccaccgggaagccgatgacgggct

SEQ ID NO: 29055 - DNA, 329 bp, Zea mays
  Clone ID: cC-zmle189093h12a1
ggggagaaggctttattattagcggatgatactttttatgcatcaataggcctctcccacctcacattagtctcaacattgacttcatattatacaacccctaaaaaggccgatcggctgcaacaattgaaacctaaagactacgtcaagcgcttccctcttgcgatatcatcagtttgctggaaccttgtagcttccgcactgcaaaccatgctcaaatcgcctcttacactgctcaacaacatacacaaccttttccatgcacacaaccttttcagtttctttggtgaccttggaacacaaacaacaaacctttgccttcttgatga

SEQ ID NO: 29056 - DNA, 701 bp, Zea mays
  unsure at all n locations
  Clone ID: cC-zmle189094a01d1
agaagaaaacaaaaaaaaaaaaatnntttaaaaaaccacaaaaaacaaacaaaaaaaanggggntttaaaaaaaaaaaaacaaccatcaaccaaaacaaaataaattaataaaaatatcataaaaaaaaaaaaaacaaaaaataaaaaaataaaaaaaaaaacaaaaaaaaaaaaaaaaaaacaaattaacaaaaacaaaaaaaaaaaaaacataacaaaaaaaacacaaaaaaaacaaaaaaaaacaaaaaaacaaaacacataaataacaaaaaaaaaaaacaaaaacaaaaaaaaaacaataaaaaaaaaaacaaacaacaaaaaaaaaaaaaaaaaaaaaaaaacaaaaaaataaaaaaacactaacaaaaaaaaaaaaacaaacacatacaataaaaacaaacacaaatacaacaaacacaaaaaaaatccaaacaaaaaacaaaataaacataaaaaaataaaataacaatataaaaataaaaaaaaacctcaaaaaacaaaaaataaaaaaaaaacaacaaaattaaccaaaaaacaaacaaacaaaaaacaaaaaaaaaaaaaaaacaaaaaaaatcaaataaacaactaaaaaaacaaaaaaaataaataaaaacaaaaaaaataaaaaccaaccaaaaaaaaacaacaaaacataaaataacaaaaaattacaaaacaaataaaaaacaaa

SEQ ID NO: 29057 - DNA, 69 bp, Zea mays
  unsure at all n locations
  Clone ID: cC-zmle189094a02d1
gggaaaaaaaaaaaaaacaaannnttaaaaaacaaaaaaaaaaaaaaaaaaaaannngggggtttttat

SEQ ID NO: 29058 - DNA, 581 bp, Zea mays
  unsure at all n locations
  Clone ID: cC-zmle189094a03d1
aaaaaaaaaaaaaaaaaaaaaaaaaaaaaaaannttttaaaaaaaaaaaaaaaaaaaaaaaaaaanngggggtttaaaaaaaaaaaccccccaacaaacaacaaaaaaanaaaaaaaaaaaaaaaaacacaaaccaaaaaaaaaaaaaancacaacaaaaacaaacaaacaaaaacaaaaaaaaaaaaacaaacaaaaaaaaacaaaaaacacacaaaaaaaaaaaaacaaaaaaaaaaacacacaaaaaaaaaaaaaaaacaaaaacaaaccaaaaaaaaaaaaaaaaaaaaaccaaaaaaanaaaaaaaaaaaaaaaccacacacaagaaaaccaaaacaacaaaacaaaaaaacgaaaaccaaaaaaaaaaacaaaacnaaaaaaaccaaaaaacacaaaacaaaaagaaaaaaacaaaaacataacaaaaaaaaaaaacaaaaaaaaaaataaaacaaaaaaaaaaaatacaaaaaaaaaagcaaccaacaaaaccaaaaaaacaaaaaaaaaaaaaaataataaaccaacaaaaaaaacataattaaaaaaaaaacaacaaaaacaacaaaaacaa

SEQ ID NO: 29059 - DNA, 534 bp, Zea mays
  unsure at all n locations
  Clone ID: cC-zmle189094a04d1
gggacgcgtgggctcgccggcaaaacctatgtgtctgngtactccattactaaggatgacattaaggtcttcgccncttttctcgacgaagcctggcgctgcctcccctaatgccgcccgctggtacgagaccgtctctgcggctgtagcctcaagattccctggtaaggctgttggtgtaaatctgcctgcgggatcagctcctgcggcagctgctcctgcggatgaggctgaggatgatgatgaccttgatctttttggtgatgaaactgaggaggacaagaaggcagctgatgagcgtgctgccgctgccaaggcctcttctaaaaagaaagaaagtggtaaatcctccgtccttatggatgtaaaaccatgggacgatgagactgatatgaagaagctggaggaggctgtccgcagtgtccagatggagggtctgacttgnggagcatcaaagcttgtgcctgttggatacggcatcaagaagatgactatcatgttgacaattgtcgacgatcttgtgtccatcgacac

SEQ ID NO: 29060 - DNA, 306 bp, Zea mays
  Clone ID: cC-zmle189094a05d1
gcaacaaaaaaaaaaacaacaaacaacatccgccacctacaacaaaagacaaaataagctaaaaaaatacaaagaaaagataacatcaacacaaaacacaacaacaaccaacaaccacaaaaaagaactgaacacccaccaagaacaagcacacagatgaaaccaaaaatcgccaaaaactccaacaaaaaacaatcacgcaaaaaaaaaaaaaagagaggcgaccgatcaaaaaaatccaaccaaacaaaccctgcaacaaaaaaaaaaaaccataaacaagaaaacaaaaacaaaaccatgaac

SEQ ID NO: 29061 - DNA, 356 bp, Zea mays
  unsure at all n locations
  Clone ID: cC-zmle189094a07d1
cgggggcgataaaggagtaccggnacgcggnggacgggcnctacattttggcggcgaccaagaagngganggctggctacggtgccatctactacgccgacgaccgcgcgccggcgagggacagcgagctgcaggggtggtggagcgaggtcaggaacgtggggcacggcgacctggcggacgcgccgaggtggccggcgacggactgcgtcgccgacctcgtggagacctgcgccaccgacgtctggctgagctcggcgaaccacgcgtacatcaggttcgggcagcacgactacctgggctgcgtaccgaacgggccctacatgaccacacggccagggccgggcccggacgcc

SEQ ID NO: 29062 - DNA, 454 bp, Zea mays
  Clone ID: cC-zmle189094a09d1
acaggcaattcagattaaagacagcgacataggtttcggcaatgttggatctgagttaccagtgcgtgggtttgtctttacaggatccatcctccactgccactaagaagctcgggaccggcgtatcatttgataatgccaaggcgctcattgtgtcagctgattctcatgaaggatttcatggcttgatcatcaacaagcgattaagctggggtgtcttgaaggatctggatagctccatggagcctattaagcatgcaccactttactatggcgggcctgctgtggtgcacggctatcattttgtaagcttgtcaagagtatcctccgaggggtgcatgcaattcataccaggcgttaattatgggaacgcattagccacaagccgggtagtcacacggatcacgtagcccaacaatttgtatatggcctgtgttcttcctagggacttggg

SEQ ID NO: 29063 - DNA, 414 bp, Zea mays
  Clone ID: cC-zmle189094a10a1
tctctttttttttttttatatagcatcaaaattatggaaggaagagtagcactgattattgttacatgacgaaggttgagcatccatggaggctagattatagacagacaccctgattttacatgacgaatcgcaagaagcgcatgcattggatatccttagccggagagggcgctggtgttgtagacgaggagggcgccgccgccgaggatcccagcgagggtgacggcccagatcagaagcccagtggttccaccgacgtaaacgtcgccggtgggagaccagtcatcctcgttgtagattgggctgtatccgtcgacgttcgcgccgtacttgtcgacgaactggtacacgcccttgcccttgccctttctcccgttggcgtcgacgtcgacggtcaggccacccccaatc

SEQ ID NO: 29064 - DNA, 584 bp, Zea mays
  unsure at all n locations
  Clone ID: cC-zmle189094a10d1
cgcccggcgagcgagagcagcacacactgcacgcagctagctagttgcatttgcagcggcggcgatggcggcctccaggatctgctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctnctcgtctacaacaccagcgccctctccggctaagatatccaatgcatgcgcttcttgcgattcgtcatgtaaaatcagggtgtctgtctataatctagcctccatggatgctcaacttcgtcatgaaccataatcagggtactctcattactaatttgagctttnt

SEQ ID NO: 29065 - DNA, 455 bp, Zea mays
  unsure at all n locations
  Clone ID: cC-zmle189094a11a1
aggggcgccccccccccccnttggatgccacaaacccagcacaaaaacnnnagacggtttatagggatacgcactccacacaccgtgcaaacaacgaggggtgttgattgaaggctgcctgcttgggcaaggatgacggacggaggaccatggaaggagccatcggatgtgccgctgaggattaggctaatggatcttgcagaccgagattaacggggaggaagtcgaggaacctgtacttggtggcgcccttgtccggggacactgggactcacttcttgcaggaggcgccgcactagttgaggaggtcggcggaggtgcacacacacaaccagctggtgcactcgccgcaccagaactgattctttggcgttggccctggagggcctttagccacggacgcagagaccacaagggcctggagaactaggatcgccaacagagtgctgctcttc

SEQ ID NO: 29066 - DNA, 310 bp, Zea mays
  unsure at all n locations
  Clone ID: cC-zmle189094a12a1
tntttaattaagaagagaaaaaaaaaaaaaaacggncgggatttttttaaganggggggcggaaaaaaaacccaaagaacaaccaaannccnnnaaaaagggaaaacaagaaagggagaaaaagaaaaagggacaagggaaaaaaaaaaaaaagcgaaaaaaaagagggacggggcagggaaaaaaaaagaacgaaaaccaaaaaggagagggggggaaaggaaaaccaaggaaacacgccaaaggggccaagacaggaacaaggacaccaaacacaaacccnccagaaaggaaaaagaggggggggggg

SEQ ID NO: 29067 - DNA, 520 bp, Zea mays
  unsure at all n locations
  Clone ID: cC-zmle189094b02d1
ggtgggagcagctgaaggccnngcgtatctccacagcgatgatgctaaagtcatctaccgtgacttcaanacgctgtttgttttctagatgcgaacttcaccgcaaagctctctgatttcgggctggcgaaggatggtccgaccggcgacaagagccatgtctccactagggtgatggggactcacgggtatgcagctccagaataccttgcgacaggtcatctgaccaccaagagcgacgtgtacagctttggggaggtgctcctagagatgctgtcagggcggcgggcgctggacaagaaccgcccgaacggtgagcacaacctggtggagtgggctaggccatacctgacaagcaagcggcgcatatttcgcatcctgaacccacggctgggcgggcagaactcccttgccagggcgcataatgctgcggggctcgccctggaatgcctctcggtggagtccatgcgcatgcccagcatggacgaggtggacacagcgttagagcatctacaggaca

SEQ ID NO: 29068 - DNA, 432 bp, Zea mays
  Clone ID: cC-zmle189094b03d1
aaaataaaaacaaaaacataaaaaaaatcaaaaaaacaaaacaaaccaaaaaaaaagaacacataaaaaaaaaaaaaatcaaaaataaaaaaacaaataaaaaaaaaaacaaacacaaaaaaaaacaccaacaaaaaaaaaaaaaaccataaaaaaataacaaaaaaaaaaaatacaaaaaaaacaaaaaaacacatacaacaaacaaacataaaacaaaaaacaaccaaacaaaagaaggaggagaaaaaccaaacacaaaaaaaaaaaaaccaaaaaatcaaaagaaaaaaaaaacaaaaaaacttaaaaaaacaaaacaaagcaacaaaaacaaacaaaaaaaaaaaagaaaaaataaacaaataacacacacaaataaaacagaacacaaaaacacaaaacaacacacaacacaaaaacaacaataac

SEQ ID NO: 29069 - DNA, 175 bp, Zea mays
  Clone ID: cC-zmle189094b04d1
ttacacttgatgtatctattactcaaactcatcttgcttcaaatacatctaactcaatttatataaatactgacattgaccattttatatatgaagataataatgcagacaacattaaaataaatgaattgcattcttacattaaatataaaccatttcaaaagattgatcctac

SEQ ID NO: 29070 - DNA, 512 bp, Zea mays
  unsure at all n locations
  Clone ID: cC-zmle189094b05d1
gtgcggatcctaagcaggtcggcgcctacgccgacgccgagaatgccaaggactccgtcggcatccgccccggggggggtaatatgcgcaaccgccggtacatcaaccgcaagggcccgctcgtcgtctacggcacagagggctccaaggtcgtcaaggccttccgcaacctccccggcgtggacgtcgccaacgtcgagcgcctcaacctgctcgaccttgcccccggtggccacctcgggcgctttgtgatctggaccgagagcgcgttcaagaagctcgaggaggtgtatgggagctttgacgcgccgtcgcagaagaagaagggctttgttctgccgaggcccaagatggccaacgctgacctgtgcaggattatcaactctgacgaggtgcagtctgtggttaagccactcaacaaggaggtgaagcgcanggagaagaggaagaacccgctcacgaacatggctgctgtgctcaagctcaaccnctacctcggcactgcccggaag

SEQ ID NO: 29071 - DNA, 381 bp, Zea mays
  unsure at all n locations
  Clone ID: cC-zmle189094b07d1
aaaaaaaaaaaanaaaaaaaaaaattaaattttaaaaaaaaaaaaaaaaaaaaaaaacagaacagataaaaaaaaaaaaaccaaaacacccccacccccgggggggccgcacaaaaggaacaacccaaacccccccgggcacgcacggaacaacccccgcataggggaacccaaaaccaactacccgggccgccctataaaacggccggacggggaaaaacccgggggacaccccactaaaaccccgggaggaacacccccctttccccagcgggaggaaaaaaaaaaaggccccccccgagccccctcccaaaacatggccccccccgaggggggagggggaccccccctctcacggcacaaaaaacacgcggggggggg

SEQ ID NO: 29072 - DNA, 475 bp, Zea mays
  Clone ID: cC-zmle189094b08d1
aaaaaaaaaaaacaaaacaaaaattaaaaaaaataaaaaataaaaataaaaaaacaaaaataaaacaaataaaatacaaaaaaaaaaaatatcaaaaaaacaataaaatatcaaaaaaaaaaaaaataaaaaaaccaaaatcaacataaaaaaaatcaaaaaaaaaatataaaaaacaaaaaaaaacaacaattagtataatgtaaaaaaaaaaaaaaaataaaaattaaaataataaaaaaaaaaaatataaatttcacataaccatttaataaaaaaatataaaaaaaaataaaatatattaaaaatcaataaataaaaaaacaacaattacaacaaataataaaaattaaattaaaaaaatattataaaataaaaataaacaaataacaaaataaataaaaaattcaaaaaaattaaataaaattaataaaataaaatataaacacaaataaaaaaatacataaaaaaataa

SEQ ID NO: 29073 - DNA, 553 bp, Zea mays
  Clone ID: cC-zmle189094b09d1
aaaaaaacaaaaaaaaaaaaagaaagttttaaattaaaaaccataaacccaaaccataaaaaaaaaaaaaaaaataaaaaataaatatataatataaaataaaataaaaaataaaatataaaaaaaaaaaaaataaaataaataaatattaaaaaatataattttaaataaaaaaaaaaaaaaaaaataaaaaaaaaataaaaaaaaataaaaatattaaataaaaaataaaaaaaaaataaaaaaaaaatacaaaaataaaaaaaaaaataataatatatataattaataaatataataaaaaaaaaaaatatattaattataaataaaaataaaaaataataataaaaaaaatataataattaaaaaaaatataaaaaaatcataaaataaaatattaaaaaaataaataaaaaaaatttataaaaaaacaaaaaaatatataatatatttaaaaaaaaaattaataaaaaaaataaaaaattataacaaattaaataaaatatacaataataaaaaatataaaaaaaaatataatataaatcaaaataaa

SEQ ID NO: 29074 - DNA, 195 bp, Zea mays
  unsure at all n locations
  Clone ID: cC-zmle189094b10a1
ttttangataaacaaacaatcaaccgcagcgacttnagacttatttgatacttgattaaaggcaaccccctgtaaggaaaattgcccggctgcaacgaagggcagactatacacaccctatgaccatgggacaacgaggaccccactaacagcacggcggcaaagcaaaccgtacgcgtgggcggacgcgtgggc

SEQ ID NO: 29075 - DNA, 204 bp, Zea mays
  Clone ID: cC-zmle189094b10d1
ataactaaatgttcgtcgattaacaaacctaaaacttataaaaccttatctataccaaacttaaatatctttgaagacatttacatctttcaaactatttttaatatcaaaaatttctacataaatcatcctttataataactgtccatcattaatatcaaatttaacatacccttaaaattctatataaaattccattatata

SEQ ID NO: 29076 - DNA, 425 bp, Zea mays
  unsure at all n locations
  Clone ID: cC-zmle189094b11a1
cnttaagctatataaagcagcagcaaatgataaaaacngggaggttttaaaagatgggcacaggagacaccacggatgaaccaacatgcagggggacacacgaacgtacattgagcacaaagactgacgcgaaacatgcagagagagatagcaaactgaagaacgtggattttctctctctaacacacacgacacaatacctatgtatggcagccagctcgggctcgcttattattgttcaaccaccaccacaagctagatagataataatcatatccatggtcgtcgatcgatgtgatcagcgagggggggggtcacacttgcagttgccaccgcagctgcagccgagggcggactcgccggactccgccgcggcctcgacgaactcgggcgcggccttcttctccggggccacgccgaggacg

SEQ ID NO: 29077 - DNA, 466 bp, Zea mays
  Clone ID: cC-zmle189094b11d1
aattattatttttttatttattttttttttttttttttttttttttttttttttttattttattttttatttttttttttttttttttttttatttattttatttttttaattttttttattttattttttttttttttttttttttaatttttatttttattttttttttttattatttttttttttatatttatattttttaattttttatttattttttttttttttttttttattttatttttttttttttttttttttattttatttttattttttttttttttttatttattttaatttttcttttttatatattttctttttttttatttttattttttttttgtttttttattttttttttttttattattttttttttttatctttaattttttttttttttttttattttctatttattatttttttttttatttatatttatatttatttatttt

SEQ ID NO: 29078 - DNA, 420 bp, Zea mays
  Clone ID: cC-zmle189094b12a1
ccctcccttttttttttttttttttttttttttgtttgttttttttttattttttttgggcgttttccccccttttttttttttttttttttttttttgagaaaaaaaaaaaattgggttcttaaaccccggaaccaaaaaaggggggggaaaaaatttttttctaagggggcaaaaagggccaaagttgggggaaaattggggggcgaaaaaaaaaaaaaaaaggggggggggggggcaccccggaaattcgggagggggcccggggggggaaccatttttccctaaaaggggccaaaaagaggggggggaaaaaaagggaaaaagctgttcccgggggaaaaatgatacccggcacaaaacccaccaaaaaataagggggggaaaataaagggaaaagcgtggggggcctaagggggg

SEQ ID NO: 29079 - DNA, 529 bp, Zea mays
  Clone ID: LIB189-025-Q1-E1-G11-R3B
aatctacacagcagcatagtaatcaaactgcttttggtgaacatagtggatctcttggtcatggcaacttcggaggaggcctgcaattcttccacccgcactcactgacagagtgtcacaatggtatttgcaatggctataactccacgacacttaaatgcaaggaattctaacttgacatttactgcaagaatagactaccataatgccaaagatgcccacactgacctccatggccattactaccaccaaaatgaacatgccttagaccctggaatgctaacctgcccacataatcgacttcactctacgtgcataccctacaatggaggaacccaagaagctcacgctgcaatgctgggacagagccaccaccagctaggaggtatgaattgctacctcgcaacacatgatgacacgagggacaagactcggcaggagattgacctacgctcacttgagcagggagcgactcctagtgcccgttgagcttatcgaacactcattttgcctactactccaccgagct

SEQ ID NO: 29080 - DNA, 595 bp, Zea mays
  unsure at all n locations
  Clone ID: LIB189-006-Q1-E1-D9-F2B
acatcacgtctgggaccaggccgacctccgacgacgagccgctgtggcccagcgacgccgccgtgtaggagctgtaggacggctgcttggcggcgacggcgacgccgccaccaaagtcgaagtccacagcggcgccgcagttggatccatcgttcggcacgacgctgtcggcgtgcgggaacctggcgaagtcttgggcgaggaacgggtcgaccacgtcgtccgcgaacaggaggtccagcttactggcgtcgacgacgaccttggccgcgtcgccgccgtccttcccttccgcggcaaggccgaacagcagcgccgccttctccgcggcgggatcagcggcggcgccgatgggctgcacggggacgcgctcgtggcggcgcgccagcgggttggcgtcgtggatgtcggcgtcgcacgcggcgcagagcgcggcggcgtcggcgcggcacgtcacggcggccggcgcgcactcgcacacctcgcagacccacacccgctcgtgccccgcccgcgcgtgccccgcgtcgcaccccccgcacaggtacgcgccgcccgggcacgtncggcagtgcgccgccaccggacgcgtggg

SEQ ID NO: 29081 - DNA, 577 bp, Zea mays
  Clone ID: LIB189-006-Q1-E1-D9-SP6B
acatcacgtctgggaccaggccgacctccgacgacgagccgctgtggcccagcgacgccgccgtgtaggagctgtaggacggctgcttggcggcgacggcgacgccgccaccaaagtcgaagtccacagcggcgccgcagttggatccatcgttcggcacgacgctgtcggcgtgcggaaacctgccgaagtctgggccaaggaccggttggccacgttggtccggaaccggaaggtcaacttactggcggtcgacgacaaccttggccgcgtcgccgccgtccttcctttccggggaagggccaaccaaggggcggctttttcggggggggatcaacggggggccccatggggctgcacggggacgcgctcgtggcggcccgccagcggtttggcgtcttggaatgtcggcgtcgaacgcggggcaaaccgcggcggcttcggcccggaacgtaccggcggccggggcgcactcgcacacctggcagacccacacccgttcgtgccccgcccgggcgtgccccgcgttgaaccccccgcacggtacgcgccgccgggcacgtccggcagtgcgccg

SEQ ID NO: 29082 - DNA, 595 bp, Zea mays
  Clone ID: LIB189-006-Q1-E1-D9-T7B
cccacgcgtccggtggcggcgcactgccggacgtgcccgggcgtcgcgtacctgtgcggggggtgcgacgcggggcacgcgcgggcggggcacgagcgggtgtgggtctgcgaggtgtgcgagtgcgcgccggccgccgtgacgtgccgcgccgacgccgccgcgctctgcgccgcgtgcgacgccgacatccacgacgccaacccgctggcgcgccgccacgagcgcgtccccgtgcagcccatcggcgccgccgctgatcccgccgcggagaaggcggcgctgctgttcggccttgccgcggaagggaaggacggcggcgacgcggccaaggtcgtcgtcgacgccagtaagctggacctcctgttcgcggacgacgtggtcgacccgttcctcgcccaagacttcgccaggttcccgcacgccgacagcgtcgtgccgaacgatggatccaactgcggcgccgctgtggacttcgactttggtggcggcgtcgccgtcgccgccaagcagccgtcctacagctcctacacggcggcgtcgctgggccacagcggctcgtcgtcggaggtcggcctggtcccagacgtgatgt

SEQ ID NO: 29083 - DNA, 471 bp, Zea mays
  Clone ID: LIB189-021-Q1-E1-E11-F3B
tgggaggaggacgaggaggtgcagagccccctcgccttcaagaagccccgcctcctcatgaccgcgtgaaaccgctgcgcgcgcgggcggcggatctcatctcatcacccgtccaagattttggtctgcagctgccgagttcagcggtggaagtggaacacactattcgttcattcatttcgtatggtgccagtagcgctattgtttgatttttgtggctgctcctcttgtacagtaccgagtgcgagaaaagatgcatagtcatcgtatacataccaatacaataccgtacctataggtcttcctattcctgtggaagagtagaacttgtatccttattagctgtcagttcatacacacttggttctcattaccagagatcattggtgaattagtggttttgtatcataagcttattgtaaatgatggattggagattagtatggaatcagataccccatttgttccaaa

SEQ ID NO: 29084 - DNA, 467 bp, Zea mays
  Clone ID: LIB189-021-Q1-E1-E11-F3C
aggaggacgaggaggtgcagagccccctcgccttcaagaagccccgcctcctcatgaccgcgtgaaaccgctgcgcgcttgggcggcggatctcatctcatcacccgtccaagattttggtctgcagctgccgagttcagcggtggaagtggaacacactattcgttcattcatttcgtatggtgccagtagcgctattgtttgatttttgtggctgctcctcttgtacagtaccgagtgcgagaaaagatgcatagtcatcgtatacataccaatacaataccgtacctataggtcttcctattcctgtggaagagtagaacttgtatccttattagctgtcagttcatacacacttggttctcattaccagagatcattggtgaattagtggttttgtatcataagcttattgtaaatgatggattggagattagtatggaatcagataccccatttgttccaaa

SEQ ID NO: 29085 - DNA, 387 bp, Zea mays
  Clone ID: LIB189-025-Q1-E1-G11-R3C
gatcgtggcttcgatctcttgatccaacatttcccaatgatgtgtcaaatcaagagctgttttagagcatattggacaagtgtatttgttatgcgccaccatttcttcaaaacatgtcaagtgcattgtgtgtccacagttaagaactcttgttccttgtaatgagtcaaatagatactcataacagattgggcaattctgcctcattgagttctccacacactgatggttatcacggagtataacagaatagcaggatccacacttcacacagtggaagaagttttccttgccaccaaccctgcatatgccacaatcgatgcaatggtactgccctttgtctgtatcatcatcataaaatttcggacgcgtgggcggacgcgtggg

SEQ ID NO: 29086 - DNA, 720 bp, Zea mays
  Clone ID: LIB189-028-Q1-E1-F5-B
ttcctcccgcagaacacagaatggtggcttaactaaaaacaaaagaaaaatgtcaaatatttgatttaaaacaaaaacataacagaaaaaaaatggaataaccttttggcctaacggtaaagcccccgccatgggcccatcaagaaaaacaacgcttacttgatatttaatgacgagcggataacaggtggacctgtaggtggtcctttcttttaaaagctttattacaaaaagtacatatgaaacgtctttctttcccacactcgtaccgcctgtgacggttcaacgtgttcaaacgtaaatatcttttaccgcattcacaataaaaccctaaaaacaacatagatcaataaaaaaagaaacaaaattttcaggttataaaatcatgagtacagcgacataaaagcgaaagccctattttgttgtaacagggagggacctaggcggggggctttccccatatttccatggattctcaggtcgacagtctccgaaaaaagtgaggagtcaaaaatagattagaaaacaaaataaataaaaataaaatataatagaaataaaatatacagaaaaaatataacagaaaaaaaaaacaaaaactaaggaaaaatatttatgctgtgtatgaccatatgacgcttaagtacgtctctcctgtgaaaaagcttagaacatatgtggcatttaaaatgacgttcgcgcccacattcgaattaacat

SEQ ID NO: 29087 - DNA, 774 bp, Zea mays
  unsure at all n locations
  Clone ID: LIB189-028-Q1-E1-F5-C
ttctcccgcaccacacagaaatggtggcttaactaaaaacaaaagaaaaatgtcaaatatttgatttaaaacaaaaacataacagaaaaaaaatggaataaccttttggcctaacggtaaagcccccgccatgggcccatcaagaaaaacaacgcttacttgatatttaatgacgagcggataacaggtggacctgtaggtggtcctttcttttaaaagctttattacaaaaagtacatatgaaacgtctttctttcccacactcgtaccgcctgtgacggttcaacgtgttcaaacgtaaatatcttttaccgcattcacaataaaaccctaaaaacaacatagatcaataaaaaaagaaacaaaattttcaggttataaaatcatgagtacagcgacataaaagcgaaagccctattttgttgtaacagggagggacctaggcggggggctttccccatatttccatggattctcaggtcgacagtctccgaaaaaagtgaggagtcaaaaatagattagaaaacaaaataaataaaaataaaatataatagaaataaaatatacagaaaaaatataacagaaaaaaaaaacaaaaactaaggaaaaatatttatgctgtgtatgaccatatgacgcttaagtacgtctctcctgtgaaaaggcttagaacatatgtggcatttaaattgacgttcgcgcccacattcgaanttaacatggcggctcaaagtgcccaactttcgataagaccttccacactgagggcataca

SEQ ID NO: 29088 - DNA, 585 bp, Zea mays
  Clone ID: LIB189-003-Q1-E1-E7-F3A
aattccaacaaaagctgaacataactgagtttgttctctagccatatatgacatctggccagtttcgattagtttgcaaacgagtttttgttaacagttggatggataaccttgcaaacatgtggagcttcaggttgtttagaagttatttggagttcagcaaattggcaatatcccactgttcaactttgatgattccatgaattcacacaactgaggtaccaccttttccagtgatgttcacctgtaacggcttataaatacatctgtacagatgcgataataatgtctatcaattttatctccaaggcttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggcgtttttagggggtcaaattttactaccgggggctgggaaggaaatattttttttttgacggacccaaattgaattcccggggccgggttttaaaaccgtgggaatgggaaaaacctggggttacccaaattaaatggcttggaaaaaaatccccttt

SEQ ID NO: 29089 - DNA, 504 bp, Zea mays
  Clone ID: LIB189-008-Q1-E1-E8
cccacgcgtccgcacagccacactgcccttctctccccttcctctctcctctgcgtcgcttccacctctcaatctcaccccacgcctgccccgagctccaaccctaaaggaacacacccctgcttgcggcggcggggagcggtcttgggcgtccgccgttgctgtggcccagccgtgacagatccgggccccgcgccgttaggtcggtgtttcttcggcgacggtgcagccgctggatgttagtctggcggatcggggcccgttgttcgcgtgattcgaggcggtgttgagttgtaacatttgtatcacatgaatgaactcagagcatctcagtgttaaaactgtgagcatatcaattcccctcctttaagcaatatgggagctaattgctgcattgctgcaaaggagaggacacaaccatgcattactccattagaagtatcagcgtacaggaatgtgagacattcaccatcatggagctttcggtgggacaatcgcacacat

SEQ ID NO: 29090 - DNA, 494 bp, Zea mays
  Clone ID: LIB189-008-Q1-E1-E8-F2A
ccaacaatacgaagtaccttagtcaatcgtcattaaaaaaaacatcgagtacaataaataatctagcaagctggttgtgtaacccagcgttgggccttacatccatgaaggccacaccgtttctgttagattgctactattactaagctgcaaccagggcctacaacaaccgtatctcgcatggtataaaaaaccttgttattctactataatggatctgctgggaccggcgctagcgtgcgctctgcaccagtatccgaatattatggctgggagaaacttccaaatatgttggttgcccgccaggacggcagcccttgtgccagtctgaactccgtgagcttgcatgctggagagttcacctcctctcgaagacccttccaaaacacactaatggaaaccagcacacctaatggcaattggaggctattctactccctccagtgtcttgcccagaatcccttctttctcgtcgaatcagtttctgagactga

SEQ ID NO: 29091 - DNA, 335 bp, Zea mays
  unsure at all n locations
  Clone ID: LIB189-004-Q1-E1-G5-F62A
aggaagatgggcttggccaccaagaagggttgcaggtcgtctgtccatggctgaggggaggggcgagctcagcgacggcgttgagaaagggctagagcagaggatgggcgagctcgactagggcgctcggggaagcggtgccaaggccgacgctaggaagggcgatgcagcggcgctggccaccggcgaggacgcggccgggtggaggttcgagcaggggacagatgtcgtggcaagagatggaagcgaaggcttggggatccgagtggagaggatggtgtgctctgctgctgggtggagaaggcggctggaagatgagcctangtgagcggcgt

SEQ ID NO: 29092 - DNA, 584 bp, Zea mays
  unsure at all n locations
  Clone ID: LIB189-004-Q1-E1-G5-F63A
tcctatctttatgtagagatcatcaatcttctagattggtccgcgacatcgcctctcgaagtaggccatcctttgcaccacttggggtcaacctagaccctggctgtcgcatctcgatcattagcgtaccatgactaaaattgactgtggatacgacgacgacagactacatgtttaggcatttcgtcgaacacatgacacgtgaggtatgacaccaatggttagcgaggtggacaacgtcgtgacctaagctgcgcaagtgcgatgtgctgctcgacaaccaccaaggtgctgctgcagggagggaaagaacatttgcctgcaccgtggggaacagatcaccaacatccagggggaacgccatggggagggagcaagggagccgagagggaggaaacaccatgggggttggacgagctgatacgcgcagaggtggaaaaagacggngcgcgagcaggaagatgggcttggccaccaagaaaggttgcaagtcgtcgtgtccatggctgaagggaggggcgagctcancgacggcgttgagaaagggctagagcagaggatgggcgagctcgactagggcgctc

SEQ ID NO: 29093 - DNA, 538 bp, Zea mays
  Clone ID: LIB189-012-Q1-E1-F6.F2
tttttttttttttttttttttggggcctaactttgggttgcccaaagttgattgggttcacgagccgttcaaaagttgacacgatttttgtccagttaacattcttgccaacgggtcaagcgccacattgcattatgaagccgcaggggtgacaaatcaggttaactgatcttgcttccgatgcaagattattgcagttgtcgggggtcgtcccttagacaataacacaagtgcctattttttgaagccgcagcttcacccagatcaacacagaccattttgttttttcacttctctgccacacaagggagcccttttttttgagagacatccgaaccatcatcattattctgtgaactcccagaatgcaacgcagtcatgactgattcagaggattgcccatctttagcgattacatttttagcatcagcaactgattgcttgccaactgggggtgtgtgggatacttgattcctcagttgcctgttctcctctgccagttgtgtactcttttgttcgaggtcgctgtatctgttcc

SEQ ID NO: 29094 - DNA, 590 bp, Zea mays
  unsure at all n locations
  Clone ID: LIB189-012-Q1-E1-F6.R2
tcccgggtcgaccccgcgtccgccgngctcttcccacccgccctctctcttgtgggtcggcggccgagtgtctgcgtcgtccacggagatcagggatcggcggcggggtatggcgagggagcgtcgggagataaagagatagagagcgcggcggcgcggcaggtcacgttctccaagcgccgccgcggcctcttcaaaaaggctgaggagctctccgtgctgtgcgatgccgacgtcgcgctcatcgtcttctcctccacgggaaagctctcccagttcgccagctccagtatgaatgagatcattgacaagtacagcacacattctaaaaacctggggaaagcagaacagccttcacttgacttgaacttagaacatagcaaatatgcaaatttgaatgagcaacttgtggaagcaagccttcgactcaggcagatgagaggtgaagaacttgagggattgtagtgttgtaagaactccagcaattggagaagaatctggaatctggtctgcatagggtccttcaaacaaaggatcaacaattcttggaacagatcagcgacctcgaacaaaagatacacaactggcag

SEQ ID NO: 29095 - DNA, 607 bp, Zea mays
  unsure at all n locations
  Clone ID: LIB189-015-Q1-E1-E3-F64A
tgctgacnacnaancggtnggngcgagccgggccctggcctcggcctccttggccggcgacgtgctgtttacggtgacgcggaggccgaacgccttggcgagcttgacggcgacgtggccgaggccgccgagcccgacgacgccgaggctggcgccggggtgccccagcatgccgtggtgcttcatggggctgtacaccgtgacgcccgcgcacagcagcggcgcggcggcgtccagcggcagcgcgtcggggacgcgcaccacgaagcgcttgtccgccaccagcgcgcgcgagtagccgccgtacgtgacgctgccgtcccagaagacgccgttgtaggtgagcgccacacggtcgcagtagttctcctcggagcggcggcagcggtcgcagtccaagcaggaggcggcgatgcagcccacgccgacgcggtcgccgacgcggaagcccgtcacgttgcgcccggccttggtgaccacgcccgtgatctcgtgccccgggaccagcgggtacgtggtgatgccccagtcgttgttgatgaagtgcaggtccgtgtggcacatgccgcagtactgcaccttgatcgtcacgtcgtcagggccgttc

SEQ ID NO: 29096 - DNA, 668 bp, Zea mays
  unsure at all n locations
  Clone ID: LIB189-015-Q1-E1-F1-F65A
cccaggtaatttgagaatgctttctgaccccaaggcagtttatcggattggcaattggagcaaatgctgacaccgacttgtatttatcagtgtttttcaagtaaattgtcagcgcgccatgccctcccattgagtgcccaaaaattgatgcctgtgacgtgttgagttgttcaaagttatcacttaaaacttttggaagttccttcacaatgtagtcatacatgcgccagtttttccacttttcatttgtggcattcaaataaaacccggcacccacaccaaaatcatagctgtctgactctccttcaatatttaacccacgtggggaggtgtcaggtgccacgagggcgatgccgtgggcagcggcggcgcgctgggcgccggactttatgatgaaattctcgtcggtgcaggtgagacccgagagccagtacagcacgggaaggttggacgccggggacgggggcaggtagatggagaaagtcatggcgcagccaagggtggcgctctggtggcggaagcggagattgaagccgtcgaacatcttgctgctgcttagctgctccagcgccgccgccgtaggaggggccaccgccatcgctcgatccgtgccgcgccgcgccgcgccttcggtttngccttcctagttccgatgcggtggagatgtg

SEQ ID NO: 29097 - DNA, 433 bp, Zea mays
  Clone ID: LIB189-015-Q1-E1-F1-F66A
gtgactctacttcaatatttaaccacgtggggaggtgtcaggtgccacgagggcgatgccgtgggcagtgttggcgcgctgggcgccggactttatgatgaaattctcgtcggtgcaggtgagacccgagagccagtacagcacgggaaggttggacgccggggacgggggcaggtagatggagaaagtcatggcgcagccaagggtggcgctctggtggcggaagcggagattgaagccgtcgaacatcttgctgctgcttagctgctccagcgccgccgccgtaggaggggccaccgccatcgctcgatccgtgccgcgccgcgccgcgccttcggcttcgccttcctagttccgatgcggtggagatgtggaggatgaggggagttccagactccagagtggagactggtgactggtgagtggtaactgg

SEQ ID NO: 29098 - DNA, 560 bp, Zea mays
  unsure at all n locations
  Clone ID: LIB189-026-Q1-E1-F3.F2
ggaagaggccggatccatttctgttctggcggcggccgtggctactgtacatacatggngaatctgcatgcacagcacagcgtgcttctgttctcagaacgcatagacttggatggattctagtatctatacaacaagaaggcaaacaagatcgatccaagttgcaacggcgtgtcgcgttgttcctgcctgatttccttctctgttaatcagctgatgctgtccttgtccgtcccctctgatgcaagacgtgcagagagagagagagagagagaaaagaacgatgaatcaattaggagccgaaaattctcgcgcgagcggtctaaatctgcggcagttctgggtgcgcgtcgccggactccatgaacactctgagccagtagtccaggtcgccgtcggcgccgacggacgaggaggaggcggcggccacgtcgacgtcgacgtcgccgaacgcgtcgtcggagggctccatggggacgacgtcgtcgaggctgtccagcggcatcgacagcgtctcggaccagaagctgtcgtcgaactggaactccttggcgtccgag

SEQ ID NO: 29099 - DNA, 608 bp, Zea mays
  unsure at all n locations
  Clone ID: LIB189-026-Q1-E1-F3.R2
cccacgcgtccgcccacgcgtccgggacagtgctccctcccgtccccaaanacaaacaggcgagcagcanaacacacacgctcgaaccgagacaagccaatccaataatggggagggctccgtgctgcgagaagatggggctgaagaaggggccatggacgcccgaggaggacaaggtcctggtcgcccacatccagagcttcggccacagcaactggcgcgcgctgcccaagcaagccggcttgctgcggtgcggcaagagctgccggctccggtggatcaactacctgcgcccggacatcaagcgcggcaacttcagcaaggaggaggaggacgccatcatcagcctccacgagcagctcggcaacaggtggtccgccatcgccgccaggctgcccgggcggacggacaacgagatcaagaacgtctggcacacgcacctcaagaagcgcctggatcccaccaagcaggaacagcagcagcagcacgggacgacgccggtggctggcgccggcaagaagcacaggcccgcggcggcggcgaagcgcggnggcggcggagccaggaaggcgacggccgacgccgtncgtcgtcccggccaccgctgc

SEQ ID NO: 29100 - DNA, 213 bp, Zea mays
  Clone ID: LIB189-030-Q1-E1-C11-F67A
ccttgtggtctcgtctcatgcatggatagccaggtcacatggcttgcgacgaccatgcatctcttcttcccagcgattttagcctgtatcttcccttatttatagtcttttgggtttggtggaatctgtccacagtgtggtttgatctatgtactcctcttctacatttctaccagaacgaatcgatgagattaataataatgttactactaa

SEQ ID NO: 29101 - DNA, 581 bp, Zea mays
  Clone ID: LIB189-008-Q1-E1-E8-F2B
ccaacaatactaagtaccttagtcaatcgtcattaaaaaaaacatcgagtacaataaataatctagcaagctggttgtgtaacccagcgttgggccttacatccatgaaggccacaccgtttctgttagattgctactattactaagctgcaaccagggcctacaacaaccgtatctcgcatggtataaaaaaccttgttattctactataatggatctgctgggaccggcgctagcgtgcgctctgcaccagtatccgaatattatggctgggagaaacttccaaatatgttggttgcccgccaggacggcagcccttgtgccagtctgaactccgtgagcttgcatgctggagagttcacctcctctcgaaaacccttccaaaacacactaatggaaaccagcacacctaatggcaattggaggctattctactccctccagtgtcttgcccagaatcccttctttctcgtcgaatcagtttctgagactgaccgaggcggtcgagacccaatggagaaatgcctcctcaaaaacgggcgactgaatgggaccttcatgcttgagcttgtacctaacct

SEQ ID NO: 29102 - DNA, 540 bp, Zea mays
  unsure at all n locations
  Clone ID: LIB189-008-Q1-E1-E8-R2B
cccacgcgtccgcacagcctctctgcccttctctccccttcctctctcctctgtttcgcttccacctctcaatctcaccccacgcctgccccgagctccaaccctaaaggaacacancccctgcttgcggcggcggggagcggtcttgggcgtccgccgttgctgtggcccagccgtgacagatccgggccccgcgccgttaggtcggtgtttcttcggcgacggtgcagccgctggatgttagtctggcggatcggggcccgttgttcgcgtgattcgaggcggtgttgagttgtaacatttgtatcacatgaatgaactcagagcatctcagtgttaaaactgtgagcatatcaattcccctcctttaagccaattggggagctaattgctgcattgctgcaaaggagaggacacaaccatgcattactccattagaagtatcagcgtacaggaatgtgagacattcaccatcatggagctttcggtgggacaatcgcacacatatagaaaacataatggaaatccctactctggtct

SEQ ID NO: 29103 - DNA, 226 bp, Zea mays
  unsure at all n locations
  Clone ID: LIB189-006-Q1-E1-D9-F3A
gcggacgacgnggncgacccgnnccncgcccaagacnncgccaggtttccgcacgccgacagcgncgngccgaacgangganccaacngcggcgccgcngnggactncgactnnggnggcggcgncgccgncgcgccaagcagnccgncctacagctcctacacggcggcgncgctgggccacagcggctcgtcgtcggaggtcggcctgggcccagacgtgatgt

SEQ ID NO: 29104 - DNA, 340 bp, Zea mays
  Clone ID: LIB189-007-Q1-E1-A12-R4A
ctcgctagcctcaatatgctccttcgcatatataccaacccgatggtcgccagccaccagcatcacctttgcatagcagttggggttagatgagtgatttgcgaacttcaatttgtcccccttgcgataagcatccaacacatactggtcattaaacgaacagaaaagatgagtttgcccggtcataaattttgccgcgtttgtctgcttccttgggagagatcaattcaccagtatattctccaagataatcatttttatttacaggattcttaatgaatgcaccccaacctgcaacatcagatcttcctaacaaaatctggtccatggtaaacaatta

SEQ ID NO: 29105 - DNA, 170 bp, Zea mays
  unsure at all n locations
  Clone ID: LIB189-007-Q1-E1-A12-TGA
aaaaagggagggagcccacccccaaaaacccccggnacacanaagaaagagaaaacaatgccacaactcaaaaaaaaaaaaaaaagggccgaaaggagagaagaaacaaggaaaaaccaacaacgaacgacgacagaacaatgaacgaaggacaaagaaaaccaaacaac

SEQ ID NO: 29106 - DNA, 725 bp, Zea mays
  unsure at all n locations
  Clone ID: LIB189-028-Q1-E1-F5-F4A
gaacacgttgaaccgtcacaggcggtacgagtgtgggaaagaaagacgtttcatatgtactttttgtaataaagcttttaaaagaaaggaccacctacaggtccacctgttatccgctcgtcattaaatatcaagtaagcgttgtttttcttgatgggcccatggcgggggctttaccgttaggcaaaaggttattccattttttttctgttatgtttttgttttaaatcaaatatttgacatttttcttttgtttttagttaagccaccatttctgtgtgtctgcgggaggaaatatcaccatctcggcaatttgactcgccataaaaaattcgagtgcggtcaagaaaaacgtttcgtctgctcaacctgtgggaaagcctttaaaagaaaagaccaacttactgcccactctattcaacactatcctcaccaataaattattttgaacattntcattttttttaaaccctctcattttttcattgattttcagcaaacaaaaattagttttaattaaaattttgtttttaatttttttccttctttttttatagatgggttattcatgtgcttccgttgtggtaaaaagttgaagaacagcaccgtcctttaccatcatgttaactacacttgtggtgtcgagccgaaatttcgatgtgaagtttgcagcaaaatgtttaaaagggaagacaaatcttaaatctcattatattgccatacat

SEQ ID NO: 29107 - DNA, 342 bp, Zea mays
  Clone ID: LIB189-028-Q1-E1-F5-F5A
tttcattttttttaaaccctctcattttttccattgattttcagcaaacaaaaattagttttaattaaaattttgtttttaatttttttccttctttttttatagatgggttattcatgtgcttccgttgtggtaaaaagttgaagaacagcaccgtcctttaccatcatgttactacacttgtggtgtcgagccgaaatttcgatgtgaagtttgcagcaaaatgtttaaaaggaagacaaatcttaaatctcattatattgccatacatggacaagatacttaaattgtccagataattaattaattattggtttaattaaataataaataattattttt

SEQ ID NO: 29108 - DNA, 389 bp, Zea mays
  Clone ID: LIB189-028-Q1-E1-F5-R4A
gaaaacaaaataaataaaaataaaatataatagaaataaaatatacagaaaaaatataacagaaaaaaaaaacaaaaactaaggaaaatattatgctgggatgaccatatgaccttaagtccgtcttttctggggaaaaggttaaaacaatatgtggcattaaaatggcgtcggcccacattcgaatttaacatggcggctcaaagtgcccaactttcgataagactttcacacttgagggcttccaaggggccctaaaaaaattattaattattaaaaaaaattattattaaggataaccaaataaggaaagggaggaaggaaaatatggtttattcacaatgttagaaaaaatgtattttttaaacaaattcattaaaaaatgtttt

SEQ ID NO: 29109 - DNA, 259 bp, Zea mays
  Clone ID: LIB189-028-Q1-E1-F5-R5A
aaacggaagcaaaatgtcaggaacataattttttaaaaaattaggaatcaaaaagaataagaagctaatccatgaacggctaaatgggcttttaaattgcttttgactttaaattttttaaagcagacgacacattgaaatttaggctcgcgtccgcactcgtattttttatgacggtcatattctgcttgtacttgtaagacctcccacataaatcacagaaaaaccgttgacctaaaacaaagaaaaaggagggcag

SEQ ID NO: 29110 - DNA, 398 bp, Zea mays
  Clone ID: LIB3059-012-Q1-K1-B7
cccacgcgtccggaagaacgaacctgagtttgctaagaagctaacttctgtcgctgaggtttatgtgaatgatgcgtttgggcacgggacacagagctcatgcttcaaccgaaggagttaccaagtttttgaaacctgctgttgctggcttcctcatgcagaaagaacttgactacctttgttggagctgttgccaacccaaagaagccatttgccgctattgttggtggatccaaggtctcaagtaagattggtgtcattgagtcgttgctggcaaaggtcgatatcctcatccttggtggtggtatgatctacacattttacaaggcacaaggatattctgttggaaaatctctcgtggaagaggataaacttgagctcgcaacttctcttattga

SEQ ID NO: 29111 - DNA, 428 bp, Zea mays
  Clone ID: LIB3059-041-Q1-K1-D2
cccacgcgtccggtcattgagtcgttgctgtcgaaggtcgatatcctcatccttggtggtgggatgatctacacattttacaaggcacagggatattctgttggaaaatctctcgtggaagaggataaactcgagctcgcaacttctcttattgagaaggcgaaggcaaagggggtttctcttttgcttcccactgatattgtagtagcggacaagtttgcagccgatgctgagagcaagattgtccctgccactgctatccctgatgactggatgggtcttgatgttggccctgatgccaccaaaacattcgacgaagcattggacaccaccaagactgttatttggaacggccccatgggagtgtttgagttccagaagtttgcagctggcaccgaggcgattgccaagaagctagctgagcttac

SEQ ID NO: 29112 - DNA, 377 bp, Zea mays
  unsure at all n locations
  Clone ID: LIB3059-022-Q1-K1-C10
aaatctctcgtggaagaggataaacttgagctcgcaacttctcttattgagaaggcgaaggcaaagggggtttctcttttgcttcccactgatattgtagtagcggacaagtttgcagctgatgctgagagcaagattgtccctgccactgctatccctgatgactggatgggtcttgatgttggccctgatgccaccaaaacattcaacgaagcattggacaccaccaagactgttatttggaacggccccatgggagtgtttgagttcgagaagtttgcagctggcactgangcgattgccaagaagctagctgagcttacaaccacgaanggtgtcactaccatcatncgcggcggcgattctgtcgctgctgt

SEQ ID NO: 29113 - DNA, 414 bp, Zea mays
  Clone ID: LIB3059-027-Q1-K1-C7
gaaaatctttcgtggacgaggataaacttgagctcgcaacttctcttattgagaaggggaatgcacagggggcttctcttttgcttcccactgatattgtagtagcggacaagtttgcagctgatgctgagagcaagattgtccctgccactgctatccctgatgactggatgggtctcgatgttggccctgattccaccaaaacattcaacgaatcattggacaccaccaagactgttatttggaacggccccatgggagtgtttgagttcgagaagtttgcaactggcactgaggcgattgccaagaagctagctgagcttacaaccacgaagggtgtcactaccatcatcggctgccacgactctgttgctgctgtctagaaagctaggctgtccgacaagatgaaccaca

SEQ ID NO: 29114 - DNA, 210 bp, Zea mays
  Clone ID: LIB3059-004-Q1-K1-C3
gaagctgcactcacttgaaggtggttccaataagttgtcatatgtcttatcaggggctccaaactcatgatgtataattttacagtgtaccatctgctatttcatgatctttgctactaaaacaggatgatccatttcctcaagttcttcaactggctgtattttaaaagtataaaagctttgtggctttcgcattgaaagtgatgtgta

SEQ ID NO: 29115 - DNA, 425 bp, Zea mays
  Clone ID: LIB3059-047-Q1-K1-A8
catcccgtcgcatcccatcccactaccacccatctcgtcgtccgccgattcgatccggttcttccaacccaagggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccaaagggtgtcaccccaaagtacagcttgaagcctcttgttccacgcttgtctgagctccttggagttgaagtcgtgatggccaatgattgcattggtgaggaagttgagaaattggctgccgctttgccggaaggtggagtt

SEQ ID NO: 29116 - DNA, 390 bp, Zea mays
  Clone ID: LIB3059-029-Q1-K1-A12
cccacgcgttcgcccacgcgttcgcggacgcgtgggtgattattggttttgtcacataatacgacactagcaatgcatacagtcttgtgcaagacgttgcagattcctgcagaactggtgctgccactaatgtcattttgggtcttgctcttggatacaatgacaatgctggtggtattgctgagaactgatgctgttgatgctgctggcaacaccactgccgctattggaaagggatttgccattggttcagctgctcttgtgtctctggcgcttttttggtgcctttgtcagcagagctggagtcaaggttgtccatgtactcttccccaaggttttcattggtttgattgttggagccatgcttgcctattggatctatggcatgac

SEQ ID NO: 29117 - DNA, 458 bp, Zea mays
  Clone ID: LIB3059-035-Q1-K1-G7
gattcctgcagaactggagctgccactaatgtcatttttgggcttgctctgggggacagatcagtcattatcccaatttttgctattgcgtttagtatcttccttagcttcagccttgctgccatgtatggtgttgctgtggctgctcttggaatgctgagtaccattgccacaggccttgctattgatgcctatggccctatcagtgataatgctggaggcatagctgaaatggctgggatgagccataggattcgtgagagaactgatgctctagatgctgcaggaaacaccactgctgcaattggaaagggttttgctattggctctgcagccttggtatcccttgcactcttcggtgcctttgtaagccgggctgctatctccactgttgacgttctgactcctaaagtattcattgggcttattggtggtgctatgctcccatactggttctc

SEQ ID NO: 29118 - DNA, 409 bp, Zea mays
  Clone ID: LIB3059-024-Q1-K1-G11
cggacgcgtgggcggacgcgtgggtgatccccccaggtgctcttgttatgctcacaggactgatcgttgggattctatttggggttgagaccctctctggagtccttgctggtgcccttgtctctggtgttcagattgccatttctgcatccaacactggtggtgcctgggacaacgccaagaagtacattgaggctggagtttcagagcatgccaggacccttggcccaaaaggttctgaccctcacaaggcggctgtcattggtgacaccattggagatcctctcaaggacacgtctggcccttccctcaacatcctcatcaagcttatggcggttgaatcccttgtcttcgcccccttcttcgccgcccatggtggcattctcttcaaatggctctaagccagcga

SEQ ID NO: 29119 - DNA, 403 bp, Zea mays
  Clone ID: LIB3059-001-Q1-K2-E4
aagagcccagatgagcaccctttcttttccaaggatctgcctgagccccggttgccaggtatgcggtacccaaaggttttgcatcccattgctgattctatcaatatcaacaaagagatttggaaaatgtattttgatgaacttctaccaagattggtgaaagaaggaagtgatggtaatgctggatccagtgctctttgtgacacaacctgcttgcaggcactctccagaaggatccactatgggaagtatgtggcagacgcctagtttcaagagtcccctgaagcttacacgccagccataatagcccaagtctgcttttgttccaactattagtatttctagtactactattttcatttattttttaatctaattccaaagtttcagaaccaaattgttt

SEQ ID NO: 29120 - DNA, 405 bp, Zea mays
  Clone ID: LIB3059-017-Q1-K1-C2
aaagaattcatattggtaaatatgttgctgaggtgaagttcaaagacgctcctcaagagtatagtcgactaataaaagaaaaggacagcaattctctgatggatatgctgacattcaaggctgtggaagagaaggtcaagaagagagtagagaagaaggctaggacgttcgggcagaacgtcaccttggatgacaatgccactgctggtgacagcgagtgcaaggtcgatcccaaagtgctctccaagctgtatgatcagtgggtgatgccactgaccaaggatgtcgaagtcgagtatctcctgcgccgcctcgactgatcagtgatcacccgattagctgtagctgctaactttatgtacgcgtgggtatcagattgctttgcacatgctctttatggcttta

SEQ ID NO: 29121 - DNA, 279 bp, Zea mays
  Clone ID: LIB3059-055-Q1-K1-E5
cgaagagccaactgcaacagatcgcatgaccaatgtacagcaacccacctggtcagtgtgcactggttgtttgtataatcctcagtgatccagaattgaagagtttgtggttaaaagaagtcaagggtatggctgatcgtatcattggaatgcgtaattcacttaaggataaatcttaatagctaggttcacctttgttatggtatcatatatttaattattattgtattgttctttttttgttttatttatttttttttttttttttttttttttttt

SEQ ID NO: 29122 - DNA, 440 bp, Zea mays
  Clone ID: LIB3059-005-Q1-K1-A6
ctttaggacactgcaacgtttcacggctgctaccctggagcatggcatgcacccaccaaatgcaccaaagccagaatggcgagcccttcttgatgagatggcagttgtggcaactgaggaatatcggtccattgtcttcaaagagccacgctttgtcgagtatttccgccttgcaacccctgaaacagagtatggtaggatgaacataggaagcaggccatccaagagaaagccgagcggaggtatcgactcactccgagcaatcccatggatctttgcttggacacaaacgcggttccacctcccggtctggctaggatttggagccgcattcaagaatgtcctccagaaggacatcaggaacctccacatgctccaggaaatgtacaatgagtggccatttttcaaggtgactattgatctggtggagatggtgttcg

SEQ ID NO: 29123 - DNA, 422 bp, Zea mays
  unsure at all n locations
  Clone ID: LIB3059-014-Q1-K1-E8
cagggatcttctggaaggtgacctctacctgaagcagcggctccgcctgcgtgagtggtacatcaccaccctgagcgtctgccaggcctacaccctgaagcggatccgtgacccggactaccatgtcgcgctgcgcccccacctctccaaggagatcatggactcgaccaaggctgcggcggagctggtgaagctgaaccctggcagcgaatacgcaccggggctggaggacaccctcatcctgaccatgaagggcatagcagccggcctccagaacaccggttaaaccacgaagaggggatcttttttctcctcctgatcattggctctaggtccttcgtattttcgcggattgtaacttcggccacctctctacaccgtgaggaaataatggtggtttctgcanaagtggtggtaaataa

SEQ ID NO: 29124 - DNA, 337 bp, Zea mays
  Clone ID: LIB3059-060-Q1-K1-G6
gatcaaccgaatggaggagggatgagtgtccctacctgaaagttttcccacagatgggggcaaaaagccagaaatagagggtatcggtataatgttctaatagtatactccatcacaaaaaatgtgcacttctatttacattgctttaagtcaaacaatcttcggttttaccaacttttttactacaaatatataaaagttatatgataccaaataagtaccattaggttcatcatagaatatagttccatcgtatacttatttgtaatattaagtgttgatattattttgacaaacttagtcaaacttaaaatagttatacttgcaccagatctag

SEQ ID NO: 29125 - DNA, 415 bp, Zea mays
  unsure at all n locations
  Clone ID: LIB3059-040-Q1-K1-C12
gaagaagacgagtgtcaagtgaacctgaaacttgcggtgtcactggctggtggagccggagtgtgagtgagtgatcgagctagctgagctccgatcctcgctagctagctaggataccgccataccacaagtcttcttcacaagtttaggagtgacagcaacaagagatctcgatggcctctgccaccgtgctcaagtcctccttccttcccaagaagtccgaatggggcgccaccaggcaggccgccgcgcccaggccgcccaccgtctccatggtcgtccgcgccttcgnctacgccgatgagctcgtgaagaccgcgaaaacgatcgcgtcgccggggcggngcatcctggcgatggacgagtcgaacgcgacgtgcgggaagcggctggcgtccatcgggctggagaacac

SEQ ID NO: 29126 - DNA, 427 bp, Zea mays
  Clone ID: LIB3059-004-Q1-K1-F4
cggacgcgtgggcaagaatgctccagatggttcattctttttgcttcatgcatgtgctcataatcccaccggtgtagatcctacggaggaacaatggagagaaatatcccatcagttcaaggtgaaaaaacattttccattctttgacatggcataccaagggtttgccagtggtgatccagagagagatgccaaggcaatccgaattttccttgaagatggacaccaaattggatgtgctcagtcatacgcaaagaacatgggactttatggacaaagagcaggatgcctgagtattttgtgtgaggatgagatgcaagcagttgctgtcaagagccaactgcaacagatcgcaagaccaatgtacagcaacccacctgttcatggtgcactggttgtttctataatcctcagtgatccagaattg

SEQ ID NO: 29127 - DNA, 139 bp, Zea mays
  Clone ID: LIB3059-012-Q1-K1-F6
tctgattgtctaaaacctataattggtgtaatggtttcgtagtggttggttgaacaggggatgacgcatattttgtcaggtctatgtgttatcgttaaacttttaacggtcattctatttcaaaagttttgcattttgc

SEQ ID NO: 29128 - DNA, 331 bp, Zea mays
  Clone ID: LIB3059-002-Q1-K2-D11
cacacacttgagaactccatttcgatctcatttgaaatcaacccatccttgtgtccttcgtctgagcatcctttcaccctcatggccaacatcaagatcgggatcaatgggtttggcatgatcggaaggcttgtggccattgtggccctgcacagctacgacgtcgagctcgtagccgtgaacgaccccttcatcagcacctattacatgacctacatgttcaagtatgacactgtgcactgacagtggaagcaccatgaggtcaacgtgaacgacttcaagacccttctctttggtgagaaagaggctgctgtgtttgactgcacgaacc

SEQ ID NO: 29129 - DNA, 218 bp, Zea mays
  Clone ID: LIB3059-004-Q1-K1-G1
ggaatcaacggtttcggaaggatcggcaggctcgtggccagggtcgccctgcagagcgaggatgtcgagctcgtcgccgtcaacgaccccttcatcaccacggattacatgacctacatgttcaagtactacaccttgcacggccaatgtatgcacagctacatcaccctcaaggactccaagtctcttctcttctgcgagaatctcttcactgtctt

SEQ ID NO: 29130 - DNA, 418 bp, Zea mays
  Clone ID: LIB3059-042-Q1-K1-G11
ccgacgcgtccgcaagatcaagatcggtttcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtgtttggctgcaggaaccctgaggagatcccatggggttcggttggcgctgaatatgttgttgagtctactggtgttttcactgaccaggagaaggctgcagctcacttgaagggtggtgccaagaaggttgtcatttctgctcctagcaaggatgcccccatgttcgttgttggtgtc

SEQ ID NO: 29131 - DNA, 435 bp, Zea mays
  Clone ID: LIB3059-002-Q1-K2-D10
cacacactcgagaactccatttcgatctcatttgaaatcaacccatcctcgttggctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtgtttggctgcaggaaccctgaggagatcccatggggttcggttggcgcttgaatatgttgttgagtctactggtgttttcactgaccaggagaaggctgcagctcacttgagggtggtgcca

SEQ ID NO: 29132 - DNA, 392 bp, Zea mays
  Clone ID: LIB3059-030-Q1-K1-E12
cacacactcgagaactccatttcgatctcatttgaaatcaacccatcctcgtttccggcgtgtagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaagaagttgctgtgtttggctgcaggaaccctgaggagatcccatggggttcggttggcgctgaatatgcttgtgagtctactggtgttttc

SEQ ID NO: 29133 - DNA, 395 bp, Zea mays
  unsure at all n locations
  Clone ID: LIB3059-048-Q1-K1-D4
cacacactcgagaactccatttcgatctcatttgaaatcaacccatcctcgtttcctccgtctggcaggctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaagangttgctgtgtttggctgcaggaacccctgaggagatcccatggggttcggttggcgctgaatatgttggtgagtctactggtgttttcac

SEQ ID NO: 29134 - DNA, 428 bp, Zea mays
  Clone ID: LIB3059-029-Q1-K1-E5
atcggcaggctcgtggccagggtcgccctgcagagcgaggatgtcgagctcgtggccgtgaacgaccccttcatcaccacggattacatgacctacatgttcaagtacgacaccgtgcacggccaatggaagcacagcgacatcaccctcaaggactccaagacgcttctcttcggcgagaagccggtcaccgtctttggcatcaggaaccccgaggagatcccgtggggtgaggctggtgctgagtatgtcgtggagtccaccggtgtcttcactgacaaggacaaggctgctgcacatctgaagggtggtgccaagaaggttgttatctctgccccaagcaaagatgcacccatgtttgttgttggtgtcaatgaggacaagtacaccttcgatgttaacattgtttccaatgctagctgcaccac

SEQ ID NO: 29135 - DNA, 434 bp, Zea mays
  Clone ID: LIB3059-058-Q1-K1-A12
gcaggctgaattcttctccttcggaacgaacgacctgacgcagatgacctttgggtacagcagggatgatgtgggaaagttcattcccgtctatcttgctcagggcattctccaacatgaccccttcgaggtcctggaccagaggggagtgggcgagctggtgaagcttgctacagagaggggccgcaaagctaggcctaacttgaaggtgggcatttgtggagaacacggtggagagccttcctctgtggccttcttcgcgaaggctgggctggattacgtttcttgctcccctttcagggttccgattgctaggctagctgcagctcaggtgcttgtctgaggctgcctcctcattggcaaccggattgcctgctgctggtggatgtggtgatcaacagtattattacagagccatgctatgtgaacattac

SEQ ID NO: 29136 - DNA, 422 bp, Zea mays
  Clone ID: LIB3059-024-Q1-K1-F6
caagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtgggaaagttcattcccgtctatcttgctcagggcatcctccaacatgaccccttcgaggtcctggaccagaggggagtgggcgagctggtgaagtttgctacagagaggggccgcaaagctaggcctaacttgaaggtgggcatttgtggagaacacggtggagagccttcgtctgtggccttcttcgcgaaggctgggctggattacgtttcttgctccccttt

SEQ ID NO: 29137 - DNA, 108 bp, Zea mays
  Clone ID: LIB3059-017-Q1-K1-F2
caggaattgggacatcaggtggcccttatccgtcaagtcgctaacaaagttttcaccggtatgggtaaaactattgggtaccagatcgggaccattattgagatttcc

SEQ ID NO: 29138 - DNA, 382 bp, Zea mays
  Clone ID: LIB3059-056-Q1-K1-G11
aggacgcgtgggcggacgcgtggctatatctggctcagggcatcctccagcgtgacccgtgctaggttctcgaccagagatgaatgggccagctggttaagcttgctacagacaggggctagcaaagctaggcctaacttgaacgtggacattggtggagaacatggtggagagcctcaatcggtagctttattcgccaagactgggctggattacgttgctcgctcccttatcagggtcccgatcgctatgctagctgcatatcatgtgccagtctgagggtgcctctgttaggtcgcagccggatcacctgctggtgctacatgtgatgaatcatgatactactatgacagagccatgctactgtgagagcatcagtagc

SEQ ID NO: 29139 - DNA, 304 bp, Zea mays
  Clone ID: LIB3059-054-Q1-K1-F4
tgtccgtgctatggatggactctcattgactattcgacttctggaccctcccctccgctagttcctaccagaagggaacgtcgaggaaatcgtgcgtgaactgtgttctgagacgggagccaaccaggaggatgccctcgcacggatcgaaaagctttcggaagtaaacccgatgcttggcttccgtggctgcaggcttggtatatcgtaccctgagctaacataaatgcaagcccgtgccatctttgaagctgctatagcgatgaccaaccatggctttcaagtcttttcaggggggaatgtt

SEQ ID NO: 29140 - DNA, 417 bp, Zea mays
  Clone ID: LIB3059-012-Q1-K1-D10
gtcgctaacaaagttttcaccagtatggggaaaactattgggtacaagatcggaacgatgattgagattcccagggcagctctagtggctgacgagatcgcggagcaggctgaattcttctcctttggaacgaacgacctcacgcagatgacctttggctacagcagggatgatgtggggaagttcatccccatttatctggctcagggcatcctccagcatgaccccttcgaggttctcgaccagagaggagtgggcgagctggttaagcttgctacagagaggggccgcaaagctaggcctaacttgaaggtgggcatttgtggagaacatggtggagagccttcatcggttgctttcttcgccaagactgggctggattacgtttcttgctcccctttcaaggtcccgatcgct

SEQ ID NO: 29141 - DNA, 344 bp, Zea mays
  Clone ID: LIB3059-048-Q1-K1-A4
cggacgcgtgggagctcttgtcccctattaccttgatgaaaaaactgggtggggtttggagatgtctgatcttaagaaacaactcgaagatgctcggtcaaaaggcattgatgttagggccttggtggttatcaatccaggaaatccgactgggcaggttcttgctgaagacaaccaatatgatatagtgaaattctgtaaaaatgagggccttgttcttctagctgatgaggtatatcaagagaacatctatgttgacaacaagaaatttaactctttcaagaagattgcaagatccatgggatacggcgaggatgaatctcctttaatatcatttcaatctg

SEQ ID NO: 29142 - DNA, 413 bp, Zea mays
  Clone ID: LIB3059-045-Q1-K1-G1
cagtccaggaaatccgactgggcaggttcttgctgaagacaaccaatatgatatagtgaaattctgcaaaaatgagggccttgttcttctagctgatgaggtatatcaagagaacatctatgtggacaacaagaaatttaactctttcaagaagattgtaagatccatggggtatggcgaggatgatctccctctagtatcgttacagtctgtttccaaaggatactatggagagtgtggtaaaagaggagggtacatggagattactggcttcagtgctccagtaagagagcagatctacaagatagcttcagtgaacctatgctccaatatcactggtcaaatccttgcgagcctcgtcatgaatccaccaaaggttggagacgaatcatatgcttcctacaaggcagaga

SEQ ID NO: 29143 - DNA, 419 bp, Zea mays
  Clone ID: LIB3059-014-Q1-K1-H7
catggagattactggcttcagtgctccagtaagagagcagatctacaagatagcggcggggaacctatgctccaatatcactggtcaaatccttgcgagcctcgtcatgaatccaccaaaggttggagacgaatcatatgcttcctacaaggcagagaaagatggaatccttgagtctttagctcgtcgtgcaaaggcgttggaggatgcattcaacaagcttgagggattttcatgtaacaaggccgaaggagcaatgtatcttttccctcagattcttctgccacagaaggcaatcgaggctgctaaagctgctaagaaagcgcctgacgctttctacgctctccgtctccttgaatcgactggaatcgtcgtggtccctggatctggatttggtcaaattcctggaacatggcaca

SEQ ID NO: 29144 - DNA, 416 bp, Zea mays
  unsure at all n locations
  Clone ID: LIB3059-014-Q1-K1-A8
cggacgcgtgggtattcctggacgggcaacaggtgcatatagtcacagtcagggtgatgaaaggattgcgtgatgcaattgctgctgggatcacctcacgtgacggattccctgcaaatgcagatgacattttcattacagacggagcaagtcctggggtccacatgatgatgcaattactgattaggaatgagaaagatggcattctgtgcccaattcctcagtaccccttgtactcggcctccatagctcttcatggtggagctcttgtcccctattaccttgatgaaaaaactggngtggggtttggagatctctgatcttaagaaacaactcgaagatgctcggtcaaaaggcattgatgttagggccttggtggttatcaatccaggaaatccgactgggcaggttcttgc

SEQ ID NO: 29145 - DNA, 422 bp, Zea mays
  Clone ID: LIB3059-006-Q1-K1-H5
cgactgggcaggttcttgctgaagacaaccaatatgatatagtgaaattctgcaaaaatgagggccttgttcttctagctgatgaggtatatcaagagaacatctatgtggacaacaagaaatttaactctttcaagaagattgtaagatccatggggtatggcgaggatgatctccctctagtatcgttacagtctgtttccaaaggatactatggagagtgtggtaaaagaggagggtacatggagattactggcttcagtgctccagtaagagagcagatctacaagatagcttcagtgaacttgtgctccaatatcactggtcaaatccttgcgagccttgtcatgaatccaccaaaggcttgggacgaatcatatgcttactacaagggagagaaaggatggaacccttgagtcttt

SEQ ID NO: 29146 - DNA, 434 bp, Zea mays
  Clone ID: LIB3059-049-Q1-K1-E5
ggcaaactgacttatatcagcaagacgttcagaagtatggaaacattgagtacatgagatgcggtccagaaaatggattttttcctgatctgtcaactgtccctaggacagatattattttcttttgttcacccaacaatcctactggtgctgctgcatctcgggaccaactaaccaaattagtaaaatttgcaaaggacaacaggtccatcatagtctatgattctgcttatgcaatgtacatatcagatgacagcccaaagtctatctttgaaattcctggagcaaaggaggttgctattgagacagcctcattctcgaaatacgctgggttcacaggtgtccgtctaggttggactgttgtccccaaggagctccttttctcggatggacatccagttgctaaagatttcaatcgcatagtttgcacttgc

SEQ ID NO: 29147 - DNA, 422 bp, Zea mays
  Clone ID: LIB3059-012-Q1-K1-G3
cgaaaagctaagcagagagaacaagcttaccaaatcatcagtcatggtcactgctggtgcaaatcaggcttttgtgaacttggtcctcactctttgtgatgctggtgattccgttgtcatgtttgcaccgtattatttcaatgcctacatgtcattccagatgacaggtgttactgacatattagttggtggctgcgatcccaagacacttcatcctgatgttgattggttggagaaggttctgaaagaaaatgagcctatccctaaacttgtcactgttgtgaatccggggaacccctgtggagcttttatttcaaggcctatgcttgagagaatttcagatctgtgcaaaaatgctggtgcatggcttgtggttgacaatacctatgagtactttatgtatgatggaatggagcactact

SEQ ID NO: 29148 - DNA, 441 bp, Zea mays
  Clone ID: LIB3059-037-Q1-K1-H5
cccacgcgtccggaggcacttaagatggaaattattccaaaccccaaggaagttgatggggtgaaagtccttcaacttgaaactgcagctggtgcagctattcgtttctttgacaaagcgattggaattaatgttccccgctcaagatttctcccggtgaaggctacatctgatttattgcttgtgcagtctgatctttacaccttggttgatggctttgtcatccgcaatccatccagagcgaatccagctaacccttcgattgagcttggacctgagttcaagaaggttgccaatttccttgctcggttcaagtccatccccagcatcgtcgagcttgacagcttgaaggtttctggtgatgtctggtttggttctggaattacgctcaagggcaaggtgacaatcaccgccaagtctggagtgaagttggaggttcca

SEQ ID NO: 29149 - DNA, 394 bp, Zea mays
  Clone ID: LIB3059-032-Q1-K1-G11
cccacgcgtccgcccacgcgtccgcccacgcgtccgcggacgcgtgggtttcaatcagagccagtatcctcgcattgttaccgaggacttcttgccacttcccagcaaagggaaatctgggaaggatggctggtatcctcctggtcatggtgatgtgtttccctctttgaataacagcggaaaacttgacatcttattggctcagggcaaagagtatgtctttgttgcaaactcagacaacttgggtgctatagtcgacatcaagatcctaaaccatctgatcaataaccagaacgagtactgcatggaggttactccaaagacgctggctgacgttaagggtggcactctcatctcttacgaaggaagagttcagcttttggagattgcccaa

SEQ ID NO: 29150 - DNA, 377 bp, Zea mays
  Clone ID: LIB3059-001-Q1-K2-G1
ccaggatctaccgggcttcagagaggcgctggaggagtacgcgaaagcgatggaagagctggcggtcaagctgctggagctgatcgcccggagcctgaagctgaggcccgaccggctgcacggcttcttcaaggaccagacgaccttcatccggctgaaccactaccctccttgcccgagccccgacctggccctcggcgtggggcggcacaaggacgccggcgccctgaccatcctgtaccaggacgacgtcggggggctcgacgtccggcggcgctccgacggcgagtgggtccgcgtcaggcccgtgcccgactcgttcatcatcaacgtcggcgacctcatccaggtgtggagcaacgacaggtacgagagcg

SEQ ID NO: 29151 - DNA, 423 bp, Zea mays
  Clone ID: LIB3059-037-Q1-K1-H8
ggcacgcctccgggacaacttgggtttagccctcaacgggttgcttccttccccaggacgtggggctgaattccgtttcttgctccccttttcagggccccgatcgctaggctagctgcaactcaagtgcttgtctgacggtgcctctgctcgttggcagccggatcgcctgctgttggtgcatctggtgattaataatactactatgacagagccatgctctgtgaagagtattagtagcagcgctcataaaagctacagttccgtctcttttctcagctatgtaaaacttccaaactgttcatgcttaaaactgagggttttcttggtgtgaggtgtgcatgtcgttgttgaggccattgctgcacattccacctattgaggccctcctcaaaataagccttcaaaaagctgatatctttt

SEQ ID NO: 29152 - DNA, 397 bp, Zea mays
  Clone ID: LIB3059-003-Q1-K1-F1
cgaccagagaggagtgggcgagctggttaagcttgctacagagaggggccgcaaagctaggcctaacttgaaggtgggcatttgtggagaacatggtggagagccttcatcggttgctttcttcgccaagactgggctggattacgtttcttgctcccctttcagggtcccgatcgctaggctagctgcagctcaggtgcttgtctgagggtgcctctgctcgttggcagccggatcgcctgctgttggtgcatctggtgattaataatactactatgacagagccatgctctgtgaagagtattagtagcagcgctcataaaagctacaggtccgtctcttttctcagctatgtaaaacttccaaactgttcatgcttaaaactgagggttttctt

SEQ ID NO: 29153 - DNA, 425 bp, Zea mays
  Clone ID: LIB3059-023-Q1-K1-C8
aaatcgagtccctgaacaagaagtatggatgtaatgtccctttacttctgatgaactctttcaatacccatgatgacacacagaagatcgttgagaagtattccaactccaacattgaaattcatactttcaatcagagccagtatcctcgcattgttaccgaggacttcttgccacttccaagcaaagggaaatctgggaaggatggctggtatcctccaggccatggtgatgtgttcccctctttgaataacagtggaaaactcgacatcttattggctcaaggcaaggagtatggtcttcgtgctaactcagacaacttgggtgctatagtcgacatcaagatcctgaaccatctgatcaataaccagaatgaatactgcatggaggttactccaaaaacattggctgatgttaaaggcggt

SEQ ID NO: 29154 - DNA, 345 bp, Zea mays
  unsure at all n locations
  Clone ID: LIB3059-058-Q1-K1-A4
ctaggcctaacttgaaggtgggcatttgtggagaacatggtggagagccttcatcggtggctttcttcgccaagactgggctggattacgtttcttgctcccctttcagggtcccgatcgctaggctagctgcagctcaggtgcttgtctgagggtgcctctgctcgttggcagccggatcgcctgctgttggtgcatctggtgattaataatactactatgacagagccatgctctgtgaagagtattagtagcagcgctcataaaagctacagttccgtctcttttctcagctatgtaaaacttccaaactgttcatgcctaaaactganggttttctggtgt

SEQ ID NO: 29155 - DNA, 339 bp, Zea mays
  unsure at all n locations
  Clone ID: LIB3059-018-Q1-K1-H2
cggacgcgtgggtgagattcccagggcagctctagtggctgacgagatcgcggagcagtctgaattcttctcctttggaacgaacgacctcacgcagatgacctttggctacagcagggatgatgtggggaagttcatccccatttatctggctcagggcatcctccagcatgaccccttcgaggttctcgaccagagaggagtgggcgagctggttaagcttgctacagagaggggccgcanagctaggcctaacttgaaggtgggcatttgtggagaacatggtggagagccttcatcggttgctttcttcgccaagactgggcttgattacgtttc

SEQ ID NO: 29156 - DNA, 432 bp, Zea mays
  unsure at all n locations
  Clone ID: LIB3059-028-Q1-K1-G7
cggacgcgtgggcagggatgatgtggggaagttcatccccatttatctggctcaggggatcctccagcatgaccccttcgaggttctcgaccagagaggagtgggcgagctggttaagcttgctacagagaggggccgcaaagctaggcctaacttgaaggtgggcatttgtggagaacatggtggagagccttcatcggttgctttcttcgccaagactgggctggattacgtttcttgctcccctttcagggtcccgatcgctaggctagctgcagctcaggtgcttgtctgagggtgcctctgctcgttggcagccggatcgcctgctgttggtgcatctggtgattaataatactactatgacagagccatgctctgtgaagagtattagtagcagcgctcataaaagctacagntccgtctcttttc

SEQ ID NO: 29157 - DNA, 416 bp, Zea mays
  Clone ID: LIB3059-017-Q1-K1-C3
aacgacctcacgcagatgacctttggctacagcagggatgatgtggggaagttcatccggatgtatctggctcagggcatcctccagcatgaccccttcgaggttctcgaccagagaggagtgggcgagctggttaagcttgctacagagaggggccgcaaagctaggcctaacttgaaggtgggcatttgtggagaacatggtggagagccttcatcggttgctttcttcgccaagactgggctggattacgtttcttgctcccctttcagggtcccgatcgctaggctagctgcagctcaggtgcttgtctgagggtgcctctgctcgttggcagccggatcgcctgctgttggtgcatctggtgattaataatactactatgacagagccatgctctgtgaagagtattagta

SEQ ID NO: 29158 - DNA, 390 bp, Zea mays
  Clone ID: LIB3059-044-Q1-K1-E2
ggcgttcaagtctttccagagataatggttcctcttgttggaacaccgcacgaattgggacatcaggtggcccttatccgtcaagtcgctaacaaagttttcaccagtatgggtaaaactattgggtacaagatcgggacgatgattgagattcccagggcagctctagtggctgacgagatcgcggagcaggctgaattcttctcctttggaacgaacgacctcacgcagatgacctttggctacagcagggatgatgtggggaagttcatcctcatttatctggctcagggcatcctccagcatgaccccttcgaggttctcgaccagagaggagtgggcgagctggttaagctcgctacagagaggggccgcacagctaggcctaac

SEQ ID NO: 29159 - DNA, 387 bp, Zea mays
  Clone ID: LIB3059-043-Q1-K1-F7
gcacatgtgctttgcttcagactagaggattaaggctgtcaggcagatgattatggctcccactcttgagctgaggcagcaggcgctcgaccgtctcttgccgtatcagaggtctgacttcgaaggcattttccgtgctatggatggactcccggtgaccatccgactcctggacccttgcctccacgagttccttccagaagggaacatcgaggacattgtaagtgaatgatgtgctgagacaggagccaaccaggaggatgccctggcgcgaatagaaaagcttccagaagtgaacccgacgcttggcttacgtgggtgcaagcttggtatatcgtaccctgaattgacagatattcaagcccgggccatttctgaagctgctat

SEQ ID NO: 29160 - DNA, 417 bp, Zea mays
  Clone ID: LIB3059-047-Q1-K1-H7
agaggtctgacttcgaaggcattttccgcgctatggatggactttcagtgactattcgacttctggaccctccccttcacgagttccttccagaagggaacgtcgaggaaatcgtgcgtgaactgcgttctgagacgggagccaaccaggaggatgccctcgcacggatcgaaaagctttcggaagtaaacccgatgcttggcttccgtggctgcaggcttggtatatcgtaccctgagctaacagaaatgcaagcccgtgccatctttgaagctgctatagcgatgaccaaccagggcgttcaagtctttccagagataatgggtcctcttgttggaacaccgcaggaattgggacatcaggtggcccttatccgtcaagtcgctaacaagagcttcaccagtatggggaaaacta

SEQ ID NO: 29161 - DNA, 441 bp, Zea mays
  Clone ID: LIB3059-011-Q1-K1-F5
caccgtggggcagtacgagtcccacatcgcgttcactcttcctgggctgtaccgtgtgatccatggcatcgatgttttcgatcccaagttcaacattgtctcccctggagcagacatgagtgtttactacccgtatacggaaaccgacaagagactcactgccttccatcctgaaatcgaggagctcatctacagcgacgtcgagaactccgagcacaagttcgtgctgaaggacaagaagaagccgatcatcttctcgatggcgcgtctcgaccgcgtgaagaacatgacaggcctggtcgagatgtacggcaagaacgcgcgcctgagggagctggcgaacctcgtgatcgttgccggtgaccacggcaaggagtccaaggacagggaggagcaagcggagttcaagaagatgtacagcctcatcgacgagtacaagtt

SEQ ID NO: 29162 - DNA, 421 bp, Zea mays
  Clone ID: LIB3059-010-Q1-K1-C9
cccacgcgtccggaaatcgcgggaagcaaggacaccgtggggcagtacgagtcccacatcgcgttcactcttcctgggctctaccgtgtcgtccatggcatcgatgttttcgatcccaagttcaacattgtctcccctggagcagacatgagtgtttactacccgtatacggaaaccgacaagagactcactgccttccatcctgaaatcgaggagctcatctacagcgacgtcgagaactccgagcacaagttcgtgctgaaggacaagaagaagccgatcatcttctcgatggcgcgtctcgaccgcgtgaagaacatgacaggcctggtcgagatgtacggcaagaacgcgcgcctgagggagctggcgaacctcgtgatcgttgccggtgaccacggcaaggagtccaaggacaggg

SEQ ID NO: 29163 - DNA, 418 bp, Zea mays
  Clone ID: LIB3059-024-Q1-K1-H4
atctcacagggcggcctgcagagaatctatgagaagtacacctggaagctctactccgagaggctgatgaccctgaccggcgtgtacgggttctggaagtacgtgagcaacctggagaggcgcgagacccgccgctacatcgagatgttctacgccctgaagtaccgtagcctggcaagccaggttccgctgtccttcgattagtacggggaaagaagaagaagaagaagcccaggccggagaaccatcgcctgcatttcgatctgtttcaccgcaattcgcattgttagtcgtgtattggagttatgtgtacttggtttccaagaactttggttccttctcgttttttttccttgtttgagcgtttttgggcagcgctggcctggttcctagtatggtgggaattggctgcaccttt

SEQ ID NO: 29164 - DNA, 383 bp, Zea mays
  Clone ID: LIB3059-048-Q1-K1-H5
gagaatggcatcctccgcaagtggatctctcgttttgatgtctggccatacctggagacgtacgctgaggatgtttccagtgaaataatgaaagaaatgcaggccaagcctgaccttatcattggcaactacagcgatggcaacctagtcgccactctgctcgcgcacaagttgggagtcactcagtgtaccatcgctcatgccttggagaaaaccaaataccccaactcggacatctacttggacaagttcgacagccagtaccacttctcttgccagttcacagctgaccttattgccatgaaccacaccgatttcatcatcaccagcacattccaagaaatcgcgggaagcaaggacaccgtggggcagtacgaggtcca

SEQ ID NO: 29165 - DNA, 420 bp, Zea mays
  Clone ID: LIB3059-024-Q1-K1-E5
cccacgcgtccgcaagatctcacagggcggcctgcagagaatctatgagaagtacaggtggaagctctactccgagaggctgatgaccctgaccggcgtgtacgggttctggaagtacgtgagcaacctggagaggcgcgagacccgccgctacatcgagatgttctacgccctgaagtaccgtagcctggcaagccaggttccgctgtccttcgattagtacggggaaagaaggagaagaagaagaagaagcccaggccggagaaccatcgcctgcatttcgatctgtttcaccgcaattcgcattgttagtcgtgtattggagttatgtgtacttggtttccaagaactttggttccttgtttttttttctttcttgtttgagcgtttttgggcagcgctggcctggttcctagtatg

SEQ ID NO: 29166 - DNA, 453 bp, Zea mays
  Clone ID: LIB3059-044-Q1-K1-E7
cccacgcgtccgggacaccgtcggccattacgagtcacacatggcgttcacaatgcctggcctgtaccgcgttgtccacggcattgatgtgttcgaccccaagttcaacatcgtgtctcctggcgcggacctgtccatctacttcccgtacaccgagtcgcacaagaggctgacctcccttcacccggagattgaggagctcctgtacagccaaaccgagaacacggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggcaacccttccaaggacaaggaggagcaggccgagttcaagaagatgtttgacctcatcgagcagtacaa

SEQ ID NO: 29167 - DNA, 403 bp, Zea mays
  Clone ID: LIB3059-018-Q1-K1-F11
cccgtacaccgagtcgcacaagaggctgacctcccttcacccggagattgaggagctcctgtacagccaaaccgagaacacggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgctgcgaccatggcaacccttccaaggacaaggtggagcaggccgagttcaagaagatgtttgacctcatcgagcattacaacctgaacgggcacattcgttggatcttcgcccatatgaactcgcgtccgtaacggcgagctgttccgttacatttgctacaccaaggtctctag

SEQ ID NO: 29168 - DNA, 253 bp, Zea mays
  Clone ID: LIB3059-017-Q1-K1-G4
acgaacgttcggcctgactgtgatcgagtccatgacgtgcggtctgccaacgatctgtaccggccatggtggccctgctgagatcatcgtggacggggtatctggcctgcacattgacccttaccacagcgacaaggccgcggatatcctggtcaacttctttgacaaatgcaagggagatccgagctactgggacaagatctcacatggcggcctgcagagaatctatgagaagtacacctggaatctctac

SEQ ID NO: 29169 - DNA, 240 bp, Zea mays
  Clone ID: LIB3059-029-Q1-K1-F1
cggacgcgtgggcggacgcgtggggtttactacccgtatacggaaaccgacaagagactgactgccttccatcctgaaatcgaggagctcatctacagcgacgtcgagaactccgagcacaagttcgtgctgaaagacaagaagaagccgatcatcttctcgatggggcgtcttgaccccgtgaagaacatgacaaggctgggcgagatgtacggcaagaacccgcgcctgaaggagctg

SEQ ID NO: 29170 - DNA, 433 bp, Zea mays
  Clone ID: LIB3059-042-Q1-K1-B5
cccacgcgtccgctgataccgtactaccgtctacaggatcagtatagctgaaggcatgagcaaattggagggtgtagacggtagtacggtatcaaaacaaggacttcgatttgttttcactgatggatctaggattatcttccggctttcgggaaccggatctgctggagctactatccgcctctacatagaacaatttgaatctgatatctcgaagcatagtctcgatgctcaaacagctttgaagcctttaatagacctggctttgtctgtttcgaagctcaaggacttcacaggaagagagaaacctactgtcataacataggccctgtttgtttcggcttttggcagcttctggccaccaaaagctactgcgtactgtcaaacgctcagcttttcagccagcttctataaaattcggttggggcaaaaa

SEQ ID NO: 29171 - DNA, 431 bp, Zea mays
  Clone ID: LIB3059-019-Q1-K1-H1
cccacgcgtccggcttggtgctgatgaaagctcactgttgaattgtgtcccgaaagaggactttggaggtggtcatccggatcctaaccttacctatgcaaaagagttggttgaacgcatgggtcttggaaagtcatcctcaaatgttgagcctcctgaatttggtgctgcagctgatggagatgctgaccgcaacatgattcttggtaaaagattctttgtgacaccgtcggactctgttgccattatcgcagccaatgctgttcaatcaattccttactttgcttctggcctgaaaggagttgccaggagcatgccaacatctgctgcccttgatgttgttgcaaagaatttgaaccttaagttctttgaggtgcctactggaatgaagttttttgggaatttgatggatgctggaatgtgctcaatct

SEQ ID NO: 29172 - DNA, 422 bp, Zea mays
  Clone ID: LIB3059-020-Q1-K1-B12
cccacgcgtccgcctccccaaaggccctaacctatcgcccgtacgagactgcgccgccgttgccgtctcctcctccgtcccatcactctctgctcgcgcactctcacctgcccgcgccgtcttcgaccgccaccaagatgaacaaggagaggctcatgaagatggccggcgccgtccgcaccggcggcaagggcaccatgcgcaggaagaagaaggctgtacacaagacggtcaccacggacgacaagaggctgcagggcactctcaagagagtaggggtcaacaccatccctgcaatcgaggaggtgaacatattcaaggacgatctcgtcatccagttcttgaaccccaaagtgcaagcttccatcgcagcaaacacatgggtggtcagtggatctccacagacgaaaaagctacaggat

SEQ ID NO: 29173 - DNA, 379 bp, Zea mays
  Clone ID: LIB3059-049-Q1-K1-B3
gctctgtaaagaaggatgcaattagtccccatggtggcaccagtagctcaagtaatcagttggttcagcatggagtctacaaccaagggatgggctatatgcagccacagtaccacaatggggaaacctaataaagggctaatacagcagcaatttatgctagggaagtctctgcattgcttaccatgtgtattggcagaaaacaggaggcacttacaaagggtgttaatctctgcgatggctgcctctcaggtgtaaattggcttccgtttagcgctgcttttgtccgtatatttaggatgatttgacttgtgctacttttgggcaccttttacatttacagatatgtattattcagcataaatataatatagtagtc

SEQ ID NO: 29174 - DNA, 407 bp, Zea mays
  Clone ID: LIB3059-044-Q1-K1-F4
cgcagcgtgatgggtttcaaggatactccaaggttcaatttttctttccaggagttcggaccgaagattataatacccctggagaatctgcggagtatcgagctcctacacctgctgttggaacaccaaaacaaagaaatgatgctggagatgatgataatgatgatgatgatgatgaacctcctcttaatgaagacgacgacgaggagttagatgaccttgagcaaggggaggatgaacctaacacacaacatcttgtacttgcacaatttgataaagtgtcaaggaccaagaatcgttggaagtgcaccttgaaggatggaatcatgcatttgaatggcacggatgtcctttttaacaaggcgacaggtgagtttgatttttgattttttggatgaagatgagct

SEQ ID NO: 29175 - DNA, 409 bp, Zea mays
  Clone ID: LIB3059-035-Q1-K1-H9
gggatggcaataaatggggcagacccaacagctggtcatccaagtccctacatgccggcaccttccccttggatgaatcagaggccgctgggtgttgatgtgaatgtcgcttatgtggaaggccgtgaagatcctgacaggggcgtgcagcctcagccactgactcaggattttttgatgatgtcttctgggaaacgcaagagggatgagtatcctggtcagctcccttctggttcttttgtaccacaacaagatggaagtgctgatcagatagtagaatttgttgtgtcaaaggaaaatgcgaatcaactttggagttccatcggcaataagcttgaaacaccaaccaagacaatcactccagttattccgcagcgtgatgggattcaagataactacaatgatcaat

SEQ ID NO: 29176 - DNA, 422 bp, Zea mays
  unsure at all n locations
  Clone ID: LIB3059-042-Q1-K1-E7
cccacgcgtccgggaacaagctgagatctccagcatggggaggggaaggattgagatcaagaggatcgagaacaacacgagccggcaggtcaccttctgcaagcgccgcaatgggctcctcaagaaggcgtacgagctctccgtcctctgcgacgccgaggtggcgctcgtcgtcttctccagccgcggacgcctctacgagtacgccaacaacagtgtgaaggctacgatcgagaggtacaagaaggcacacgccgttggctcttcctctggccccccactcttagagcacaatgcccagcaattctaccagcaagaatccgcaaaactgcgcaaccagatccaaatgctgcaaaacactaacaggcacttggttggtgactctgtgngaaacttgtcactcanagagctgaagcagctgg

SEQ ID NO: 29177 - DNA, 418 bp, Zea mays
  Clone ID: LIB3059-047-Q1-K1-D8
cggacgcgtgggcggacgcgtgggcggacgcgtggggggatgcattccagcttgcgcgaagagaaagctccttgtattatatttattgatgagatagatgccattggcaccaaacgttttgatagtgaagttagcggtgatagagaagttcagcggacaatgttggaattattgaatcaactggatggattcagcagcgatgagagaataaaggtcatagctgcaactaaccgtgctgacatccttgaccctgctctgatgcgatctggacggttggaccgaaagattgagttccctcacccatacgaagaagcatgagctagaatcttgcaaatccattcaaggaaaatggatggaaatcctgatgtccaccttgaagaattggctcgctcaactgatgacttcaacggagcacagc

SEQ ID NO: 29178 - DNA, 435 bp, Zea mays
  Clone ID: LIB3059-010-Q1-K1-H6
ggaccgtagattgagttccctcatccatcagaggaagcaagagctagaatcctgcagatccactcgaggaaaatgaatgtgaatccagatgtcaactttgaagagttggcgcgttcaaccgatgatttcaatggcgctcagctaaaggctgtttgcgtagaggctggcatgctcgctctacgccgagatgctacagaggttacccacgaggatttcaacgaggggatcatccaagtgcaggcaaagaagaagtccagcttgaattactacgcgtaagggggggaacgcccggtacttggtgatcattcagttgtttgtgacactgccattgtctgggcaggctaacttactatttgtactataagcaagctgttgcttttgtgtcttactccgtatgagagtatcatttatgaaatattaaccaagtctgcctgc

SEQ ID NO: 29179 - DNA, 395 bp, Zea mays
  Clone ID: LIB3059-018-Q1-K1-B7
agcatctccgctccggctgcgctctgccttgctttcctgctacctgctctagcgcgagcgagagaggtacggcggccgatctggcggcgcaggcggagggctcggccggggccggcaagtcggcgccgaacatggggaggggccgggtcgagctcaagcggatcgagaacaagatcaaccgccaggtcaccttcgccaagcgccgcaacggcctgctcaagaaggcgtacgagctctcggtgctctgcgacgccgaggtcgcgctcatcatcttctccaaccgcggcaagctctacgagttctccagcacgcagagcatgccaaaaacacttgaaaagtaccaaaaatgcagttttgcagggcctgaaacagcactccagaatagagagaatgag

SEQ ID NO: 29180 - DNA, 410 bp, Zea mays
  Clone ID: LIB3059-053-Q1-K1-C9
ggacaaggagatgactctggaggaatttgagaaaataagagaggagaagaggagagcgactacttgcattgaaggctgaggagaggaaagttgaagttgacaaggatttgcagtctctgcagccactttcaaacaagaaagaaaatgatgaagttttcattaagctgggttctgacaaggataagaagaaggaaaatgctgagcgtgatgagcgtgccaagaagtcggtgagcatcaacgagttcctgaaacctgctgaaggagaaaggtactacggcggccgtggccgtggaaggggccgtggggatcgtggtggttttagaggcggatacggagggggatacagtcgtggcccagctgctgctgctccatccattgaagatcaagctcagttcccaagcctcggtggg

SEQ ID NO: 29181 - DNA, 398 bp, Zea mays
  Clone ID: LIB3059-033-Q1-K1-F8
caagaaaaagagactcgtccagtcgcccaactccttcttcatggatgttaagtgccgggggtgcttcagcataaccactgttttcagccactcccagactgttgttgtgtgccctggctgccaaactgtcctctgccaacccacaggaggaaaggcaaggctcactgagggctgctctttccgcaggaagggagactagagcggatgtggtcttcaagttttgctctatgccagatactagcgtcatgaactgcctttagctaagattttccataagttgttctcgagcagctatgtgttgcatgttggctacttccaaacttatatctggtttggtttggattgtgatgaactaatggctctttgaatttatattatgatgttgacgatatttggtg

SEQ ID NO: 29182 - DNA, 432 bp, Zea mays
  Clone ID: LIB3059-041-Q1-K1-H6
gatctgctcaacccgccggcagaactcgagaagctcaagcacaagaaaaagagactgggccagtcgcccaactccttcttcatggatgttaagtgccaggggtgcttcagcataaccactgttttcagccactcccagactgttgttgtgtgccctggctgccaaactgtcctctgccaacccacaggaggaaaggcaaggctcactgagggctgctctttccgcaggaagggagactagagcggatgtggtcttcaagttttgctctatgccagatactagcgtcatgaactgcctttagctaagattttccataagttgttctcgagcagctatgtgttgcatgttggctacttccaaacttatatctggtttggtttggattgtgatgaactaatggctctttgaatttatattatgatgttgacgata

SEQ ID NO: 29183 - DNA, 255 bp, Zea mays
  Clone ID: LIB3059-018-Q1-K1-H3
cagctttctcagattgaagaccagaagaactttctaccccagttagttgagactgaaatggacagacttttgaaggagggcacttacaaaggaaagaagtttaatgcaatctgtcacttctttggctaccaagctaggggagcactgccttccaagtttgactgcgattatgcctatgtcttggggcatgtgtgctaccacatcatagctgccggtttgaacggttacatggccacagtgacaaatgttaagagt

SEQ ID NO: 29184 - DNA, 442 bp, Zea mays
  Clone ID: LIB3059-028-Q1-K1-D5
tggcaacctagtcgccactctgctcgcgcacaagttgggagtcactcagtgtaccatggctcatgccttggagaaaaccaaataccccaactcggacatatacttggacaaattcgacagccagtaccacttctcttgccagttcacagctgaccttattgccatgaaccacaccgatttcatcatcaccagcacattccaagaaatcgcgggaagcaaggacaccgtggggcagtacgagtcccacatcgcgttcactcttcctgggctctaccgtgtcgtccatggcatcgatgttttcgatcccaagttcaacattgtctcccctggagcagacatgagtgtttactacccgtatacggaaaccgacaagagactcactgccttccatcctgaaatcgaggagctcatctacagcgacgtcgagaactccgagcacaag

SEQ ID NO: 29185 - DNA, 441 bp, Zea mays
  Clone ID: LIB3059-015-Q1-K1-E7
actcagtgtaccatcgctcatgccttgttagaaaaccaaataccccaactcggacggatacttggacaaattcgacagccagtaccacttctcttgccagttcacagctgaccttattgccatgaaccacaccgatttcatcatcaccagcacattccaagaaatcgcgggaagcaaggacaccgtggggcagtacgagtcccacatcgcgttcactcttcctgggctctaccgtgtcgtccatggcatcgatgttttcgatcccaagttcaacattgtctcccctggagcagacatgagtgtttactacccgtatacggaaaccgacaagagactcactgccttccatcctgaaatcgaggagctcatctacagcgacgtcgagaactccgagcacaagttcgtgctgaaggacaagaagaagccgatcatcttctcgat

SEQ ID NO: 29186 - DNA, 407 bp, Zea mays
  unsure at all n locations
  Clone ID: LIB3059-056-Q1-K1-A5
agatcatccacagagaccatcttccgtgtaagagacaagagagtgggagagaggggggatatatggcagacatcgcgttgctggtgacggagcagttcgacaagaagctgaagcgaggcgcccccggcgaggacatcggcggcggcgccggcgaatataggaggaacttcggggccgtggccaaggtgtggagctcgtgggtggagtccgccgccgccgcgtccggggtgaggttcagcgtctcggtgcacctggagcccaagaccgcgctcgccctggccgccgacgacggcctcttctccgcctagctagctagctagctactagtgtcgcctagctgcttncaggcccttcttctgagtgagcatcagtagtcgagttcttctggaccatataatacaatgcgc

SEQ ID NO: 29187 - DNA, 395 bp, Zea mays
  unsure at all n locations
  Clone ID: LIB3059-035-Q1-K1-D9
catctctagggctcctgtttctccccatcctccccccaccctaccccgcaccaaacgggttcaatccgacatgacaagcatccatgtcgtcgtcacgccggagctcgagccccgacagcaacgacacgacggacgagcgcaagcggaagcggatgctgtccaacagggagtcggcgcggcggtcgcgcgcgcggaagcagcagcggctggaggagctgttggcggaggtggcccgcctgcaggcggagaacgcggcgacgcaggcccgcaccgcggcgctggaacgcgacctgngcagggtggacggcgacaacgctgtgctgcgcgcccgccacgccgagctgaccggccgcctgcagtcactgggcggcgtcctcgaagtgctccagatggcc

SEQ ID NO: 29188 - DNA, 429 bp, Zea mays
  Clone ID: LIB3059-019-Q1-K1-B10
cccacgcgtccggtggcaaactacatgggtcaaatggccatggctatgggaaaacttggaacgcttgagaatttccttcgtcaggctgacaacctgcggctgcagactctacaacagatgcaaaggatcctgaccactagacagtcagctcgggcgctacttgtgataagtgattactcttcacgtctccgtgccctaagctctctctggcttgctcggcccaaggaatagcaagaacatgctatttgactgcaatacttttcacaatttggttttcaatggtcaggagatttgacaaggctgcgacagacttgattcggacatatctgcacatactatgacccaaatggaaggggatgttcatgtagcttaagctgcttagctttgtagttaagtgttgttgatgtatcattaccaactgctgtaaaa

SEQ ID NO: 29189 - DNA, 373 bp, Zea mays
  Clone ID: LIB3059-042-Q1-K1-A5
gtcttctcatgaacgcatcgcccctctccacctgctgatccttcgccgtctctctctgtctctctctctctctctcttagatagtcttttgaatccatctctagggctcttgtttctccccatcctccccccaccccaccccccaccaaacagattcaatccgacaagacaagcatccatgtcgtcgtcacgccggagctcgagccccgacagcaacgacacgacggacgagcgcaagcggaagcggatgctgtccaacagggagtcggcgcggcggtcgcgcgcgcggaagcagcagcggctggaggagctggtggcggaggtggcccgcctgcaggcggagaacgcggcgacgcaggcccgcaccgcggcg

SEQ ID NO: 29190 - DNA, 414 bp, Zea mays
  unsure at all n locations
  Clone ID: LIB3059-023-Q1-K1-E11
gccacgcgtncgattgggcaagggtacaactgtgctgcaaagtggcactccaggcattggtggactcccagccaaggcaatgctgcagaaactgcgaatgtttaatacatattttgaggagatctatgcggcacagtcagaatgggtgatagcagatgaccagctaaaggttgacattagggcagcggtggaggagacagtgatgccagtttacgcctctttaattgccaagttaaagtcttctcctgaaactgggcgtgatttgtacatcaaatacaccccagaagatgttgtaacccacatccagcacttggtttgaagaacaacaaagtgataaatgatatgtatccttgtagcctgttatactgcagcttctgctcttctgaacttgtgaagttgctaccatggatttct

SEQ ID NO: 29191 - DNA, 367 bp, Zea mays
  Clone ID: LIB3059-024-Q1-K1-E10
gcgcggcggccacaaaacccagtcccatacgcacccgtccgttccgcgcgatcagccgagcgatgtcgtcgtcggcgcccgcaccggccgccatggccgtggacgacgcggaggacgaccagctcgcctccatgtccacggaggagatcatcagggcctcccgtctcctcgacaacgagatccgcgtccacaaggatgagctgcagcggtcgaacctggagctggagtctatcaaggagaagaccaaggagaaccaggagaagattaagctcaacaagcagctgccgtacctcgtcggcaacatcgtcgagattttggaaatgaaccctgaagatgaggctgaagaagatggtgctaacatcgatct

SEQ ID NO: 29192 - DNA, 394 bp, Zea mays
  unsure at all n locations
  Clone ID: LIB3059-047-Q1-K1-C2
cttgcgtgttgtcggtagtgaacttattcaaaagtaccttgnggatggtcccaagctagtcagagaattgtttanggtggctgatgaactttctccctcaatagtcttcattgatgagattgacgcagttggaacgaagaggtatgatgctcattcaggaggggagcgtgagattcaaagaactatgttggagctgctgaatcagctagatggttttgactcacgtggagatgttaaagtcattctagcaacaaaccgcattgaaagtcttgatccagccttgcttcggccaggccgtatagaccggaagattgaatttcctctaccagatattaaaactagacgacgcatcttccagatacacacatcgaaaatgacattagctgatgatgtg

SEQ ID NO: 29193 - DNA, 424 bp, Zea mays
  unsure at all n locations
  Clone ID: LIB3059-027-Q1-K1-C2
cgacagagggaaaaaaactcagaaacccaactcgctcgttcccgcaactcgcatcttgctcgtcgacagctccaactccggaacccttgtcgccggcgccggcgatgtcgtcatctaccgcccccgccccggcggcggcgatggccgtggacgatgcggaggacgaccagctcgcctccatgtccacggaggacgacatccgggcctnccgccttctcgacaacgagatccgcgtcctcaaagacgagttgcagcggacgaacctggaattggagtccgtcaaggagaagatcaaggaaaaccaggagaaaattaagctcaacaaacagctaccctaacctcgtggcaatttcgttgagatcttggaaatgaatcctgaggatgaagctaaggaggatggtgctaacattgatttagattcaca

SEQ ID NO: 29194 - DNA, 404 bp, Zea mays
  Clone ID: LIB3059-003-Q1-K1-C10
ggttcctgattctacatatgatatgattggaggccttgaccagcaaattaaagagatcaaagaggtcattgagcttccaatcaaacatccggaactatttgagagccttggaattgcccaaccaaagggtgtcctcctttatggacctccaggcacaggaaagacattgctggcacgtgcggttgctcatcacactgactgcaccttcatcagggtgtctggttctgaattggttcagaagtatattggtgaaggttcccggatggttcgggaactatttgttatggccagggaacatgcgccatgcatcatgttcatggaagaaagtgactctatcggatctgctagaatggagtctggaactggcaacggtgatagtgaagtgcatcgtacaatgcttgaac

SEQ ID NO: 29195 - DNA, 427 bp, Zea mays
  Clone ID: LIB3059-036-Q1-K1-G10
ggttgacaatattacatgtgcaccgaccacaaaccaaataatcagcaaaatggatttcgagtggcatctcaacatgcacaaccttaggtaaaagcttgagatggagaaactaaaagtttccaacagcgaacacaaagagtggctggggctggcctaggaggggaggaagaagagtgccatcacacgaaaaccatgacctcacagcattggtgcagtaacatttcactatttagagcctatgatcaggctttaaagagtggctggggctggcctaggaggggaggaagaagagtgccatcactaacaaaacagcccctcgaaccatggttgttttgcgacctctaaaggtggtaataactaacttggaagaaggaaaagtactagaccttgatggcaaaatgtggcctgatgcttctgatactgatgc

SEQ ID NO: 29196 - DNA, 429 bp, Zea mays
  Clone ID: LIB3059-036-Q1-K1-B10
cccacgcgtccgccgaaactccgacagtccgaccacaagaaggatgagtgaagaggatgagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagatcacaaagggaagcaaagttaaatatgagcttgacaagaaaactggactgattaaggttgatcgagtcctgtactcatcagttgtataccctcacaattatggtttcgttccaaggactctttgtgaagacaatgacccaatggatgtgttagtcctgatgcaggagcctgttgttcctggttcgttcctgcgagcaagagcaatcggccttatgcc

SEQ ID NO: 29197 - DNA, 154 bp, Zea mays
  Clone ID: LIB3059-020-Q1-K1-H3
gtcctgccgatggagaatcgagcagccctttttttttgttctatcaactatgctgtaatgctggctatgtatcggcaaaaacaattctatatgctgagttggagtcggcaaaaattcatatatgctgagttggagacagcaacttgtttggatc

SEQ ID NO: 29198 - DNA, 400 bp, Zea mays
  Clone ID: LIB3059-029-Q1-K1-B3
ccgactcgtacgtcatgcaacaaaaccctttaatgatggaaagtacctcccggttcaggtgggacctataaactggttattttttcgcgactacaggaaggtgtggaagtacttcacgaagttgattgcttagcaactggaagatatgctatcattgatgcactaaggtggaacgttggaattatcgatgccacatacagcacacgaataccgaagaacatgctgatgaaaatggctgaaggaaaatgtcagatcatatttctgtgaacactatgtaatgaccaacatgttcttgagagaactatacaatcgaaagttcaacaaagacctgactatgcatagcatacagaatatgaagctggcgtacaagatttcaaataccgattggcctattatgaaa

SEQ ID NO: 29199 - DNA, 402 bp, Zea mays
  Clone ID: LIB3059-023-Q1-K1-A7
cccacgcgtccgcccacgcgtccggacaaggttgcgtatgccctgtctcagggactaaaggtcattgcatgtgttggtgagacccttgagcagagggaggctgggtctaccatggatgttgttgctgcacaaacaaaagcaattgctgagaagatcaaggactggagcaacgtagttgttgcctatgaaccagtttgggctattggaactggtaaagttgccaccccagctcaggctcaggaagtgcacgcctccctgagggattggctaaagaccaatgccagccctgaggttgctgaatctactaggatcatctacggaggctctgtaactgctgcgaactgcaaagagctagcagcacagcctgatgtcgatggttttcttgtcggtggagcttctttg

SEQ ID NO: 29200 - DNA, 415 bp, Zea mays
  Clone ID: LIB3059-026-Q1-K1-G9
aatgggttattcttggacactctgagcgtagacatattattggtgaaaatgaggagtgtattggaaagaaggctgcatatgcattgagccaaaatgttaaggttattgcctgcataggagagctgctggaagagagggaagcaggcaaaacttttgatgtatgttttaggcagatgaaggcttttgcagatagtatttcaaactgggcagatgttgtaattgcatacgagcctgtttgggctattggaaccggaaaagttgctactcctgaacaagcccaggaagttcatgctgctgtacgcaattggctgaagaccaacatatgacccgatgttgcctctagcactcgaataatctatggaggatctgagaatgcatgcaactgtgcggagctagcaaagaaagaagatattga

SEQ ID NO: 29201 - DNA, 266 bp, Zea mays
  Clone ID: LIB3059-060-Q1-K1-G9
agacccacgcgtacacatcgcctctcacttgcacagatacatggacaccgcgccgtgaaacaccatgtgtcgagctcggtccatgctccagtctgagctcggagttctgcgcacccatctcccccggctccttgcagctcggatccctgcacgtggagtcttatccatagccaagatcgttcttgctcgctgtcgatgcctaatacgacgtcagctatcgctacagctatggcgctatatcgatcaggagtccgtatactatgcgc

SEQ ID NO: 29202 - DNA, 393 bp, Zea mays
  Clone ID: LIB3059-060-Q1-K1-H10
ctccagtgagccgagggcggagacggggacggtgggcagagtgacacgccggacgcctctccgccccgctccggtccagattgcgcgcacccacccatggcgctcgccgcttcccaccacggcctcctgcccttcgcccccgctgtcacgcctaccccgtcacgggggcacctgcgcttgcgcgccgcgcgccctctgtcccgccccggccggagaatgtgttgccaatctatcaactcagctaatgcgttgggagcttcttcaacgacatctgatgaggcagtcccagtcccagttgtacagatagatcaggactcagaccgtgatgcgaccattgtgcagctaagttttggagatcgattggaggcactacttgacacgatgaaagcactc

SEQ ID NO: 29203 - DNA, 382 bp, Zea mays
  Clone ID: LIB3059-060-Q1-K1-H12
cgcacgcgtccgtccacgcgttcgcttagacgccgccgtcgcccaaagaaggacggggactccggaaaccaggatgggagaactgaagagaaggatgggctttgagaagcagatcctgagatccggcaccggtcccaagccgataaagggccagaaggtcaccgttcactgcaccggctacgggaaggatcgtgatctgttcaagaaattttggagcaccaaggaccctgggcagcagccattcagtttcagcattggtcaaggttcagtgatcaaaggatgggacgagggagttatgaccatgcaagtgggtgaagttgctcgtatacagtgcacgcctgattatgcttatggagccggcgggttcccagactggggaatt

SEQ ID NO: 29204 - DNA, 415 bp, Zea mays
  Clone ID: LIB3059-060-Q1-K1-H2
cccacgcgtccgcggacgcgtgggtctggcttatcgagttgcacaagtagaggagggggcggaaaagaaagtagttgcaggatcacattagcactgacggccatgctgtctgcatcgtttcccgttgtcgtctgcaggatcgccatcgccgtgctcatagtttctaccctgtcatcctatgcggaggcgaggtactactgctacgccccgtgcaaggactgcccgaactgcagcagctggtgcaaggggaaagggtaccccaagggcgggcggtgccacccgaaggacggcggcggcgacatcgtgttctgctgctgcgacagggcagacgtcatgaagctgctagtttcagcagatgcgaatgcgattctctgatggactggcaaacaaataaacggggctggacgcattgaga

SEQ ID NO: 29205 - DNA, 450 bp, Zea mays
  Clone ID: LIB3059-060-Q1-K1-H4
accggttcggaatataccgtcccaagcgtccggtgacgcgtgtgcggacgcgtgggtttgagctttcagaaccacacctagcgaagcgcactagcaacgacctaacaacaatggctaccaagatattatccctctttgcgcttcttgccctttttgtgagcgcaacaaatgcgttcattattccacaatgctcacttgctcctagtgccattattccacagttcctccctccagttacttcaatgggcttcgaacacccagctgtgcaagcctacaggctacaacaagcgcttgcggcgagcgtcttacaacaaccaattgcccaattacaacaacaatccttggcacatctaaccatacataccatcgcaacgcaacagcaacaacaatttctaccagcactgagccaactagctgtggtgaaccctgtcgcctacttgcaacagcagt

SEQ ID NO: 29206 - DNA, 418 bp, Zea mays
  Clone ID: LIB3059-060-Q1-K1-H5
ctgaaaagatccgatcatgcgatgaagcagactcttgtagtgcaaaatgtaattctcggctccagcctttgaagtcacaaatgccaaaatcgctaggcagctgttgggccactgcctgttgttggcagggtggttgacgtctcggcgacggatatgtgatctgatccacatggcatatccttgtagaatatgcaggaaggactaccgagtgcaactttcatggcctgaaccacatcctggatgaaagattgctgaaggtgaccttatgattcttgaaacagggatgtttgacaaatttgtaatgtacttttgggctttaagtatcttattatcttaagctacctagtaatcagcacttgtaccttaaggtgtgcgttatggcaagttcttttagagggcttgtttggactagcaccat

SEQ ID NO: 29207 - DNA, 342 bp, Zea mays
  Clone ID: LIB3059-060-Q1-K1-H6
ccgacgcgtccggccacgcgtacgactacgcgtccgatgcgtctgacgtgacctagagggctgcatccatcaagcaacgattgatgttatctattggagcttaccagcagtcttgcgacttgtcacctgtggtagaataaccgtagtacttagtggatgtagcaacgcgtagcatatatatatatatatatatccactggtgtataattgaaccgtagtataactggcctggatttaactagaacatagtgtatacctggaataattggagcttgagtctcgaaccaggagctatccgcacatgaacttttgggctttaagtatcttattatcttaagctac

SEQ ID NO: 29208 - DNA, 386 bp, Zea mays
  Clone ID: LIB3059-060-Q1-K1-H7
ccggcgcttacgcctacgcctccgccttcgcgtccgatgcggctgacgggacggtggggggctttttccatgaagcaacgattgacgttatctattgtagcttaccagcactcttgtgacttgtcacctgtgttagaataaccgtagtacttagtgtatgtagcaacgcgtagcatatatatatatatatatatccactaatgtctaattgaaccgtagtataactgccctgaatttaactagaacattgtatatacctggaataattggagcttgagtctcgaaccaggagttatccgcacataaactaataatactataagtatctaatcaaattaagcttacctaataatcagcactagtaccttaatgttcgcgttatttca

SEQ ID NO: 29209 - DNA, 416 bp, Zea mays
  Clone ID: LIB3059-060-Q1-K1-H8
gatccttttgaccaggatgactgggttcactatgctaagatgactgaagaaattggagagcaagtgcagattgttggtgatgaccttctcgtcaccaaccccactagggttgctaaggctatcaaggagaaatcatgcaatgcccttctgctcaaggttaaccaaatcggatctgtgactgagagtattgaggctgtgaagatgtcaaagcgtgcgggctggggtgtgatgactagtcataggagtggtgagactgaggacactttcattgctgatctggcagttggtttgtccacgggtcagattaagactggagcaccctgcagatcagagcgtcttgccaaatacaaccagcttcttaggattgaagaagagcttggcgctattgctgtctacgcaggtgccaaattccgtgc

SEQ ID NO: 29210 - DNA, 410 bp, Zea mays
  Clone ID: LIB3059-060-Q1-K1-H9
ggttttacgaaggaccaggacttagattatttgtttgttgaagctgcacggcgagagttaagagtaataattgagaacaagcaacgccttgttctggcgcatgctacatcaggttacaagcatagtgtaaaggaagttttggacacaccaggtgtgatggctctgataaaagatacaactgcagcacaggaggttcgagctctgcaggatttcttcaatatgcttactaatgagtcagctcgtgcttgttatggaccgaatcatgttgagtttgcactgcaacagtttgctatccagactctattaataactgatactatgtttcggaacgctgacattgctactaggcaaacgtacgtgaagttgggtagaagatgtcaaggaaatatagttgcacagtacacatattt

SEQ ID NO: 29211 - DNA, 403 bp, Zea mays
  Clone ID: LIB3059-060-Q1-K1-G8
gcataccattggctatcattgcaatagctagtttgttggttgaaagatcacgtgaggagtggtcagaagtgtacgacaagattggtcatgggaatgaagacaatacaacaaagataatgtcatacagctactatgatctgcctccttatctcaagccatgtctgctgcaactaagcatatatccagaagactacctcattaatgcaaaagttgcaatatggatgtggataggtgaaggtctagtccatcttgagaaacaagatgttagcctatttgaggttggagaaagatacttcaaggagcttgtgaatagaagcatgatccagccgagagaggacaaatatgatcggtttatacaagagtttcgtattcacgacattgtgtttgatctcatctgtaagtt

SEQ ID NO: 29212 - DNA, 252 bp, Zea mays
  Clone ID: LIB3059-060-Q1-K1-F10
aggcgccacgatgctatcttcttgtagaccgacacaagagaaagcatgtggcttccaactctgcgatgcactaacgaaagcaagattgctatcactgcagcattagggtatgatagttaccttgtcatgctacatgtggctggccctggcataagttgcgaagcttccagtgtggtcactgtcatagacacgacgtccacggacgatgcccttggcctgcatatgctggtgtacgaacgatggaatgacctg

SEQ ID NO: 29213 - DNA, 375 bp, Zea mays
  Clone ID: LIB3059-060-Q1-K1-F11
cccactcgtccgcggactcgtgggttattatcacgcacgtaatctaagcatcgaaggcgagtgcgtgcgtgttgggtgggggtacgcgcatcgcggtttgacgcgcgatgcattgataataattcgtgccccgaggtaccaataagcaacgatgagagaagcattccaccttgcatttacactccccttttaggcttattgagcccaatccacatgtgttgaggtggattgagggtgtttaacgaggctttagggcttttgaggtggattggaggtgtttaatgaggctttagggttttatttggtttgaaagggattagagtggattaaatttccttttatacaaatttgtgtacgagatctaattcttcttaa

SEQ ID NO: 29214 - DNA, 418 bp, Zea mays
  Clone ID: LIB3059-060-Q1-K1-F2
gtgaaaacccaattcttcaaccctacaggatccaacaggcaatcgcagctggcatcggacctgtatcacccttgttcctccaacaatcatcagccctattacaacagttacctttggtgcatttattggcacaaaacatcagggcacaacaactacaacaacttgtgctagcaaaccttgctgcctactctcagcaacagcagtttcttccattcaaccaactaggttcattgaactctgcttcttatttgcaacaacaacaactaccattcagccagctacctgctgcctacccccagcaatttcttccattcaaccaactagcagcattgaactctcctgcttatttacagcagcaacaactactaccattcagccagctagctggtgtgagccctgctaccttcttgacacaacc

SEQ ID NO: 29215 - DNA, 411 bp, Zea mays
  Clone ID: LIB3059-060-Q1-K1-F3
ggtgtgagccacacggttccaatctatgtaagatacacactttctcatgctattctgcgtgtggatcttgcggggcgtgacctcaccgaccacctaatgaagatcctcacagagagagggtactccctcactacgagcgctgagcgggagattgtcagggacataaaggagaagcttgcctacgttgcccttgattatgaacaggagctggagactgccaggagcagctcctctgtcgagaagagctacgagatgcctgatggtcaggtcatcaccattgggtcagaaaggtttaggtgccccgaggtgctgttccaaccatcccttgttggcatggaatcgcctggcgtacatgaggccacgtacaacttcatcatgaagtgtgatgttgatatcatgaacgatttgtat

SEQ ID NO: 29216 - DNA, 414 bp, Zea mays
  Clone ID: LIB3059-060-Q1-K1-F4
cccacgcgtccggagaagacgtctctctcctctcggcgtccccgttccccaacctcgggtctgctgcctgcctgcctgcctgcctgcaaaaaggagtttgtcatggcgtctaagcgcatcctcaaggagctgaaggacctgcagaaggacccccccacatcatgcagtgcaggtcctgctggtgaggacatgtttcattggcaagcaacaattatgggaccacctgacagtccctatgctggtggtgtttttttagtgaacattcatttcccgccagattaccccttcaaacctccaaaggtttctttcaagacaaaggtcttccatcctaatatcaacagcaatggaagtatatgccttgacattctcaaagagcagtggagccctgctttgacaatttctaaggtcctgctc

SEQ ID NO: 29217 - DNA, 391 bp, Zea mays
  Clone ID: LIB3059-060-Q1-K1-F5
accaagagtgtcatactaaacatatcttcagatcatttaattgcatgcactaaataggttcaaactggatcaatatcacgaaaggacgcatcatctttgccctgtcattatgcattctaattaggcacatgtgcactctgaattccttaggctatgctgcgaggtacagctactagactggacatacgctctagttatggacctgtaactgagctcagcacaatcagagcgttagcagctgaatgaaactgaacaggccgtcagcgatctgtccttaaagctgatgctcatataatgatgctgatgcgaccttaacactgacacaggataaagcacttaagctgaaacctgtaccagacactcacaatgtatgctgcatagatagctagct

SEQ ID NO: 29218 - DNA, 415 bp, Zea mays
  Clone ID: LIB3059-060-Q1-K1-F6
cccacgcgtccgcccacgcgtccggtggaatgataatctcatcgtctggcgggctcgattcttccactcactctcggtggagttcacaaagtcccagattattgcctcaatacctggatttttcttttgcttgtggtatgcgtcaaagaagcattggcttgcaaacaatgtcctgggattggctttctgtattcaggggattgagatgctgtcattgggatcatttaaaactggagccattctcttgggtggactttttgtgtatgacattttctgggtgttcttcactccagttatggtcagtgtggctaaatctttcgatgctccaataaagcttctgtttccaactgcagacgctgaacggccattctccatgcttggccttggtgacattgtaatacctggtatattcgtc

SEQ ID NO: 29219 - DNA, 324 bp, Zea mays
  Clone ID: LIB3059-060-Q1-K1-F8
gtgagccgccccgccgctcctcagccatcctctccatctcggtgtcacacactccggatacgcacctacgagagtcgagtgacagcgagcgagcgagcgagcgaagccatggctctccgcaccctggcatcgaagaacgccctatccttcgcgctcggcggcgcggcccggccgtcggcggcgtccgcgaggggggtgacgacggtcgcgctccccgacctctcctacgacttcggcgcgctggagccggccatctcgggggagatcatgcgcctgcaccaccagaagcaccacgccacctacgtcgccaactacaacaaggct

SEQ ID NO: 29220 - DNA, 419 bp, Zea mays
  Clone ID: LIB3059-060-Q1-K1-F9
gttcgtgtaaatgctaatgatgaagaggatggagaggatatgacatatgtagagacggcaaggcgttctgttgactcaacatcatctagctacaagaagcggaagaaagagtgtataggaaagatgacttcatcaagtgacctgttttttgatgtgttcaatgaagtgagtggtgatctcaaggttgccaccatgtcaattggaaaaatggctgcaagctatggatcgcgaggcatccaacctagagaaggcaagagatgaggatacactgcacaatctaagagagaaggcgatcaatgaggtactgagactcgaatttactggctcagaagttatcaaagcatctggtgtgtttgttaggatgccagatcaaatggcgattgcgtttgcacttccagaaccactgaggagggaataca

SEQ ID NO: 29221 - DNA, 355 bp, Zea mays
  Clone ID: LIB3059-060-Q1-K1-G2
gctgaaaatcgtacctgcggaggatcgggaagagaccttaactctatgccacttgaaggcggaacagaaaaacagagccgccgaaccttagataaactgtctcatgtgcatgttcctctgtgtgctgttagatttatacatactcacaccaaggagttgttgtttacactttacagccgttgttgtgcaaaagttggacctctgttgtgcagaagataagtctgaagcctttttcattgttcttttttgacataatggagaagctgggggagtgcttgtctctggaggacctccaattcagtgaccgagcactaaatagtaatcaggttctttttgacataatggagaagctgag

SEQ ID NO: 29222 - DNA, 87 bp, Zea mays
  Clone ID: LIB3059-060-Q1-K1-G4
aaatgatagattctaagaatattctgaacatgctgccacctaatcaaaaaaattcatgtggaacatcataaggaataactgttgctt

SEQ ID NO: 29223 - DNA, 419 bp, Zea mays
  Clone ID: LIB3059-060-Q1-K1-G5
gaggagatgctgccgggagctggcggacatcccggcgtactgccggtgcacggcgctgagcatcctcatggacggcgcgatcccgccgggcccggacgcgcagctggagggccgcctagaggacctgccgggctgcccgcgggaggtgcagaggggattcgccgccaccctcgtcacggaggccgagtgcaacctggccaccatcagcggcgtcgccgaatgcccctggattctcggcggcggaacgatgccctccaagtaactgcgaagagcatagtgcatgaggaatgagcttgtagctagctcatatgtctgaataataagcacagcaagaagatgaatgcatttctcggatcgttcatccggaacaataattaaaggggatccggatttgctcttgtgatataattaacgattcc

SEQ ID NO: 29224 - DNA, 237 bp, Zea mays
  Clone ID: LIB3059-060-Q1-K1-F1
cccacgcgtccgggtccatgctgcttgaacccatcatgttgtgtaacatgattttatgtttagccaaatggtgattgtaccaatagtttaagtatagactatagagcacctgataattgaattgctcaattctcctctattcatgctagctctagcatcttacttatccatatacctatatttaaacttactctatgaacaatgcagtttacagtgcaaaacattggtttgagtggc

SEQ ID NO: 29225 - DNA, 414 bp, Zea mays
  Clone ID: LIB3059-060-Q1-K1-G7
aggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctacggcggtcggcgcgagggtggtggcggcggctacggaggcggtggcggctacggcggtcggcgcgagggtggtggtggcggctacggcggcggcggcagcggctggagggactgatgtgtgggcccatcctggcttccgccgagttatcttatctatctatagtatcgtgttaccgttcgcttctgtcaccgtgttagtgtccgttctacctttggattaggtgttggtacccctgttgttccctttgtttgctcccgctatgaaacga

SEQ ID NO: 29226 - DNA, 421 bp, Zea mays
  unsure at all n locations
  Clone ID: LIB3059-060-Q1-K1-D5
cccacgcgtccgcggacgcgtgggcatagagacgccaagttgatgaacgtgtcaaacgagattattgaattgaaaaataaggtttgtgctggaggcgataaaaactttgtggtgatcaatcagaagggcattgaccctccatctctggatctccttgctagagcggggattattgctcttcgaagagcaaagaggagaaatatggagaggcttgtgctagcatgtggtggtgaagctgtcaattcagttgatgagttgactgaagattgtctaggctgggctggtcttgtctatgagcatgttcttggagaagaaaagtacacatttgtggagaatgtgaaaaatcctcgctcttgtactatactgattaaaggacctaatgaccataccattgcacanatcaaggatgctgtccgggatg

SEQ ID NO: 29227 - DNA, 416 bp, Zea mays
  Clone ID: LIB3059-060-Q1-K1-D6
ggcaaacctttctccctactctcagcatcaacaatttcttccattcaaccaactgggtgcattgaaccgtgctgcttatttgcagcaacaactattaccattcagccagctagctactgcctactctcagcaacaacaacttcttccatttaaccaattggccgcactgaaccccgctgcttatttgcagcagcaaatactactaccatttagccagctagctgcagcaagccgtgcttacttcttgacacagcaacagttgctgcctttctaccagcagtttgcggctaaccccgcaaccctcttacaactacaacaattgttgccctttgtccaacttgctttgacaaacccagcagcctcctaccaacaacacatcattggtggtgccctcttttagattgcttattagttgt

SEQ ID NO: 29228 - DNA, 417 bp, Zea mays
  Clone ID: LIB3059-060-Q1-K1-D7
aattgcaacagtttctgccagcgctcattcaactagccatggtgaaccctgccgccggcctacaacagcaacaactgctttcatctagccctctcgttgtgggtaatgcacctacatacctgcaacaacaattgctgcaacagattgtaccagctctgactcagctagctgtggcaaaccctgctgcctacttgcaacagctgcttccattcaaccaactgactgtgtcgaactctgctgcgtacctacaacagcgacaacagttacttaatccactagcagtgcctaacccattggtcactgccttcctacagcagcaacaattgctaccatacagccagttctctttgatgaaccctgccttgtcgtggcagcaacccatcgttggaggtgccatcttttagattacatatgaga

SEQ ID NO: 29229 - DNA, 416 bp, Zea mays
  Clone ID: LIB3059-060-Q1-K1-D8
cccacgcgtccgcccacgcgtccgctgctatgtgggacagccgatctcgagggccgaggcaatgcccgagaggaggtccaggttctggcagatggatgcgcctcctccgccccgggcggaggtcatctgcccccagcctcgccgcgccacccggattcccctcaccgctgtggaaaccctgaacaaagccagccccaagatgaacggtgcatttccgccgtacagatcggactccacttgcgatatacttgatcttatcctcagtaagaatgactcggatggagattcgagcagccaggtgggcttcttatgcggctcacctccgatacgcgctgacaaccctgttatccatgatccacagtttggtaaaagactgccatccttttctcctctaggagggagctcctatggcaaaa

SEQ ID NO: 29230 - DNA, 226 bp, Zea mays
  Clone ID: LIB3059-060-Q1-K1-E1
cccacgcgtccgcggactcgttggatttttttaatttaatataaaagctaaaccagagcaggttttaaatattattgacccaacaatcttaacatacactacttagcacttcacaatcgaatatctcaatactcttatatacatcctcactctagcatctaaattatccatattcctatattactaacgactctatacacaatgctatttacactattaatcattt

SEQ ID NO: 29231 - DNA, 424 bp, Zea mays
  Clone ID: LIB3059-060-Q1-K1-E11
caactagcaacatagaaagcacaatagtgtaccaacaatggcagccaaaatattttggctccttatgctccttggtctttctgcaagtgctgctacggcgaccattttcccacaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacaacagtttcttccattcaaccaactagctgcattgaactctgcttct

SEQ ID NO: 29232 - DNA, 428 bp, Zea mays
  unsure at all n locations
  Clone ID: LIB3059-060-Q1-K1-E12
ccaatccttccggaaaggatttccagttggaggtgccgttatactacaactcaagaagggtggaaggacaggagatgacaaaggataaaaatggtgatccagtgacagggtatgtgaggatctcacaccaggtttacaatgtcacagaggactatgagagactgagggatgttgtcaataaacttgtttctgaagggttcaccagcagcaagttgcggccttctgagaagcaagaagcttaggtgtaatgaccttgcagccaggtagcatccacctgaaggcgctgtggccgactacttaggtgtggaccggatcagcgcaaccagtacggcttcgtgatcgtgacgttgaagaatgtagtgtaccgncaggaactgacatgtgttgtatttggcgttcagtgtaagtaacattaatgcccctgcatg

SEQ ID NO: 29233 - DNA, 138 bp, Zea mays
  Clone ID: LIB3059-060-Q1-K1-E2
ggccaggcttcgccatgtcactcagttttctccgttagttatttccgctgcattaaagtttatggttattatttctgaaacttcgataatgtaatcactaatgatacttattaaatttgtggtattatgttttattgt

SEQ ID NO: 29234 - DNA, 421 bp, Zea mays
  Clone ID: LIB3059-060-Q1-K1-E3
agcagaacaaggctcagctcgttgtcatcgctcatgatgtggatccgattgaactgggtgggtggcttccagccctgtgcaggaagatggaggtcccatactgcattgttaaaggaaaggctcgccttggatcgatcgttcacaagaagactgcatcagtcttgtgtctgaccactgtcaagaacgaggacaagcttgagttcagcaagatcttggaggctattaaggcgaacttcaatgacaagtttgatgaagtcaggaagaagtggggaggtggcatcatgggctccaagtcgcaggccaagaccaaggccagggaaaagttgctggccaaggaggccgcccagcggatgacgtagattatccactgttgagtttgcccctgtagtttgacgtggaagaaccgatgagcattgtgcac

SEQ ID NO: 29235 - DNA, 420 bp, Zea mays
  Clone ID: LIB3059-060-Q1-K1-E4
gttaattctatgaaaatcatttgacaacctgatcaactggcgagaagagtttctaatggaggctagcccatcagatcctgataacttcccttttgttctgttgggtaacaaagttgatgtagatggtggcaacagccgcgtggtatctgagaaaaaggcaaaggcatggtgtgcttccaaagggaacatcccgtactttgagacgtctgctaaggacggaacgaacgtggaagacgccttccagtgtatcgtgaagaacgctctgaagaatgagccagaggaagaactgtatgtgccagataccgtggacgtggtgggtggcaaccgggcccagagatcatccgggtgctgttaaggcacgaggcatcacgaggcgttgtgaccatcatcgtcggttatgcagtgaccaaacaatacctt

SEQ ID NO: 29236 - DNA, 414 bp, Zea mays
  Clone ID: LIB3059-060-Q1-K1-E6
cccacgcgtccgcccacgcgtccgcggacgcgtggggatcagcaaagcggcagtgcggagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatgttccagccgctccggcaacagtgctgccagcagcagatgaggatgatggacgtgcagtccgtcgcgcagcagctgcagatgatgatgcagcttg

SEQ ID NO: 29237 - DNA, 417 bp, Zea mays
  Clone ID: LIB3059-060-Q1-K1-E7
ccctaacctcggccttgtcgatgtcggccgccacaaccgccccaacccctgcggtggccaccccgatggcgccgcctccgtcgtacccggcctcctccacgatctccgcctccgttgccgcgtcggtcgaggaagaggacgacctctatggccgcctcaagtcgctccagcgccacatggagttcgtcgagatccaggaggagtacgttaaagacgaacagaagaacctcaagcgcgaactcctccgtgcgcaggaggaggtcaagcggatccagtccgtaccgctcgtcatcggccagtttatggagatggtcgatggcaacaacggcatcgtgggttctactacgggcagcaactactatgtgcggatcctcagcaccatcaaccgcgagctgctcaagccgtcagcatctgtcg

SEQ ID NO: 29238 - DNA, 414 bp, Zea mays
  Clone ID: LIB3059-060-Q1-K1-E8
cggacgcgtgggagcaaagaagaatggcaaacatgcacccaggccatggactgtggatggatgcaaatggcaaagccagtgatgaatttatatacagaagcaactgatggatcctacattgagagaaaagaaagtgccttggtgtggcaccatcaggatgctgacccaggctttggatcctcacaggcaaaggagctgcttgatcacctggaaagtgtactagcaaatgaaccagtctctgtcaagagtggccagttcatcgttgaagtcaagccacagggagtaagcaagggaatagttgccgagaggatacttgcatcagtgaaggagaggggaaagcaggctgatttcgtattgtgcatcggcgatgataggtctgatgaggacatgtttgaaaatattgccgatatcatt

SEQ ID NO: 29239 - DNA, 418 bp, Zea mays
  Clone ID: LIB3059-060-Q1-K1-E9
gcccacaggacccaacgagccttgtaccgatccaaggagccatccacctttagctggtcttgaagatccatttcccggtgacccctttggcttgtctgtgaaggatcttgctaccaggatccttctcacgtggtgtgatagctccgagccgctgtacactcttcgcctgcttgcctccaattccccgacctccaccttgcatgccttgaccgctgctacctcatctatcacttggtgtcaccgccttggccacctcgggcctgatgtgatgtctaagttgtctagcagttctgtcatctcatgtagtcggggttcttttgagcatttgtgtcatgcctttcagttaggtcaacatgttaggctcccttttccctcctcttctagagcaacaagcaattttgatctggttcactgtgat

SEQ ID NO: 29240 - DNA, 462 bp, Zea mays
  Clone ID: LIB3059-060-Q1-K1-D4
gggccaatatcaaagcgtgtaaactcgaatataccagtcacttcaatgccatagggtgccgcatgacagcaacataagaaggaactaacaagctggcttcccaccatacactgggcaccttcgctgcaatcggctactccttggattctaacgagttatgacatctactgaggaatcccgctttacctcgttatgccatatttcgtgaatttatctctgcttggaaaagccactttgggtgccaatcagacacattggcacgggaattcacaacatcggatttctatcctggccatcactttcacttgtcgactgaaatttcgttcccactgtcaatgaacaatcctgaagaaaggttagctgacgccgggtcaaagaactctgcagcagtcccccgagaaggcaaagagagatgtgagcttcaaccaaaatccaccaggaacggttccttatacagcaatg

SEQ ID NO: 29241 - DNA, 417 bp, Zea mays
  unsure at all n locations
  Clone ID: LIB3059-060-Q1-K1-C11
gccctggtgatctgaatgactggtaccgccacacatctaaaggcgcatggccattcgcaaccgcggatcatggttggcctatatctgattgcactgctgaaggactaaaggcttcattattgttatcaaagatttctcctgaaattgttggtggaccaatagaagctaatagattttatgatgctgtcagttgtctgatgtcttatatgaatgataatggtggttttgcgacttatgaactcacaagatcctatgcctggctggagctgatcaatcctgctgagacctttggggatattgtgattgattacccgtatgttgaatgtacatcagcagcaattcaggccctgacatcattcagaaaactataccctgngcaccgcaggaaagaggtggacagctgtatcagcaaagctg

SEQ ID NO: 29242 - DNA, 420 bp, Zea mays
  unsure at all n locations
  Clone ID: LIB3059-060-Q1-K1-C2
caaatggattacccataagaagctggccacaagggacatcaagatacttgtgtttgatgaggcagatcatatgcttgctgaggatggctttaggagtgattctgaaaggatgatgagggatatacaaagaagcgctggtggttgtcaggtgcttctcttttctgcgaccttcaatgatagggtgaaggattttgttacaaaggtcattagggatggaaatcagatatttgtgaagaaggaagagcttactttggaaaaagttaaacagtacaaagttcaagtacctgatgaatcggcaaaaatagaggttataagggacaagatatttgaatttggacagaaagttggccaggttatcatatttgttagaacaaagcanagtactaagaatgttcacaatgctttgacgagggaggacta

SEQ ID NO: 29243 - DNA, 421 bp, Zea mays
  unsure at all n locations
  Clone ID: LIB3059-060-Q1-K1-C3
gcggcggcggcggtggctgcttcaagtgtggcgagcctggccacatggccagggactgctgcagcggcggcggcggctacggcggtggcggcggcggcggtggaggcggctgctacaactgcggccaggccggccacatggccagggactgccccagcggtggcggcggtggcggagggaggttcggcggcggcggcgggggtggcggcgaccgctcctgctacaactgcggcgaggccggccacatcgcccgcgactgccccacgtgaggtgtgtccgcgtccgtccgtccagccagatcagatcggatcgctccaccacctgctggtctgatggcgccgnccccttctagatctcgcttaaaaaacacccccctctcgctgtgtgtcggagtaccgcttttagtttgccgatccgggca

SEQ ID NO: 29244 - DNA, 423 bp, Zea mays
  Clone ID: LIB3059-060-Q1-K1-C4
ggcgcgggcaatggggtggttgaagaagagttggacgacgacgacgatttcatcacggatgaggtgaagcggaggctcaaggagctcaggaagaacagcttcatggtgctcatccccgaggacgagtgcgccgaggtcgaggaggatggcgacgaggaggaagggggcagccccagggagtggctggagtcgggtgtcggtgacggcttcccgctgtgtgggttcgattcactgtatgataagtactgcgagagtatgctggtgtttcataagatgatcgcacagctcatgaaggatccagagtcactgaacatgtccaaaaagtctccaagatcagcatcaaaattggtgtctaccctgcgcaacctctcattcaaaagaaaagatgagctcccggaggattgtgaacaacttcaacaacag

SEQ ID NO: 29245 - DNA, 413 bp, Zea mays
  Clone ID: LIB3059-060-Q1-K1-C6
cccacgcgtccgcacgggcctgtccaccgagttcgtgtcgcgcgcgtgggatctgcgggagcccgacgccgcgaggctggtgtcgagccagccggcctcgggcatcgtcaagctgcccgcctccgccgccgcgctcccggcgccctcgccgcaggaccgcgccggggtggcgctcaactgcctggaggcgccgctggacgtggacatccccggcgggggccgcgtcgtggtgctcaacacggccaacctgccgctggtgcgcgaggtcgggctcggcgccgacctggtccgcatcgacgcccactccatgtgctccccgggcttctcgtgcgactcggcgtaccaggtcacgtacatcgtgcgcggcagcggccgggtgcaggtggtcgggcccgacgggaggcgcgtgctgg

SEQ ID NO: 29246 - DNA, 344 bp, Zea mays
  Clone ID: LIB3059-060-Q1-K1-C9
gagcgtgccgctgccgccagcatcagcctgtacgagccagctctgatgcagcagcaggagcagctgctggcagcccagggtctcaaccccatggccatgatgatggcgcagaacatgccggccatgggtggactctaccagtaccagctgcccagctaccgcaccaacccctgtggcgtctccgctgccattccgccctactactgattcatgatatttgggaaatctcctctatccatctctctctatctatatatgtaataatgcagtaagacgacacacattatcatgtgtggtatgaccaataatatatgcatggtcataataaagttttggttttaatg

SEQ ID NO: 29247 - DNA, 234 bp, Zea mays
  Clone ID: LIB3059-060-Q1-K1-D1
ctgctgtggggctgaaatggatgctctttcatttcttaatgaagcaccatcaagagagggtgtaatacttcaaccgaaggggcgtttctgcaatttttctactaagaagaaatcttctcaggcgttatgtctctatattagcaaatgctcatgatagtgccatgaaacagctgaatggaactcataaagctcatgtgcactccatacatatggcttgaaatactttctcaatat

SEQ ID NO: 29248 - DNA, 428 bp, Zea mays
  Clone ID: LIB3059-060-Q1-K1-D10
cggaattccgcgggaccacgcgtgcgttgttctcactagctcgtggttattttggaagcttgatcatctttccttacggcggggatgaagagcagcacaatcgtcgcgcttctgttggctgttgccattctgtcctcgctgtctccatgctacgaagccggcggctgcatcgggaaacccaagaagtcaccgtcgccgccgagaaggccatacctctcgtcctattccgaggaccaccagaactgccgcttgatctgtagctcgaagggtttcaaggacggtggctggtgtgacgaaagcgtcgagcacaaagtgtgctgctgctcccattagaaatataatatcgtatgttatgttgatgcatatatatgcatcatccatctacctgtgtggtgcaaaattctgaataaaatctacctgtgtggtgc

SEQ ID NO: 29249 - DNA, 413 bp, Zea mays
  Clone ID: LIB3059-060-Q1-K1-D11
cccaaccctacttgaggctttggactttatcaatgagccgaagaggccttcagacgagcccctgcgtctccccctacaggatgtgtacaagattggtggtattggaactgttcctgttgggcgtgttgagactggtatcatcaagcctggtatggttgttacctttggtcctagtggccttactactgaggtgaagtctgttgaaatgcaccatgaggctctccaggaggcccttcctggtgacaatgttggcttcaatgttaagaatgttgctgtgaaggatctgaagcgtgggtatgtggcctccaactccaaggatgaccctgccaaggaggctgctagcttcacgtcccaggtcatcatcatgaaccaccctgggcagattggcaacggctatgccccagtgctggact

SEQ ID NO: 29250 - DNA, 360 bp, Zea mays
  unsure at all n locations
  Clone ID: LIB3059-060-Q1-K1-D12
gatggaactactaatggtgatgtatctgaaaatctgctttctcgaaagccgagctgggatgagttaaaggctcttttggctgattcggaacgaagtaagcttttgagaagactcagtgaagcaaatcaatataaccgattcctcaagagacagttgcaaataaaggatgatgcagtcgtaaaattcaaaggtgaacttgctgttttggaactagaactgcaggctctggttggcctagctgaagaggttgctaattttgatgttccgttagggtctangaagataaacggaaaatatattcaatctcatcttctcttcagattagaagctgtncatgataagaatatggaacaagtaaag

SEQ ID NO: 29251 - DNA, 376 bp, Zea mays
  Clone ID: LIB3059-060-Q1-K1-D2
aaaaaaaaaaaataaaaaaaaaaaaattttaaaaaaaaaaaaaaaaacaatataaaaagagaaggtatactaaaaaaaaaaaaaaaaaaaaaaaaaaaaaaataaaaaataacaaaaaaaaaagtgcactccccttaaataaccaaagtttactacccctaaaatccaacctttacccatttttatagcctccccaaaattaaatttattgcccgctttttaaaaacctcatcaattgaaaaacccttggctttcccaaacttatcccctttcaaaaaaatcacccttttcccaacctgcataatctcaaaaaaccccccccccattagcctttccaacaatttgcccacttcaattcccaacatggcacccccct

SEQ ID NO: 29252 - DNA, 416 bp, Zea mays
  Clone ID: LIB3059-060-Q1-K1-D3
gtccgggcccgcgcccggacgcttgctgtgccggttggcgtggggcttttggcgggggccgacgtgctgggctggggcgcgctggagggcgccgtgatgaatccggcgcgcgcgttcgggcccgccgtcgtgggctcccgtcgctggagacaccaatgggtgtactgggtggggcccatggtcggcgccggcctctccggcgtcgtctacgagcacctcgtcgccggcccggccgccgaggaggaggagcccgcgccgagctgcggcgaccgccgtcgtgcgtagaggactacatgcatgcaagagcagcaggacgtcgtcgtcgtccccgctcctcggaatcttctgaataaaaaaaacagcttgcatgcgtgctcaattgttgggtgtcgtggtcgatcatgaatagaattaat

SEQ ID NO: 29253 - DNA, 412 bp, Zea mays
  Clone ID: LIB3059-060-Q1-K1-A6
cggacgcgtgggctgcgaaccatcctgaattttcaagcatgatacaacaggatgtcgttgaattcttccttcaccttattgacagagttgagaaggcaaaccctggagaccgtgagctaaatcctttttccggtttcaagtttgttgttgaagagagggttcagtgcccttctgggaaggtttcttacaacaaacgatctgacaacgttctttctttgagcataccactgcatgaggcaactaataaagagcagctagaagcttttaatgagaagaaagctgcaatgaacttggatggaaaagaagtgtctaatgaggatattgtcaggcctagagtcccattggaggcatgcttggcaagtttttcagggccagaggagattccagatttttatagcactgcattaaattc

SEQ ID NO: 29254 - DNA, 420 bp, Zea mays
  Clone ID: LIB3059-060-Q1-K1-A9
cagacagtttcagctgctcaccttctcaccaagcccagaacgggccagcaaaggagacggcggccgaagcgagatttccagagagatgtcttgcctggcctttcgtcgctttcccggcctgagatcacagaggacgtccagttgctcgaggggttagtccaggcttccgggggatcctgggagtcgagcttgactaggcgaggacgttgtggtgggcgtgctagaggcaggaaacctcggaaaactgtagtaaccgtaattgtacaggaggaggaagaggaggaggtagaggttagcccaccgccaaaacctgctggcactggggaataggaagccgatggcaggggtatgatcgggtggggcagaacaacaaggcggtgtcacagagcgagatgttcgtcaggtaacagcatggctact

SEQ ID NO: 29255 - DNA, 310 bp, Zea mays
  Clone ID: LIB3059-060-Q1-K1-B1
cggacgcgtgggcggacgcgtgggcggtacgcgtgggcggacgcgtgggcggacatcggcgtgagcctggactgcgccgggttcagcaagaccatgtcgacggcgctggaggcgacgcggcccggcgggaaggtgtgcctggtcgggatgggccacaacgagatgacgctgcccctgacggcggcggcggcgcgggaggtggacgtggtgggcgtgttccggtacaaggacacctgggcgttgtgcatcgacttcctgcgcagcggcaaggtggacgtcaagccgctcattatccaccgatttcgttttt

SEQ ID NO: 29256 - DNA, 421 bp, Zea mays
  Clone ID: LIB3059-060-Q1-K1-B10
ggccagtgcgtcgagtttctgaggcatcagtgcagcccgacggcgacgccctactggtcgcctcagtgccagtcgttgcggcagcagtgttgccagcagctcaggcaggtggagccgcagcaccggtaccaggcgatcttcggcttggtcctccagtccatcctgcagcagcagccgcaaagcggccaggtcgcggggctgttggcggcgcagatagcgcagcaactgacggcgatgtgcggcctgcagcagccgactccatgcccctacgctgctgccggcggtgtcccccactgaagaaactatgtgctgtagtatagccgctggctagctagctagttgagtcatttagcggcgatgattgagtaataatgtgtcacgcatcaccatgggtggcagtgtcagtgtgagcaatgacctg

SEQ ID NO: 29257 - DNA, 358 bp, Zea mays
  Clone ID: LIB3059-060-Q1-K1-B3
cggacgcgtgggcggacgcgtggaggtttgttggcttctcctccccctccggttcgggttcgggttcatgaggttctaccgggttcgggttccttgggtaaccgaatcgagatgcaggcgtcagatgttgactaccgctgcttcgtcagcggcctcgcctgggccacggacgaccactccctgcacaacgcctttaacacctacggcgaggtccttcagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacg

SEQ ID NO: 29258 - DNA, 420 bp, Zea mays
  Clone ID: LIB3059-060-Q1-K1-B4
gggttggcttctcctccccctccggttcgggttcgggttcgtgaggttctccggggtgcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtg

SEQ ID NO: 29259 - DNA, 410 bp, Zea mays
  Clone ID: LIB3059-060-Q1-K1-B5
cggacgcgtgggcggacgcgtgggcaataggagacccagcagcagcagtatggatacggatatggatatggacaccatcaccatcagcatgaccaccacaagatccaccgattcgagcagggcgacgtggtggccatgccggccggcgcccagcactggctgtacaacgacggcgacgcgccgcttgtggcggtctacgtcttcgacgagaacaacaacatcaaccagctcgagccttccatgaggaaattcttgctggctgggggcttcagcaaggggcagccccacttcgccgagaacatcttcaaagggatcgacgcccggttcctgagcgaagccctgggcgtcagcatgcacgtcgccgagaagctgcagagccggcgtgaccagcgaggcgagatcgtccgcgt

SEQ ID NO: 29260 - DNA, 266 bp, Zea mays
  Clone ID: LIB3059-060-Q1-K1-B6
gcccggattgctccaaaaaacaacacatgagagactccaatagatctcaaatgtgcgtgtgtgccactggaactaacgtggttatctctccccttgaacctgaaccatcaccatcaacttagacgatacatgaaaaacaataggagagtttaagctgttgtcaacgttgccgacgccgatgcaaaacgcacatgattcgcatgatcacacgatgaccgtcatcaggatcttcaagcctgccaatgatacttttttactgcttataa

SEQ ID NO: 29261 - DNA, 396 bp, Zea mays
  Clone ID: LIB3059-060-Q1-K1-B7
acaacctgcactgcacgagatgaggacggtgcactccacagctgctggcatttgcatgcttcttctcatggtcatgtcttgcaccctcatgacgacacccacctgggcagcagaggattgctaccagcagtacccgacatgccaggacgccgtgtgcgaggcaaaatgcagtgaggaattccactccaagctctccggtttcaggtgcacgagccgtatgcacatccctgtttgctgctgaacccacacttgacgcggccggccggggatgcgtcagatccaattaatataatccaccaccacccgtgctaaacctggacaccgattagtatgtaggagtaccattaattatatatcctataaagatatatgtaacagctggactggctcttccat

SEQ ID NO: 29262 - DNA, 419 bp, Zea mays
  unsure at all n locations
  Clone ID: LIB3059-060-Q1-K1-B8
cccacgcgtccgcgagtacagccggctaggtaatctggtacgacgacccacgacgacgtggcggcggccaccaccaccagcagcagcaagaagtcgtcgtcgccgtcgtcctcgagctcggcgcatcgggcagcagctgccgccctgctcgtggcggtgtccgtcctggtggtgggcgcggcggcggtgtgcgacatgagcaacgagcagttcatgtcgtgccagcccgcggcggccaagacgacggacccgtcggacgcgccgtcgcaggcgtgctgcgacgcgctggcggaggcggacctcaagtgcctgtgcggctacaagaactcgccgtggatgggcgtctacaacatcgaccccaagcgcgccatggagctgccggtcaagtgcggnctcgacacgccgcccgactgctagcc

SEQ ID NO: 29263 - DNA, 419 bp, Zea mays
  Clone ID: LIB3059-060-Q1-K1-B9
cccacgcgtccgcccacgcgtccgcccacgcgtccgggtgggttggcttctgctccgcctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggt

SEQ ID NO: 29264 - DNA, 423 bp, Zea mays
  Clone ID: LIB3059-060-Q1-K1-A3
cacaattcaccacgtcctcaattctactttgactcaatcactatatttttccatagtgtgctaaaccctcctgaagtggcagaggatcattatttcatgacaccacatggtagccttggtcagggtcattgggatacagaacaagacatagagtatcggttctctcaatcacctacagggacagccaatgctactacaacagaagatgccattgcacagttgcgctctagaaggctcatgagtagaatggaggtcccatctggtgccaccaccgaagacaggactgatcgaactgagggtttcgatagtgatcttggtccctcttcatctagtgtatcaacagcaactcctcccaatggtcgcaacggaaggctgctgactccaacctctgatgatggcgagtatgtggagtactcatttgat

SEQ ID NO: 29265 - DNA, 428 bp, Zea mays
  Clone ID: LIB3059-059-Q1-K1-H11
ctagcaacatagaaagcacaatagtgtaccaacaatggcagccaaaatattttgcctcgttatgctccttggtctttctgcaagtgctgctaccgcgaccattttcccgcaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgctgcttatttgc

SEQ ID NO: 29266 - DNA, 427 bp, Zea mays
  Clone ID: LIB3059-059-Q1-K1-H12
gcgtgggcggacgcgtgggcggtcgcgtgggcggacgcgtgggatctcatttgctatgttgctcggtaacgtctctgatttgctatgcaaaaaaaaaaaaaaaaaaaaaaaaaaaaaaaaatataaataaaattattaccacgttcctttcaccagcggtgtcttcagtatgtagaaaacccaattcttcaaccctaatagatccaacaggcaatcgcaactggcatcttacctttaacacccttgttcctacaacaatcataagccctatcacaacagtgacctttggtgcatttattggcacaaaacatcaaggcacatcaactacgacaacttgtgctagcaaaccttgctgcctactctcagcaacagcagggaaaaccattcaaccaactagctgaattgaactgtgctgcttatttgcaac

SEQ ID NO: 29267 - DNA, 449 bp, Zea mays
  Clone ID: LIB3059-059-Q1-K1-H2
attgagaccaacaagcaacatagaaagtggaatccagtagcaacaacagagcaacaatggcgaccgggatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttcttcctactctcagcaacaacaatttcttccattcaaccaactgtctacactgaaccct

SEQ ID NO: 29268 - DNA, 437 bp, Zea mays
  Clone ID: LIB3059-059-Q1-K1-H3
aaatgattcttcagaacagtgaagctatggtatctatagacatgcctgctggcccttgtgaagttgtagtcattgctgataaatacgcgaacccagttcatgttgctgctgatctgctatcccaggcagaacatggcccagatagtcaagttgttctagttgttgctggagatggtgttgatctgggtgccattgatgcagaagttagcatgcagtgcaacgcgctttcaagaggtgaattcgcttcaaaagcacttagccacagcttcactgtgttcgcgaaagatatggttgatgcgatatcattctcaaatctgtatgcccctgagcatttgatcatcaacgtaaaggatgctgagcagtgcgaggagttcatcggacacgcatggtcagttatcttgggccaatggaccccagagagcgtgggcgaatatgcg

SEQ ID NO: 29269 - DNA, 197 bp, Zea mays
  unsure at all n locations
  Clone ID: LIB3059-059-Q1-K1-H4
ccttggtcttttctgcatagtgctagctacacgcataccattttctccacatatgctcacaagtctcctatagtcttcctttcttcccccatacactctcaccagccggtgtcttcaatatggtgaaaaccccaatgtcttcaaaccctacaaggatccatacangtcaatcgcaagcaagcatctttacctttatc

SEQ ID NO: 29270 - DNA, 392 bp, Zea mays
  Clone ID: LIB3059-059-Q1-K1-H5
caggctccaaatcaagctgctgcatttccagatctcaagctgacagaggtgtcaaaagagaatgtaagtgaaaagaaagattctgagattgttcgttcgcctagagctccaacccattctttcaagaagccgattggtgctaaaaagcctggaaataagactggtggacttggtgcacggaagcttacatcaaagccaaatgaaagcctctatgagcagaagcccgaggaaccagctcccgtcctgccatcatcggtgattgagagtactacaactaggagcaaatcacatacttcccgatttgattacgttgaaaatgcacctgctcttaagaatgggaatagctcagaaggcaaccacatgagtggacatgttgcacccccaatgtcgtc

SEQ ID NO: 29271 - DNA, 371 bp, Zea mays
  unsure at all n locations
  Clone ID: LIB3059-059-Q1-K1-H6
ggggtatggagctgtaccctcggattggcaagtactttgatatcaaagtcgtcaccagctgtcgtttcggtatgatgtcctgggctgttcttgccgtaacctattgcataaagcagtatgaaatgaatggcagagttgctgattctatgcttgtgaatactgcacttatgttgatctatatcactaagttcttttggtgggaatctggatattggtgtactatggacattgctcatgatagagctggtttctatatctgctgcggatgcttgatatgggttccatccatatttacttnccctggaatgtaccttgtaaaccaccctttgaatttgggcccccaactagcactctcaattcttctagctgga

SEQ ID NO: 29272 - DNA, 436 bp, Zea mays
  unsure at all n locations
  Clone ID: LIB3059-059-Q1-K1-H7
gcaaagcggcagtgcgtagagaggatcgtcgaacagaacagcatgaagatggtcatcggtctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagacgagcgccatgtaccagccgctccggcaacagtgctgccagcagcagatgaggatgatggacgtgcagtccgtcgcgcagcagctgcagatgatgatgcagctngagcgtgccgctgccgncagcagcagcctgtacgagccagctctgatgcagcagcagcagcagc

SEQ ID NO: 29273 - DNA, 259 bp, Zea mays
  Clone ID: LIB3059-059-Q1-K1-H8
ggaagctgcagagctcaagaacggtaggaagcatgagctggctgtgcttactcctgcgggcagtggcagctaccaacaaggtcaagctggcagcgcccaacagtaggcacaacctcagagtgatctgcctgaataagtactcgtagactgtaataattaaacaaagcttgctcatgggtaaaaaaaaatgatcaaatactacaagatccagaaggaaatacaatgcagcatgttagctgtataaccctagtacgtccaa

SEQ ID NO: 29274 - DNA, 430 bp, Zea mays
  Clone ID: LIB3059-059-Q1-K1-H9
gaaatgtgaaagtgcctcagcctcaaacagtaagggcgttgatatgtcaagcaaggcgggtcgaaagaggtctcgaccaggagagaatcctaagccacgaccaaaggaccgccagcttattcaggatcgtataaaggagctccgggaactcgtacctaatggggcaaagtattgatgcattactggagaagaccattaagcacatgcttttcttgcaaagtgtgacaaagcatgcagataacctcaaggactcaaacaaatctgatattcttggtggtgagaatggtccactcaaagactacttcgaaggtggtgcaacttgggccttggatgttggtagtcgatctatgacgtgcccaatcattgtcgaggatctcgagcggcctcgtcagatgcttgtggagatgctttgtgaggatagaggtatctt

SEQ ID NO: 29275 - DNA, 409 bp, Zea mays
  Clone ID: LIB3059-060-Q1-K1-A10
attctctaggaagcaagggaatcacatcgccatggcagccaagatgtttgcattgggggcgctcctagctctttgtgcaaccgccactagtgctacccatatcccagggcacttgtcaccactactgatgccattggctaccatgaacccatggatgcagtactgcatgaagcaacagggggttgccaacttgctagcgtggccgaccctgatgctgcagcaactgttggccttaccgcttcagccgtgccagatgccaatgatgatgccaggtatgatgccaccgatgacaatgatgccgatgccgaatatgatgccatcgatgatggtgccgactatgaagtcaccaatacgatggctaatatgatgccaccgatgatgatgccaaacatggtttcaccaatgatga

SEQ ID NO: 29276 - DNA, 423 bp, Zea mays
  Clone ID: LIB3059-060-Q1-K1-A11
cggacgcgtgggtgcaactactcaatgtattcttacctcagatgcttgtcctgaaacgtcttcattctcaaacacagtcctctaggaaaaattatgctgatgcaaaccgtgtatctgctatcattttgggcggaggcactggatctcagctctttcctctgacaagcacaagagctacgcctgctgtacctgttggaggatgttacaggcttattgatatccctatgagtaactgcttcaacagtggtataaataagatatttgtgatgagtcagttcaattctacttcgcttaaccgccatattcatcgtacataccttgaaggcgggatcaactttgctgatggatctgtacaggtattagcggctacacaaatgcctgaagagccagctggatggttccagggtacagcagactctatca

SEQ ID NO: 29277 - DNA, 400 bp, Zea mays
  Clone ID: LIB3059-060-Q1-K1-A12
cagatgcaagattgcattttggaagattgcgaacctgatattccttttcttcctgcgcctgaagctcatactgcctttctactccttcacgctgttctgcatcatcctcccgatgactatgttcgtgccggaggccgatctccccgactgggtggtgtgctacgtcccggccctgatgtccctgctgaacatcctgccgtgccccaagtcgatccccttcatcatgccgtacctgctcttcgagaacaccatgtccgtgaccaagttcaacgcgatgatctccgggctgttccagctggggagcgcgtacgagtgggtggtgaccaagaagtcgggccgctcgtcagatggcgacctcatcgcgctggccccgaccaaggagcctgtgaaacactcgacg

SEQ ID NO: 29278 - DNA, 423 bp, Zea mays
  Clone ID: LIB3059-059-Q1-K1-G9
cccacgcgtccgtgactggcgaggcaaaagcattgcgaccacagacagcgcgcgcttcggggccttttttttgagataacaaggaggagaggaggagatggcggtcacgatcacgtgggtgaaggcgaggcagatcttcgacagccgcggcaaccccaccgtcgaggtggacgtgggccttagcgacggcagctacgcgaggggggccgtacccagcggcgcatccactgggatatatgaggccttggagttgagggatggaggatctgattatcttggcaagggtgttcttaaggctgtcagcaatgtaaataacattattggaccagcaattgttggaaaggaccccactgagcatgttgagattgacaacttcatggtccaacagcttgatgggacctccaatgagtggggctggtgcaa

SEQ ID NO: 29279 - DNA, 405 bp, Zea mays
  Clone ID: LIB3059-059-Q1-K1-F5
cttatttgcaacaacaattaccattcagccagctagttgctgcctacccccagcaattgcttccattcaaccaactagcagcattgaactctgctgcttatttacagcagcaacaactactaccattcagccagctagctgatgtgagccctgctgccttcttgacacaacaacagttgttgccgttctacctgcacgctatgcctaacgctggcaccctcttacaactgcaacaattgctgccattcaaccaacttgctttgacaaactcaacagtgttctaccaacaacccatcattggtggtgccctcttttagattgcttatgagttatagttcaataatgaagttttttggatgatgtttgtggcgtcccagaaataagaaagtacatttctagattctt

SEQ ID NO: 29280 - DNA, 441 bp, Zea mays
  Clone ID: LIB3059-059-Q1-K1-F6
gcctcgcctcgcccctgtttgtttgcttctggccggaccccttccccttctccggtgcgcgccactctgcaacccccctcctctcgagcagagcagtcgagcagagcggcagcctcggcgcgcgccggcgccagccgacatgactgccggtcagtgcggcaacatccaggaccaggaggcagctcctggcgccgacctctacgccgtgctcgggctcaacagggagtgcaccgacgccgagctcagggtcgcgtaccggaggctcgccatgatatggcatccggacaggtgctcggcgtccggcagctcggcgcgcgtggaggaggccaaggagcggttccaggagatccagggcgcctactccgtgctctccgactccaacaagcggctcctctacgacgtcggcgtctacgacagcgaggacgacgacgctgacctgtc

SEQ ID NO: 29281 - DNA, 408 bp, Zea mays
  Clone ID: LIB3059-059-Q1-K1-F7
cggactcgtgggcggactcgtgggcggacgcgtgggctttgttcccatctgtggtttggaaggtgacaacatgattgagaggtccaccaaccttgactggtacaagggcccaaccctacttgaggctttggacttgatcaatgagccgaagaggccttcagacaagcccctgcgtctccccctacaggatgtgtacaagattggtggtattggaactgttcctgttgggcgtgttgagactggtatcatcaagcctggtatggttgttacctttggtcctagtggccttactactgaggtgaagtctgttgaaatgcaccatgaggctctccaggaggcccttcctggtgacaatgttggcttcaatgttaagaatgttgctgtgaaggatctgaagcgtgggtatgt

SEQ ID NO: 29282 - DNA, 326 bp, Zea mays
  Clone ID: LIB3059-059-Q1-K1-F8
acgacccgtactgcgagcttcactggctcatacaacgacggatactacgaggtgttcggatagctgtgcacatccctatggacgactcttacgacactgctgataacgatgttcatactgatcttcattggaatggtcactgccatctacaacgcgttcaactactgatgtcaattattcggcacgctgttctttaagctctggttgacctttcatgtgatcgcgcatctttacgctctcctcaagggtctgaacaggacgccgaccatgacgcctgccattgccattgtctggtctatcatcctgtctctgatcttgttgctgat

SEQ ID NO: 29283 - DNA, 428 bp, Zea mays
  Clone ID: LIB3059-059-Q1-K1-F9
cgcaaattgcaccaagaaatccatcgagaggccgtcgacaggggaattaatggcgtcggcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgcctagaggacctgccgggctgcccgcgggaggtgcagaggggattcgccgccaccctcg

SEQ ID NO: 29284 - DNA, 449 bp, Zea mays
  Clone ID: LIB3059-059-Q1-K1-G1
caaaagggaggggagagtgtcgtcatggcttccattgtcgcttccaggagggccgttcgtctagttcgcgctctggagaagctcatcgcagcgtcctccgctcccgggactggctccgccctcaggccggtggcagtcgccggcggcctccgcggctacaacaccggcgctccgctccgacgctacgagggggccgagtcggaagacgatagcgtccgcgagtacgatgggcggcacggcggccgggactacgctgtgcccagcctgttctcagatattttccgtgatccgcttagtgcgccgcacagcattggccgtctgctgaaccttgtggacgacttggcggtggcggcgccaggtcgtgcggtgcgccgtggctggaacgcgaaggaggacgaggaggcgctgcaccttgaggtggacatgccaggcctggggaaggagcacgt

SEQ ID NO: 29285 - DNA, 371 bp, Zea mays
  Clone ID: LIB3059-059-Q1-K1-G10
cccgtttaaaaaaaaaaaaaaaaaaaattaaaaaaaaaaaaaaaaaaaaaaggaaaaaaggaaaaaaaaaaaaaaaaaaaaaaaaaaaaaaaaaaaaaaaaaaaaaaaaaaaaaaaaaaaaaggccagccgttttaaaggttccaagtttacttacccttccttccaacttcttaacttttctatagggtaccctaaataaaatccattggccgtatttttaaaaccttttaactggaaaaaccttgcctttccccaatttaatccccttgctccaaatccccttttcgccagttgcattattaccaaataggcccataccattagcctttcaaaaaatttgccaaacctgaatggcaaatggaacccccc

SEQ ID NO: 29286 - DNA, 429 bp, Zea mays
  Clone ID: LIB3059-059-Q1-K1-G11
aatcaacgcaccctgtgcccggtgccgccgacccaaatggcatccacctcggcggaacgcgccgccgccgacgaaactatcgacaccatccacatccgtcgcctagagtgttccgaccacgagaggggcttcgtcgcccttctctcccagctctccccctgcccggacctcaccacatccgtgttcgccacgcgcttcgccgagctcgcggcgcagggcgacgaccacatcatcctcgtggccgaggacccctccgcctcggaccggcggatcctcgcgacagggtgcctcttcgtggagcgtaagttcctgcgaggctgcggcaaggtggggcacgtggaggacgtggtggtcgatgccgccgcgcgcggcaggggtctcgggctccgcatcgtgcgccgcctcgtggagatctccagggacgccggc

SEQ ID NO: 29287 - DNA, 413 bp, Zea mays
  Clone ID: LIB3059-059-Q1-K1-G2
cccttgttcctgcaacaatcatcagccctattacagcagttacctttggtgcatttattggcacagaacatcatggcacaacaactacaacaacttgtgctagcaaaccttgctgcctactctcagcaacagcagtttcttccattcaaccaactagctgcattgaactctgctgcttatttgcaacaacaactaccattcagccagctagctgctgcctacccccaacaatttcttccattcaaccaactggcatcattgaactctgctgcttatttacagcagcaacaactactaccattcagccagctagctggtgtgagccctgctgccttcttgacacaacaacagttattgccgttctacctgcacgctgcgcctaacgctggcaccctcttacaactgcaacaatt

SEQ ID NO: 29288 - DNA, 436 bp, Zea mays
  Clone ID: LIB3059-059-Q1-K1-G3
cgcagagctcaccagggaggctgttgatgttttcatttggtgcttaactcaaaatgcagagtcttgcaagcagtgggaaagaatttatcttgaaaatattgaagccagtgttgctgtcctgagcaaagttgtgattgattggagggatgtgtctcctaagctcagttctgaagctctcaaggcaacagtgaagaactttaaggctaagaatgaggctgcgctggagtccacaacagatgctggaaagcatgcatctatcaaagaagcagacaagcactgcaaggcgatctttggaaagctgacccgtggcgccacctgcctgaagagcaagctggtggtcatcgcgctcgcttgtgctgctagttacgtgctgtctgctggcatggacctcgagtaggtccaggcgatggtctcatcgcacctgtcgttctaaaca

SEQ ID NO: 29289 - DNA, 421 bp, Zea mays
  Clone ID: LIB3059-059-Q1-K1-G4
ggcgactccaggtttgtcggcgatgctgcgagcgggaggcaggcggctcctcgccccggggctccgtcggctcggcctgggcacaggcgcctccggcgaggcgggtcctgccgcggcggcggcggcggtgagggcgtaccacgagcgggtggtggaccactacaacaacccgcggaacgtaggttccttcgacaaggacgaccccaacgtcggcactgggttggtcggcgcgccagcctgcggcgacgtcacgaagctgcagatccgcgtcgacgagaactccggcatgatcgtcgacccctgcttcaagactttcggctgcggctccgtcatagcgtcctcgtccgtcgctactgaatgggtgaagggaaaaccaatggatgaagttttgacaatcaggaacacggagatcgcgaagcac

SEQ ID NO: 29290 - DNA, 366 bp, Zea mays
  Clone ID: LIB3059-059-Q1-K1-G5
cgctcctggaggtctcgctgctcagcagcagtccactcgcgcagcggagggcggccaggatcttgcgctggttcaaggaggaagggccgcagagcaggacgaccagggcgcgttcggggcctcgcgtggagggagtggcagaggccacgtcgtgccacgacgacgacgtatcctgcgaggcgaagggttgccgggataccaccgtggacgagattgtgaggcgtagcctggataggaacatgaagtctatactgaggagggccacggcgtccgtggacctgaccaatgttaagctgctcgttacgagccccagctccaagagcttgccttgctgaactcacaatgacacaagtgctcagttttccc

SEQ ID NO: 29291 - DNA, 314 bp, Zea mays
  Clone ID: LIB3059-059-Q1-K1-G6
caaaccgatgacatggccaataaatcggtcgaactttctacccgtagatgagctcatggataaaccactcattgatgagcacttgagcaataccagggagataagaaagagaattcaggactccgtgctgacatagcagggcgtacatatgcttgtgcatatgcggcgttggaccgttggtagtacaagatatgaatgtctcgagatatgtgtacttgtctatgcctaggctgatgtctgacgactcttccgtaaactataccatgtcgtgcagatgttcattcttgtgcaaacgtcttatgtctgagcagatg

SEQ ID NO: 29292 - DNA, 444 bp, Zea mays
  Clone ID: LIB3059-059-Q1-K1-G7
gccggatggatggttggattatgcagctaaaaggatcgcacagcttggtgctgataaaggttacaaccacactctctgtgatgaacttcttagcattttactgcctgctaaaccccctttccatccacgccagttcgcgacatgtgcagttgttggtaactcaggagatctcttgaaaacagagtttggacaagagattgatgcgcatgacgccgtgtttcgggacaatgaggcacctgtcaataagaaatatgcaaaacatgttggattgaaaagagactttcgactggttgtccggggtgctgctcgaaatatggcaccaatactgaagggctcctgtaatgctccgatgaggcacttatcattaaaagtttgacgcacaaagaaatcaatgcggtgataaaggaacttccaaatcctgtctacctttttcaaggtatagtt

SEQ ID NO: 29293 - DNA, 315 bp, Zea mays
  Clone ID: LIB3059-059-Q1-K1-G8
gtgcgatcgcaggaacaatcaccaccgttattaagaagatgatgcgctgcgctgcaaggggcggcgggtgcgtcgcttcgtggagcggcgatcggagattgccggcggtcaacccctgcagcgtgcggatgccgacgggcaacgatgggtggtgcgccggcctgaggtcgcgggcggcggatctcgccggcctcgagatggccaacctgcgcggcggcgtcggggggctcttgcgcgcgagcccgcgctacgggcgcttgcaagccacggcggcagttgaccctgaagatattccattggaagaggttcaagtta

SEQ ID NO: 29294 - DNA, 422 bp, Zea mays
  unsure at all n locations
  Clone ID: LIB3059-059-Q1-K1-F4
gtccgcgtggagccggagcacggctttcaccagctgaatccgtcgccgtcgtcgtcgtcgttttggttcccatcgtcacaagtccagtaccaaacgtgccagcgcgacgtcgacaggcacaacgtctgcgccatggaggtgaggcacagcgtcgaacggctggaccaggccgacgtctacagccctggggctgggaggatcacacgcctcaccagccacaagttccccgtcctcaacctcgtacagatgagcgcggtgcgggtagacctgtaccaggacgccatcatgtcgccgttctggaacttcaacgcccacagcgccatgtacggcatcaggggcagtgcaagggtccaggtcgccagcgacaacgggaccacggtgttcgacgacgtgctccgtgcggngcagctgctcatcgtacc

SEQ ID NO: 29295 - DNA, 427 bp, Zea mays
  Clone ID: LIB3059-059-Q1-K1-E11
gcagattgttggtgatgaccttctcgtcaccaaccccactagggttgctaaggctatcgaggagaaatcatgcaatgcccttctgctcaaggttaaccaaatcggatctgtgactgagagtattgaggctgtgaagatgtcaaagcgtgcgggctggggtgtgatgactagtcataggagtggtgagactgaggacactttcattgctgatctggcagttggtttgtccacgggtcagattaagactggagcaccctgcagatcagagcgtcttgccaaatacaaccagcttcttaggattgaagaagagcttggcgctattgctgtctacgcaggtgccaaattccgtgcacctgtggagccctactaaacgggcgggatgcaagtgcttttatgtctgcacaagtcctgtgaaactgtttactgc

SEQ ID NO: 29296 - DNA, 446 bp, Zea mays
  Clone ID: LIB3059-059-Q1-K1-E2
aatccatcgagaggccgtcgacaggggaattaatggcgtcgtcgtctagcagcagccaccgccgcgtcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgcctagaggacctgccgggctgcccgcgggaggtgcagaggggattcgccgtcaccctcgtcacggaggccgagtgcaacctggccaccatcagc

SEQ ID NO: 29297 - DNA, 383 bp, Zea mays
  Clone ID: LIB3059-059-Q1-K1-E3
cggattgaccgactcgtcccacgcagtacgctcatgaagccctacactagatggagagaactgtccaaactaatgatcacctaccatggcaaggatttggaattgctcgtaacatccacaacagaacatattgtaagctatgttcatgagactagtccagaacgctctgatgatgcgctggacgactatcatccaggagctgtcaatcctttcgagcaacttgaactgttcataaaggtagactacgaggaatacgacaagcaatgctcactgcattaaagaaagcatagaaaggcgaaatcagctgacagtgctaggctattccatgcactgtcaaggtctacgagctggtgccaaactattgatccaaagtgatcacctgt

SEQ ID NO: 29298 - DNA, 320 bp, Zea mays
  Clone ID: LIB3059-059-Q1-K1-E4
gtgtggtatgaccaataatatatgcatgatcataataaagttttggttttaatgaaagggaaaaagaaaaaaaaaaaaaaaaaaaaaaaaaaaaaaaaaaaaaaaaaaaaaaaaaaaaaaaaaaaaggacaaaaaaaaagaaggactcaaaagaaaaaaacaacatattaaagagcaaaagactgcaataactgaacagaaaagtgaaaaaaacggaacctgtgaaaaaataggaagacctggaaaaaacgttagtgcatcaaactgagcacattgaagataaatcacgttttagaaagctggatgtgaacatattagac

SEQ ID NO: 29299 - DNA, 445 bp, Zea mays
  Clone ID: LIB3059-059-Q1-K1-E7
atccaagtcttctgcatatctgaagaggataccgacgcagaggagctgaaagctgatggcaaaaagttcttgtatgatcttaggatgcaagctgaggtcattgttgtcactatgaaatcatgggagtcacacatggagagcagcagtagcggtgttcagcaggataactcccatgaggcttacacaagtgcacagcaaaggatcgaaacataccttgacgagatgaaggaaactgctcaaagagaaaggcagccactaaaggagaatgggaggcaagttgttgtgaatgaacagaaggttgataaattcctttacacaatgttgaaattgaactccacgatactcaggtactccagaatggcagctgtagttcttgtgagccttccaccaccaccactaaatcatcctgcatatttctacatggagtacatggatttgcttgtaa

SEQ ID NO: 29300 - DNA, 422 bp, Zea mays
  Clone ID: LIB3059-059-Q1-K1-E9
cggacgcgtgggttttacacccagcgctcaagccagattattgaagcaaacaaggacataagtagaagacggtaagagtgcatgcatgaaacattaattctactcatgatcgaccacgacacacaacaattgagcacgcatgcaagctgttttttttattcagaagattccgaggagcggggacgacgacgacgtcctgctgctcctgcatgcatgtagtcctctacgcacgacggcggtcgccgcagctcggcgcgggctcctcctcctcggcggccgggccggcgacgaggtgctcgtagacgacgccggagaggccggcgccgaccatgggccccacccagtacacccattggtgtctccagcgacgggagcccacgacggcgggcccgaacgcgcgcgccggattcatcacggcgccc

SEQ ID NO: 29301 - DNA, 425 bp, Zea mays
  Clone ID: LIB3059-059-Q1-K1-F1
cacggaggaggcgatgcggaacgccatcgagggcatgaacggcaaggagctggacgggcgcaacatgaccgtcaacgaggcccagtcccgcggcggccgtggaggcggcggcggtgggtacggtggtggccgtggaggcggcggctacggcggtggcgggcgccgtgatggcggcggcggctacggcggtggcggcggctacggtggcggcggcggctactgtggtggtggcggcggctacggcggtggcaaccgtggcggcggctacggcaactccgacgggaactggaggaactgagcggtggggcccgcgcggtcaagttatcctgttcgctgccgtgatgtttaccctagtccagagggtttatcttcgttcgtctcgtgtttgttgttgcccatctgtgtttttgattgcaaggtcgctc

SEQ ID NO: 29302 - DNA, 414 bp, Zea mays
  Clone ID: LIB3059-059-Q1-K1-F12
cccacacgtccggcagtggcagggacaatcttgctctcagcatcggctatgcctgatgactggatgagtcttggtggagcacaacgctcagccggatgcggttgctatatgagataatgcggatgatcccactgaagctgctccagcagatgaagaaatgtgaccgcaaaacattgatacggaagacaatgtattatgcaggaaagaggaagcaaggtccaaggaagagcactggcttaatggaacccttagaactagcaagaggaagtattaattttccaacaaatcagaatatggagaaaatgggactcacgctactcctgttcaaccaaggcaaccaatctatatagatgcaacggagtccgaagaggcgaaattgctagcccagaattaacccatactggaatatgattc

SEQ ID NO: 29303 - DNA, 317 bp, Zea mays
  Clone ID: LIB3059-059-Q1-K1-F2
gcaaccatcaacgatgggtctgtcatatagatcggctgcgtttgcgtctacaaaacaagaacctacaatggtattgcatcgatggatcgtgtaaccttggtatggtaagagccgcttgacaggaagtcgagcgttcgggcgcaagatgcgttgtctggcatgctgttccttgaccatttgtgctgctagtatgtactgttataagctgccctagaagttgcagcaaacctttttatgaacctttgtatttccattacctgctttggatcaactatatctgtcatcctatatattactaaatttttacgtgtttttct

SEQ ID NO: 29304 - DNA, 287 bp, Zea mays
  Clone ID: LIB3059-059-Q1-K1-F3
gctctctattgacattccaagcaaacgcgtaggccagttcagagagcagtttatcatgcaaccgggaaacttaatgtcatgctattacatatcaaagcaagatctgtacattatccaatcctgattgaacatattatttgtaagattattctctgaagcacatgtatagaggatttagaagaattcctttcggacctggttttgaatcttatttactttgtggaactgaaattttgggccaaacctctgacaagaattgaaaagtttaagtcttcaactatgaaaca

SEQ ID NO: 29305 - DNA, 431 bp, Zea mays
  Clone ID: LIB3059-059-Q1-K1-E10
ggcaaaactactcttgggtttgctccttgcccttgctattctagggacaacatcgggggctggttgtgtacaagacgcggaagacatgaaacgagagtgcaagcagtttgagctattcccagcgaacccaaagttgccaccgtcggcagcatgttgtgctgtgtggaagagggcagatgttccatgcctatgcaaatatgttaacaaggaagtagagaaggtatggtgcatggagaaggttgtgtacgtcgccaactattgtaagaggccgtttcaacctggctacaagtgcgggagttatacagttcctcttagtatgtaaaaggagtggttgggacatgtggtactctctcctagaactttaatttgagatttgtaacatgtgagagactattgagaataatatgtatggagtaatatgcttccttctt

SEQ ID NO: 29306 - DNA, 412 bp, Zea mays
  Clone ID: LIB3059-059-Q1-K1-C12
gagagaaaaaaaacaagaaagactgatatgttcatataagtatgttaagcaggcgcaggggcaggaatccctccccttactttacaacagaacaaagatttggccaaacaaatccatacaacaattcaatccgtaggtctggtgctatagtaaacagcggtggcggtggcggtagcgcctgaacgaacaaggcgaaagaaattattgtcggcgaaagggccgggacctggaccagacctttcctcggcagtctggcggatccggcgccgcctcagccgcggcagcgggtgatgcgggagcagccgcggtggtaggggttggcctggccgcccgggcggcagttgtagtagctggcgccgcggcgggagcagggcacgttgtcccgccgcagcgcgccgtagctgatgtaccc

SEQ ID NO: 29307 - DNA, 436 bp, Zea mays
  Clone ID: LIB3059-059-Q1-K1-C3
cccactcgtccgcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcatggcaagagaagtttggtggcctcagggatggatactatatccatggccagtgtgcgatcatcatgtttgatgtaacctcaaggcttacttacaagaatgttcctacgtggcatagggacctgtgcagggtctgtgaaaacatccccattgtcctctgcggtaataaggttgatgtgaagaacaggcaggtcaaagccaagcaggttactttccacaggaagaagaatctgcagtactatgaaatttctgccaagagcaactacaactttgag

SEQ ID NO: 29308 - DNA, 379 bp, Zea mays
  Clone ID: LIB3059-059-Q1-K1-C4
cccactcgtccggcgtcgtcacaactggccgcaagatcattggcgccaccaaccccctggcttctgagcccggcaccatccgtggcgactttgctgtcgacattggcaggaatgtcattcatggaagtgacagcattgagagtgctaataaggagattgccctgtggttccccgagggccctgctgattggcagagcagccagcacccctggatctacgagaagtaaacatggaaagtttcacatcaaaccttgagagccagaggaagcatgtcaccatttgtgctttagcaatgttttcgaaaagattatgatctgtatcttggaaccttatttcaatggaccaaatttctttcaaaaaaaaaaaaaatcactaatct

SEQ ID NO: 29309 - DNA, 442 bp, Zea mays
  Clone ID: LIB3059-059-Q1-K1-C6
cccactcgtccgggctggcaagacagactacagggccaggataaggctgattaaccaggacaaaaacaagtacaacacacccaaatacagatttgttgtgcgatttaccaacaaggacatcactgcccaaatcatatctgctagtatagcgggtgatatggttcttgcttctgcctactcgcatgagttgccacgatatggtcttgaagttggtctgaccaactatgcagctgcctactgcactggccttctgttggctcgccgtgtgctcaagatccgtggtttggatcaggagtacgagggcaatgttgaggccactggtgaagacttctctgttgagccagctgatgagaggaagcctttccgtgctctcttggatgttggccttatcaggactacaacagggaaccgtgtctttggtgccctcaagggagcattggat

SEQ ID NO: 29310 - DNA, 441 bp, Zea mays
  Clone ID: LIB3059-059-Q1-K1-C7
cccacgcgtccgcccacgcgtccgcggacgcgtgggtgccccagcagctgtcgtttctcctgtgcttacacggtctccatcactgcagagcacttctgtagcaactgggcaacctcaggttgttgctgaacctagctcgatatgcaaacttcaggctgatctccccattgccaggaggcactctcttcagcgtttccttgagaaacgccgtgacagggtcgtgagcaaagctccatacagccccgctaagtcgtccgatggcatggagtcaccgaggattgaggtgacagcggagggcaaggcccagtaacttgaaaggtccccgcgaagtcccatcggtgaaggctgacgttgtgggaaggggcagggacatgcttgtgttgcctttatgttatgtggcggcggcagcgtggaaccgcactaataatgtggaccggaacc

SEQ ID NO: 29311 - DNA, 384 bp, Zea mays
  Clone ID: LIB3059-059-Q1-K1-D10
gaacaagttgaaagaccaagttctgaggaattactagctgatgtttcacttggactagggaaggtagagcctcataagactgaacctgcacttgctgctctggttagtatccaacagcatgggttcaaacaagctgaaaatggcaacactgaacctaaaagcatggataacgctaacggcgatgatgacccgatatcaaggctacagctagcggacggtactgccatttcagaagctgcagtgaacgccaagttccttgttgagcacgaggagggttacattccacatctagctgcacttgtgatcgaaaagcaattccataagatggatacagtacagtcgtttctcaccgaagatggaaacctggtgttacgatcgagagat

SEQ ID NO: 29312 - DNA, 426 bp, Zea mays
  Clone ID: LIB3059-059-Q1-K1-D11
attcccaactgcagctgcgcgcctcgactggtagcccgaaccctagctagcaggtcggaggcgagagagcagccatggcgcggtgcctcgcgctcgtctccttccttctcctcggcctcgcctccgccgcctccgctgccgatgcgccctttgtcgtcgcgcacaagaaggtttcgctctcccgccccaagccgggcgtcgagcgcgtcgccgtctccctcgacctctacaaccagggatccgcgactgcctatgatgtgtcacttaatgacgactcttggccaacacaagcatttgagcttgtcactggagagaaatcgaagacattggaaaggcttgaccctggtgccactgctacacacacatatgtcctggagaccaaaacacagggcaggttccagggttcaccagctattattacgtacc

SEQ ID NO: 29313 - DNA, 430 bp, Zea mays
  Clone ID: LIB3059-059-Q1-K1-D12
ccgacgcgtccgcccacgcgtccgcccacgcgtccgcccacgcgtccgcggacgcgtgggcgccgccatgtcgaagcgaggcaggggaggttcggcggggaacaagttccgcatgtcgctgggtctgccggttgccgcgacggtgaactgcgcggacaacacgggcgccaagaacctctacatcatctccgtcaagggcatcaagggccgcctcaaccgcctcccgtccgcctgcgttggcgacatggtcatggccaccgtcaagaaggggaagcccgacctcaggaagaaggtgatgcccgccgtcatcgtccgccagcgcaagccgtggcgccgcaaggacggtgtctacatgtacttcgaagataatgctggagtgattgtgaatcccaagggtgagatgaaaggttccgctatcactggacctatc

SEQ ID NO: 29314 - DNA, 433 bp, Zea mays
  Clone ID: LIB3059-059-Q1-K1-D4
cggactcgtggggtctatgctgttgctaaggctgattgcttggatgatttggcttttgcaattatgcatgagatgagcaaattgtcataccgggttacggaagaagatgttatccgtgcacgtaatcagctgaagtcctctatccaactccaccttgatggttcaactgctgttgttgaggacattggccgtcagctgctgacctatggacgaagaattcctacccccgagctttttgcaagaatagatgctgttgatgcaagcactgtgaagcgtgttgcaaaccgcttcatctttgatcaggatgttgctattgctgcgatggggccgatccaaggacttccagactacaactggttcagacgccggacctacatgctccgttactagattaatcagccggtgtacccatgtttaccgtctgcaaaagaca

SEQ ID NO: 29315 - DNA, 439 bp, Zea mays
  Clone ID: LIB3059-059-Q1-K1-D7
aactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaac

SEQ ID NO: 29316 - DNA, 438 bp, Zea mays
  unsure at all n locations
  Clone ID: LIB3059-059-Q1-K1-D8
cccacgcgtccgtgatgcacatgtctccccaagagtacctcagcatcctcagattgcaagtccattcgacaattcagttgtcccacctggaactggtttgtatgggcaatcagcagctgggtttgctcctagacccagtgtcactgaccagtcgaagaatacaatattctctaatgccttatcaagcccagtgcgcaggagtctccagaactctcataccactcaaggtgctggcaatggaggccggaatgcagaagcaaacttagcaggtgcaaatagagaggccaattctacaagctccaacgacacttctatggatatggtttcagacacgaatgaattctaccagtgatttgcagtaagatccttctgcaatcaagcagcatcgcatgccagtgtttntcttgggcctttcctttcgttgaggttttcacataa

SEQ ID NO: 29317 - DNA, 422 bp, Zea mays
  Clone ID: LIB3059-059-Q1-K1-D9
gcgtcagcgactcccggcgaagacgatggggaaggggttcgcatcctacctggcgatgaagacggggccggagggcggcgacgcggcggcggcgcagcaggctctgatcgacgcggacctgcgggagctcggcgtcgccgcgcggaagctcgccaaccacgcattcgtcctcggcggcgggctggggttcggcacctccttcctcaaatggctggccttcctcgccgcagtgtatctcttgatattggatcgcacaaattggaagaccaacatgctgacagctctcttggttccttacattttcttcaccctgcctaatgtgctgttttctctgatcagaggagaggtggggaaatggattgcgattattgctgttattctgcgtctattctttccacgacacttcccagatgggttagagc

SEQ ID NO: 29318 - DNA, 365 bp, Zea mays
  unsure at all n locations
  Clone ID: LIB3059-059-Q1-K1-A8
gtgaagatcatgcttgactgggacccgaagggcaaggttggcccgatcacccctcttgcggacctggtgaccatccataccccgaaggaggaggacgagctgcgccctcctgtcttggcagctgaggtctaaggtcccaacagcgtcctcgaaatggcagtttgatctggtcctagctaggtttgtatcttatgataagggcagtgctaagacagttcgttccgtgtcacttctgtttaaaattaagttttgccgagacaagctatatgtaccggatgaaagtgtggttccttattgtatgctctggaattttatttttggtatgtttattttttgccttagttcaacatgcctnctgcttggac

SEQ ID NO: 29319 - DNA, 429 bp, Zea mays
  Clone ID: LIB3059-059-Q1-K1-A9
atctgccgctccagcctttcgctagggtttaaccaccggcggcgcgcgcgacggcggcgagatggtgcagcgtctgacctaccgcaagcggcacagctatgccacgaagtccaaccagacgcgggtcgtcaagacccctggtggcaagctcgtgtaccagtacaccaagaagagagccagcgggcccaagtgtcccgtgaccgggaagaagatccagggcattccccatctgaggccagctgagtacaaaaggtccaggttgtctaggaaccgcagaactgtgaaccgtccctatgggggagtactatctggaactgcagttagagaaaggatcatccgtgctttcctggttgaagagcagaagattgtcaagaaggtgttgaaattacagaagaccaaagacaagacttcctcaaaaaagtaactctg

SEQ ID NO: 29320 - DNA, 432 bp, Zea mays
  Clone ID: LIB3059-059-Q1-K1-B10
cccacgcgtccgcccacgcgtccgcccacgcgtccgcccacgcgtccgctcgtcgcatgttccttgcaaccgattgcctatccccctcccaaccaaagaccgatggcgcccaaggccgagaagaagcccgcggcgaagaagccggcggaggaggagcccgcggccgagaagacgaccgccgggaagaagcccaaggcggagaagcgggtccccgcgggcaagtccgccggcaaggagggcggcgagggcaagcgtggcaagaagaagggcaagaagagcgtggagacgtacaagatctacatcttcaaggtgctgaagcaggtgcacccggacatcggcatctcctccaaggccatgtccatcatgaactccttcatcaacgacatcttcgagaagctggccggcgaggccgtcaagctcgcgcgctacaac

SEQ ID NO: 29321 - DNA, 431 bp, Zea mays
  Clone ID: LIB3059-059-Q1-K1-B12
cccacgcgtccgcccacgcgtccgaacaaagtttgagctgttgtaccttcacccaatcgacatatagcactacaaaatggtcactgggaaagtagcagtcgtcctcctagcctgctggacgctagttctctaccaaccagtgcttggccgtttaccgtgtaacaatgatcagaagagagagatcctgcgcgagtgtgatccactgaactcaacacctgactatactccatcccggcacggtgcgtgctgcgtggcggtgagaaaggtgccaggaaccaacatgctttgcattgcctccatactctcacttgctgacaaggccaaatacagtgtaaggaagattctaggatttagagatgcatgcgccccttcacatccacaccatcaggtcatggcctaaaagagtgtagctgccagcctgccatcgctta

SEQ ID NO: 29322 - DNA, 447 bp, Zea mays
  Clone ID: LIB3059-059-Q1-K1-B2
gtcatgcgtgcgtggaggcggagctcctcctactatagcgtgccagcgtggggcagctgcctcaactatcgccggagcagagaacccacgggccactgccccaccccacccctctcttttccccagccaccggtggctgcggcggcagcctaggcggcgttgtcgagctgccgacagaggagggaggactggaccagaaaggtgaaggctgtgccgtgtgtcgatcaataggcccaaatcccaatacaaggaatgcaataagagacatggttgtccgtggtgctccagcaatagccatagcagcggcactagcattagccgttgaagtttctgatttagattttattggtacgcctgaagaagcagcttcttttgtttcaaagaaattggaataccttgtatccagccgaccaactgcagtgaacctatctgatgctgcaacaaagc

SEQ ID NO: 29323 - DNA, 441 bp, Zea mays
  Clone ID: LIB3059-059-Q1-K1-B6
cccacgcgtccgcccacgcgtccgcccacgcgtccgcccacgcgtccgcccacgcgtccgggcagctcgagcacggcgggcggcacgacaagctacacagagcgacggctggcgcgagtagcagcaataggggcacgacgataaatcgcagaatcagaggtcggaggggagcgaggagcagagcaagtgaggaaggggaaggcgagctcgcaggcgcactacttatgggcgtccggaggagggaagacgagtaggcgatggtgcttcagtgtggccgacgactcttccgtgccagcaggcacaattacttggagaagaaatagacgaagttaatggaaaggaagagaaacggacgacgtccattgagaaggagaggcgagcggacggagtgaaaactcgtgtcgcggcaacgcatgcatgtggtgcgagcggcggtgcgcg

SEQ ID NO: 29324 - DNA, 441 bp, Zea mays
  Clone ID: LIB3059-059-Q1-K1-B7
acttggaattgtaaagatctgcatgtccattgccttttgatgaagccaaactttgtcggggcgaaaatggtcctgagctaaagcaagagattcagaagcaatttagaaacattagtgcaattatggactgtgttggatgcgagaagtgccgactgtggggaaagctccaagttcatggtcttggaactgcactgaaaattcttttctctgttgatggggacagccatatgaatcagccattgcagctgcagcgaaatgaggtcattgcattgttcaatcttctgaacaggctctcagagtctgtcaaatttgtacatgaaaaaggatcatcaattgaagaagtcattgaggaacagatcccttcaacggttcaaaagagtgtttccatgccgaatcttaaactggacttcctctgagatgtatgagagtaatttgtagtta

SEQ ID NO: 29325 - DNA, 423 bp, Zea mays
  Clone ID: LIB3059-059-Q1-K1-B8
gtttcacagacagcatccattccacagtcaccagagcactagagcagagcggcaaccgacaagagcagagtgagatcgtcgtcagcgagcccagcagatacgagagagaggatggcggacatcgcgttgctggtggcggagcagttcgagaagacggcaaggcgaggcgcccccggcggggacagcggcagcagcagcgggagcggcggcgagacaaggaacttcggggccgtggccaaggtgtggagctcgtgggtggagtccgccttcgtcgtcgcgtccggggtcagattcaccgtcgcggtgcagctggagcccaagaccgggctcgcgctggccgctgccgacggccttttttccgcctagcttcctgcctgcttccatgtctttctcctgagcagtgccagtgatcgagcgagtcct

SEQ ID NO: 29326 - DNA, 428 bp, Zea mays
  Clone ID: LIB3059-059-Q1-K1-B9
ctcagatgcatggtggaagcactaagaaatcggcacctgatctatccccgaccaaacagaagaagcaacaggcagttcaagaaaggaaaaggaagcaacagtcaaagaggggcaagaaagtggctggtgaatccctggaaataccccaaacaaattttgaatcggagaatcaacctcataatgacgatgtcaacattgagaaacagacaattacgagtagcacactctcaccaaatggtgccaaggggcaaaagggagctcaaaggagaaaccagaccaaaaaaaggaatcaaagaaaaatccttggagatgctgaccttgcatgccagcctggagtgagaaaaagctcaagaacacgctcaaggcctttggagtattggcttggtgaaagattactatatgggcctatacatgacaatttgcatgga

SEQ ID NO: 29327 - DNA, 345 bp, Zea mays
  unsure at all n locations
  Clone ID: LIB3059-058-Q1-K1-H2
cccacgcgtacgtccacgcgtccgttcactcgtgcttgtagatctgccactacccttcgcaatctagaaaatatnactcctatacatagccacacctattcccgtatccactgatgcatccaagcccatgccagctgtacagaacccgcagtatatataatacctcaatactggcccacttcgtagatttcctcatgcattacagtagtctcaatgcatctccctactaatggggtaactaccagaatttcccataccagtgttttcaagccctcatgctggtgaaaccctagcttctctaccatgctaaaccctgctatgcattccactatatcctgctgtagc

SEQ ID NO: 29328 - DNA, 267 bp, Zea mays
  Clone ID: LIB3059-058-Q1-K1-H3
gctgctcgcctgtcgattccgcctcatcgcgtcccgtaactccatgtccactgggaccgggaccctgggcggcgggcgatccccggctggcgcgcttcttaacctgcgcccgcgcgcaacccggggtggccccaatccgttgcccgggctgcgcgtcggctctgggtgccgtcacataactattggttccgcggaagcaagcccgcgccccaacggccccgtttcccaagggtgctgatttatttttcccggcagtaatctcgaaca

SEQ ID NO: 29329 - DNA, 367 bp, Zea mays
  Clone ID: LIB3059-058-Q1-K1-H4
acgactcgtccgaccacgcctcacgggtaccgtggtccaatgcgtatttcaaacgtttggcaatgagattcaagaaaaagccggcttgccagacagactaccaggccaggataaaggctgttaacccaagacaaaacaagtacaacacacccaaatacagatttggtgtgcgatttaccaacaaggacatcactgcccaaatcatatctgctagtatagcgggtgatatggttcttgcttctgcctactcgcatgagttgccacgatatggtcttgaagttggtctgaccaactatgcagctgcctactgcactggccttctgttggctcgccgtgtgctcaagatccgtggtttggatcaggagta

SEQ ID NO: 29330 - DNA, 424 bp, Zea mays
  Clone ID: LIB3059-058-Q1-K1-H5
aagaacatcgccttgaggacagccttcactttccctggcagtgtgtttgctattttttgcttcttgaatgctcttatctgggggcaaaagtcctcaggtgctgttccattcaccaccatgtttgctcttgtcctcctttggttcggtatttcagtacctttggtttttgttggaagcttccttggcttcaagaaacctaccattgaagatccagtgaagacaaacaagataccaagggcaaatccctgagcaggcctggtacatgaacccaatcttctcgattctaatcggagggatccttccatttggtgctgtcttcatcgaactcttctttatccttacttccatctggctgcaccagttctactacatctttgggttcctcttccttgtgttcctgattctcatcgtgacatgtgctgag

SEQ ID NO: 29331 - DNA, 454 bp, Zea mays
  Clone ID: LIB3059-058-Q1-K1-H6
acgcatccgaaggacatcgccttgaggttagccggttctttccctggcagtgtgtttgggatttttggcttcttgaatgcgcttatctggcggcaaaagtcctcaggtgctgttccattcaccaccatgtttgctcttgtcctcctttggttcggtatttcagtacctttggtttttgttggaagcttccttggcttcaagaaacctaccattgaagatccagtgaagacaaacaagataccaaggcatatccctgagcatgcctggtacatgaacccaatcttctcgattctaatcggagggatccttccatttggtgctgtcttcatcgaactcttctttatccttactttcatctggctgcaccagttctactacatctttgggttcctcttccttgtgttcctgattctcatcgtgacatgtgctgagatctcgattgtcctatgttact

SEQ ID NO: 29332 - DNA, 414 bp, Zea mays
  Clone ID: LIB3059-058-Q1-K1-H8
cgcgtaccgacgagtcctccgacgcgtccgcacagctgcttcctctcgctttgccggcgccgccaatgcctggcatgggtggtcctccacctccgatgggtggaatgggcatgcctcccatgggcgggatgggtatgccgccgatgggccctggtccgatgccagcattcggaatgggaggctactgagtggtggttttgcagggagcttagatgatgatgtgaattgttccattgcaagcataagcggaacctcattggagctgtagatggtttacagtttgggaaatcaatattctttattgtaccaggaaactttttttttttgggcgagtgagcagcctggcccatagtttgtgaagtgcaaccttcgatatgtttaacgatgggatcggaaataggatgattaggttgt

SEQ ID NO: 29333 - DNA, 429 bp, Zea mays
  Clone ID: LIB3059-059-Q1-K1-A10
caacaagcaacatagaaagtggaatacagtagcaacaatagagcaacaatggcggccaggatattttccatccttatgctccttgctctttctgcatgtgttgctaacgcgaccatttttcctcaatactcacaagctcctatagctgcccttcttcccccataccttccatcaatgaccgcttcagtatgtgaaaacccagcccttcaaccctacaggctccaacaagcaatcgcaacaagcaacttacctttatcacccctgttctttcaacaatcgccagccctatctttggtgcagtcattggtacaaaccatcagggcacaacagctgcagcaactcgtgctaccagtgatcagccaagtagctctggcaaacctttctccctactctcagcaacaacaatttcttccattcaaccaactgtct

SEQ ID NO: 29334 - DNA, 428 bp, Zea mays
  Clone ID: LIB3059-059-Q1-K1-A11
atggcaacgagctagcggcagaggaggtgcaccatggcaccatggatgtctggcgtgacgtgatgcacaatcacgctgctagctgttgatggcagtagctgctgcaggaagcatcgaacgtctgtgctcactcgctagtatggctacacttattcgtcaatcactatgaccatcaagatgttccgtgtgcgaagatgcaatgcgaattggatacatgatccaacaggtactggtagctactattggacatgtgtaactgttgctcgtacgacaatcatcatccatattacatacaatgcattagacgcttagattgtgacgacacataccgtcgcaacgactgccactgctcgtgctaacgctgcttgatgcatactgtgatgcacaactgactccggaggtgcatttggtggcacgaagcataccgg

SEQ ID NO: 29335 - DNA, 412 bp, Zea mays
  Clone ID: LIB3059-059-Q1-K1-A12
cccacgcgtccgcccactcgtccgaaacaggacgatttgcccagacttggtgtttttggtgctgttgaaatctccgatccctttggggtgacccactggacatggccaatttgtcacaatttattattttgacccatgtcatgtgaaactcctttcgttgaagtctggtatctagattgacttgtatcagagctgtggtttacgcagactggattctggagtactggactgtgtgtgtgtttttcggaactgtgcatctgacttttagctgttcgttgactttgtttttcttttttcagataaagagctgtttcttgatttgatgcagaaaaaaaaactacaacaactcaagctaacactaaaaaataaaatacaaaaaacaaaaacaatatcataaaatgcatttgatagc

SEQ ID NO: 29336 - DNA, 446 bp, Zea mays
  unsure at all n locations
  Clone ID: LIB3059-059-Q1-K1-A2
gttgacaagaagactagaaccgaacctgaccatgtcgctgatccgccgcagcaacgtgggcgatcggttctccctcgacctatgggacccctttgagggcttccccttcggctccggcagcagcagcagtctcttaccctcgttcccgcggaccagctcggagaccgcggccttcgctggcgcgcggatcgactggaaggagactccagaggcgcacgtgttcaaggcagacgtaccggggctgaagaaggaggaggtcaaggtggaggtcgaggacggcaacgtccttcagatcagcggcgagcgcaacaaggagcaagaagagaagacggacacctggcaccgcgtggagcggagcagcgggagattcctgcgcatgttccgactgcccgagaacgccaagacggagcagatcagggccgncatggagaacggcgtgcttacag

SEQ ID NO: 29337 - DNA, 357 bp, Zea mays
  Clone ID: LIB3059-059-Q1-K1-A3
accggttctcggattaccgactcgtcccactcgctcgtcgtacccctacggttctgctccggcttcgtgaggttctccgtggttgggtttctggggtggtccgatcgatatgtcctctttcaatgttcactactcgcttctattttcattggactctgctgagccacgtaccaccactcgctgaacaacgccttctgcacctaccgagatgtcctatagtacatgatcctcctcgatctgcagacgcacatgttacgctgattaggattaaccatcttatacacatatgatgcaatgcggcacgccatcttagtgcatgaactgtctggagctatacgggcgcaacatctccgtcaa

SEQ ID NO: 29338 - DNA, 241 bp, Zea mays
  Clone ID: LIB3059-059-Q1-K1-A4
atcatgcactagcgttggtcgtacgccactcctgacaaggcatgatcggactttcacgtggtccggtcctgctgctcagcatatgcccgccggcagagattgccctggagatcccatctcttacgcctactcttgcagacgccactctggaagcgttactgcgatgaaacaggctcagcgctgtagattattgtcccgaagtttcctgctagccctgaagaacactaactgcatgtagcca

SEQ ID NO: 29339 - DNA, 442 bp, Zea mays
  Clone ID: LIB3059-059-Q1-K1-A5
cccacgcgtccgcaacaagcaacatagaaagtggaatccagtagcaacaatagagcaggaatggagaccaagatattttccctccttatgctccttgctctttctacatgtgttgctaacgcgacaattttccctcaatgctcacaagctcctatagcttccctttttcccccataccttccatcaattatagcttcagtatgtgaaaacccagctcttcaaccatataggcttcaacaagcaatcgcagcaagcaacatacctttatcgcccttgttgtgtcaacaatcgccagccctatctttggtgcagtcattggtacaaaccatcagggcacaacagctgcagcaactcgtgctacctgtgatcaaccaagtagctctggcaaacctttctccctactctccgcaacaacaatttcttccattcaaccaactgtcta

SEQ ID NO: 29340 - DNA, 418 bp, Zea mays
  unsure at all n locations
  Clone ID: LIB3059-058-Q1-K1-H12
ccggtccgattgcggagcgtccgccaccgtcgccaccgtcgccaccgtcgattgatccactagcaacatcatatggatacactacacatttacaccaatggcagccaaattttgcctcttgccctccttgctctttcagcaaacgttgctaccggactattattcacaatgctcacaacaatacctcttccggtgacagccgcgagatttgaatacccaactatacaatcctacaggctacaagaggccatcgcacaagcatcttacggtcgtagcattgactgttcacaccatatgccctattgcaacaaccatcctaatgaatctatatcntccaagaatcgtagcacatcaactacaacaacaattgcttccacaatncaaacaagagtttcagcgaacttgagcttacctcagc

SEQ ID NO: 29341 - DNA, 445 bp, Zea mays
  Clone ID: LIB3059-058-Q1-K1-F8
gttggcttctcctccccctccggttcgtgttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcg

SEQ ID NO: 29342 - DNA, 288 bp, Zea mays
  Clone ID: LIB3059-058-Q1-K1-G1
cggacgcgtgggtgccgccgccggttcatctgccgccgccaccatgccactaccctacgcaaccgcgccggcctcagcctcatccccagccacacccatgcccgtgccaacagccgcatccaagcccgtgccagctgcagggaacctgcggcgttggcagcaccccgatcctgggccagtgcgtcgagttcctgaggcatcagtgcagcccgacggcgacgccctactgctcgcctcagtgccagtcgttgcggcagcagtgttgccagcagctcaggcaggtggagc

SEQ ID NO: 29343 - DNA, 435 bp, Zea mays
  Clone ID: LIB3059-058-Q1-K1-G10
cccactcgtccgattgagaccaactagcaacatagaaagcacaatagtgtaccaacaagtgcagccaaaatattttgcttccttatgctccttggtctttctgcaagtgttgctaccgcgaccattttcccacaatgctcacaagctcctatagcttcccttcttcccccatacctatcaccagcggtgtcttcagtatatgaaaacccaattgttcaaccctacaggatccaacaggcaatcgcaacaggcatcttaccattatcacccttgttcctccaacaaccgtcagccctattacagcagttacctttggtgcatttggtggcacaaaacatcagggcacaacaactacaacaacttgtgctagcaaaccttgctgcatactctcagcaacatcagtttcttccattcaaccaactggctgcattgaac

SEQ ID NO: 29344 - DNA, 436 bp, Zea mays
  Clone ID: LIB3059-058-Q1-K1-G11
gcaacatgcagatgtagcaatgcatcgagaggaggttcaacttttgaatctattgaagggccatgatcaagaatacaatgttgatgagatcagcatgaatgacaagctcaccaactgtggccatcagataactattatggaatatgccggatttcctttccccactgttgccttgaaggagggcctaactgcatcaagttagcagagtgttcagcagagctacgaagaacttgaagcagcatttgagccagggaaagaattctgctttgacgcgacaattcgtttaaactaagcttgccactaggattgatcaccagcctcctccaatattgtgacctcattagtagttgttaagaaatgtttatcacgtgaagcagaattgtgtaaaatatcatgaggcatgagcgtaatgtatttgtgtggcattaacccataa

SEQ ID NO: 29345 - DNA, 423 bp, Zea mays
  Clone ID: LIB3059-058-Q1-K1-G12
tcccgggctgacgttcattccggttggttgactgatccaggtattagcagtcaaccggttcctcggagcacgatgaagttggctgctgactacctgctagctgtcctcgctgggaacgccagcccctgcgctgacgatttgactgccattctggagtcagttggctgtgaagttgacaatgaaaagatggaactcctgctgtcccaactgagcggtaaggacatcaccgagctcattgccgctggcagggagaagtttgcttcagtcccatgtggaggcagcggtgtcgctgctgcagcagctgcacctgctgctggcggagctgctactgcagatgaggctaagaaagaagagaaagcggaagagaaggaagaaagcgatgatgatatgggcttgagactcttcgactaggctgcacagtca

SEQ ID NO: 29346 - DNA, 448 bp, Zea mays
  Clone ID: LIB3059-058-Q1-K1-G3
ggacaagagtcttctagagttcaccaatcctggttcccttctccctcagtccctcaccgtccgcctgcccagccaaatgccaccgggccaacaaaatctagcggctccacgctccccgtttcctccgtggcttccatggcgaactcaggcctagggcttggacttgcgccaccgggcgccgagccctcttcactccacgcccagtgcttggccaaacggcgcgtcgtgcccgccttctcttaattcaagggccgaaggcatggcgtcgtagtatgtgtggcgcctccagtttgcgtgtgacctccctggggaccttcttcgcactggtgtcgaagcttgacctaacctggccaggccgaaccttaaaccaagtcctggcgatccagatcgttcggtgaggcatgaagaccccaagccaacagccttcggagctagcattggcggtagc

SEQ ID NO: 29347 - DNA, 448 bp, Zea mays
  Clone ID: LIB3059-058-Q1-K1-G4
cccacgcgtccgcccacgcgtccgcccacgcgtccgcggacgcgtgggcattacttggagcgaagggtttctttgctttcataggggaacactttgagagttctgaagagctgaaacatttgaaagaagtgctgcttgatcttttcagaggagaggtcgtagagaatctgaaccttgccggtgtggatcggatctatgtgtgcactgcaatctctcccaccactgtctacatgatgcactgtgctctccgtctaaaaaggtcaggtacatctattcctaggatggagctggtcgaagttggaccttcaatggatctggttgtaaggaggcacagacttccagctgaaagtttgaagaaagaagctatgaagaccgctgaacatgctaagaagatgaaaaatgtcaccaaggatccagtgcagggcaagctgggcaaggtctacatgcc

SEQ ID NO: 29348 - DNA, 407 bp, Zea mays
  unsure at all n locations
  Clone ID: LIB3059-058-Q1-K1-G5
gtccaagccgtgcttctgctgcttggaggcagggagctgagtagcctgagcggagcgtggtcctctgcaccttatagtaagaggttgaactttccacatcgggtggcatcactgatgagatttagggaaaagcggaaggagcggaactttgataagaagatccggtacaatgtccggaaggaagttgcacttaggatgcagcgtaatagaggtcagtttacatcttcaaaaccaaagcctgatgaaatagcagcatcagaaaatggcagctgcagatggctctctgaattgngcactagttgaagggccgacctccatctgctgctgaatggtcatccctgtggtattaatgcaacagctacaccaatgatgcgtcggggaccttgatggaccaagaacactatgca

SEQ ID NO: 29349 - DNA, 446 bp, Zea mays
  Clone ID: LIB3059-058-Q1-K1-G6
cggacgcgtgggcggacgcgtgggcggggctcatcatgcatctcctcagcggcgccggcgtcgtcggtgacggcggctctgagtctgagtcccgtgaagttgccgttcccgggttgccggagccggagatacggatccccgtcagcgagctgccggagttcttgagacgcccagcgaagggccaaggcacgttgaacccttgcaacgcggcgatggccaggtgcctgggcgtcgcctacaacacgttcgcgggcctggagcaggagtaccgcgaggcgagcatgcgcgtcgcgtccttgaagcgcagctacttcgtcggccccgtctcactgccgctgccgccggccgcggcaggcgtcactgagcctccatgcatccggtggctccactccaagccgagctgctcggtggtgtatgtgtgcttcggcacctacgccgccatctcg

SEQ ID NO: 29350 - DNA, 351 bp, Zea mays
  Clone ID: LIB3059-058-Q1-K1-G8
aaaaaaaaaaaaaaagaaataaaaaaatttaaaaaaaaaaaaaaaataaaagaaaaaaagaaaaataaaaaaaaaaaaaaaaactaaaaaaaaaaaaaaaaaaaaaaaaaaaaaaaaaaaaaaaaaaaaaaaaaaaaaaaaaaaaaaaaaaaaaaaaaaaatttgcccccctttttaaagttccaattttttcttccccttatttccaaatttttatttttttttttttccccctaaatttaattcatttgcccatctttttaaaaccttatttttgaaaaaccctttttttacccaattttattccttttcaaaaaattccctttttcccaatttgtgtattttccaaaa

SEQ ID NO: 29351 - DNA, 434 bp, Zea mays
  unsure at all n locations
  Clone ID: LIB3059-058-Q1-K1-G9
cccacgcgtccgcaacagctatcgtcaaatctacgacattcccagcaatgactatgctagtaattatacagaggaaacatcaatacaacttccagaaataggcaccagcaatactattgttcaaggtcatgttgatgtcaatgaacaccgatttgatggaccaagaacaatcgaagaaatcgttcctgttccattggatgagatacagatccatgaggatgtcccagggcaaccgggagcagccgatgagatagatgaggttccattttctgacgctccgatcattggtgctccattcagactgatctcatttgttgctaggtatgtcagcggcgctgatttggtcaaccaaaaataactgtctgcataccaggaattcaggactnttatgtcaggagttcctttttgatcccactgataattacgtcagtatc

SEQ ID NO: 29352 - DNA, 429 bp, Zea mays
  Clone ID: LIB3059-058-Q1-K1-H11
cccacgcgtacggtacgacacttcgttcagtgaagatgagaagaagcaatccaagcagctgaagagcagctgctacctaaacaatgctgcctgcaaactgaagttgaaggattacaaggaagctgcgaagctttgcaccaaggttctggaactagacagccaaaatgtcaaggctctctacaggagggtgcaagcttacattcaacttgctgacctagagctagcagaggccgatatcaaaaaggcactggaaatcgatcctgacaacagggatgtcaagttggaatataagatcctgaaggagaagatcaaggagtacaacatgaaggacgccaaattctacagcaacatgttcgccaagatgacaaagtagcttttggggtggaggatgttgtggtgaagcgaacggattaaaaacaccgatttctg

SEQ ID NO: 29353 - DNA, 440 bp, Zea mays
  unsure at all n locations
  Clone ID: LIB3059-058-Q1-K1-F6
gcaccagaaggagctctttgtcgcagccgagggcatgtacacgggccagttcgtctactgcggtcgccgcgccaccctctccatcggcaacgtgctgcccctccgcgggatccctgagggtgccgtcgtctgcaacgtcgagcaccacgtcggtgaccgcggtgtcttcgccagggcctctggggactacgccattgtgatcagccacaaccctgacaacggcacatcgaggattaagctgccctctggcgccaagaagattgtccccagcagctgccgtgccatgattgggcaggttgctggtggaggcaggactgaaaagccgatgctcaaggctggtaacgcgtaccacaggtaccgtgtgaagaggaacagctggcccaaggtgcgtggtgtggccatgaaccctgtggagcatccncacggaggaggtaaccacc

SEQ ID NO: 29354 - DNA, 443 bp, Zea mays
  Clone ID: LIB3059-058-Q1-K1-E2
cgacaaaatccctcaccctcgtgagtcctgacgccctcgcccgtgctcgcagttggtagggttgtagccatggcgtggagcgccgccgccgtctccaggttcgccgccgcctccccacccgcggcacccatctccgtcaggcttggagccgccgcttctcgctcctccctgtccttctccagtgggcgccgacgccccgtggccgcgtccctctcgacctctgccaccgttgtaaaggaggctgttcagacagagaaggcaccaccagcactaggcccttattctcaggccatcaaagcaaataatcttgtgtttgtttctggagttcttggcttgaatcccgagaccaggaagtttatctctgaaaatgttgaggagcaaactgagcaggttatgaaaaacatgggcgagatattgaaagctagtggtgctagctattcttc

SEQ ID NO: 29355 - DNA, 352 bp, Zea mays
  Clone ID: LIB3059-058-Q1-K1-E3
aagacgcgcgcgcagaagcacacctgctcgggctggattaagaagacagctttttcgggcgcgacgtggcggaggagaagggcgcgttgcagtcggcgagggagtgggtggtcgaccacaagctccgggccgtcgggacgctggggctcagcggcatcgtcggctccatcgcctacaactggtccaagccgggcatgaagaccagcgtcaagatcatccacgccaggctgcatgctcaagctctcacgctggctgccttggctgggtccgcgctggtggagtactacgaccaccagcaagggtcaggatcgaaagttcaccaatttgcaaagcagtttctttcatctgatag

SEQ ID NO: 29356 - DNA, 398 bp, Zea mays
  unsure at all n locations
  Clone ID: LIB3059-058-Q1-K1-E4
cccacgcgtccgcccacgcgtccgggctcacaggtaaaggcggcatggtcttcggttcgggcctgtgccccaagcgcatcgtggtggacgcgcgccaacacatgctgggccgtctctcctcgaacattgccaaagagctgctcaatgggcagaaggtggtcgtcgtccgctgcgaggagatctgcatgtcgggcggcctcgtccgtcagaagatgaagtacctccgcttcctccgcaagcggatgaacaccaagccgtcccacgggcccatccacttccgcgcccccggcaagatcctgtggcgcaccatccgcgggatgattccgcacaagaccaagaggggggaagcggctctggcgaagctcaagacgtacgagggcgntccggcggcgtacgac

SEQ ID NO: 29357 - DNA, 444 bp, Zea mays
  Clone ID: LIB3059-058-Q1-K1-E6
gtagcaacaacagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttctccctactctcagcagcaacaatttcttccattcaaccaactgtctacactgaaccctgctgcttatttgcagcaacaactattaccat

SEQ ID NO: 29358 - DNA, 340 bp, Zea mays
  Clone ID: LIB3059-058-Q1-K1-E7
cgcaaattgcaccaagaaatccatcgagaggccgtcgacaggggaattaatggcgtcggggtctagcagcagccaccgccgcctcatcctcgcagccgccgtcctgctctccgtgctcgcggctgccagcgccagcgccgggacctcctgcgtgccggggtgggccatcccgcacaacccggttcccgagctgccgctggtacgtgaccagccggacctgcggcatcgggccgcgcctcccgtggccggagctgaagaggagatgctgccgggagctggcggacatcccggcgtactggcggtgcacggcgctgagcatcctcatggacggcgcgatccc

SEQ ID NO: 29359 - DNA, 423 bp, Zea mays
  Clone ID: LIB3059-058-Q1-K1-E8
atcagcagcttctgcttgctttgtgggggaaggagagagagagagagagagatctaggggagaggctagtaggtggtcctcgaacgaagatgttggcggtgttcagcgctcaggtggtggaggtgccggccgcactgctggcagctggcagccggacgccgtcgcccacgacgaaggtctctcatctggtggtcgcgcttcctggccgcctccgagcctgccgtgtccgtgcagttcggccaccacagtcacctcgcctacttccacaccaaccacgcgctcctacgccccaggtcgttcgcggcccaggaccaggtgttctgactgatcgagcgggtgctgcacaccctgagtcgtctgaaccatgcacacgggctgtcatgcaagggcgccaacgaggtgctcctagccatggatgcctac

SEQ ID NO: 29360 - DNA, 419 bp, Zea mays
  Clone ID: LIB3059-058-Q1-K1-E9
cggacgcgtgggcggacgcgtggggggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggc

SEQ ID NO: 29361 - DNA, 110 bp, Zea mays
  Clone ID: LIB3059-058-Q1-K1-F1
gttactgatggttcaaacggtctttacagtgtcttgttggtgttagtgcttgtttatctgacatttgtagtgaagctggacgtgcgaggaatattgaattctcttcctac

SEQ ID NO: 29362 - DNA, 433 bp, Zea mays
  Clone ID: LIB3059-058-Q1-K1-F10
ggagttctggggtctcgaggtcaaacctgtatccactgtcaagtgtgagcctgtactgactttgtcctgcacgtttcccaggctgcccttggggaatcaaagaaaagtgacagtgccttaatgtatgtcaaagttgatgacaagaagcttgccattggaacgctctctatcgacaaatacccacagatacaattcgatttggttctcaataaagagtttgagctgtcacacacatcgaaaactaccagtgtatttttctctggttacaaggttgagcagccaattgagggagatgaaatggatcttgattctgacgatgaacaggaggagctaaacattccagtaatcaaggaaaatggcaaaggtgatgggaaggaggagcagaaaaatcaagagaaggcagtagctgctacagcttcaaaatcaagtcttg

SEQ ID NO: 29363 - DNA, 407 bp, Zea mays
  Clone ID: LIB3059-058-Q1-K1-F11
cggactcgtgggaaaaaaaaaaaaaaaaaaaaaaaaaaaaaaaaaaaaaaaaaaaaaaaggaaaagggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaagaaaatattaaaaaaaaaaatttttaaaaaaaaaaaaaaaaaaaaaaaaatttttatataagggaaaaaaaaaaaaaaaaaaggagggtatttaaaaaaaagttgaattgaaaaaaaaaaggtttaacaaaataaattaggttaaaaaaaaaaaaatttttttaaaaaagggaaaaaataaaaaaaggctaaaaaaagaaattttaaaaa

SEQ ID NO: 29364 - DNA, 330 bp, Zea mays
  Clone ID: LIB3059-058-Q1-K1-F12
ctgaaatactgttaggactagtttggttactctattttttcaagagattcatatttttgcaagtggaaatgaattaattttcttttgagaaaatagaaagaaatcccttgaaaaaaatgagattctctaggagccataaaaccggagtaaattggaggagctaaattcatcctttttattcaattttgaataagaggaatttagctcctctggttttgtggcttccaaactaaggttgtattctctaagatatttgtgctgctgctgctgccaatgtactgtaaatatctactaccatcaaagttattgatgttctctaagctatttttt

SEQ ID NO: 29365 - DNA, 452 bp, Zea mays
  Clone ID: LIB3059-058-Q1-K1-F2
cccaacgagaagagcggcggcgcgggcggacaaggagcaggcggaggaagagctgtgcgaagccagaatgggtatctcacgcgactcgatgcacaagcgccgtgccaccggtggaaagcagaaggcctggaagaagaagcgaaagtatgagcttggtcgccagccggccaacaccaagttgtcaagcaataagacagtgaggagggtccgtgttcgtggaggtaacgtgaagtggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaaccc

SEQ ID NO: 29366 - DNA, 293 bp, Zea mays
  Clone ID: LIB3059-058-Q1-K1-F3
caagcacccaaatcgacgaattcttgccccctctgcgatctcgacgcgcaccgatgcgggcgatgtggtcggcggttaatggtatgctgcgggcacggctgcgcggggcagcgcgcgttcgcggcggcggcggcgaaggggccgggcggtggacgacccccaggtcacgaggagcgccccaaggggtacctcttcaaccggccgccgccgcctccgggggaatctcgcaagtgggaggattgggagctgccctgctaccgggacctccttcctcaccgtcgtcatcctcggcg

SEQ ID NO: 29367 - DNA, 444 bp, Zea mays
  Clone ID: LIB3059-058-Q1-K1-F4
ctcagtatatatgcgaaaatgatggagtttttaagttaagtatctttatggcctcttggggttcggggtgaactttactgtaagttctttttcttaaaccaccaccaattttcaaattggtcacctcttccttctttcccttatgacattgaggcttatgtttatgttcctgaagccgatatcctgtcagtcttagatgtgcctcctgggaaaatgggacgagttattggcagaaaggggtcaacgataatggctgtgaaagaatgttgcaaggttgaaatacatattggtggtgctaaggggccttcagacagggtgttcatcattggaccagagaaggatgtcaggaaagctgaggccatctttcgaggccgaatgctggagttctagagatgttaccctttgcgatacaggtttcaactgctttatattttgaacgtaaaa

SEQ ID NO: 29368 - DNA, 360 bp, Zea mays
  Clone ID: LIB3059-058-Q1-K1-F5
caaacagaagtggtgtagtgctcttaacaactgcacctttgatggtgggatcgagtatgaaccacaatgtgacagtatgagcaacatgtttaataatgtttctgataagttgacttctctttgtgcaattgctgttgctgtggataaacagactgaagattggagggaaaaagaattagatgaggatgcacggtgtttccaaaggccacctgcttgcatcataaaatacagtgatattttgaatcatgcagcaaaggtttatacaccttagaatctacaaactgtttgagacagattttcttgatgggtgtggagccacaaaattcaaagagcttccgtgtcaagataacaatacatatc

SEQ ID NO: 29369 - DNA, 409 bp, Zea mays
  Clone ID: LIB3059-058-Q1-K1-E12
aacataaaaagtggaatacagtagacactaacagaggaccaacggtctacaagatccaagctctcggtatcctgcttgctatgtctgcatgtgttgataacgcgacctttattcattaaagctgacaagcttctataacttccctacttgcaaaataccttccataaccgactgattcagcatgcgaaaaatcagcttttcagcactatacgctacaacaagcagtcgcagaacgaaagatatctttatcacccttgcagcctgaacaatcaacaggactatctttggagcagtcatatgttacaaaccatcatggcacagtacctgcagcaactcctgctacactgtgatcaaccaataagctctgtcatacctatctccctactctcattatcaacaatttcttcca

SEQ ID NO: 29370 - DNA, 419 bp, Zea mays
  unsure at all n locations
  Clone ID: LIB3059-034-Q1-K1-E3
cgaatacaatttaaagatgatatagtaatctcgtcacctgatgtatctctggtagaggttggaccagacgtggaatttgttctgttagcaactgatggtctttgggattacataaaaagctctgaagctgtagcttttgtcagagaacaactccgtcagcatggtgatgtccagttggcctgcgaggcacttggtcagaaagctctggatcaacggtcccaagacaatattagcatagtcatagctgacttggggaggacaaactggaaggcgttgcccgatgaaaggccgaacttgttcttggaactaagtcaagcagtcgcgacttgtagggttgtctcaataagaatttgggtctcgtcgttccttgggttacagtagaactagctactccgtncggatgtgtatattacctactg

SEQ ID NO: 29371 - DNA, 442 bp, Zea mays
  Clone ID: LIB3059-034-Q1-K1-E4
cccacgcgtccggggaaaattcttcctgaagggatcggtgaggttcaagaaatcatggacatgtgtgattatgctgtggggctaagtcgccaactaaatggatccattataccatctgaacgaccaaaccatatgatgatggaagtgtggaatccccttggagttgtgggtgttataacggcatttaatttcccttgtgctgtgcttggttggaatgcttgcattgctttggtctgtggaaattgtgtcgtctggaaaggtgctccaacaactccactgatcactattgcaatgacaaaaatagtggctagtgtattggagaagaacaacttgccaggcgcaatttttacatctttttgtgggggcactgaaattggtcaagcaattgcccttgacattaggatacctttggtttcattcactggaagtacaagggctggtc

SEQ ID NO: 29372 - DNA, 326 bp, Zea mays
  Clone ID: LIB3059-034-Q1-K1-E5
cggacgcgtgggaaaaaaaaaaaaaattaaaaaaaaaaaaaaaaaaaaaaaaaaaaaagaaaaaacaaaaaatttaaaaaataactaactaaaaaaaacatgcatcctccttcttaatttttcttttttccttcctcattcttactacctcttagtttttatataacgttccttactttaaattccctggccttactttactaacttggcttctggtaaatccttctttttcccccttttattctccttgcaacgcatccacctttcttcatttcaattatttgcccagattccttaaccattcgcactttccatcatttgcccaa

SEQ ID NO: 29373 - DNA, 427 bp, Zea mays
  Clone ID: LIB3059-034-Q1-K1-E7
cccacgcgtccgcggacgcgtgggccgctgccgcacaaagacgagaggaagagggtcggggcgcctccaccaccatgtcgtcgatgatgaacgcgctggcgaactggctggcgaacccgcgccgcaacccgctggcgcgcctccacatgcacgccgtctcctcgcgcctcaggaaatacggactgaggtacgacgacctctacgacccctacttcgatctggacatcaaggaggcgctcggtaggctgcctagggaggtggtcgacgcccgcatccagcgcctcaagcgtgccatggacctctccatgaagcaccagtacctcccggaggacctccaggcacagcaggttccattcagaggatatttgggtgacatgttggcgttggtgaaaaaggaaagcgccgagcgtcagtcactgggagccct

SEQ ID NO: 29374 - DNA, 444 bp, Zea mays
  unsure at all n locations
  Clone ID: LIB3059-034-Q1-K1-E8
ctctttgcgcttcttgccctttttgtgagcgcaacaaatgcgttcattattccggagggctcacttgctcctagtgccattattccacagttcctccctccagttacttcaatgggcttcgaacacccagctgtgcaagcctacaggctacaacaagcgcttgcggcgagcgtcttacaacaaccaattgcccaattacaacaacaatccttggcacatctaaccatacaaaccatcgcaacgcaacagcaacaacaatttctaccagcactaagccaactagctgtggtgaaccctgtcgcctacttgcaacagcagttgcttgcatccaacccacttgctctggcaaacatagttgcataccaacaacaacaacaattgcaacagtttctaccagcgctcagtcaactagccatggtgaaccctgccgnctacctacaacag

SEQ ID NO: 29375 - DNA, 414 bp, Zea mays
  Clone ID: LIB3059-034-Q1-K1-E9
caagggtgtcaaccctgatgaggctgttgcctttggtgccgctgtgcagggaagcatgttgagcggcgagggtggtgacgagaccaaagatatcctcctccttgatgtggctcccctcaccctgggtatcgagaccgtcggtggagtcatgaccaagttgatcccgaggaacactgtcatcccgaccaagaagtcgcaggtgttcaccacctaccaggaccagcagaccactgtctccatccaggtctttgagggtgagcgcagtatgaccaaggactgccgtcttctcggcaagttcgacctcaacggcattgcgccagctccaaggggcacaccccagatcgaggtgaccttcgaggtggacgccaacggtatcctaaacgtgaaggcggaggacaagggcacgggcaagtc

SEQ ID NO: 29376 - DNA, 397 bp, Zea mays
  Clone ID: LIB3059-034-Q1-K1-F1
ccgacgcgtacgagagggtgatgaggatattggtaatcgtgaggatcacaagctcgagtaggatggtcaggagcttgaggacaaccagctgatagctgatattagcaggacggatgatgctgagattcatttattcatccgcaaaccagcaaaggtatggacacaacaagttgatggagatactttggttacagttgtcaatccacaggggaaaggcaacctgcaaaatgaagctggctcagtgaactccgcaaactcagttgtggataggcctgtccatgttgaaccaatagttaaccgaaaagccaagctgtcatgtgaagtgatgaatatgataaattcaaccatagctggactggagaaagggcacctgactgtgatgtcagctgaacgttca

SEQ ID NO: 29377 - DNA, 261 bp, Zea mays
  Clone ID: LIB3059-034-Q1-K1-F10
cgcaaccctcttacaactacaacaattgctgccctttgtacaacttgctctgacagacccagcgggctcctaccaacaacacatcattggtggtgccctcttttagatagcttattagctgcaattcaataatcaagttatctggatgatgtatgtggccaaccagaaataagaagctacatttacagattctagaggcaaaactggataaaaacgatagactgctggatttcacacacaaaccttgatctgcatgtgttg

SEQ ID NO: 29378 - DNA, 412 bp, Zea mays
  Clone ID: LIB3059-034-Q1-K1-F11
gctgttcgagaaaatctgctcagcaggtcgattcagtgaagatgagtccaggtatttgttccgacatctgatatcaggggtcagctactgccattctatggaaatttgtcaccgtgatcttaaacttgagaacaccctccttgatgggagtccaacacctcgtgtgaaaatttgcgactttggttactcaaagtctgctttgctgcattccaaaccacaatcaacagttggaactccagcatacatagcccccgaggttctttccagaaaagagtatgatggaaaggtagcagacgtctggtcctgtggtgtcacgctgtacgtgatgctcgtgggatcatatccatttgaagatcctgaggatccaaggaacttccggaaaacgatcagcagaattcttggcgtgcaatac

SEQ ID NO: 29379 - DNA, 410 bp, Zea mays
  Clone ID: LIB3059-034-Q1-K1-F12
ggcgtcggcggatagcgctactgctagtaggagaggaagcggaaagggcggcggcggggcttgtggtcagtcaaagatccaacctccggactcgcgatggggcggcggatcctcaacgatgctctgcgcacgatggtcaacgcagaccggcggcggaacgcgtcggcgcttctccgacccatctccggcgtcatggtctccttcctcaacatcatgaagtaccgagggtatatcaaaaaatttgaggtcattgatgagaatagagctgggaaaattagagtggagcttgatggacgtcttaaagattgcaaagctctcacctacaggcaagacctcaaagctaatgagatagaacgatacagagttaggatgctcccaacacgccagtggggctatgttgtgattactac

SEQ ID NO: 29380 - DNA, 446 bp, Zea mays
  Clone ID: LIB3059-034-Q1-K1-F2
gcgctccgcaggcagcatcaagcatggcggacacgaaggcgtcacccgcggtgacgctgcggacgcccaaggtcatgaccaaccggcttctttcccgcaagcagttcgtgctcgaaggtctccaaccgggccgggccaacgtctctaaagcggagctcaaggagaggctggctaagatgtacgaagtgaaagatcccaactgcatcttcgtcttcaagttccgcacccacttcggaggcggcaagtctaccggattcggtctcatctacgacaacgtcgactcagccaagaagttcgagcccaagtacaggcttatcaggaacggtcttgctaccaaggtggagaagtcgcgcaagcagatgaaggagaggaagaacagggcgaagaagatccgcggtgtgaagaagacaaaggctggggacgccaagaagaaatgagccaggttt

SEQ ID NO: 29381 - DNA, 430 bp, Zea mays
  Clone ID: LIB3059-034-Q1-K1-F3
ccagttttccaggccttcgacggttcttccctggccttcgtcgcgttcgccagaaaaggcatggagggggctgatggcaagcaagagtcagaaactacatgtataatcaaagttcctaaagagcctgccatcattatcaatggcgttccagattttccttttgattgcacaactggttctcaatctgcagtaaaaaatgacgcagaatctcatgttgatcctcgttttggtgaatggttagaagggaggaaagtgcgtaagctttttggagacacatatttcgtcgggaaagtggccaagtatgacattgaaagcaactggtacaccgtcatttatgatgatggagaccaggaagatcttgaatggcgtgaacttgagaaagttctactgccattggacataactgttccacttaaaaacactgttatcg

SEQ ID NO: 29382 - DNA, 438 bp, Zea mays
  Clone ID: LIB3059-034-Q1-K1-F4
cctccagcctcttgagcctcctcaaacactcacatttcaaccggtcatcttcttggaggtggttaacaagatggtgcgtcgtcgcaacccttcggtggtggagttcaacagtgactccgacgaaatccaagaggaatcgcgtgttccttctcctccgcctcggcgttctctctccaagtgaggacgaggctctggccgtttggaaaggggaggaccctcgatgcccttgcaacctgggcgccaagggcgtcaaaaggttggcgccactcgtccccgtcgaagcaccttcttcgctgtatacgctccttgccaggaggaggatggagcttttgacgacgaggtcgaaccttcgtcatccgacactcccctcgtcatcggactccacatgcatccggcgactgtgtcccatgggccgaatgaaccttcagtcgacttctc

SEQ ID NO: 29383 - DNA, 449 bp, Zea mays
  Clone ID: LIB3059-034-Q1-K1-F5
ctgacactgctttactatcaagagttattagtacacataccagcagctgatgctgtggtgatcatcataaacatcttcaggatcctcatctacaacaacatcattcaccaaggcacacatcatacaacacagacacacacatcatcactatcagcagtgacacaaacaactacatgttaccatgcgatcacaaaaacattaacaacaacatgaagtacatgtacagacaacaacaacaatgactgtagcatcagcagaacatacaacaacggcaccagctacaacatcatgaatgtgaaagtcatcaactcatgaccatcaatctacaggccatgtgcaacaatacgaacagagccatgtacatcactaagacagagccatgagcaactacatcgacaacaatatcagcgtcatgacaagcacgaacatccacgacatgcttatgaata

SEQ ID NO: 29384 - DNA, 433 bp, Zea mays
  Clone ID: LIB3059-034-Q1-K1-D1
aaggaagatgatgacctgaagcacttttacgagaaataaagctgccacgtgacatgggggacatagagaaggagctacagaaaaacggtttcaagcccatgacaaatactgccaaacgactagcagctgcccagatcaatggcgtaaaacccaaggctaagcccaagaagaagcagcgtgagatcacaaaacggaccaagctcacgaatgcccatctgcctgagctgttccagaatcttaacacttaaacgtgctacagtatctgacgacggaagatggttcattatactcctatttattgctacgttgcgtgtatgtgttatgcagctatgctgtatggcttatggttatgagcgccacaaatttgcttgacaagattctggatgatatacttatgcattctgacataataggaagcaaaacctcaagattt

SEQ ID NO: 29385 - DNA, 298 bp, Zea mays
  Clone ID: LIB3059-034-Q1-K1-D10
cagaatcatttattcaaatcctactttattgtatggaactactataattggaaccaaggtctaagaatgaaaagttaaagtctctgatccatgaaccgttgcagtggaaatgtggtcgtggacagtataaagtacacagatgtggtccacataccctgagatactgatgataagacagtgcccaaggatagtgtgactccaacgtttgctgctgaggagcttttcataaataatgccagatgggatggagttgcctatcttatgaaagctgggaaagctttgcacacaaaacgagctg

SEQ ID NO: 29386 - DNA, 328 bp, Zea mays
  Clone ID: LIB3059-034-Q1-K1-D12
atgtttgtagccgccctggccctggtggtggtgatggcgacgacgagcacaggcggtggcagggcggcagcggcgtgcgatcccaagccgctggtggtgtgcgatccggcgttcatggacggagcgaaacccgcggcagcatgctgctgcaccctgcgtgcgcatgacgcatgcttgtgcgtgtacgccaaagaccccaagtttgcaaaatacatcatcaaccccaacaccgacaaaacctttacctcgtgcggcatagccatccgcaaatgctaagcaagcgctctgcgtcgtcgcttcgcttgctcttgctcttgtgtgtaacata

SEQ ID NO: 29387 - DNA, 168 bp, Zea mays
  Clone ID: LIB3059-034-Q1-K1-D2
gttcttgtgatataattaacgattcctgttatacttggaaataactaagctcgtcccgatgcaatgcaagcaaagatctgatcaaaaaaaaaaaaaaaaaaaaaaaaaaaaaaaaaaaaaaaaaaaaaaaaaaaaaaaaaaaaaagaggaaccaaaaacaataataac

SEQ ID NO: 29388 - DNA, 438 bp, Zea mays
  Clone ID: LIB3059-034-Q1-K1-D3
cccacgcgtccgcccacgcgtccgcctacgcgtacggaaaggggagagagagagagagacgagagagagaagagagagagagagagaggagtgcgagacccgcgagaggctgccgtgtaaggaccgtagactcagcgactgcgaaggatggataaggggatggccgggatcggaccgatcaggcaggactgggagccggtcgttgtgcggaagaaggcacccaccggcgtcgccaagaaggatgagaaggccgtcaacgccgcgcgccgcgccggtgctgagatcgataccatgaagaagtacaacgctggtacgaacaaggcggcatccagcggtacatccctcaacaccaagcgcctcgacgacgacaccgaatacctcgcccatgagcgagttccaagtgatctgaagaagaatctcatgcatgcaaggctcgat

SEQ ID NO: 29389 - DNA, 436 bp, Zea mays
  unsure at all n locations
  Clone ID: LIB3059-034-Q1-K1-D4
gcaatatctgaaggaaagtgcgtgagctaactggagatgttctggtcccagttcaggacgtgcattcacagaaacctatgaagggagagggcatgggtgggcacgtggacaggatcctcaagcatggcgtgttcctcaaatccggacccgtggagagcatcttcctggctgagaagtcgatgagtaattacaagtacataagtggggagaatgcgatgttcatgaacgaccactcgaagctggagaaagacaccgncgtgcgcttcaaggtcctagggttccgctggatggaggctgaccgccaattccagctccttgctacgatcgctggtgacttccttgggccgctgtgaactgcttccacaggtcaaacaggttctaatgtacattgctcgttagatggtggatggatggttggatctgatgtgtagaatta

SEQ ID NO: 29390 - DNA, 430 bp, Zea mays
  Clone ID: LIB3059-034-Q1-K1-D6
gggctcgcagggtcctgcccaagcccagaacctgagagattcactggctgaagccaagtcagatattgttgtgaagattggtctccggaaaggatccaaatcttttgaggaagcacgtgccgctggattcaccgaagagagcggaaccttgggcgatatttgggaaaccgtctccggcagcgatcttgtgttgctgctgatatccgatgctgcacaggctgacaactatgagaagatcttctctcacatgaaaccaaacagtatccttggtttatctcatggatttcttctgggacatttgcaatcactcggactcgatttcccaaagaacatcagtgtgattgctgtatgccccaaaggaatgggtccatccgtccgcaggctttatgttcagggcatggaagtcaatggcgctggcatcaactctagc

SEQ ID NO: 29391 - DNA, 419 bp, Zea mays
  Clone ID: LIB3059-034-Q1-K1-D7
cccacgcgtccggaccatacatctcacttcgccaaaaaaatttcgtcaacagttgaagttatacccatggcaaaactactcttgggtttgctccttgcccttgctattctagggacaacatcggctgctggttgtgtacaagacgcggaagacatgaaacgagagtgcaagcagtttgagctattcccagcgaacccaaagttgccaccgtcggcagcatgttgtgctgtgtggaagagggcagatgttccatgcctatgcaaatatgttaacaaggaagtagagaaggtatggtgcatggagaaggttgtgtacgtcgccaactattgtaagaagccgtttcaacctggctacaagtgcgggagttatacagttcctcttagtatgtaaaaggaagtggttgggacatgtggtactct

SEQ ID NO: 29392 - DNA, 428 bp, Zea mays
  Clone ID: LIB3059-034-Q1-K1-D8
cccacgcgtccgcccacgcgtccgtttgagcattcagaaacacaccaagcgaagctagctagcaacgacttaacaacaatggctaccaagatattagccctccttgcgcttcttgccctttttgtgagcgcaacaaatgcgttcattattccacaatgctcacttgctcctagtgccattataccacagttcctccgaccagttacttcaatgggcttcgaacacctagctgtgcaagcctacaggctacaacaagcgcttgcggcgagcgtcttacaacaaccaattaaccaattgcaacaacaatccttggcacatctaaccatacaaaccatcgcaacacaacagcaacaacagttcctaccagcactgagccaactagatgtggtgaaccctgtcgcctacttgcaacagcaggtgcttgcatc

SEQ ID NO: 29393 - DNA, 399 bp, Zea mays
  Clone ID: LIB3059-034-Q1-K1-D9
gtgtacactgaaccctgctgcttatttgcagcatcaacaactactaccattcagccaggtagctactgcctactctcagcagcaacaatttcttccatttaaccaattcgccgcactgaacccctctgcttatttccagcagcaaatactactaccatttggccagctagctacaacaagccccgcttccttcttgacacaacaacaattgcttccgttctaccagcagtttgtggctaaccccgcaacccttttacaactgcaacagttgctgccctttgtccaacttgctttgacaaacccagcagccttctaccaacaacacatcattggcggtgccctcttttagattgcttattagttgtcattcaataatgaagttttttggctgatgtatgt

SEQ ID NO: 29394 - DNA, 401 bp, Zea mays
  Clone ID: LIB3059-034-Q1-K1-E11
gggaaatcgctgctgtgtcgctgtctgttacagtgcattactgaattgactatgtggaactggactttcacaaggaggtgatagaaatgtccagaccgagtcacgaaaatgtcccaaagatggtgagatactgcatggagtctgacccatcctcgagaatgctagtctttcagtacccaccaaaagggacactgtacgagcatctgcacgatggagatagctggcagctatcttggcctacactgatgaaatcagcactcgacatatacagggctatcagatacttgcacactgagctgcaacctccgtctgcagatgctgcactgacgtctagttcagtgtacctaactgaagacttctactcaaagataatcgattgcgacaggaggagatatattgcg

SEQ ID NO: 29395 - DNA, 415 bp, Zea mays
  Clone ID: LIB3059-034-Q1-K1-E12
cccacgcgtccgcccacgcgtccgcccacgcgtccgatggcccaagtatactcaacgatattgggttactcttttttccttaaaaattgtgttccctgtttctcagttatcatgaaaatagagtattatttcattccatagtgccggcttttcgcaacgtcattgatgtgcctcttgtggttagaggattacgcaaatctagatctgaggtgaggaaggaactaggaattgaggagaatgctaaggtgctcgtttttaattttgggggtcagccagcaggatggaaactgaagcaagaatgtctccctgatggttggatttgtttggtctgtggtgcctctgattctcaagatgttccaccgaacttcattaagcttgcgaaagatgcttacacacctgatgttatggcagcatc

SEQ ID NO: 29396 - DNA, 437 bp, Zea mays
  Clone ID: LIB3059-034-Q1-K1-C8
cagagggctactctttgtggttctgtgactacaagtacaatgatgagaacaccgtctcctttgtgaccctgaacaaggttggtggattcctgcagcggatggacctgtgccgcaagtacgcctttgggaagatgctcgtgataggctctgagccacccttcaagctgaagggcctttggctcttccgtggccaggatgttcccaagtttgtaatggacgaggtctatgacatggagctctacgagtggaccaaggtggacatctctgatgaggcccagaaggagcgtgtcaatgcgatgattgaggaccaggagccctttgagggcgaggccttgcttgacgcgaaatgcttcaagtgagtgtgcttgcctggagacagaactgtttagcccttgaaattgcctatggaagagtttgcccttttactagtgtcgatg

SEQ ID NO: 29397 - DNA, 436 bp, Zea mays
  Clone ID: LIB3059-058-Q1-K1-C8
cccacgcgtccgtgaggatgatggacgtgcagtccgtcgcgcagcagctgcggatgaggatgcagcttgagcgtgccgctgccgccagcagcagcctgtacgagccagctctgatgcagcagcagcagcagctgctggcagcccagggtctcaaccccatggccatgatgatggcgcagaacatgccggccatgggtggactctaccagtaccagctgcccagctaccgcaccaacccctgtggcgtctccgctgccattccgccctactactgattcatgatatttgggaaatctcctctatccatctctctctatctatatatgtaataatgcagtaagacgacacacattatcatgtgtggtatgaccaataatatatgcatggtcataataaagttttggttttaatgaatcaaaagctaacaaacccaacc

SEQ ID NO: 29398 - DNA, 387 bp, Zea mays
  Clone ID: LIB3059-058-Q1-K1-C9
cccacgcgtccgcccacgcgtccgtgttttttttttttttttgttccaagtaccagttgtttttggcactgagaattacagcttccaagtgacacaatacagcagcattcagcaccacacgcggcactgtactgcaaacccaattcggttcatcattatacaggaaggatagaacgaatacatggaggcacgtccaggtcccggcaacacaacgcagcagcgaccccaaaggccaggtagagaaaatactacatggcatacctctgggtccaggtcctcgcggtgttctcgtacttgtgccggtccgtcttgtacatgtgagctatctcggggaccaaagggtcgtcggggttcggatcagtcagcaaggaacagatggacagcagc

SEQ ID NO: 29399 - DNA, 360 bp, Zea mays
  Clone ID: LIB3059-058-Q1-K1-D10
aactacctcatgtctcactagaactagtgacaatttaaccttataatactaaacctatacctacttctctaattactatccaacaacatcttttcaaacatcctcaaaatctcaacactaaacctaaaatccaatataactctaaccactatcatcaccccataacaattcttcctcaatctcactgtccttccatttcaaactctcaactaaactccaacttcctttttaaccacgatcacctttacattccacaactacctcaacttctaatcgaaaaacatttccctaaaattaaaccaaaaattcctcttctaacccaatccttaaacctttttttactatctataaatttcacat

SEQ ID NO: 29400 - DNA, 434 bp, Zea mays
  Clone ID: LIB3059-058-Q1-K1-D12
cccacgcgtccgcccacgcgtccggaaatccatctagaggccgtcgacaggggaattagagggcggcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgcctagaggacctgccgggctgcccgcgggaggtgcagaggggattcgccgccacc

SEQ ID NO: 29401 - DNA, 355 bp, Zea mays
  unsure at all n locations
  Clone ID: LIB3059-058-Q1-K1-D3
aggacgcgtgggccttgcctcccgtactgtccgactaacacaagaactcgacaagctgggctgtgtccgatgggctttcctggatggacccaacttcggggcttctttaaccacaggaaggggaccttcatctaattcttcatggagcgcctttcctttctcctcttcaaagccgccgtcgtcgcaaccggcgncggcggcgtcggcttctaatcaaccaagtctccgtccatcacaccgtgcactttgtactgctagctagtactatataacatttgtaatgtccagaagcttaaatcctgtacgggcagcaacctgggtaaatacatcggcccatgctttcgctcggtcctcg

SEQ ID NO: 29402 - DNA, 426 bp, Zea mays
  unsure at all n locations
  Clone ID: LIB3059-058-Q1-K1-D4
aggtaagatgttcctgcggaggatcctgaccggccggggccggctggccgcccttaggggcgccgcgcgcctgaaaggagatgaacgggaatcgtgggccttggaggtgtgccttaacgcgcgagaggntctggtagggctctacgagcgcacgctcaaagagatcaaggccgtncncgaagacgagggttaccgcaaggccgttgaatccttcaccggtcaccgnctccagatctgccaagaggaggaagactggaagcgcatcgaggaccgaatcggatgcgggcaggtcgaggagctcatcgaagaggccgaggacgagctcaagctcatcgctaaaatgattgaatgggatccatggngtgttcccgatgactacgaatggtaagtgattgaagacgacaccccaattcctaagcatgttcc

SEQ ID NO: 29403 - DNA, 437 bp, Zea mays
  Clone ID: LIB3059-058-Q1-K1-D5
caacaagcaacatagaaagtggaatccagtagcaacaatagagcaacaatggcgaccaggatattttccctccttatgctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgtttcaacaatcgccagccctatctttggtgcagtcattggtacaaaccatcagggcacaacagctgcagcaactcgtgctacctctgatcaaccaagtagctctggcaaacctttctccctactctcagcaacaacaatttcttccattcaaccaactgtctacactgaa

SEQ ID NO: 29404 - DNA, 422 bp, Zea mays
  Clone ID: LIB3059-058-Q1-K1-D6
cccacgcgtccgcccacgcgtccgggacaccagcaggcagtccaagcagctggaggatctcaccgccaagatgagagagtgcaagcgggcttagcaagaaagagctccaggaccttctgcaagagggcgccaagatgctggttcgtgctgcaagtgctagaggaaattggatcctcgggtcgggcgatgagatggaagggatgctgcagccacacgggcgttgagtcatgacgtgactgctcgcctggtgttagctttgtcaggaactcgctctattttgctgctgtctgttatgtcgtatggtctggtacttgtgtgatgtaaaactctaaactcgtcggttggcatgttgcctggtaggggacccggctgttctgagtcatccgaagcggattggctcgtcagcgcttctgtttgcgggt

SEQ ID NO: 29405 - DNA, 334 bp, Zea mays
  Clone ID: LIB3059-058-Q1-K1-D7
cccacgcgtccgcccacgcgtccggggttccatcagccgacacaagcacggggacgatgttaccgtcaacatgagagagtgcaagctgtcttatcatgaaagagctacaggaccttctgcaataggtcgccaagatgctggatcgtgctgcaagtgctagaagaaattggatcctcgatttaggcgatgagatagaaggcatgctgcatccacactagcgttgagtcatgacgtgactgctcgcctggtgttagctttgtcaggaactagctctattttgctgctgtatgttatgtccgatggtttggtacttgtgtgatgtaaaactctaaac

SEQ ID NO: 29406 - DNA, 441 bp, Zea mays
  unsure at all n locations
  Clone ID: LIB3059-058-Q1-K1-D8
ccaagaacctcaagcttggcatccacgaggactccacgaacaggaccaagattgctgagctcctgaggtaccactcgaccaagagcggggatgagctgaccagcctcaaggattatgtgaccaggatgaaggagggccagaacgacatcttctacatcactggtgagagcaagaaggctgtggagaactccccgttccttgagaagctgaagaagaggggctatgaggtgctgttcatggtggatgccattgacgagtattctattggacagctgaaggagtttgagggcaagaagctcgtctctgccaccaaggagggcctgaagctggacgagagtgaggatgagaagaagcgcaaggaggagctcaaggagaagtttgagggcctctgcaaggtcatcaaggaggtgctgggcgacaaggtgganaaggtggtggtct

SEQ ID NO: 29407 - DNA, 433 bp, Zea mays
  unsure at all n locations
  Clone ID: LIB3059-058-Q1-K1-D9
cccacgcgtccgcccacgcgtccgcccacgcgtcctgccatctcccaatggatcccggggcgtctgccccagcagctctgatgtggaactacgatgaggtgatggctattgttcaccagtacaactgtgtcaaggcctgctttgccggtcatgaccacaagggtggccactctgtggactcacacggtgtgcaccaccgcacccttgaggctgccttggagtgtcctcctggtaccagcgcttttggtcacgtcgaagtgtatcctaacaggctgctgcttgtaggttttgacagaatggctgatacagaggtccgtttttgagccattaaacggctttaattcgtgccgacttctactacttctataatgttnttgtctatatagattacagctgcagcagtccaaacgctggctttaatccgatgcttaca

SEQ ID NO: 29408 - DNA, 413 bp, Zea mays
  Clone ID: LIB3059-058-Q1-K1-E10
atcgggcggtgggcgtaataggcgcggtgcagatggctcgggcatcgccactcggcgcggcggagctgtgccgtcttctcctcgacgccgaccccactgccctctcccgtgccgtcatctccatctccgcctccctacggcgcctcgccgccaagggccagctctcccaggccgcgtgcgaggactcaataaagcggataaggtgcgtctccgccgtgcaggatctcagggacgcggatcttgtgatcgaggccgtcgtggagaacgaagctgtcaagaagaagctattcgtggagctggataaggtcacgaagccctcggccatcctcgcctccaacacgagctccatctccataacccgcctggcttcagctaccaaacgcccctctcaggtgataggcatgcacttcttc

SEQ ID NO: 29409 - DNA, 424 bp, Zea mays
  Clone ID: LIB3059-058-Q1-K1-E11
cccacgcgtccgaccacaccaccggcggcggcggcgacccagtcgagaacacgaaggcgatggcgacagcgctgaaccgcgggctccgcctcctcgccgccggcgccgaggcgtccaagccagcttctcgtggattccatgccaccggcgtgaagagaatgggagggcatggccatgatgagccatactacatccatgccaagcacatgtataacttgcacaggatgaagcatcagggtttgaaggtgacactctccgtgctgggagcggttggcatcggtgttggagtccctgtgtatgcagtcatattccagcagaagaagactgcctctggctgagatgatgcctctcgctgcctgcatatggagacttattttgagcgacatttttttgaagttaaaagcttggacttcatcctatcttg

SEQ ID NO: 29410 - DNA, 422 bp, Zea mays
  unsure at all n locations
  Clone ID: LIB3059-058-Q1-K1-C6
gctctgggccaccaacgaggttcgcgccaagtccaagttctggtacttcctgagaaagcgtcaagaaggtgaagaagagcaatggccagatgcttgccatcaacgagatctttgagcgcaacccgaccaccatcaagaactatggcatctggctgcgctaccagagcaggactggttaccacaacatgtacaaggagtaccgcgacaccaccctgaacggcgcagtggagcagatgtacaacgagatggcctcccgccaccgcgtgaggtccccctgcatacagatcatcaagacagcgacggtccacttcaagctgtgcaagagggacaacaccaagcagttccacaactccgagatcaagttcccgcttgtgtaccgcaaggtcaggccgnctaccaggaagctccggaccactttcaag

SEQ ID NO: 29411 - DNA, 237 bp, Zea mays
  Clone ID: LIB3059-058-Q1-K1-B12
cgaatttgttaagggcttcatgttgagacgatgaataccgactgtcgccgctactctgagctccgttgtatctcctctgttggctgattaactgttattacaagaaattgctggacttgttttttccagttgttttgaatcatgtattatggttgcatgggcaccatttcttcgtgggatgtgaattgaaacagtccaaatcaattggtgtggcagatatctggtttgcccttctac

SEQ ID NO: 29412 - DNA, 316 bp, Zea mays
  Clone ID: LIB3059-058-Q1-K1-B2
attatgcccaagtgcttatgctgccgatgatagagctctagcgcatgtaccatttctggcatattttgcttattcgctaattgctgaatacttgacttattctcgggaatggtctatatgcagtccatgggacgatgcaagcgatgtcagatgatcaacctatatcagagctcatgtcatgtgatcaagtcaaaggaaccgttggcaactttagcatcgtatagacgaagacatggaaagattttgtttggcgttctgttgaactatgaatatgacatggacggagaagatgatgccattgtccatagatggctca

SEQ ID NO: 29413 - DNA, 315 bp, Zea mays
  Clone ID: LIB3059-058-Q1-K1-B4
gatagcactgcgtcacagcgctggtctttataaccttgcgagtacatgctatatgaatgcgacattgccgtgtctgcattctgatccagagctgaagtcagcgctgctaagctatctacatactgcaagaggtaatggcattgaccaagcttgtcataatatgactgctgctactggcaataactctgatgatcttcatcaacgtgttcacgctgacgcacctctacaagtgctgctgacactgcgtatactatacctgaaagttgcacagcagattcttaatgtctacatgcaccaggatgcagactaatgctg

SEQ ID NO: 29414 - DNA, 425 bp, Zea mays
  Clone ID: LIB3059-058-Q1-K1-B5
gagaataaatttttttccatcggaatgtctgaaactatgttgggtgtatcctagtggggggttgagcattaatggctcatattttgtcaggtctatgtgtcgccgtgaaacttttaatcaaatcagttcactcttttgcctctaaaaaaaaactaaaagaacaaaaagacctaaaaaaaaaaaaaaaaaaaaaaatgcaaagcaagtactgctggtgaagacatgtttcattggcaagcaacaattatgggaccacctgacagtccttatgctggtggtgttatcttagtgaacatgccattgccgacagattacctgttcaaacctccaaaggtttctttgaagacaaaggtcttccatcctaatatcaacagcaatggaagtatatgccttgacattcctgaagagcattggagccctgcttt

SEQ ID NO: 29415 - DNA, 411 bp, Zea mays
  Clone ID: LIB3059-058-Q1-K1-B6
cccaactcctgaccttactggatacattactgagggacagatatacattgataggcaggtccataacagacagatttatccacctattaatgtcctgccatctctttcacgattgatgaagagtgctattggtgagggcatgacacgtcgagaccattcggatgtatctaatcagctttatgccaactatgctattggaaaggatgttcaggccatgaaggctgtcgttggagaggaggcactctcgtctgaggatctgctttacttagagttccttgacaagtttgagaggaagtttgtgacacaaggagcatatgacacacggaacatcttccagtcactcgatcttgcatggacattgcttcggatcttccctggcgaacttctccaccgtattccagcaaagacctt

SEQ ID NO: 29416 - DNA, 437 bp, Zea mays
  Clone ID: LIB3059-058-Q1-K1-B7
cttgcatttaaccaattgggcgtactgaaccccgctgcttatttgcagcagcaaataggactaccatttagccagctagctgcagcaaaccgtgctgccttcttgacacagcaacaggtgctgcctttctaccaacagtttgcggctaacccagcatccctctgacaactacaacaattgttgcccttaggccaacttgctttgacagacccagcggactgctaccaacaacacatcattggtggtgccctgtgttagagtgctaattagatgtaattgacatagtaaagtaggatggatgatgcatgtggacaaccagaaatacgaagttacattcacagaatctaacatgcatggacattgcttcggatcttccctcgcgaacttctccaccgtattccagcaaagaccttggaccagtactatagcagagatgc

SEQ ID NO: 29417 - DNA, 427 bp, Zea mays
  Clone ID: LIB3059-058-Q1-K1-B9
gcaacatagaaagtggaatccagtagcatcaatagagcaacaatggcgaccaagatatgttccctgcttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacattga

SEQ ID NO: 29418 - DNA, 385 bp, Zea mays
  Clone ID: LIB3059-058-Q1-K1-C10
ggcacgcgtggtggaaccctaagtggtggacctcatggacgtacttaaggattcggcgggacttgcggatacgggtcttgattcatgtgaggaatgaggcgtgcagtttcactttcactttaactctgataatgaccatgcataagcgcattcgtgacttaatgacaaactaagtgtcaaaggacgagtctttcaaattatcgtgcgcactacataatacacttcatgccatatgttgatctcctatttgctatactaattatgatactgaatatgctttagaaaaaacataaaaaaatacaaacaataaaaacatatcaaaaacaacaattcacaccaaggctgaaccaaactagatcgagtaaccctgaagggttgtagcttc

SEQ ID NO: 29419 - DNA, 434 bp, Zea mays
  unsure at all n locations
  Clone ID: LIB3059-058-Q1-K1-C11
cccacgcgtccggaaaacagaagttccagggattcacggtggatgaagccctgatggagattgctggcccacaggcctaccttatgcactgtttgcccgcagagagaggagtggaggtgaccgacggtgccatcgaggctccaaattcaatcgtgttcccccaggctgagaacagaatgcacgctcagaacgccatcatgcttcacgttctcggtgcttaaccctcctattgcacaccagtgtttaacttttcttgaatttgcttagggattgaggcagttttggctttagggcatatgtgagagcttaattcagcgaactgttcagtaacgtggtaactgttcttcagggtgggagtttgttgtactggaaaagtttggcaacctgaataaaaaataatcttttgtgctggttttactgagcagcanggaaaa

SEQ ID NO: 29420 - DNA, 430 bp, Zea mays
  Clone ID: LIB3059-058-Q1-K1-C12
cctggatttttcttctgcttgtggtatgcgtcaaagaagcattggcttgcaaataatggtctgggattggctttctgtattcaggggattgagatgctgtcattgggatcatttaaaaccggagccattctcttgggtggactttttgtgtatgacattttctgggtgttcttcactccagttatggtcagtgtggctaaatcttttgatgctccgataaagcttctgtttcctactgcggatgatgcaaggccattctccatgcttggccttggtgacattgtaatacctggcatttttgttgcacttgccttgcgctttgatgtctcaagaggcatcaagaagcgttacttcaacagcgcattttcgggatacgccgtgggtatggcggtgaccatcattgtaatgaactggtttcaagctgcacagc

SEQ ID NO: 29421 - DNA, 439 bp, Zea mays
  unsure at all n locations
  Clone ID: LIB3059-058-Q1-K1-C2
accatctgtcgactggtagcagagagaagagatagaccgagagagggagggagagagagaacctgagactgagactgaagcatccgcgctagctagcttgggcagcaacatcacgatgtcgtccaactgcggcgaggatgagaaggagctggtgtgcgtgaccggcgccggcggcttcatcggctcgtgggtggtgaatgagctgctccagcggggttaccgcgtcaggggaaccgcgagggaccctgcggacagcaagaacgcgcacctgctggctctggagggagccaaggagcgcctcaccctgtgccgggccgacgtactagaccgcgcctacctgcgcgccgnctttgccggctgacacggcgtcttccacgtcgccatcccggtgtccaacgacccggagcttgtccggtggcggtggagggcacccagaacg

SEQ ID NO: 29422 - DNA, 408 bp, Zea mays
  Clone ID: LIB3059-058-Q1-K1-C4
gtcaaatatgtgcttgttgtctttggaggacttgttggataccctagcgatgatatcaataagttgctttggatggtacgaataggaggtggtgtgttccctcacattaaggagccagattatcttagggacggtcaatatcgcgttgatgctcaagctactccaactatgctgaattgcctcatgtacaagctttgttactacaggtttgtggagactgatggaaaaggctttgacagagtaagaggatatgaaataggaaagaagcatttcaagctaacacattttgaggaggtatttacaacccaccattggatggtccgcatatataaactgaaaccccagaagaacagggttcgaggcaagctggaagaagttgaaggccagtgcccaaaactagttccacac

SEQ ID NO: 29423 - DNA, 436 bp, Zea mays
  unsure at all n locations
  Clone ID: LIB3059-058-Q1-K1-C5
cacgcgtccgccggactttccttctgcttgtggggttcgtcaaaaaagcattggcttgcgtataaggggactctattggatgtctgtatccaaggcactgagatgctgtcattagaatcatttaaaacaccaaccattctattgagtcgactttttgtgtatgacattttctgcttgtacttcactccacttatagacagtgtggctaaatcatttgatgctccgataaagcttctgtttcctactgcngatgatgcaaggccattctccatgcttgaccttggtgacattggaatacctgacattttagttgcacttgccttgaactgtgatgtctcaagaggcattaacatacgttacttcaacaacgcattttccgaatacgccgaagctatggcggagaccatcattgtaatgaactggtttcaaagctcac

SEQ ID NO: 29424 - DNA, 381 bp, Zea mays
  Clone ID: LIB3059-058-Q1-K1-B1
attatgcccaagtgctaattttgccaataataaaaccctaaaacaaataccatttctggcatattttgcttatttgctaattgctgaatacttgtcttattttcgggaatggtctatatgcagtccatgggaggatgcaaccgttgtcagatgatcaacctatatcagagctcagggcaggtgatcaagtcaaaggaaccgctggcaactttagcatcgtatagacgaaaacatggaaagattttgtttggcgtcctgttgaactatgaagatgacatggaaggagaagatgatgccattgtagagagatggctcaaagtggggcaagaggtgtacccttcaacataataatgacttccatacctgtgtaccaaaccaaat

SEQ ID NO: 29425 - DNA, 410 bp, Zea mays
  Clone ID: LIB3059-057-Q1-K1-H2
cagcaagcaacatagaaagtggaatccagtagcaacaacagagcaacaatggcgaccgagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcaaggcacagcagctgcagcaactcgtgctacctgtgatcaaccaagtagctctggcaaacctttctccctactctcagcaacaacaatttct

SEQ ID NO: 29426 - DNA, 367 bp, Zea mays
  Clone ID: LIB3059-057-Q1-K1-H5
gcaaagcggcagtgcgtagagaggatcgtcgaacagaacagcatgaagatggtcatcggtctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagacgagcgccatgtaccagccgctccggcaacagtgctgccagcagcagatgaggatgatggacgtgcagtccgtcgcgcagcagctgcagatgatgatgc

SEQ ID NO: 29427 - DNA, 437 bp, Zea mays
  Clone ID: LIB3059-057-Q1-K1-H6
gccccaaaaacaacacacttgtgataactacatctaaaaatgaggtgtatgtatttgatgtggaagcaaaacaattaggcgaatggtccaagcgatatacacaccagttgcccagaagtttccaggaattccctggagaggtcattggcttatcatttcctccgcaaagctcatcgtcagttgttgtatacagtaccagggctatgtgcaacatcgatttcggattgccagtcgttgaggatgttggcttgccaaatggatcaggtggaccagcagagaaggcagacgcataaaagagtaaaaaaacaaggcagaagcgtaaggcccgtgatgaagagtctacagaggagaaaaggaacaacttcaacttctttgcgtttaaagaaccagtgctctttggtgggcatctacaggacagttcaattttaatggtagag

SEQ ID NO: 29428 - DNA, 367 bp, Zea mays
  Clone ID: LIB3059-057-Q1-K1-H7
cggacgcgtgggaacaaatgcgttcattattccacaatgctcacttgctcctagtgccattataccacagttcctccgaccagttacttcaatgggcttcgaacacctagctgtgcaagcctacaggctacaacaagcgcttgcggcgagcgtcttacaacaaccaattaaccaattgcaacaacaatccttggcacatctaaccatacaaaccatcgcaacacatcagctacaacagttcctaccagcactgagccaactagatgtggtgaaccctgtcgtctacttgcaacagcaggtgcttgcatccaacccacttgctctggcagacgtagctgcataccaacgactacaacaattgcaacag

SEQ ID NO: 29429 - DNA, 310 bp, Zea mays
  Clone ID: LIB3059-057-Q1-K1-H8
gcgaaaggcggccttctcaccgtctgactccggttatgcagcggcacgtagtctccgggcggccgtttggcacggacggcttcgactttttttaccgcatggtcttcgaatcccggtaccagaaggtcgccgagggcagatcccgactcgcgcgcctcatcctcgtgcaggcgctgcacctagtggccggaggcttgcttctattgctgtcgatgcacaagggggcggcggtgaacaagttcgccgagctgtgcatggccgccggattcctggctataacggtgggggaattatggcgaatgcggtgcat

SEQ ID NO: 29430 - DNA, 444 bp, Zea mays
  Clone ID: LIB3059-058-Q1-K1-A1
cggacgcgtgggcggacgcgtgggtctgaattgtcaggtccatcagctggccctaagggttcaaagaaggttgcacaacagtctccaagggcccaggttgcaatctttgttgttcttgccatgactttaagaagaaagcctgatgtactggtaaatgttatgccaaagataatgggaaacaataaatatctgggacaggaaaagcttcccatcattgtctgggttattgctcaggcctctcaaggtgacctagtgtctggcatgttttgctgggctcattctctatttcccacattatgtgcgaagtcaagtgggaatccccttgcaagagatttggttttgcagttgcttgaaagaattttgtctgtcaccaaagctcgttctatattattgaatggtgctgttagaaagggagaacgcttagttccccctgtttcatttgac

SEQ ID NO: 29431 - DNA, 411 bp, Zea mays
  Clone ID: LIB3059-058-Q1-K1-A10
gtgatagatcgctatagagcattctagatgacgctcgcttacatgcgacttcatacgaggtctagggtgttatataaagtcaactaactggacttcactgtacaacgttttaaatcgtaataacttggaaatacccaacttaacccaactgaatcacattgcactatatccagctttcgtcatatggaataataccgaacagatcggcattgataacacttgcgcacactgaatcacgattaatacgcactgtgacgcgccccattaagcgccattaatctcgtcgttactcgcagttacacccatactgtatcctacactctacagcccgctactttcggttcctttccttactttctctacacttctggccactttccccgtctatccctaaatagctgtatatcttta

SEQ ID NO: 29432 - DNA, 303 bp, Zea mays
  unsure at all n locations
  Clone ID: LIB3059-058-Q1-K1-A2
agaacacgtatgcggacaaccagaaaactttagtattgaattacaactactaagtaatgggtcatagggcgtagcacaacagtctccaagggcccacgttgcaatcttagtggtccttgccctgactctgagaagaaagcctgatgtactgattaatgttactacctagatactgangtcacagtgattatctgagacaacacaatcttgccatcatcgtctgcgatactgctcaatcctctgacagtgacctaccgtctggcatgctatgatgatctcattctctatttcccacattatgtt

SEQ ID NO: 29433 - DNA, 442 bp, Zea mays
  Clone ID: LIB3059-058-Q1-K1-A5
gcgaagcgcactagcaacgacctaacaacaatggctaccaagatattatcgctctttgcgcttcttgccctttttgtgagcgcaacaaatgcgttcattattccacaatgctcacttgctcctagtgccattattccacagttcctccctccagttacttcaatgggcttcgaacacccagctgtgcaagcctacaggctacaacaagcgcttgcggcgagcgtcttacaacaaccaattgcccaattacaacaacaatccttggcacatctaaccatacaaaccatcgcaacgcaacagcaacaacaatttctaccagcactgagccaactagctgtggtgaaccctgtcgcctacttgcaacagcagttgcttgcatccaacccacttgctctggcaaacatagttgcataccaacaacaacaacaattgcaacagtttc

SEQ ID NO: 29434 - DNA, 440 bp, Zea mays
  Clone ID: LIB3059-058-Q1-K1-A7
cagaaacacacctagcgaagcgcactagcaacgacctaacaacaatggctaccaagatgttatccctctttgcgcttcttgccctttttgtgagcgcaacaaatgcgttcattattccacaatgctcacttgctcctagtgccattattccacagttcctccctccagttacttcaatgggcttcgaacacccagctgtgcaagcctacaggctacaacaagcgcttgcggcgagcgtcttacaacaaccaattgcccaattacaacaacaatccttggcacatctaaccatacaaaccatcgcaacgcaacagcaacaacaatttctaccagcactgagccaactagctgtggtgaaccctgtcgcctacttgcaacagcagttgcttgcatccaacccacttgctctggcaaacatagttgcataccaacaacaacaa

SEQ ID NO: 29435 - DNA, 394 bp, Zea mays
  Clone ID: LIB3059-058-Q1-K1-A8
cattaacatagatgacaagctagagcgatcgccagtgtgctatcgtttactggcagatgggtgagcctctgtgtgctcgtgctcgtgttgggtagcactgcattagagctgttcattgaacatacaacgcgaagttgatggacaagatgtgcttctgcatattgacaacatttttcgttctactgacgtaaactatgaagtgtctgatgttctcggacgtctacaatctgttgcgggataccagtcacaccttgcaactgatcttgtacgactgcaagagtgtattactacaaccatacaaaggatctattacatatgtgcacgacatttactagcctgactatgacttgtcggatcctggtactgttactacttttgccaatattgatgctac

SEQ ID NO: 29436 - DNA, 384 bp, Zea mays
  Clone ID: LIB3059-057-Q1-K1-H11
gcaaagcggcagtgcgtagagaggatcgtcgaacagaacagcatgaagatggtcatcgttctcgtcgagtgcctggctctgtcagctgccagcgcctctgcaatgcagatgccctgcccctgtgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatgttccagccgctccggcaacagtgctgccagcagcagatgaggatgatggacgtgcagtccgtcgcgcagcagctgcagatgatgatgcagcttgagcgtgccgct

SEQ ID NO: 29437 - DNA, 433 bp, Zea mays
  Clone ID: LIB3059-034-Q1-K1-B2
acgatccactcgagcaccaagccgagggaaggtgaggagcgatggcgcgcggcgtggggtcggcgaagggcggcgcggtcgcgggcaagaagaaggggtcggtttccttcacgatcgactgcaccaagccagtggaggacaagatcatggaggtcgcctcgctcgagaagttcctgcaggagcgcatcaaggtcgccggcggcaaggctggcaacctcggcgactccgtcaccatctctcgcgagaagaccaaggtcaccgtcacctctgacggacccttctccaagaggtacctgaagtacttgaccaagaagtacttgaagaagcacaacgtgcgggattggctacgcgtggttgctgccaacaaggaccgaaacgtctatgagctccgctacttcaacattgctgagaacgagggcgaggaagaagatta

SEQ ID NO: 29438 - DNA, 400 bp, Zea mays
  Clone ID: LIB3059-034-Q1-K1-B3
cggacgcgtgggttcttttttcctatttatttttatgagcgatttttctctttttggggtgttttaatttctttttttttgcccccaaaacaaaatcaattgtttcaattatatcgactctaccaaaacatttgccttcacgatataaaaataactaaattgtatttcctaataacccattaagtcttctaaaaacttgatgggaacacatctgagactccggccaccattttatggaaagagaccgctaaaaccatttcttataacaacccattgtgcaaaacgtcccttaaaaacttgaccaagaactacttgtttaaacgcaccaagcttaattacctactcatgcgaactgacaacttttacataggcgtccataaactcaattacttggacattg

SEQ ID NO: 29439 - DNA, 436 bp, Zea mays
  Clone ID: LIB3059-034-Q1-K1-B4
gccagaagttcccaatcatgccttttactgctagggcattagaagagaagcgtgcgcgtttaagcttggtggaatgcatgaaccatgaactattgcagccgtaccctgtacttcatgagaagccaggcgatcttgttgcacacataaagttcactgtgctgctgatgcccaatggatcagataagataacatcacatcctctacaggagttaaagcccaccaaatccattgaagacaatgcagagataaaggcatggcttgctttggggacgaaatcaaagaagaagggtggtgggaagaagaagaaaggcaagaaaggagatgcagcagaagcagatcccatggaggaggcgacaaacggtgctacaagccaagaataattctgatttttggaattactgccaccagcttttttcttggttcttcgctgcatctg

SEQ ID NO: 29440 - DNA, 434 bp, Zea mays
  Clone ID: LIB3059-034-Q1-K1-B5
ctccttggtctttctgcaagtgctgctacgacgaccattttcccgcaatgctcacaagctcctatagcttctcttcttcccccatacctctcaccagcgttgtcttcagtatgtgaaaacccaattcttcaaccctacaggatccaacaggcaatcacagcaggcatcttacctttatcacccttgttcctccaacaatcatcagccctattacatcaattacctttggtgcatttattggcacaaaacatcagggcacaacaactacaacaactcgtgctagcaaaccttgctgcctacgctcagcaacagcagttacctttggtgcaattgttggcacaaaacatcagggcacaacaactacaacaactcgtgctagcaaaccttgctgcctactctcagcaacagcagtttctgccattcaaccaactagc

SEQ ID NO: 29441 - DNA, 345 bp, Zea mays
  Clone ID: LIB3059-034-Q1-K1-B8
aaaaaaaataaataaatataaaagtaattaaaaaacaaaaaaacaaaaaaaaaaaaaaagaaaaaaaaaaaaataaaaaaaaataaaaaacaaaaaaaacaaaaataaaaaaggggccgccctttttaaggttccaatctttctaacgcaattgttcaaagtcttaattttcctattggtgaacctaatttcaattccctggtccttttttaaaaacttggttactggaaaaaccttggcattaccaatttaaacttccttccagaaaatacccttttaaacatttggcttaatatctacaaggccctacccgatctcctttacaacaagtatcccatcctgaat

SEQ ID NO: 29442 - DNA, 378 bp, Zea mays
  Clone ID: LIB3059-034-Q1-K1-C10
ggcaattgcaacttgccttttaaccttttcacccttgttcctccaacaatcatcaggcctagtacagcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctatctgctgcctaccctcagcaatttcttccattcaaccaactgacagcattgaactctcctgcttatttacagcagcaacaactactaccattcagccagctagctggtgtgagccctggtaccttattgacaca

SEQ ID NO: 29443 - DNA, 304 bp, Zea mays
  Clone ID: LIB3059-034-Q1-K1-C11
aaaacaaaaaaacaaaaaaaaacaaatataaaatatagaaaaaaaaaatcaaaaataaaaggagtagggtgaaaaataaaaaaaggaagcataaatagaaactaaaaaaacaatgaaacaacaactaacaacatctggtgctagacaaaccttgatgactactctcatcaacatcagtatcttacattcatccaactacatgcattgaactccagcttcttatatgcaccaacagcaactaacatacagccagctacatgattcctaccgtcagcaattcctatcattctaccaactgacagca

SEQ ID NO: 29444 - DNA, 387 bp, Zea mays
  unsure at all n locations
  Clone ID: LIB3059-034-Q1-K1-C12
atctcactgctgtgttggagccagagttagcggatgagttcaaaaagggtgtcgagggtgcagccaagtttctccttagcaagctgaaggaccttcaattttttgttggtgagagcatgaaggacgaagcgtccgtggtattcgcctattacaaggatggtgccactaatccgacattcctctatttctctcatggtcttaaggagatcaagtgctagattagttacccatgttgggtactatatatgttctattgttatagccacaactatagctgccctgcctgaactgaactcaggtttttttaagaaaaaactgtccaagattggattgcttgttaaagctaaatattgntattgacgtgttattgcttagttgtcattngtc

SEQ ID NO: 29445 - DNA, 378 bp, Zea mays
  Clone ID: LIB3059-034-Q1-K1-C2
caaagcggcagtgcgtagagaggatcgtcgaacagaacagcatgaagatggtcatcgggctcgtcgtgtgcctggctctgtcagctgccagcgcctctgcaatgcagatgccctgcccctgcgcggggcttgcaggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatgttccagccgctccggcaacagtgctgccagcagcagatgaggatgatggacgtgcagtccgtcgcgcagcagctgcagatgatgatgcaacttgagcgtg

SEQ ID NO: 29446 - DNA, 446 bp, Zea mays
  Clone ID: LIB3059-034-Q1-K1-C4
cccaaggaggaggtggaggacttcggcgacctcggcggcgacgactggctcgcgggcatcaacctcgacgacctgcagatgccgggggatgccgccgatttctacggctccatgctcgtctcgccgatggccgccaagatggagccggacggcggcttccccttcttctgagatccttcggcgactccggggaccggatgcagcgcaacgcaaactgtgtatagttcagattttcttcatggaaccaacaacaacaaaaaaaaagttcttgctaatatcttgttctagtggtgtagtgcagaagtagcagcaggcatgattgaagttccattgtagtactgatgttcatcgccacttgatctgtgacaagtgacggcattctttcgtttcttggctgcaaattcttcgttgtccagaatataatttcagatgggtaatgccaattc

SEQ ID NO: 29447 - DNA, 436 bp, Zea mays
  Clone ID: LIB3059-034-Q1-K1-C5
cccacgcgtccgcccacgcgtccgcggacgcgtgggtgcgactcaattataacttcgatactgccctgggatgaaaggctgatagttggactatccaacagggaaataaaggtttactacaaggcatcatgactctttgcttcaaccccatgtatacattgtgaatagttcagtatacagtaaacgtgagatagaggattggaatccccaggactagaatacatcaaaagtacaatccgtgtttttttctttaaacaacaggggcgttcgtgtcccctccttttttttatattttctacaaagggatagtatacaaggggcctgtttggttcagcttttttctgaccagcttttctgaaaatctggctgtggggagaatctggctgtgggagagaatctgggtatcattacgattacctgtggaggaagataaagt

SEQ ID NO: 29448 - DNA, 433 bp, Zea mays
  unsure at all n locations
  Clone ID: LIB3059-034-Q1-K1-C6
caatggcggcgggcgggaatggcgccggcggggacaccagggcggccttcgcgcggagctacaagacgctcaaggaggagctgctcaccgacccggccttcgagttcaccgaggagtcacgccagtggatcgaccgcatggttgactacaatgtactcggaggcaagtgtaaccgtgggctctctgtggtcgacagctacaagctgctcaagggcgctgatgctctgggcgaggaggaaacgttccttgcttgcaccctcggctggtgcattgaatggcttcaggctttctntcttgtgcttgatgatatcatggatgactctcacactcgtcgcggccagccttgctggttcagggtgcctcaggttggcttaattgctgcgaatgacgggatcatccttcgcaaccatatctcacggatcccttcgcgcca

SEQ ID NO: 29449 - DNA, 325 bp, Zea mays
  Clone ID: LIB3059-034-Q1-K1-C7
caattaaatggttgcattcaaaaaaaaaaaaaaaaaaaaaaaaaaaacttaaagcgagggtacaaaaaaaaaaaaaaaaaaacaaataaaaaacataaacaaaaaaaaaggccgaccaatcacgcggatccaatccttccttatcgcttagtgcatacgtcctagctctcatttgttaccgcctactttctgtgaactacaggtactttctcatcaagggcactgttaatcccctggagtatcccaccttacttgctttcacgctaatccccttcattccatctgttttaatatctaataggcccctcccttttatcattcctaa

SEQ ID NO: 29450 - DNA, 355 bp, Zea mays
  Clone ID: LIB3059-034-Q1-K1-B11
cccacgcgtgcgcccacgcgtacgtgattgctgttattgagcctgatgagcatgtggggagagctatgaatgagatcaatgcagctgctaggctgaggttggctgccagcgagaaagctgatgcagagaagatactgcagatcaagagagccgaaggtgatgcagaatccaagtacttggcgggtctgggtatcgcaagacagcgccaggctatagtggatgggctcagagacagtgttcttgctttctctgagaatgtgcctgggacctctgcaaaggatgtcatggacatggttctggttacccagtacttcgacaccatgaatgacattggggcctcgtccaagtcctggtc

SEQ ID NO: 29451 - DNA, 439 bp, Zea mays
  unsure at all n locations
  Clone ID: LIB3059-033-Q1-K1-H6
cccacgcgtccgcccacgcgtccgcggacgcgtgggctcgagtccaagatcagcctggatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggctacggcggtggcgggcgccgtgatggcggcggcggctacggcggtggcggcggcggctacggtggcggcggtggctacggtggtggtggtggcggctacggcggtggcaaccgtggcggcggctacggcaactncgacgggaactggaagaactgagcggtggggcccgcgctggcaagttatcctgttc

SEQ ID NO: 29452 - DNA, 348 bp, Zea mays
  Clone ID: LIB3059-033-Q1-K1-H7
cccacgcgtccgcaaccctctcgagagccaaatttgaggaactatgttcaggcgttagggacaggcttaaaactcctgttaataatgccttaagagatgccaagttgtctgtcagtgatctagatgaagttattcttgtgggtggatccacccgaatccctgcagttcaagaacttgtgaggaagcttactgacaaagatcccaatgttacggtcaaccctgatgaggttgtatctcttggggcatctgtgcacggtggcgttttggcacgagacgtgaaagacgtagttcttctggatgttactccattatctcttgtttcggagacattggcaggagtgatgacaa

SEQ ID NO: 29453 - DNA, 340 bp, Zea mays
  Clone ID: LIB3059-033-Q1-K1-H9
cggtactggccgtccctctactgctccaaatctggaacatgcttcatcggcaaggggctctggtggactcacgagtgggagaaacatggcacctgctctgcccctgcggttcacgatgaattacagtatttcacccttgcccttgacctctactacaagtatgacgttacagaaatgctgtcacgtggagggatacatgtttcaaatggcaaagaatatgcactgaacgatgtcatcgataccatcgaacatgcttatgggggatcaccacaaattgcttgcctgacgggctcaatcgaagaactaatgttactcatcgacagaaaaatgaaccctcttg

SEQ ID NO: 29454 - DNA, 362 bp, Zea mays
  Clone ID: LIB3059-034-Q1-K1-A1
gcaaattgcaccaagaaatccatcgagaggccgtcgacaggggaattaatggcgtcggcgtcgagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctgga

SEQ ID NO: 29455 - DNA, 391 bp, Zea mays
  Clone ID: LIB3059-034-Q1-K1-A12
acccactcgtacgcagacaaagtgaagcgcactagcagcttcccaacaccaacggctaccaagatattaagcctcgttgcacttattgccgttttagagagctcatcaaatgcgttcattattccacagtgctcacttgctcctagtgccattattacacagttccttttatcagttacttcaatgggcttctaacattcagccgtgtaagccttctgactacatctagcgctttcagagagcgccttacaacaaccaattgcccaattgcaacaacaatccttggcacatctaaccctacaaaccattgcaacgcaacaacatcaacatcaacagtttctgccattactgagccatctacccgtggtgaaccatgtcacctacttgcaac

SEQ ID NO: 29456 - DNA, 396 bp, Zea mays
  Clone ID: LIB3059-034-Q1-K1-A2
attgtcccaacaatggcacccacaatattggggttccttatgcgctttgttctgcctgcaggtcctgctaccgcagccattatcccacactgctcacaagctcctatagctgcctttatatctccatacctttcaccatcggtgtctccagtatgtgaaaacccatttcttcaaccatacaggatccaacaggcgatcccagcaggcatcttaccttgatcaccatcgttactacaacaaccgttagacctattacaggagttacctctggagcatccgttggcacataacatgacggcacacctactacaacaacttgtgctacgacaccttgctgcctactctgatgaacagtatcagcttccattcaaccaactagctgcattgaactctgct

SEQ ID NO: 29457 - DNA, 445 bp, Zea mays
  unsure at all n locations
  Clone ID: LIB3059-034-Q1-K1-A3
tactcggtccggaatggctggacccacgcgtccgaagtgcaccaagaaatccatcgagaggtcgttgacaggggaatcaatggcgtcgtcgggtagcancagccaccgccgcctcatcctcgcagccgccggcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggacggagctgaagaggagatgctgccgggagctggcggacatcccggcgtactgccggtgcacggcgctgagcatcctcatggacggcgcgatcccgccgggcccggacgcgcagctggagggccgcctagaggacctgccgggctgcccgcgggaggtgcagaggggattc

SEQ ID NO: 29458 - DNA, 419 bp, Zea mays
  Clone ID: LIB3059-034-Q1-K1-A5
aggaaactgaagaagcagaactcaaaatgctgagaaagagtttgaatttcaaggcaacaccaatgccaagcttttataaggaaccaacccctgccaaggttgaattgaaaaagatccccccaaccagagctaaatcaccaaagcttggtcggtctaaaaacaagtccatatcagagactgaagaaaatactactacggaccaacctgcccgtctgagccttgacgaaaaggtttctcaaaacggtgtgaaaaaaccaaccccgtcgagttcagcaaagaagccccagagaaagtcactccccaggctgccatctgaagaaacttgtccgcttgatgccacctcaaggcagctgaagaacaacaaactggatgaagttaatgctcaggagacaggatcagctacagggcaggtacaagga

SEQ ID NO: 29459 - DNA, 436 bp, Zea mays
  Clone ID: LIB3059-034-Q1-K1-A7
cggacgcgtgggcggacgcgtgggccggcacgtccactcgcaaggcattctttgctggtcttcaaagctgggtgtcaagaaaatttatgactggatgtgtagttcttttgccaattgctgtcacattcttcatcacttggtggtttatccaatttgttgatggtttttttcagcccactctatgcaaaactggggtttgacatattcggccttgggttcttgacctccctggtgtttatacttcttgttggaatctttgtgtcttcttgggtgggttcaacggtcttctgggttggagaatggtttataaagaaaatgccctttgtaaggcacatatactctgcatcaaagcaagttagcactgctgtttcaccagatcaaaatacaacagcattcaaagaagtagcaatcattagtcatccccgtgttggtgaat

SEQ ID NO: 29460 - DNA, 444 bp, Zea mays
  Clone ID: LIB3059-034-Q1-K1-A8
accaactagcaacatagaaagcacaatagtgtaccaacaatggcagccaaaatattttgcttccttatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggctgcattgaactctgctgcttatttgcaacaacaacta

SEQ ID NO: 29461 - DNA, 406 bp, Zea mays
  unsure at all n locations
  Clone ID: LIB3059-034-Q1-K1-A9
cgacgattatggggccatcagatagcccatacgctggtggcgtatttttggtcactggtcactttccaccggactacccattcaaaccaccgaaggttgcattcaagacgaaggtttaccacccgaatatcaacagcaacgggagcatctgtcttgatatcttgaaggagcaatggagccctgcactgacagtttctaaggtcctcctctcaatttgttcccttctgacggacccaaaccctgacgatccgttggtcccagagattgctcacttgtacaagactgatcgcgtgaagtacgaatctactgctaggagctggactcagaaatatgcaatgggctgacaagctattggtctctcatagacccttctgtaactganaccagatgtctaaattaaatttgt

SEQ ID NO: 29462 - DNA, 415 bp, Zea mays
  unsure at all n locations
  Clone ID: LIB3059-034-Q1-K1-B1
gccctgctcatactgcttgccctcgccgtatcgtccacccgcaacgcacaggaggatgccatggccgacaacaccgggacgttggcgggcggcatcaaggacgtgccggggaacgagaacgaccttcacctccaggagctcgcccgcttcgccgtcgatgagcacaacaagaaggccaatgctcttctggggttcgagaagcttgtgaaggccaagacacaagtggttgctggcacgatgtactatctcactattgaagtgaaggatggcgaagtcaagaagctctacgaagctaaggtctgggagaagccatgggagaacttcaaggagctgcaggaattcaagcctgttgaagagtgtgctagcgcctaaggatctctccttcaccatgtgcgagcctgaagctcanagcaaa

SEQ ID NO: 29463 - DNA, 440 bp, Zea mays
  unsure at all n locations
  Clone ID: LIB3059-033-Q1-K1-H4
cgtccggagaatcgaagaagcaatcagacatggctgtaatgatcttaagatacttcaatgtgagtgggtcggacccagaggggcgactaggagaagctccaaggccagagctacgcgagcatggacggatatccggtgcttgctttgatgcggctttgggaatcattccagggctaaaggttcgtggaactgattactccactgcagatggaacttgtattagggactacatcgatgtcacagaccttgtagatgcccatgtcaaagctcttggtaaagctcagccaggcaaagttggaatctacaacgtcggaacaggccaaggtagatcggtgaccgagtttgtagaagcttgcaagaaggcaacgggagctttcattcaagtcgaatatnctgcccgtagacctggagattacgccgaggtatacagcgacccgtcg

SEQ ID NO: 29464 - DNA, 442 bp, Zea mays
  Clone ID: LIB3059-033-Q1-K1-F9
accagaacggccaccagatctaccaccaccacgctggccgttctggtgggagatttggtgaccgttctggtggccggcgtggtggtggtagatttggtgaaagatctgggggcagggatggtggcggcagattcggtggccgacgtggtggtagggatggcggccgaggacgtggtggccgtggctttggtaacaagcacagcgctggcactcccagtgcaggaaagaagactacttttggtgatgattgatgatgaacgcggaggatgctgcaaaaggatccaatgaaattgtgtttttttggtcttgttgtggtaccgtaactggaatttggtattttttgtctactatttactgtagtggtttctggattttccttgtgttgcctatgctgcaatacaccgttttgttgttgcgatacatctgtagtttggctttggtt

SEQ ID NO: 29465 - DNA, 437 bp, Zea mays
  Clone ID: LIB3059-033-Q1-K1-G1
catataaagtggaatccattagctacaacagagcaacaatggctaccaggatagtttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcatggcacagcatctgcagcaactcgtgctacctgtgatcaaccaagtagctctggcaaacctttctccctactctcagcaacaacaatttcttccattcaaccaactgtctacactgaaccctgcttct

SEQ ID NO: 29466 - DNA, 388 bp, Zea mays
  Clone ID: LIB3059-033-Q1-K1-G10
gatcagcaaagcggcagtgcgtagagaggatcgtcgaacagaacagcatgaagatgggcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggctgctgcgccctactacgccgggtgtgggcagccgagcgccatgttccagccgctccggcaacagtgctgccagcagcagatgaggatgatggacgtgcagtccgtcgcgcagcagctgcagatgatgatgcagcttgagcgtgccgc

SEQ ID NO: 29467 - DNA, 421 bp, Zea mays
  unsure at all n locations
  Clone ID: LIB3059-033-Q1-K1-G4
gcggcagtgcgtagagaggatcgtcgaacagaacagcatgaagatggtcatcgttcgcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagacgagcgccatgtaccagccgctccggcaacagtgctgccagcagcagatgaggatgatggacgtgcagtccgtcgcgcagcagctgcagatgatgatgcagcttgagcgtgccgctgncgncagcagcagcctgtacgagccagctctgatgcagcag

SEQ ID NO: 29468 - DNA, 251 bp, Zea mays
  Clone ID: LIB3059-033-Q1-K1-G5
aaaaaaaaaaaaaaaaaaaaaataaaataaaaaaacaaataaaaaaaaaaaaaaggaagaaaaatacaacatctttcaaaattccaaaaaataaaaaaacaacaaaaaaaggtcttccattttatatgatccaaccttcattactcttacatccactttattacctaccttatatcttcaccaaactcaaattcatttccccttatttaacaatttcctcattgacaaaacccttgatttccccaactaaa

SEQ ID NO: 29469 - DNA, 372 bp, Zea mays
  Clone ID: LIB3059-033-Q1-K1-G6
cccacgcgtccgcccacgcgtccgctcgtagagagaaggaaaaatatccccagaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacacc

SEQ ID NO: 29470 - DNA, 442 bp, Zea mays
  unsure at all n locations
  Clone ID: LIB3059-033-Q1-K1-G7
gtggaattcagatgtgtttccctcagtttggatactctgggacattggagcgagatggatttgcaagaaacaggatatggtccctggatgatgagcagccaccactgaatcataatgataacggaagcaaagtttctgttgaccttattctaaagccatctgaagatgacctcaagtgctggccacattggtttgagttccgtctgagggcctatctttcaaaagatggggacttgtcattgatatcacgcatcangaatgtcaatggcaagccattcagtttctcatttgcttatcacacatatctttctgattctgacatcagtgacgtcaggattgaaggtctggagacacttgatcatcttgacaaccttagccacaaagaacggtttacggaacaaggagatgccataacatttgagtcataggtcgaccgagtcta

SEQ ID NO: 29471 - DNA, 414 bp, Zea mays
  Clone ID: LIB3059-033-Q1-K1-G9
ctcaaatcctcagtggtgaaagtagatcaagggatacaagcatcaaaattgagcagagtgaacaagaacatagaatactcaagaatgaagatggtatggtgaaatctgaacggccatataaatcccgaaagagggggcgacacattgagaaatgacatttcattgaggccgtgaagatacaagaatgtggaagtcatgttcgcttcaatggttctgctgcctatttatgtttcttgtgggggggagaaggtgcctccagttggagatcccggtagcttcatagaaatgtacgatgatttttgtaaaacgaatggaaggttgcatttgcaaattatcaccttttttgacaagatagtagtaactgatctcaccgtaagggtttattggcaaatggcaagtcccatgtttcaatta

SEQ ID NO: 29472 - DNA, 436 bp, Zea mays
  Clone ID: LIB3059-033-Q1-K1-H1
cctgagtcttgtcgctgccgccgggatggccggagtcaccgccaccgggatggccggggttgccgccaccttctcctcagccaccgctcagatcgggggcttcctctcgaagaagccttacgcgccgccgttgtgggccacgcacctcttccccatgccttgccataccttctcgctcggccatttcccaacaccgattcacaagtggaatctgcccaatttgccggaaggaacggaagtgtggatcaagcgagacgatttatcaggcatgcagttgagtggaaacaaggtccggaagctggagttcttgatggcagatgccgtagcacaaggcgcagactgcgttattactggtgggggtatacagagtaaccactgtcgtgccacagacgtggctgctaagtatctcaatcctgaatgctacctgatactacgt

SEQ ID NO: 29473 - DNA, 401 bp, Zea mays
  unsure at all n locations
  Clone ID: LIB3059-033-Q1-K1-H10
cagctcttcaaccctataggctccaacaagcaatcgcagcaagcaacatacctttaggacccgggtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacattgaaccgtgctgcttatttgcagcaacaactattaccattcagccagctagctactgcctactctcagcaacaacaacttcttccatttaaccaattggccgcactgaaccccgctgcttatttgcagcagcaaatactactaccatntaaccagctagctgcagcaagc

SEQ ID NO: 29474 - DNA, 372 bp, Zea mays
  Clone ID: LIB3059-033-Q1-K1-H2
gcgaatactactaccatttagccagctagctacagcaagccgtgcttccttcttgacgcaacgacagttgctgccgttctaccagcagtttgcggctaaccccgcaaccctcttacaactacaacaattgttgccctttgtccaacttgctttgacaaacccagcagcctcctaccaacaacacatcattggtggtgccctcttttagattgcttattagatgtaattcaataataaagttttttggatgatgtatgtggccaaccagaaataaaaagttacatttccaaaaaaaaaaaaaaaaaaaaaaaaaaaaaaaaaaaaaaaaaaaaaaaaaaaaaaaaaaaaaaaaaaaaaaaaaaaaaagggcgg

SEQ ID NO: 29475 - DNA, 435 bp, Zea mays
  unsure at all n locations
  Clone ID: LIB3059-033-Q1-K1-F7
gcaacatagaaagtggaatccagtagcaacaacagagcaacaatggcgaccaagatagtgttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatntcttccattcaaccaactgtctacactgaaccc

SEQ ID NO: 29476 - DNA, 417 bp, Zea mays
  Clone ID: LIB3059-057-Q1-K1-F5
cggacgcgtgggggaggttcagtgatgcgtctgtccagagtgatatcaagttgtggcccttcaaggtcatttctgggcctggtgagaagccaatgattgttgtccagcacaagggtgaggagaagcagtttgcagctgaagagatctcctctatggttcttatcaagatgcgtgagattgctgaagcttaccttggtagcacgatcaagaatgctgtggtcacagtccctgcctacttcaatgactcacagaggcaggccacaaatgatgctggggtgattgctggccttaatgtgctgcgtatcatcaacgagccaacagctgcagctatcgcctatggtcttgacaagaaggctaccagtgtcggtgagaagaatgtcctcatctttgatcttggaggtggtacctttgatgtct

SEQ ID NO: 29477 - DNA, 403 bp, Zea mays
  Clone ID: LIB3059-057-Q1-K1-F7
gtagcaattgaggcggtaattgaggatatggtgctgaaacagcaaatattttctgaccttgagaagtattgccatcataattgcatatttgcaacaaacacttcaacaatagacctgaacataattggtcagaagacagcttctgatgaccgcattgttggtgcacacttctttagtacagctcatgtcatgtcactgttggaaatagtttgtactcatcatacttcctctcaagatattgtggacctgattgatttggcaaataaaatacagaaaacaccaatagttgttggcaactgcacaggattcgctgtcaaccggatagtctttccttacgctcatgcagcttctttacttgatgattatggtctggatgtgtatcacatagatcatgtgatcacac

SEQ ID NO: 29478 - DNA, 468 bp, Zea mays
  unsure at all n locations
  Clone ID: LIB3059-057-Q1-K1-F8
ccgtccgaattccggtcgcccacgcgtccgcaatgaattgcatgctgcatgtgaatgccggaaaagtggaaagtgcaggttgatcgtgttaaatatggtcgtggctgcgtcagttgtacaacatcataggctttgttttatctccatttatgatattgaacttatataacatggcaggtccagattccagcagctctgagctatagaaaaaacggcttgggggcgagacggagagaggggtatttgcagtataagtacctttggatcgaagagcatcactcgaagatgcatcgaggactgttcttcttcttcctcaagctgtagcctgtgggaggagaggccggagaggcctcccatggagttcccccactcatcacttcttgttggtcccctgctagctgttcgttcctctcagcaggtagctagagatgatcttgctntaattctgtgctgatctcttactcgtcg

SEQ ID NO: 29479 - DNA, 305 bp, Zea mays
  Clone ID: LIB3059-057-Q1-K1-G1
cccacgcgtccgcccacgcgtccggccaccaccaccgagcctggactaccgccgccggccttcgccgatatcttcagcggcgaacagcgcccaccagatcccgcccctgcgatggagtccgtggtgaacccgaaggcatacccgctggctgatgcgcagctgacgatgggtatcctcgatatcatccagcaggccgccaactacaaacagcttaagaagggagcgaatgaagcgacgaagaccctgaataggggcatatcggagtttgtagtgatggcggcggacacagagcctctcgagatcct

SEQ ID NO: 29480 - DNA, 380 bp, Zea mays
  Clone ID: LIB3059-057-Q1-K1-G10
cagcgtcgggacctggcaaataactgcctagaggcggtatttcagaggcgagatgagactcaagaagctgattgcagacattgaagcccagccaagcattgcggttcagaaagtgctgaaatccttcttgcacaagatctacaagaggcagaagtaggggctcttggataaacgagctcaggagtcgttactccttcgcatgcttgacataaccggacttcctcacctggttgctctagtatgatgtggagcgtctagttaaaaaaaatcgatgtagtatgaagcaccttgctgctctgaatattaacaggcaattaaggcaaggtgctgtttcggtttggtggaccgcatgttgcagataataaattagttgatttgtc

SEQ ID NO: 29481 - DNA, 385 bp, Zea mays
  Clone ID: LIB3059-057-Q1-K1-G12
ccacgcgttcgcgaatgctccacatgatctctatgatagttactacaacagttacaagtcaaacctgaagttgtatgttatgagagttttcatctctgacgaatttgatgatcttcttcccaagtaccttagctttttgaagggtattgttgactcggacacgctgcccctgaacgtgtcacgagaaatgcttcaacaacatagcagtctcaagaccatcaagaagaagctgatccgcaaagcccttgacatgatcaggaaacttgctgaagaagaccctgatgagtacagcaacaaggataagacagatgaagagaaaagcgagatggaggacaagaagggcagttcgccaagttctggatgagtttggcaaatcaatcaagct

SEQ ID NO: 29482 - DNA, 433 bp, Zea mays
  Clone ID: LIB3059-057-Q1-K1-G2
gaaaaaaaaaaaaaattaaatttaaaaaaaaaaaaaaaaaaaaaaaaaaaataaaaagggcgtgtcgttctcgtatcttatattttttcttaattatattttattttttatattttttgtttaatttttttttcttttttatttttttttatcttttttttaattttttatttttttattttttcgttttttattattaacttttttgtattttttcatgctattttatctttattttatatagtttctttatttcatattttttgctcttttttttacattttttttattttaaatctttttatttttttttctttatttctttttttttttttctcctttttttatttttttttttttctttttttatttttttcttttttttttattaatttttttatttttatttttttattttttattttctttttct

SEQ ID NO: 29483 - DNA, 390 bp, Zea mays
  unsure at all n locations
  Clone ID: LIB3059-057-Q1-K1-G4
cacttctccaggtaaggaaagtgttcgtcctcatggcgccgccgcagccgaagtcgggcctcttcgtgggcatcaacaagggccatgtcgtcaccaagcgcgagctgcctctgcgcccgtcccaccgcaaggggaaagcaacgaagagggtgtccatggtcaggggcctgatcagagaggttgctggctttgctccttatgagaagcgtatcaccgagcttctgaaggttggcaaggacaagcgcgctctgaagcttgccaagagaaagcttggaactcacaagagggcaaagaagaagagagaggagatgatgggcgtnctcaggaagatgagatcggctggtacgcacactgacaagaagaaataaagcatttcaagttcatgaatgt

SEQ ID NO: 29484 - DNA, 429 bp, Zea mays
  Clone ID: LIB3059-057-Q1-K1-G5
acgggcccttgctctcctcggcccaccgatccacgccccgcacgcacacgacccgcagaccgcaccctgtcggcgagctcgctcccgttcccgtccgctgctctccgctcgacgccgccgtcttccgcgcagctagtgtctacactcccggcgacgatggcggaggacttggttttggacacggcgatccgagactgggtcctgatcccgctctccgtggttatggtcctcatcggcgtgctccgctactttgtctccaagctcatgcgctccccggcgacctctgcgtctcccgaccccaagctcgttaaggaagggcaggtggtcatcaaggcgaggaacctgaggaccaacgcacaggtcatcccggccaaggctttaaggcacgcaagggttattacaccaacgaggaaaatggattacttcatg

SEQ ID NO: 29485 - DNA, 395 bp, Zea mays
  Clone ID: LIB3059-057-Q1-K1-G7
cggacgcgtgggcggacgcgtgggttgccaagaagtaccatgctttcttggcatcagaggccatcatcaagcagattccccgtctccttggtcctggtctcaacaaggcaggcaagttcccgaccctggttactcaccaggaatccctcgaatccaaggtgaacgagactaaggcaaccgtcaagttccagctcaagaaggtcctttgcatgggcgtcgccgtcggcaacttggcgatggaggagaagcagatccagcagaacatccagatgagcgtgaacttccttggttcccttctgaagaagaactggcagaatgtgaaatgcctctacgtcaaaagcaccatggggaaaccatacagggtgttctaagtatgctcttttgtgaagtctgct

SEQ ID NO: 29486 - DNA, 289 bp, Zea mays
  Clone ID: LIB3059-057-Q1-K1-G8
ctgccctaagaggtgttagtcccatttgcattacagaaaaaaaaagtagacatagtagtagtcggcatcaacacgggccacgttgtcaccaagcgcgagctgcctctgcgcccgtcctaccggatggggaacgcatctaacagggcgtccatggtcatgggcctcatcagagagggtgctggctttgctcctcatgagaagcgtatcaccgagcttctgaagggtggcaaggacaagcgcgctctgaagcttgcccagaaaaagcttggaactcacaagacgtgcctta

SEQ ID NO: 29487 - DNA, 338 bp, Zea mays
  unsure at all n locations
  Clone ID: LIB3059-057-Q1-K1-H1
gggagaatttggttgtgagggagaatctgagtatgcgtgggccgtatagtggtggctttggagggatttcctttcgcggcgacatggacattgcactggctcttcgcactatcgtcttccccaccgcatctcggtttgataccatgtactcgtacacagacagtaagtcccgacaggagtgggtggctcacctccaggccggagctggcatagttgctgatagcaaaccggatgacgagcaccaagagtgtataaacaaggctgcaggtgttgctcgtgccattgaccttgctgaatctacatntctagaagactagtctagtctaatgaatgaaatg

SEQ ID NO: 29488 - DNA, 340 bp, Zea mays
  Clone ID: LIB3059-057-Q1-K1-F4
cggacgcgtgggcggacgcgtgggttttttttttttttttttagttcccagcacgacgtcatatcacaaactcgtatttactgacgaacaaacgacacatcacacatcaaggccaacagcagcagatgataaaccacgggaagcacagataaaactagggcagggaaggtggtggaatagctcacatgccacgccccatggtctgctccatgggcggcatcatgacaaagacggagtgcccattgttgaatccagggtggggaaccctgcggcgcagctcgcgaccctcctggcagagggcgcacgggtggcagaggtagtgggttgcaaggtcacaggc

SEQ ID NO: 29489 - DNA, 405 bp, Zea mays
  Clone ID: LIB3059-057-Q1-K1-D9
cataaagctgctgttctttgtgttcagtggtcacctgacagagcatctgtttttggaagttctgcagaagatggtttcttaaacgtgtgggatcatgagaaggtggggaagaagaaaaattctaatgtcccagccgggcttttctttcagcacgctggtcatagggataagattgtagacttccactggaattcgtcagatccttggacaattgtcagtgtctctgatgatggcgagagcactggtggaggtggaacactgcagatttggcgcatgagtgatttgatctaccgcccagaggatgaagttcttgcagagctggagaatatcaaggctcatttggccagctgtgcaccgaataattgagtcatgtgggttacctgctgaatgcaatcctgtggaaac

SEQ ID NO: 29490 - DNA, 374 bp, Zea mays
  Clone ID: LIB3059-057-Q1-K1-E1
cccacgcgtccgcaaagcactggaagcatccattctaagaaatgagggttcatggtctggttcatctcattcctcagccgctgaaagaacactgcccttccaagttaaaggtggtgagtgggaaatcgacaaacgacttctgaagatgggagggatggttgcttctggttcttgtggggacttgtatcacgggacttaccttggtgaggatgtagctgttaaagttataagagctgagcatttgaataagaatgtttggaacgagtttacgcaagaagtatatatactaagagaagttcaacataaaaatgttgtgcgattcattggtgcatgcacaaaaccaccccattttgcataattacaggatacatgtc

SEQ ID NO: 29491 - DNA, 395 bp, Zea mays
  Clone ID: LIB3059-057-Q1-K1-E12
cccacgcgtccgatttcctttagccactgatcaagtcaatagagactatgggcaggctgcacatccaattgttcaacaaaactcagttcaatcccctacacaatctgcacccaggatgcctgcccagatgtttggtgcaaaattcagcaatagcagtaaaatatcaccagcacaacctacaactattctgggtgatgacactgaaatttcttcacctagtggatcaaacaaatatgattctcggttaacaattaaggggcaacctgatgaccaaggaacagagcattcttcgtttctccgtggtggggctcatgttcttggggctacaggtgcaatgggcattaaacttggtgatcaaaatttccatggtaccccagcattgctgccagttatgc

SEQ ID NO: 29492 - DNA, 304 bp, Zea mays
  Clone ID: LIB3059-057-Q1-K1-E3
cggacgcgtgggcggacgcgtgggagcgaaacgacgctgggtggtgtgatgtttgcaggtcgtggtccacaggctgccggagcatacagcagttcattttcaattcttattatcatatattatggaagaagaaatgaacatcttcaggattgaacagtgtcgcgaaattgtagatgatggttccacaatcccaatgggaccgacagacaaagagacatgctgcttcctgctgtgagttttgtattgcagacgacactgtttatgtggagttaaaaaaaaatatatacgcaaaaaagacttggaa

SEQ ID NO: 29493 - DNA, 236 bp, Zea mays
  Clone ID: LIB3059-057-Q1-K1-E4
gccacttccattattacacactgcatataacgcgttacagatacgggcatttgaacacggatctgtgcaagcatataggctacaacacggacatgttgcgagcgtcgaatatcaaccaagttcctaatttcaacagcgatccttaggacatctaacaatacagaccatggtgacccgcagcgacaacaatttgtaccgcgccgaccacctatatagggtgaactcctgccgtctac

SEQ ID NO: 29494 - DNA, 403 bp, Zea mays
  unsure at all n locations
  Clone ID: LIB3059-057-Q1-K1-E6
cggacgcgtgggagcccgagcagcaggattcaccgaagagagtgggacgctgggtgatatatgggagactgtatcaaacagtgatcttgttttgctactgatatctgattctgctcaggctgataactacgagaaaattttctcgcacatgaaaccaaacagtattcttggtttgtcacatggatttctccttggacatttgcaatctctgggttttgatttccctaatagcatcagtgtgattgctgtatgccccaagggaatgggcccatcagtcagaagactttatgttcagggcaaagagatcaatggtgctggtatcaatgctaagcttgctgttcanccagatgttgatggaagggcaacagatgtagctctagggtggtcagtaactttaggttct

SEQ ID NO: 29495 - DNA, 436 bp, Zea mays
  Clone ID: LIB3059-057-Q1-K1-E8
cagaaacacaccaagcgaagctacctagcaacgacttaacaacaatggctaccaagatattagccctccttgcgcttcttgccctttttgtgagcgcaacaaatgcgttcattattccacaatgctcacttgctcctagtgccattataccacagttcctccgaccagttacttcaatgggcttcgaacacctagctgtgcaagcctacaggctacaacaagcgcttgcggcgagcgtcttacaacaaccaattaaccaattgcaacaacaatccttggcacatctaaccatacaaaccatcgcaacacaacagcaacaacagttcctaccagcactgagccaactagatgtggtgaaccctgtcgcctacttgcaacagcaggtgcttgcatccaacccacttgctctggcaaacgtagctgcataccaacaaca

SEQ ID NO: 29496 - DNA, 402 bp, Zea mays
  Clone ID: LIB3059-057-Q1-K1-E9
ggaagtcgtgattgctaagatggactcgactgccaatgacgttcccagtgagtttgacgtccaaggctacccgaccttgtacttcgtgaccccgagcgggaaggtgacatcctacgacagcggcaggacggcggacgacatcgtcgacttcatcaagaagagcaaggagaccgcagccgccgccgccaccaccacccaggtgccaccggcatccgagaaggcagccgccgccgagcccgtcaaggacgagctgtgagcatccaaggtgtggacggctgtggctgcgtatgcgggaggaaaacctggcgctaacgtgcctccaacgcctagtttttgcgggggaccagagggagagagagagagggacggagttagagagagaggggatctgcgacgtgtttt

SEQ ID NO: 29497 - DNA, 307 bp, Zea mays
  Clone ID: LIB3059-057-Q1-K1-F10
gggacgcgtggggtgtaaacccaattctttaaccctacaggatccaggtggcatgcgcatacctaagacaccgctggagagatgtactgagtaagaagggaagttattggagcttgtgagcattgagctcttggatctaacacgcgagcgaaccagagagccatgaacctatcaagcaagcgacatcctggcctataacagagacatatgctaacacactcatggagcagatgtgattctcgcatgaaggaaggtgtgcttcatgatcatcaaggcactagaaccttaagctttttttcaaagtggt

SEQ ID NO: 29498 - DNA, 366 bp, Zea mays
  Clone ID: LIB3059-057-Q1-K1-F11
ggtggattctccttcccctccggttctggttcgggttcaagaggttctgcggaatgggagttcgtgggtgagcggatcgagatggcggcgtatgatggtgagtaccgctgcttcgtcagcggtctaatctgggccacggacgaccacttcctacacaacgccttcagcacctacggcgaggtcctcgagtccaagatcatacttgatcgggagacgcataggtcccgctgtttcagctccaacaacttgtacacggacgaggcgatgcagaacgccatcgagggcatgaacggctaggagctggacagccgtaacatcaccgttaacgaggaccagtcccgatacggtcgttgacgccgaaaccgt

SEQ ID NO: 29499 - DNA, 394 bp, Zea mays
  Clone ID: LIB3059-057-Q1-K1-F12
gtgaaaacccagctcttcaaccatataggcttcaacaagcaatcgcggcaagcagcgtacctttatcgcccttgttgtttcaacaatcgccagccctatctttggtgcagtcattggtacaaaccatcagggcacaacagctgcagcaactcgtgctacctctgatcaaccaagtagctctggcaaacctttctccctactctcagcaacaacaatttcttccattcaaccaactgtctacactgaaccctgctgcttatttgcagcaacaactattaccatttagccagctagctactgcctactctcagcaacaacaacttcttccatttaaccaattggccgcactgaaccccgatgcttatttgcagcagcaaatactactaccatttag

SEQ ID NO: 29500 - DNA, 355 bp, Zea mays
  Clone ID: LIB3059-057-Q1-K1-D7
agcagaagttggaaacagttttgctggctcaagtaggctacacgatatccgttttgtagatgaaaggataaaatacagcaaggaggaatttgtggagctgcaaggccttgctaaaccaaattcgttaatgcttggcgtgtggcttccaccagaactgcgaaggcccaaatgatagttttggatcttgattccttacgcatttactgccagcatatcataatcttccttgagttattcttgatatgacagacttttgagaattaagcatcaagcatgtcactcagttccaaattatagttcactttggtattgtcctaggtcaaacttttctagctttgacctatgctttcaaata

SEQ ID NO: 29501 - DNA, 264 bp, Zea mays
  Clone ID: LIB3059-057-Q1-K1-F2
cccacgcgtccgcacgcttgtatgttggaagattgtctccccgcacccgttctcgtgagctagaataccttttcagcaaatatgggagaattcgagaagtggagttgaagcgtgactatgcattcattgaattcaggacccccgtgaatctgatgaatcacaatacaacctaaaatggcaggacgtcgattggaaccccattattggtgaaattgcttaaaggggtcctcgggggtcttgggggtcacgtgattaccaccgaag

SEQ ID NO: 29502 - DNA, 398 bp, Zea mays
  Clone ID: LIB3059-057-Q1-K1-B9
cccacgcgtacggccacgcgtccgtgcagatcaaattcatgttatcgtggcatctttgtatcaaaaagatgcagaagagacagttgatggtattgaaaatacaactgctacccagcttgatgttgctgatattggaagcctttcagatcttgtttctcaggttgaggttgtaattagcttgctgcctgctagttttcatgctgccattgcacgagtatgcatagagttgaagaagcacatggtaacggcaagctatgttgatgaatccatgtcaaacttgagccaagctgccaaagatgcacgtgtaactatactttgtgaaatgggcctagatcctggcatagatcacttgatgtcaatgaagatgattgatgaagctcatgcacgaaagggaaaaa

SEQ ID NO: 29503 - DNA, 329 bp, Zea mays
  Clone ID: LIB3059-057-Q1-K1-C1
atcatcatatcaggaatgtatgaatgatgaagctgcatactgcaactatgttatgagagatgcttatgatcttgtcacgaagagccaagggcaggatgcattaaggaaagcactgtgggagactcttgaaagtggtgagaaagaattggagagatacctagaaaacgttacccaacatgcaccttatgccacttgaaaggatcactaattaacctcctagacttatctgctaaggatgaacaagatactttcttgttctttcaagatgcattcagaacttctgtcaaattgtacatttatagagatgaaaccgatgcttgtcaaagata

SEQ ID NO: 29504 - DNA, 373 bp, Zea mays
  unsure at all n locations
  Clone ID: LIB3059-057-Q1-K1-C11
cccacgcgtccgcccacgcgtccgctgacgcgtgggctggcgaggggccgaatagtgtctgcctggctggttgctgctcacctctctgctccttccttccttccctccctccctccctccagagtccggagcagagcagtcaaccgggctgtcgtcgccattggtgcggtacgtgcgagcccgagcggtgcgacgcagggggggaggggccagtgagagagacgacacgcgagagcgaagccaagcgaaggaggagcttcctggcgcgcgcggatcgcggaggctgtatatatatagtcggagggcgcgcgctccggtccggtaacgtgctgcangtggggtgtggcgcatggcaggattaggcaaggcagcg

SEQ ID NO: 29505 - DNA, 357 bp, Zea mays
  unsure at all n locations
  Clone ID: LIB3059-057-Q1-K1-C2
cggacgcgtgggcggacgcgtgggcgccgcgctgctcgtgctagggctctctggcgcgcccgccgcggatgtggccagggtgcccgttgacttcatcgagctgctcgggatcaggcagagcctctctccctccaggaacagcggcctgctcaacatgctcagcctcatgaagcgcaaggcgcttgagatcgccggtggtgactcaacgtcaagtcagcaatcagtccaagaggttaccagaccgcgtctagtgaacgggaaagagcctgaatttgcagctttcgaggtgcaaganaaggaaaaggaaaggccacaggatgcanagaggcgcgacgaggatgaacaattgggtcaact

SEQ ID NO: 29506 - DNA, 316 bp, Zea mays
  Clone ID: LIB3059-057-Q1-K1-C5
cagctaagcccgggccagcagttcagatcctgcggcgtaggcagcgtcagcagcccgttcctgagccagtgcgtcgagttcctgaggcaccagtgcagcccgacggcgactccctaccgctcgccacaatgccaggcgcttcaacaacattgctgccaccagatcaggcaggtggagccgttgcacctttaccagacgacatacggtgtggtcctgcagtacttcctgcaacatgaaccgtacggcgagctagcggcactgatggctgcccatgtagcggcaacagtgactgctatgtgcagcctgcaaatgcagc

SEQ ID NO: 29507 - DNA, 399 bp, Zea mays
  unsure at all n locations
  Clone ID: LIB3059-057-Q1-K1-C8
ccacggtggagaacgcgcgcgccttcgtgtcgggcctcgtgtcccacctccgctccctgtccggcacgccgcgcgcgcccggcaagtcggtggagacgtacatcttcgccatgtacgacgaggacctcaagcccggcaaggcgtcggagcggtacttcgggctgttccagaccagcctcgccgagacgtacccgacggggttgctcaggaacggcacggccggaccgataccagccacggcgccggctccggcgccaaccacgtccgccgcgacgctgaagccaacgccagggcagcagacacaggtgactccagcgcagcagggctcgacggcngcagctgggccttcggcatctgcaggccgggccagggcggttacgtcgagagggaccactaccg

SEQ ID NO: 29508 - DNA, 203 bp, Zea mays
  Clone ID: LIB3059-057-Q1-K1-C9
gaacgtggacaacgcttgcgcctttttgtcaggcctcgagtactaggggcgctggctgtccggcacgccgcgcgcgctctgcaagtcggtggagacgtacatcgacgccatgtactaagaggacctcaagcccggcaaggcgtgagagcagtacttcaggctgatccagaccagcctaacctagacgtactcgacggggttgc

SEQ ID NO: 29509 - DNA, 436 bp, Zea mays
  unsure at all n locations
  Clone ID: LIB3059-057-Q1-K1-D1
gagggataatatcttggtagccattgttgttaggttgttgcgctttttgcgagcgcagcaaatgcgttcattattccacaatgctcacttgctccaagttccattattacacagttcctcccaccagttacttcaatgggcttcgaacacccagctgtgcaagcctataggctacaacaagcaattgcggcgagcgtcttacaacaaccaatttcccagttgcaacaacaatccttggcacatctaacaatacaaaccatcgcaacgcaacagcaacaacaattcctaccagcactgagccacctagccatggtgaaccctgccgnctacttgcaacagcagttgcttgcatcaaacccacttgctctggcaaacgtagttgcaaaccaggcacaacaacagctgcaacaagttctgccaacgctcagtcaactag

SEQ ID NO: 29510 - DNA, 309 bp, Zea mays
  Clone ID: LIB3059-057-Q1-K1-D10
tgcagctgcaccatcaactcgggcatatggctgcttcctacccccagcaacatcttccatcccatctagtatcatcaatgaactctgctgctcatgtacagtagcaacaactactaccattcaggcagctagctgatgagagccctgctgccttcatgacacaacagcagtagctgcccttctacctacacgctatgcatagcgctttcaccctattaccactgcaacaattgctgccattcaaccaacttgctatgacgaacccagctgtgcactaccaacaacccatcattgagggtgccctctatt

SEQ ID NO: 29511 - DNA, 241 bp, Zea mays
  Clone ID: LIB3059-057-Q1-K1-D11
ggcatacactcaatcctatttgagattgcagaaccatcacccacccacgcaacaggcaatccttaagcgtaaactgaacaaccagaactgcataatgagagacctaactcacatctaaatcatcatgatcaatgactactacctaatctgcacacttgtcatgccagcagtattaatgaatcgacctaagcactagtgagacacaatttcattatagatccccatacttacatggaatttc

SEQ ID NO: 29512 - DNA, 344 bp, Zea mays
  Clone ID: LIB3059-057-Q1-K1-D2
aagacaccgtcgctctcctcgcgtgcgagcgccgccactgcatcttcccatcgatctgggccgaccccgcatcttcccatacgagctgtgtttctccaagttcgctgctggccatatcgacgtcgtcatcctcgatccagacgagtgcgtgtgccatctccacgggtcttcgacagatttagcaagaatgtttggaagaggatctgctatgatgaacttgatccaagctgcaactatgaaaaaaatatcccccagatctactactaacaagcgcacgaagagaacatcaccaaaagttggtcgtcttagagcaaactggaatagtggactagaaaagggtttag

SEQ ID NO: 29513 - DNA, 390 bp, Zea mays
  unsure at all n locations
  Clone ID: LIB3059-057-Q1-K1-D3
cttccccgcgtgccgcgtcaaacaaatctaggcttccaagcgagcgaaagccttcctgcgccagccgatctaccaacatcctctccgccgattggaggcacctgcgaagatgccgcagcggcactcaaagaacaacaacgacctcgccttcttcacgtacgaggagaagcggaagctcgggtacggcacgcagcgggagcgcctggggaaggactccatcaagcccttcgacgcctgctgcctctgcctcaagccgctcatcgacccgctctgctgccccaagggccataccttctgcaaggagtgcatccttgagtgcctnctcgcccagaagaaggacatcaagcgtaagctagcagctcacgaggcccagaagaagcangagaagga

SEQ ID NO: 29514 - DNA, 372 bp, Zea mays
  Clone ID: LIB3059-057-Q1-K1-D6
gctgcattgaactctgctgcttatttgcaacaacaactaccattcagccagctagctgctgcctacccccaacaatttcttccattcaaccaactggcatcattgaactctcctgcttatttacagcagcaacaactactaccattcagccagctagctggtgtgagccctgctgccttcttgacacaacaacagttattgccgttctacctgcacgctgcgcctaacgctggcaccctcttacaactgcaacaattgctgccattcaaccaacttgctttgacaaacccagcagcgttctaccaacaacccatcattggtggtgccctcttttagatttcttatgagttatagttcaataataaagttttt

SEQ ID NO: 29515 - DNA, 199 bp, Zea mays
  Clone ID: LIB3059-033-Q1-K1-E11
ctgctatactatactctaggaagcaaggacaccaccgccatggcagccaagatgcttgcattgttcgctctcctagctctttgtgcaagcgccactagtgcgacccatattccagggcacttgccaccagtcatgccattgggtaccatgaacccatgcatgcagtactgcatgatgcaacaggggcttgccagcttga

SEQ ID NO: 29516 - DNA, 405 bp, Zea mays
  unsure at all n locations
  Clone ID: LIB3059-033-Q1-K1-E12
cggacgcgtgggcggacgcgtgggaatctttgcgcgctnccctgctaccgggccgcgcttggcactccccatccccggctttcttcttgcaacagaacccagcattttcacacgttggcattgacacgtaccccagtgccacgcccgaggtcgaccgagcaagcttggcagaagccgttcgagcaccggcggcgcccgcgttccacagtgcatcttcggctgtggcgaaccggaccatgggcgcggaccgcgtgggtcaaggtctctagtcaggttgactcgatagataaagattctttctcttctgactcgagaccaagatcaggttgattcgagagacaaagatttttttctcctctgacgagacaaagattctttctcctcgtccagatagtgatgtctgga

SEQ ID NO: 29517 - DNA, 397 bp, Zea mays
  Clone ID: LIB3059-033-Q1-K1-E5
cacattaacaacaacttaacttcaatgcctaccaacatcttatcgcggtctggtccttcttgcactttttgcgagcgctacaaatacattcattattacacaatgctcactcgctccaagttccatcattacacacatcctaccaccagttacttcaatgggcttccaacacccaactgtgcaagcctataggctacaacaagccatttccgccagcgtcttacaacaaccaattttccatttgcaacaacaatccttggcacatctaacaatacaaaccatcgcaacgcaacaacaacaacaattcctaccatcacttaaccacctaaccattgtaaaccctgccgtctacttgcaacagcaattgcttgcatcacacccactttctcttgcaaac

SEQ ID NO: 29518 - DNA, 429 bp, Zea mays
  unsure at all n locations
  Clone ID: LIB3059-033-Q1-K1-E8
cggcgctggcgcggtccccgcgggagttcagctacaaggagctgagcgccgccgacgcggggcttcgacgcgtcccgcgtcatcggcaacggcgcgttcggcaccgtgtacaagggcatcgtgccggacacgggcgccatggtggccgtgaagcgctgcagcagcaccggcgcgcgcggcggaggcaacgcgagcggcgagcaggcgcggtcggagttcctgtcggagctgtccatcatcgcggggctccggcaccgcaacctgctccggctgcaggggtggtgctacgagaagggggagatcctgctggtgtacgactacatgcgcaacggcagcctggaccgggcgctgttcgacgcgtcggcgcccgtgctgccgtggcgccaccggcgcgaggccctggcnncgcgttgcgtcgcgcttgcgtac

SEQ ID NO: 29519 - DNA, 422 bp, Zea mays
  Clone ID: LIB3059-033-Q1-K1-E9
cccacgcgtccgcccacgcgtccgcccacgcgtccgcccacgcgtccgcccacgcgtgcgggagagttctggtgctatttgcacatatatcctctctatacacttgtaaaacactgacaattctgtatttgtatgaagtatatcataacttacaaacgttgttattccccagctacactacttgtctgttgtatattttttttttttctcgaaagcgcaggagaactgcgcgatattatattaagcatataggggtttctttttgggatcttctgagtttgagccttttcatagaatatggaaatcttgggctcctccaaaaaccaagttttttatgtggttggtcgcacacaggaaggtttggacggcagatagactgcagaaaaggggtatggaccatccaaagagatgtccactatgtg

SEQ ID NO: 29520 - DNA, 452 bp, Zea mays
  unsure at all n locations
  Clone ID: LIB3059-033-Q1-K1-F1
cccacgcgtccggcgggtacgcagagtcgctagacgcacctcgctcgcaacttgttggactcgaaggggcaatagacagcaggcagggccccgaactgcgggaggagattcccaaggatctcgtcggccgggtagaggaagggacggggacgggcgatggcggcggacggcggcggcggggtggactgggagagcctggcggaggccacctccggggcaatcggctcgctcgtcagcaccaccgtgctctacccgctcgacacctgcaagaccaagttccaggccgagctccagacgcaccagggcgctcagaagtataggaacctttcagatgtcttttgggaagcgattcgtaaaaagcaatttttgtccctatatcagggcctgaacacgaagaacattcagtcttttgtctnctcggtttttaattttatgggtatagctattttaaa

SEQ ID NO: 29521 - DNA, 233 bp, Zea mays
  Clone ID: LIB3059-033-Q1-K1-F11
aacctatagcctactatcaacaacagctccttgcatgcaaatcactcaccatgacaaactttcctatatcccaacatcaacaacagttataacaaattctaccacagatcactcactttgtcatccacaaccctattgactacctacaacagcatcaacaccttctatctacccaactcgatatcaacaatatacctacaaacatacaacaactgttcttacaacaacacctt

SEQ ID NO: 29522 - DNA, 402 bp, Zea mays
  Clone ID: LIB3059-033-Q1-K1-F12
aattggtgcactattaggtacctgttggaggatgttacaggcttattgatatccctgtgagtgactgcttcaacagtggtataaataagatatttgtgatgagtcagttcaattctacttcgcttaaccgccatattcatcgtacataccttgaaggcgggatcaactttgctgatggatctgtacaggtattagcggctacacaaatgcctgaagagccagctggatggttccagggtacagcagactctatcagaaaatttatctgggtactcgaggattattacagtcacaaatccattgacaacattgtaatcttgagtggcgatcagctttatcggatgaattacatggaacttgtgcagaaacatgtcgaggacgatgctgatatcactatatcat

SEQ ID NO: 29523 - DNA, 413 bp, Zea mays
  Clone ID: LIB3059-033-Q1-K1-F2
cggacgcgtgggcggatatggatatggacaccatcaccatcagcatgaccaccacaggatggcaccgattcgagcagggcgacgtggtggccatgccggccggcgcccagcactggctgtacaacgacggcgacgcgccgcttgtggcggtctacgtcttcgacgagaacaacaacatcaaccagctcgagccttccatgaggaaattcttgctggctgggggcttcagcaaggggcagccccacttcgccgagaacatcttcaaagggatcgacgcccggttcctgagcgaagccctgggcgtcagcatgcacgtcgccgagaagctgcagagccggcgtgaccagcgaggcgagatcagccgcgtggagccggagcacgggtttcaccagctgaatgcgtcggcgtcgtcg

SEQ ID NO: 29524 - DNA, 394 bp, Zea mays
  Clone ID: LIB3059-033-Q1-K1-F3
ccgacgcgtccgcggacgcgtggggccctcagtcctccagccacttgagcctcctaagacagtcgcatttcacccgttcatcttctcggagcttctcaacaagatggtgcgtcaccgcaatcctttggtggtggagttcatcagtgactccgacgaaatctaggaggaatcgcctgttccttctcctgcgtctcatcgatctctctccaagagaggactaggctctggccgtttggaaggggagggaccctcgatgccctcgcaacccgcgcgccaggggcgtcaaaaggttggcgccactcgttctcgccaaagcaccttctccgcttgatacccttcatgccaggaggaggatggagcgttcgacgactaggtctaacttccatctttcgac

SEQ ID NO: 29525 - DNA, 313 bp, Zea mays
  Clone ID: LIB3059-033-Q1-K1-F4
gagaccatgagctccacggagtgcggtggctgcggcggctgcgcctagacgtcgttgcctggggtggtcgggctgagcgtggaggacgccaagaaggtgatcctcaaggacaagccggacgccgacatcgtggtgctgcccgtcggctccgtggtgaccgcggattatcgccctaaccgtgtccgcatcttcgtcgacatcgtcgcccagacgccccacatcggctgataatatataagctagccgctatttcctttccttgccccagaacttgaaataaatatatatacgatgaaataacgcgggcatgccg

SEQ ID NO: 29526 - DNA, 385 bp, Zea mays
  Clone ID: LIB3059-033-Q1-K1-F5
atgatgactgccaaaatcggagagagggatagtaaagaggagctttcaaaagcgattgcgcattattgatcaagatggaaatggaaagatttctaacattgatatccagaggattgccaaagagctgggtgtaaatctcaccctcgatgagatccaagacatggtgcaagaggctgatagaaatggtgacggtgaaatagactttgacgagttcatcaggatgatgaggaggaccagctttggctactaggtgcatttatctgcgagtgcttgacgcttccagtttgtttatgactaccgtgcgtgtgttaatcaactggtgtggttactatgaacaatgtgctctggtttcgcttttatatataattttaatttaattttaatt

SEQ ID NO: 29527 - DNA, 384 bp, Zea mays
  Clone ID: LIB3059-033-Q1-K1-E1
caccaagcgaagcacattagcaacaacctaacaacaatggctaccaagatattatccgtccttgcgcttcttgcgctttttgcgagcgcaacaaatgcgttcattattccacaatgctcacttgctccaagttccattattacacagttcctcccaccagttacttcaatgggcttcgaacacccagctgtgcaagcctataggctacaacaagcaattgcggcgagcgtcttacaacaaccaatttcccagttgcaacaacaatccttggcacatctaacaatacaaaccatcgcaacgcaacagcaacaacaattcctaccagcactgagccacctagccatggtgaaccctgccgcctacttgcaacagcagttgcttgca

SEQ ID NO: 29528 - DNA, 432 bp, Zea mays
  unsure at all n locations
  Clone ID: LIB3059-033-Q1-K1-C8
ggctcttcctcggcgttgccaattcagacagccttctgtatgacgaagaatggaccagctatcttaagcagtatccagacaatttcaggtacgacaaagccctcagcagggagcagaagaacaggagcggcggcaagatgtacgtccaggacaagatcgaggagtacagcgacgagatcttcaagctcctggacggcggcgcgcacatctacttctgcggcttgaaggggatgatgcctggaatccaggacacccttaagaaggtggcggagcggagaggcgagagctgggaccagaagctggcccagctcaagaagaacaagcaatggcacgtcgaggtctactagggctcggattgctgtggttgcgacccttgatgctgccggngcagcgtcaggagacaaacacatgattgaaatgaatcgatggatg

SEQ ID NO: 29529 - DNA, 421 bp, Zea mays
  Clone ID: LIB3059-033-Q1-K1-C9
cccacgcgtccgtcttcccacaggtctgttcacaaattgcagctcagcgtgcagccgatcctgaccttgataaactatatattacaaaagtgagtagctctataggtcctgcttatgagatttttatggatattttttattacactcgtaatggttgtttccatttggcttttttgtcaaagttcatgaagaaattgtttcttatgcctagcaaacgcttcaaatgcaaggaaatggttagttgagggtcataccgatggtgctcttttaagttatgcagttgctgcctcaagctttctgcctccctttgccagagctagtaagattggaaaagctttcaattaattaacataaatgagagtgactggacaaccatatgatctctactttagagtagggactacaactacaacgaaaagaa

SEQ ID NO: 29530 - DNA, 393 bp, Zea mays
  Clone ID: LIB3059-033-Q1-K1-D10
atcaatataaccgattcctcaagagacagttgcaaataaaggatgatgcagtcgtaggattcaaaggtgaacttgctgttttggaactagaactgcaggctctggttggcctagctgaagaggttgctaattttgatgttccgttagggtctaggaagataaacggaaaatatattcaatctcatcttctctccagattagaagctgtccatgataagattatggaacaggtaaagagtgttgacgctttaaagacccaagaaattcctgtctactggattggcatggctgagaatgtgcagatcatgggttcattcgatggatggtcacagggcgaggcgatgtccatggagtattcaggtgactacggaagattctctgcgactctgaagc

SEQ ID NO: 29531 - DNA, 333 bp, Zea mays
  Clone ID: LIB3059-033-Q1-K1-D12
cggacgcgtgggcccgtgccagctgcagggaacctgcggcgttggcagcaccccgagcctgggccagtgcgtcgagttcctgaggcatcagtgcagcccgacggcgacgccctactgctcgcctcagtgccagtcgttgcggcagcagtgttgccagcagctcaggcaggtggagccgcagcaccggtaccaggcgatcttcggcttggtccttcagtccattctgcagcagcagccgcaaagcggccaagtcgcggggctgttggccgcgcaaatagcgcagcaactgacggcgatgtgcgggctgcagcagccgacttcatgcccctacgc

SEQ ID NO: 29532 - DNA, 374 bp, Zea mays
  Clone ID: LIB3059-033-Q1-K1-D2
gcgacgcgtccggccagtcgttgcggcagcagtgttgccagcagctcacgcaggtgtgaccgcatcaccggtaccaggcgatcttcggcttggtcctacagtccattctgcagcagcagccgcaaagcggccaggtcgcggagctgttggcagcgcagatagcgcaacaactgacagcgatgtgcggcctgcatcaaccgactccatgcccctacgctgctgccggcggtgtcccccactgaagaaactatgtgctgtattatagccgctggctagctagctagtagaagcatttaccggagatgattgagttataatgtgtcacgcattagcatgggtggcagtgtcagtgttagcaatgaccttgatgaaac

SEQ ID NO: 29533 - DNA, 413 bp, Zea mays
  Clone ID: LIB3059-033-Q1-K1-D4
aagtgatctggactcagagcgctggccaaactcgcactggcgttctgtgaaggttgggggggatgagtctacagctggtgataaacagccaagagtttcactctgggagattgagccactgacaacctttccgatgtacccaactgcttttccattaaggctaaagcgtccgtgggcttcaggactacctatgttcaatggtgggaggagcgacgagttcgctcgttattcttctctcatgtggcttcgagatggaaaccgaggggctcagtcactgaacttccagggacttggagcatcaccatggcttcagccaagaatagattatccattgttgagtctgaagccagatacttaccagcagatggctgccgccgcactagaagaaattagagctggggatcatttgaagc

SEQ ID NO: 29534 - DNA, 426 bp, Zea mays
  Clone ID: LIB3059-033-Q1-K1-D5
cccacgcgtccggctggccgttgcgggcgaaccgaaaatcacgggcgcgagagatcggagcacggcatgtcggaggagcagttcctcgccgtggcggtggaagccgccaagagcgccggcgagattattcgcaagggattctaccagaccaagaacgtcgagcacaagggccaggtggatttggtgacggagacggacaaggcctgcgaggacctcatcttcaaccacctccggaagcacttcccggaccacaagttcatcggggaggaggagtccgcggcgctcggggccaccgatgacctcaccgacgaccccacctggatcgtcgatcccctcgacgggaccactaatttcgtccatgggttcccatttgtatgtgtctccgttggcctcaccattgggaaaattcccactgtcggagtcgtc

SEQ ID NO: 29535 - DNA, 289 bp, Zea mays
  Clone ID: LIB3059-033-Q1-K1-D6
tcatgtcactctttatcttcatttttgctactagcattctagaaatgatgtgcggtggtcttggaattgatgactgctggaggaatgagcacttctgggtcattggaggtctgtcctcacacctctttgctgtgatccacggacttctcaaggtcatagctggtgttgatacaagcttcaccgtgacatccaacggtggcgatgatgactgagttctcacagctatatacattcaaatggactaccttattgatacctactaccaccttgcttctattgaacttcattg

SEQ ID NO: 29536 - DNA, 412 bp, Zea mays
  Clone ID: LIB3059-033-Q1-K1-D7
cgctcctcccccaaaatcccccaaaacctgacgcgctggagggccgatccggggctcgccgccgccttatccgagcagtctcctcggcccagccggggatccaagcgggatggggtacttgagctccgtgatcgggcaccccaccgatggatcctccgtcagcggcggcggcctcagccagaatggtagatttagctatggctatgcaagctcccctggtaaaagggcatccatggaagacttctatgagacaaaaattgattgtgttgatggtcagatagttggtctttttggagattttgatggtcatggcggtgctaaggtagcagagtatgttaaagaaaacctggtcaacaatcttgatagtcatccaaagttcatcagtgatactaaagtcgctatagatgatgct

SEQ ID NO: 29537 - DNA, 427 bp, Zea mays
  Clone ID: LIB3059-033-Q1-K1-D8
cactagcctacacacaccgagcgccgtctaaactgacagcaggtcagcagccgagcggagccaagacatccgccgatctcagatggccgggagaagggtgcgcggcaagagtgccgtggccgtggcggccgtcgcgctgctggcgctgctcttcgcggcgagcgaggccgactggacgtgcaacgtcgaccggggcacggtgctgaggcagtgcgcgtcctgctcgagcggcgcgccgagccaggggtgctgcgacgcgctgaggaacgccgacttcggctgcctctgcagcaactactggaacaagctcaagaacacgccatacgccagctgcgccaaggccatccctttcgcgtgcaacctgccaaacgccaagtgccagtagatggagacatggagtgcgtgacccggacagctaacgggcagc

SEQ ID NO: 29538 - DNA, 406 bp, Zea mays
  Clone ID: LIB3059-033-Q1-K1-D9
aatattttgagcattcagaaacacactaagcgaagcgcactagcaacgacctaacaggaatggctaccaagatattagccctccttgcgcttcttgccctttttgtgagcgcaacaaatgcgttcattattccacaatgctcacttgctcctagtgccattattccacagttcctcccaccagttacttcaatgggcttcgaacacctagctgtgcaagccaacatgcaacaacaagcgcttgcggcgagcgtcttacaacaaccaattgcccaattgcaacaacaatccttgccacatctaacaatacaagccatcacaacgcaacagcaacaacagtttctaccagcactgagccacctagccatggtgaaccctgccgtctacttgcaagagcagctgcttgc

SEQ ID NO: 29539 - DNA, 426 bp, Zea mays
  Clone ID: LIB3059-033-Q1-K1-B12
acgcaagccactccgaggccaagtctagggtttgggaatctgtaggaggggagaggggagcgcgctcagggtcagggaggcgaagatgatcgaggtggtgctgaacgaccgcctggggaagaaggtgcgggtgaagtgcaacgaggacgacaccatcggcgacctcaagaagctggtggcggcgcagacggggacgcgccccgagaagatccgcatccagaagtggtacaacatctacaaggaccacatcacgctcaaggactacgagatccacgacgggatggggctcgagctctactacaactaggcgccctgaccccaaccgtgccctgatgtaaggttaatccgaattctgaagtcatgggtgcgcttccagtcgcagcgtctttagctaacaagctcgcatacatataggcaacttgagtg

SEQ ID NO: 29540 - DNA, 392 bp, Zea mays
  unsure at all n locations
  Clone ID: LIB3059-033-Q1-K1-B2
ctgacagctgccaaagctacttgtgtgggatagaaatgaggagtatgagctcgtggagggttcagagagattagaagaaggtactgaccaagcatctcaaataagccaatttcttgagggatacagagcaggaagaacaacaaagaagaaaattagcggcccttctttcatgggtttcctgaattctctggtcagcttgacctcgctgtacatccttatattcgtcattgcccttctgtttgtcatggtgtactttgctgggcaagatgatactccacagccaagacgaattcatgaagagtgatggaagcttggggagcttcttgcacctgaagtgtaaagatggctaatgtaccangagatgtagctcagaggttatagatttcaaactt

SEQ ID NO: 29541 - DNA, 434 bp, Zea mays
  Clone ID: LIB3059-033-Q1-K1-B3
agtgagaccaactagcacatagaaagcacaatagtgtaccaacaatggtagccaaatattgtgcctccttatgctccttggtctttctgcaagtgctgctacgacgaccattttcccgcaatgctcacaagctcctatagcttctcttcttcccccatacctctcaccagcgttgtcttcagtatgtgaaaacccaattcttcaaccctacaggatccaacaggcaatcacagcaggcatcttacctttatcacccttgttcctccaacaatcatcagccctattacatcaattacctttggtgcatttattggcacaaaacatcagggcacaacaactacaacaactcgtgctagcaaaacctgctgcctacgctcatcaacaagcagtacctttggtgcatttgttggcacaaaacattatggcacaacaac

SEQ ID NO: 29542 - DNA, 379 bp, Zea mays
  unsure at all n locations
  Clone ID: LIB3059-033-Q1-K1-B4
ccgcacgcgtccgccagagcgcagaagaacccgatcgacaccatgagggtgttgctcggtgggctcgctctcctggctctcgctgcgagcgccacctccacgcatacaagcggcggctgcggctgccagccaccgtcgccggttcatctaccgccgccggtgcatctgccacctccggttcacctgccacctccggtgcatcttccaccgccggtccacctgccgccgccggtccacctgccaccgacggtccatgtgccgccgccggttcatctgccgacgccaccatgccactaccctactcaaccgtcccggcctcagtctcatccncagccacacccatgcccgtgccaacagccggattccagcccgtgccagc

SEQ ID NO: 29543 - DNA, 405 bp, Zea mays
  Clone ID: LIB3059-033-Q1-K1-B5
cccacgcgtacgcccacgcgttcgcccacgcgtccgcaactagcaacatagagagcagaatagtgtaccaacaatggcagccaaaatattttgcctccttatgctccttggtctttctgcaagtgctgctactgcgaccattttcccgcaatgctcgcaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacaacagttacctttggtgcatttattggcacaaaacatcatggcacaacaactacaacaacttgtgctagcaaaccttgctgcctactc

SEQ ID NO: 29544 - DNA, 299 bp, Zea mays
  Clone ID: LIB3059-033-Q1-K1-B6
cccacgcgtccgtcaacgggctttgggcatttcgcaattgctaatgatgatgtgtacgagttagctgagaatatcaaatccaagggtcgtaagatcacccgcgaacctggtcctgtcacgggacgatccactgttcttgccttagcacaagatcctcatgtctacatgtttgagcttattctgaggtctgactcacctgagtctctttgccaatatacgctattggtcttttacctttatcgtgtactaagctgtacgagatggtcctacacatgcaactcctattgatgaaggatgat

SEQ ID NO: 29545 - DNA, 407 bp, Zea mays
  Clone ID: LIB3059-033-Q1-K1-B7
cggacgcgtgggcggacgcgtgggtagcaacatagaaagcacaatagtgtacgaacgagtggcagccaaaatattttgcttccttatgctccttggtctttctgcaagtgttgctaccgcaaccattttcccacaatgctcacaagctcctatagcttcccttcttcccccatacctctcaccagcggtgtcttcaatgtgtgaaaacccaattgttcaaccctacaggatccaacaggcaatcgcaacaggcatcttaccattatcacccttgttcctccaacaaccgtcagccctattacagcagttacctttggtccatttggtggcacaaaacatcagggcacaacaactacaacaacttgtgctagcaaaccttgctgcatactctcagcaacatcagtttc

SEQ ID NO: 29546 - DNA, 364 bp, Zea mays
  Clone ID: LIB3059-033-Q1-K1-B9
aagaaaaaaaacaaataacaacataaaaagcacaataatataccaacaatgacaaacaggatcggtcgctttcttagacccaaaaggtctgtatgcaagcattagtaaagctaacatttttatacagtgctcacaatctaatatatcttccgttgtttaaccataactcaaatcagaggactcttcaatgtaccaaattacaattgcttaaccctactcgatccaacatgcaatcgcaacaagcctattaccattatcacgcttgttcctccaaaaaccgtgacccctattacagcaaatacctatggtcccatttatggcacaaaaaatccggccacaacatctacaacaacttgtgctacca

SEQ ID NO: 29547 - DNA, 423 bp, Zea mays
  Clone ID: LIB3059-033-Q1-K1-C1
ccgacgcgtccgattaagaccaactagcaacatagaaagcacaatagtgtaccaacagtggcagccaaaatattttgcttccttatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagccagttcttccattcaaccaactg

SEQ ID NO: 29548 - DNA, 399 bp, Zea mays
  Clone ID: LIB3059-033-Q1-K1-C10
gaaagaaaagatcagagattgtaaatgtgcttctgctccttccggatatgaacgtgagtgcgttgaccagggatcggaagaccgcgttcgacatagccgagggccttcccctgtcagaggagtctcaagaaatcaaggagtgcctgtcccgtgccggtgcggtcagagcaaacgatctgaaccagcctcgggacgagctgaggaaaacagtgacagagataaagaaggacgtgcatacccagctggagcaggcgaggaaaaccaacaagaacgtgtacggcatcgccaaggagctgaagaagctccacagggaaagcatcaacaacgcgacgaactcggtgaccgtcgtggcggtgctgttcgcgacggtggcgttcgcggcgatcttcacggtgcccg

SEQ ID NO: 29549 - DNA, 412 bp, Zea mays
  Clone ID: LIB3059-033-Q1-K1-C12
cggacgcgtgggtgccggccggcgcccagcactggctgtacaacgacggcgacgcgccgcttgtggcggtctacgtcttcgacgagaacaacaacatcaaccagctcgagccttccatgaggaaattcttgctggctgggggcttcagcaaggggcagccccacttcgccgagaacatcttcaaagggatcgacgcccggttcctgagcgaagccctgggcgtcagcatgcacgtcgccgagaagctgcagagccggcgtgaccagcgaggcgagatcgtccgcgtggagccggagcacggctttcaccagctgaatccgtcgccgtcgtcgtcgtcgttttcgttcccatcgtcacaagtccagtaccaaacgtgccagcgcgacgtcgacaggcacaacgtctgcgccat

SEQ ID NO: 29550 - DNA, 415 bp, Zea mays
  Clone ID: LIB3059-033-Q1-K1-C3
attgagcttctgtaaattagagaacaggataatctctgttgagcgcatttatcaatattgcaggcttcctagtgaagcaccattgattattgagaactgccgtccaccatcatcatggcctcagaatggaaacattgaactgattgatctcaaggtccgctacaaggacgatctaccattagttcttcatggtgtaagttgtatgtttcctggcgggaaaaagattgggattgtagggcgtactggaagcggtaaatctactcttattcaggcccttttccgcctaattgagcccactggagggaagattataattgacaacattgacatctctgcaattggccttcatgatctgcggtcacggttgagcatcattccccaagaccctacattatttgagggtactatcagaatg

SEQ ID NO: 29551 - DNA, 228 bp, Zea mays
  Clone ID: LIB3059-033-Q1-K1-C4
caaggacaaggacgaccccaacctgggcatcaagatcaacgccaccctcgcgctcgggctcggcaacgcctgcggcgccacccgcgccaacgtctcccactgcgctcagctcctgcatattcccccgggctccaaagacgccgccgtcttcagcccccggcggcgacaagggctccactgccgctccagccaaggacaactcgacggcgacgacccgactccgcgcgc

SEQ ID NO: 29552 - DNA, 342 bp, Zea mays
  Clone ID: LIB3059-033-Q1-K1-B10
gcatagccatcttcttcgtcgacaagcttgggagttaggtctcacatgcatgcttcagcacagtgttgactgcataacgaaacacattgtcgtcggatcggagatgatgagttctgtcgtctgtgatgcttatgccttcaattgggcttttctttgcttcggtgttctggtctcgtctgggtttcagactccagatttggagcataagacaccggtccttggtttccttgccgccttgccggctgcaatgttatggcgcttgcggtgttatgtatagcctgaattctgtgatgacggtgaagttctcgttgttgggaaattttttctgtgctttctcttttc

SEQ ID NO: 29553 - DNA, 368 bp, Zea mays
  Clone ID: LIB3059-057-Q1-K1-A3
agggaacagaactttatggcagccaacgagatcattgagctcttctgcgagctgattgttacacgccttcctatcatcgcaaaacagaaggaatgtccagcagacttgaaagaaggtatctgcagtttgatatttgcagctccaaggtgctctgaactccctgaacttggtcgcatacgtgacatttttgaaaagaagtatggcaaagattttgtttctgctgcagttgacttgcgcccagatgctgctgttaacaaccttctgattgagaagctgtcgattaagaagccttccgggcaaattaaactgaaagttctgaaggatatagcaaaagagcatcagattgattgggataccactgagagtga

SEQ ID NO: 29554 - DNA, 388 bp, Zea mays
  Clone ID: LIB3059-057-Q1-K1-A4
gtgaattcggcccgaggttgaaggaccatatgcagtattgtgttaatcatccagaggaaattaacaagctctccaaggttaaagcccacctatcggatgtcaaagggatcatgatggacaacattgaaaagatattggatcgcggggagaagattgagcttttggtgggtaagacagagaccctacagtcacaggcggacagcttccacaggcatggcagagagttgaggcgaaagatgtggcttcagaacctgaggtttaagctgatggtgggtggcggcattgcggctctgatccttatcatttggctgatggtctgcaagggattcaaatgttagagcacaccaagttgctcgccttttttttttcttttcaagcgtttgatatg

SEQ ID NO: 29555 - DNA, 344 bp, Zea mays
  Clone ID: LIB3059-057-Q1-K1-A5
cggacgcgtgggtgagccaagagctactaggatctttcatgctgaacttctggtttggggttggccacatacatcatccaaaaaactttattattgaattacaactaataagcaatctaaaagagggcaccaccaatgatgtgttgttggtaggaggccgctggatctgtcaaagcaagttggacaaagggcaacaattgttgtagttgtaacagggttgcggggttagccgcaaactgctggtagaaaggccgcaactgttgctgtgtcaagaaggaaacacggtttgctgcaactagctggctaaatggtagtagtatttgctgctgcaaataaacagcggg

SEQ ID NO: 29556 - DNA, 431 bp, Zea mays
  Clone ID: LIB3059-057-Q1-K1-A6
agcttcccttgttcccccataccttacatcaatgatagcttcagtatgtgaagacccagctcttcagccctataggctccaacaagcaatcgcagcaagcaacatacctttatcacccttgttgatacaacaatcgccagccctatctttggtgcagtcattggtacaaaccatcatggcacagcacctgcagcaactcgtgctacctgtgatcaaccaagtagctctggcaaacctttctccctactctcagcaacaacaatgtcttccattcaaccaactgtctacactgaaccctgctgcttatttgcagcaacaactattaccattcagccagctagctactgcctactctcagcaacaacgacttcgtacatttaaccgaatggccggactgaaccccgctgcttatttgcagcagcaaatactac

SEQ ID NO: 29557 - DNA, 323 bp, Zea mays
  Clone ID: LIB3059-057-Q1-K1-A7
ggacatagacagtggaatccaatatcatcaatctatcaaccaaggcgaccgatataggccttcttcttatgctccttgctatttctatgtgtattactctcgcgacaatgtatcttcaatgcgctcaagctactatcactgtgctctgaactccatacacttcatcacttacagcacctttatgagaaaacccatctcttaaaccctatatgttctaacaatcacttgcacccagatgcttacgttaataaccctcggatcgacaatctgcagccctatatttcgtgcagtcattgttacactccaagactgcacagatatat

SEQ ID NO: 29558 - DNA, 306 bp, Zea mays
  Clone ID: LIB3059-057-Q1-K1-B1
ttccgaggctacgacgtcacgcgacaagctctaatcttttcgtttttgctactgttactggttttaattgtcactcggagtctgggaactatttatatcttggttcctttttagttgtcaagtgcatgtttctgaacatcattggtcatactgtactatccaattgctgttaaaacattttttccaataattcgtatggtaccatttgttaaaaaaaaaaacataaaaaaaaaaaaaagaaaaaaaaattaataataataatataaaaataataaaaataaacataataaaaattataaagcataa

SEQ ID NO: 29559 - DNA, 323 bp, Zea mays
  Clone ID: LIB3059-057-Q1-K1-B11
agccttctatcagtaccatcaatcatcattcatcttagtagtataggggccaaatgaaatctgcaacatcaattatctaactccaaaaaccatgaagctggtgcttgtggttcttgctttcattgctttagtatcaagtgtttcatgtacacagacaggcggctgcagctgtggtcaacaacatagccatgagcagcaacatcatccacaacaacatcatccacaaaaacaacaacatcaaccaccaccacaacatcaccagcagcagcaacaccaacaacaacaagttcacatgcaaccacaaacacatcagcaacgacaag

SEQ ID NO: 29560 - DNA, 384 bp, Zea mays
  Clone ID: LIB3059-057-Q1-K1-B12
gaaggatccaggagacttgagtggattctaaagaagattgctggtggttctgagcgcaccctccgtgcaaagctgacattttctcaggagtcacatgggaatatcacaaaggaagctggcccagtgaacatgaatttcactataccgatgtacaatgcatcaaagttgcaggtcaggtatcttcagatcgcaaagaaatcgaaggcatacaacccttatagatgggtgcgatacgttacacaagccaactcctacgtagctcgtctatgaggaatcagcatctgtactcttgtttgcagtccattttttatgggtgtaatatttgagcgttatcatggacatagtggcgtgtattgtgtaactgtatattgaggttcgcatacc

SEQ ID NO: 29561 - DNA, 229 bp, Zea mays
  Clone ID: LIB3059-057-Q1-K1-B2
aacaacagttgttgccgttctacctgcacgctatgcctaacgctggcaccctcttacgactgcaacaattgctgccattcaaccaacttgctttgacaaactcaacagtgttctaccaacaacccatcattggtggtgccctcttttagattgcttatgagttatagttcaataatgaagttttttggatgatgtttgtggcgtcccagaaataagaaagtacatttct

SEQ ID NO: 29562 - DNA, 302 bp, Zea mays
  Clone ID: LIB3059-057-Q1-K1-B4
ctttctgcaagtgctgctacggcgaccattttctcgcaatgctcacaagctcctataggttccgttcttcccccgtacctctcaccagtgttgtcttcagtatgtgaaaacccaattcttcaaccctacacgatccaacatgcaattgcatcaggcatcttacctttatcacccttgttcctccaacaatcatcagccctattacagcagttacctttggtgcatttattggcacaaaacatcagggcacaacaactcgtgctagcaaaccttgctgcctactctcagcaacaacagttacc

SEQ ID NO: 29563 - DNA, 217 bp, Zea mays
  Clone ID: LIB3059-057-Q1-K1-B5
ccggttcggattccaggtacgacgtcacgcgtcacgctctaatcttttcgtttttgctactgttactggttttaattgtcactcggagtctgggaactatttatatcttgtttccttttagttgtcaagtgcatgtttctgaacatcattggtcatactgtactatccaagtgctggtgagacacttttttctatcaatcgtgatgtaacagttggt

SEQ ID NO: 29564 - DNA, 386 bp, Zea mays
  Clone ID: LIB3059-057-Q1-K1-B6
caatgatgactggaagaaacgaaaggaagcacagagcctgaagaggctcgaggttaagaagaagaggattgagaggaggaactctctcgcctgcaacacttcaaaagaagctgctgggcagagtccaaaagagatgaatgcaaacactgacaaattagtaagttctgatgaaactattgtcagcgctaacgaaagtcatagcagtggcaagcatctggtgaaggggcttccaccaaagtaccaggccacaattacatcagaagacagttcgtcagcaatgcgaaagaagccaaactcggccttcaaaggaacagccatcactgaagagcagaactcatcatcgtctgttccttccttcggtgaagctataagtagcgtgacggcac

SEQ ID NO: 29565 - DNA, 199 bp, Zea mays
  Clone ID: LIB3059-057-Q1-K1-B7
gaataatcaaagtggcagcctaaacattgctgagaggccagaccacgtaagggtaacgagaatacagtgaaatgcctagcaatctgtagggaaggataaactgaatgaacaagacaaggacgacttacaggtggaccatcccgtacttaaccaggttacacactttgaggataggaaactgactaccatcaaagctgga

SEQ ID NO: 29566 - DNA, 384 bp, Zea mays
  Clone ID: LIB3059-056-Q1-K1-G5
gtcagcgttgaagggctcccacttcattgaattgtgcgctcagcggcatatgccttggattttccttcaaaacattactgggttcatggtcggatcaaagtctgaagctagtggaattgccaaagctggagcaaagatggtcatggcagtttcctgtgctaaggttcctaaaattacaataattgttggtggaagttttggggctgggaattatggaatgtgcggacgtgcatatagcccaaactttttatttctttggccaactgctaggatatctgctatgggtggcatccaggcagctggagttctcgctcaaatagaatagaacaacataaggagacaaggagtggagtggagcaaggacgaggaagaagccttcaaagc

SEQ ID NO: 29567 - DNA, 393 bp, Zea mays
  Clone ID: LIB3059-056-Q1-K1-G6
attttgagcattcagaaacacaccaagcgaagcgcactagcaacaacctaacaacaatggctaccaagatattatccctccttgcgcttcttgcgctttttgcgagcgcaacaaatgcgtccattattccacaatgctcacttgctcctagttccattattccacagttcctcccaccagttacttcaatggccttcgaacacccagctgtgcaagcctataggctacaacaagcgattgcggcgagcgtcttacaacaaccaattgcccaattgcaacaacaatccttggcacatctaacaatacaaaccatcgcaacgcaacagcaacaacagttcctaccagcactgagccacctagccatggtgaaccctgtcgcctacttgcaacagc

SEQ ID NO: 29568 - DNA, 423 bp, Zea mays
  Clone ID: LIB3059-056-Q1-K1-G7
cccacgcgtccggttcttagatcgattgctcgccaggctgttggcgaggagtcgtcgaccctcacggcagccatgtctgtggagctcatcctgtggcttttctccttcgtctccgtcatggtcctcatcggcctcaccgcataccagcttatctgtctgtcagatttggagtatgattatatcaacccatatgattcatcgtctcgcatcaacgctgtggtgctgatagaatactcactccaaggggccctgtgtgcttctttcctcttgacattgcattggttcccgtttctagtcatgacaccagtaacatactaccatgtcaaactgtatttggctcggaaacatcttgtagatgtcactgaaatttttagacaattaagtgacgagaagaagtacaggatgatcaagcttgccttctac

SEQ ID NO: 29569 - DNA, 425 bp, Zea mays
  Clone ID: LIB3059-056-Q1-K1-G8
cggacgcgtgggattacgttaactcgagggagatatcatgcgaactggtcttggatgcttatcccaaagggtacacaattgtgccaactaccatccaccctggggaggaagcaccttttgttttgtcagttttttcaaaagcatcaatcagactagaggctgtttaattcaagattgagatcccatgtgtttggtggtagctgcgtctgctgggcagggtttcttctcacccgtgcacgcaggatccagctgtgggttctcgggaactagataatgggtataggaattgcctcctggacaacttcaatcaatcttgctgcatgcaagtacataagttcggttgcttgttgcagaactgacaaactgcaatgcttcttgtgctgaagggaaaggagagaaggtatgatccatggttctttggtagc

SEQ ID NO: 29570 - DNA, 439 bp, Zea mays
  Clone ID: LIB3059-056-Q1-K1-G9
cggcaccatcctgaggctgtttcggatctcctcgggggtccaagacggcacagcaagtcgccgccacgctgcggacatgcgaggctgagtccccagaggctcatgcctgcgccacctccgagcaggcggcggccgacttcgctgcctcctagctcggagtcagggccagcaagctggtcgcgctcgtcaccaccgtccatggtgggaaggacgccactagatacgtggtggcgcccaacggcatcacacgcatgggcaaggcggcaggctccagagccgtagtgccgtgccacccgatgccgtacccgttcatggtccactactgccaccagccggcggacgtggaggcgctccgagctgagctgaccgggctcggagactgcggcgtgacaaccacgatcgccatgagccacgccaacaccatgaactgggacgatcg

SEQ ID NO: 29571 - DNA, 423 bp, Zea mays
  unsure at all n locations
  Clone ID: LIB3059-056-Q1-K1-H1
ggccatggcaaaggtggtggaattgggcatgacatgggtggtggattcggcaaaggcggtggtggtcttggcggcggtagtggctacggtgctggtggcggcgggggccttggtggtggaagtggacatggcatgggtgccggattcggcaagggtggtggtcttggcggcggcgatggccttggcggtggaagtgggcatggcatgggtgccggattcggcaagggtggtggtcttggtggcggcggcggcggaggtggtggcggcggcggcggtgggtttggcaaaggatttggctttgggtttggcaaaggcagcgggttcggtggtggtggcggcggtgggggcggcggcggcatcggtgatcaccattgatacgtcagcatgcagcatacgtctnctatggttctatcacttactttt

SEQ ID NO: 29572 - DNA, 416 bp, Zea mays
  Clone ID: LIB3059-056-Q1-K1-H10
cggacgcatgctcagactctttcgcattcgcgtgggtttatcaacctcggggctacaggaaccgtcactcctatcacaccaggctcctttcgtgcatgcgcaggcacaaaacatctacgcacaacaactacaacaacttgctctatgaaaccttgctgtctactctaagcagctgcactttcttgcattcaaccaacttgctgcataggactctgctgcttacttgcaacaacaactaccattcactcacatagctgctgcctaccggcaccaattcgttccattcaaccaactgacaccattgaactctgctgctcatttacaacagcaacagctaccaccattcacccagctagctgatctgagccctgttgcctacttgacacagcaacagttgatgccgatctacctgcacg

SEQ ID NO: 29573 - DNA, 433 bp, Zea mays
  unsure at all n locations
  Clone ID: LIB3059-056-Q1-K1-H11
cggacgcgtggggcaggatttcataatttttggttcagcagttttggagatatcgaattttaaagttaaccatactgctgtctaaaatagattcagtcagttatcttgtcagatgttttagaacttgtagatggcagaatttaattatctattgaatactgaagttgtagagtattttgtgtagatactcctagagtatttgtttgatatcaccgctgttttaattttaaagatacaaaattaacaaacagcgttgctgctgtatggcatgtggttcagggtgggagtctttccactgggtcttggtttcaagtgtaggagtgttttgttgattgatggcaaatgtttgtgaaatatttgtactaagttttatgcccactagcangtggctacactccagatcatgtctagtacatttcttctcttcgatgaa

SEQ ID NO: 29574 - DNA, 307 bp, Zea mays
  Clone ID: LIB3059-056-Q1-K1-H2
attccacgccacgcagtccggggcattacgaaactggtggaatcgttcatgacttgggtggtggattcagcaaacggggatggggtcttgtcagaggtagtggctacagtgctagtagccgcacgcagcacttggtggtggaagtggacatggcatgcctgccggattctgcaaggatgcttgtcttggcggatgctatagccttggctgtgcaagtggacatcgcatgcgtgcctgattctgcaagggttgtggtcttgacggctgcagacgatgacgtggttgctgccacagatgttgacttgtc

SEQ ID NO: 29575 - DNA, 421 bp, Zea mays
  Clone ID: LIB3059-056-Q1-K1-H5
cccacgcgtccgcccacgcgtccgtgtgattgctcagcagtgcagtagtgatcttctgcaaggggagttggagaggactcgattgaacatagcctgtttcatggagtcgacccttcaaccaacagctgcgccagcaggcccaaagcctgccgcacattcttcttaccaagcacagcatgctcccgtccaaacgtcctcgcctagttttagaaggcagcagactggtacaagttcccctgtagtctccaggcggcgccggtgagcttagtgcatcttcccatcattggcgtagcctcttcccggagtttccttccttttcccccctcacatgtgtgctttttttttaatctcttgtaattgtcatcctgttgtcatgtgttacgaatttcgatccattcttttggtgttgtataagatgaaa

SEQ ID NO: 29576 - DNA, 291 bp, Zea mays
  Clone ID: LIB3059-056-Q1-K1-H6
agaagactttcttccagaaacctgaatcagaggcatgagtctccaggctgaaaaatgctgcaaatctgcaactttggtacaccacttttgtccgggatgattcctgatgataactcaacaaataatatgagacccactcgtctttccttgattgattttattcagatgtacgcattcctcttgcatgtaatattcacgaggtgagtgtagatcatttgacttgtttatcatcacacagagaaactgcttgcttcaaccgtgttatatggtcatgatggcatctctaaaata

SEQ ID NO: 29577 - DNA, 375 bp, Zea mays
  Clone ID: LIB3059-056-Q1-K1-H8
ccgagccggccgtgtccgtgcagctcggcgaccacggccacctcgcctactcccacgccaaccaggcgctgctccgccccaggtcgttcgcggccaaggacgaggtgttctgcctgttcgaaggggtgctggacaacctgggtcgtctgagccagcagcacgggctgtcaagcaagggcgccaacgaggtgctcctcgtcatcgaggcctacaagacgctgcgcgaccgcgcgccctacccggccagcttcatgctcgcccagctcaccggctcctacgccttcgtcctcttcgacaagtccaccaactgcctgctagtcgcatccgaccccgagggcagggtgccgctcttctgggggatcaccggcgacggct

SEQ ID NO: 29578 - DNA, 436 bp, Zea mays
  Clone ID: LIB3059-056-Q1-K1-H9
cgacaccatcctgaggatgtttcggatccctcgggggtccaagaaggcagagcaagtcgccgccacgctccggacatgcgaggctgagtccccagaggctcatgcctgcgccacctccgagcaggcggcggccgacttcgctgcctcctcgctcggggtcagggccagcaagctggtcgcgctcgtcaccaccgtccatggggggaaggacgccactagatacgtggtggcgcccaacggcatcacacgcatcggcaaggcggcaggggccgcggccgtagtgccgtgccacccgatgccgtacccgtacatggtccactactgccaccagccggcggacgtggaagcgctccgtgttgagctgaccgggctcggagacggtggcgtgacaaccgcgatcgccatgtgccacgccaacaccatgaactgggacgat

SEQ ID NO: 29579 - DNA, 359 bp, Zea mays
  Clone ID: LIB3059-057-Q1-K1-A1
cccacgcgtccgtttttttttttttttttttttttagaatctggaaatgtaacttctgatttctggttggccacatacatcatccaaaaaactttattattgaattacaactaataagcaatctaaaagagggcaccaccaatgatgtgttgttggtaggaggccgctgggtctgtcaaagcaagttggacaaagggcaacaattgttgtagttgtaagagggttgcggggttagccgcaaactgctggtagaaaggcagcaactgttgctgtgtcaagaaggaagcacggtttgctgcagctagctggctaaatggtagtagtatttgctgctgcaaataagcagcggggttcagtgc

SEQ ID NO: 29580 - DNA, 332 bp, Zea mays
  Clone ID: LIB3059-057-Q1-K1-A10
gtcatacagtgttccctttttcatcacacgtttccgtgaggcgctgatgcattacggtgcattggttgacatgctagagacaactgtcccactggatgatgcacagcgagcactcatagagagggaaatgtttggccgataggcactcaatgttattgcatgtgagggctcatacagagttgagagacccgagtcatataaacagtggctggtgatgaacctgagggctggatatgttcaagccccgtttaaccaagaagacgtgatgaaagcctatgacaaatttgaagacatttatcacacggactttgtcatatatgaagacagcgtat

SEQ ID NO: 29581 - DNA, 407 bp, Zea mays
  Clone ID: LIB3059-056-Q1-K1-G4
caggaaagtgttcgtcctcatggcgcctccgcagccgaagtagggcctcttcctgggcatcaacaagggccatgtcgtcaccaagcgcgagctgcctctgcgcccgtcccaccgcaaggggaaagcaacgaagagggtgtacatggtcaggggcctgatcagagaggttgctggctttgctccttatgagaagcgtatcaccgagcttctgaaggttggcaaggacaagcgcgctctgaagcttgccaagagaaagcttggaactcacatgagggcaaagaagaagagagaggagatgatcggcgtcctcaggaagatgagatcggctggtacgcacactgacaagaagaaataaagcatttcaagtacatgaatgtggcaaccagagattatcaactgtgttcttt

SEQ ID NO: 29582 - DNA, 428 bp, Zea mays
  Clone ID: LIB3059-056-Q1-K1-F1
ctagcaacatagaaagcacaatagtgtaccaacaatggcagccaaaatattttgcctgcttatgctccttggtctttctgcaagtgctgctaccgcgaccattttcccgcaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgctgcttatttgc

SEQ ID NO: 29583 - DNA, 401 bp, Zea mays
  Clone ID: LIB3059-056-Q1-K1-F11
gtgtcgaccaccatgagtggaaccccatggtggacgtgcacctgccgtcggacggctagaccaactacttgctcgagacactcgaggctggaaagcggcagagcacggaggccctgctatagcagctgttcctggaagtgcacgacgacgtgcgattgctccacttcatgaaacgtctggatggacagaatgtcgtgtacatcatgcgggacgcgatggcagtggatcgtggatgcaggacgtgcagatgatgatgctaggcacctgacgcgcagacatggaacgaatgctgcagcactcagagcgtgagcatactaacacgtgccgctgatagatcgggttctctgagcctatggtgcatcgtatcacagcagccgcagacgtgctgatgataccaactg

SEQ ID NO: 29584 - DNA, 426 bp, Zea mays
  Clone ID: LIB3059-056-Q1-K1-F12
gacctgtacgtgatgaatgttaatccttggctgtgatgaaaagttttagtgtcagtggttcagacccttcaaaacaggagaagtttttggcatacatggccccagcaccccatgagctcgccagagacttggatgatgaaaacgatgatatccagtattcctggctaatagaatatcactgggaagtgagaggagatgataaagatgatcctacaacataccttgtcacatttgataaggaggagggtgcaaaatatttgcctctccctactaagctagttttgcagaagaagaacgctaaagaggggaggtctggcgatgaaattgagcattttccagtaccttcccttattactgtgaacaaaacaggtcatgtcggtaccatggatcgcggagaatcttctggcatgcatgtgaattcaaagc

SEQ ID NO: 29585 - DNA, 379 bp, Zea mays
  Clone ID: LIB3059-056-Q1-K1-F2
cccacgcgtccgcccacgcgtccggccccgatatcgtaacacattcacaggctcggctcccttctggttgtgcgttgcattcctttctggtctgatgcatctcattattctccatcggtgatgattggtaatccgatatggggggtgcaagtatagttacgttgtacaggaacgatgcattgcagtgtacatattccaaaatgaaatcattttacacacttcgaagggcatcgatgtctgaagctggttttctcgtgcaatactttcagagtcaacactacactgccctggttatccattcagcatgtatggtggtgtccaacaaagacccattccttgtgaaaaaatcttagcactggctccttcaatacgaaagaaa

SEQ ID NO: 29586 - DNA, 403 bp, Zea mays
  Clone ID: LIB3059-056-Q1-K1-F3
atcaagtaggacccggtgcaacgagccaccgtttaattcctagggttcttggagtgttgtttttttctctctcgtcgtcgagtcaaaaaaagaaaaaagaaaagaaatggtcaaaacgcgcggacagtgagtttggacgtctgtgtatttcggtgacctgtgttttttttttctctggagggcttttggtccgcatgtaatttagccgggtttgtgacttgtgactttgtgagtgagtagcggagtttagaagcggtagaagaatatgggtctagggataggtgaagtcagaatcaggacaaggtttttcgtttgttttcatccttcttttttcagttttttaagatgatgcttttagttttgctaaaaaaaaaaaattaaataaataataaccgatataact

SEQ ID NO: 29587 - DNA, 370 bp, Zea mays
  Clone ID: LIB3059-056-Q1-K1-F4
ggaaaccctagccgccatatctcacgatccactcgagcaccaagccgagggaaggtgaggagcgatggcgcgcggcgtggtgtcggcgaagggcggcgcggtcgcgggcaagaagaaggggtcggtttccttcacgatcgactgcaccaagccagtggaggacaagatcatggaagtcgcctcgctcgagaagttcctgcaggagcgcatcaaggtcgccggcggcaaggctggcaacctcggcgactccgtcaccatctctcgcgagaagaccaaggtcaccgtcacctctgacggacccttcttcaagaagtacctgaagtacttgaccaagaagtacttgaagaagcacaacgtgcgggattggcta

SEQ ID NO: 29588 - DNA, 425 bp, Zea mays
  Clone ID: LIB3059-056-Q1-K1-F5
cccaggcatatgcgggctggactcaattgaagtcctgcagagcctagcccaggcgtttcaaaaggttttactcgcagtgaagtcaactgttggcgcacaagcaacagctaaatcgaatgctgtcacttctcttcagatggcacgatttaggctagtgctggacatgataagactgctgtactttggagcatggaacattttcagacacagtatacaccacaagagcatgcccttattatcactgatgtccgtttcaggcctaactctagtcacttggcaacatgtactttagatagaactattaaattatggattgctgccgatcctggattctatgtgcatacatacactgggcacaacggacagatcacatcattagatagtcatccaaagcaaacagaccttctatgctcttgtgattgcag

SEQ ID NO: 29589 - DNA, 407 bp, Zea mays
  Clone ID: LIB3059-056-Q1-K1-F6
cgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctacggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcggcgttggcagcaccccgatcctgggccagtgcgtcgagtttctg

SEQ ID NO: 29590 - DNA, 305 bp, Zea mays
  Clone ID: LIB3059-056-Q1-K1-F7
caatagcgaaatcgtccctgattgtattattgcatatacacagatatgctaggcatagctcttactgtgattatacatgaactattcattcaatgaatggtcagattattgtccataatgtacggaattggcaaaagggaaaaccgtttatcctgttaattaattttttttaataatatatgaacccattttaattattgtactaacattaacagtaaggttcttattaaatacttaatacaaggggccctgtctgcttcttttctcttgacattggattgggtcccgtttctagtcataacaac

SEQ ID NO: 29591 - DNA, 406 bp, Zea mays
  Clone ID: LIB3059-056-Q1-K1-F8
ctttgttggaaggaacgatggagcagtccttcatcatgatcaagcccgacggcgtccagcggggcctgatcggggacatcatcagtcgcttcgagaagaaagggttctacctcaaggggatgaagttcatgaacgtggagaggtccttcgcgcagcagcactacgctgacctttccgacaagcctttcttccccgggttggtggagtacatcatttccggccccgtggtggcgatggtgtgggaggggaaggacgtcgtgttgactggccgcaggatcattggggccaccaggccttgggaggcagcccccggtaccattcgtggggactacgccgtggaagtcggcaggaatgtcatccatggaagcgactccgtggagaacgggaagaaggagatcgctctctg

SEQ ID NO: 29592 - DNA, 312 bp, Zea mays
  Clone ID: LIB3059-056-Q1-K1-G1
cccacgcgtccgctcgattctgatagattatcttctagtataccttgtgttgttgctgttgttgtcgtcgtcgcgccggtgtatgcgatgaagctgccattgctgctgttttaattaagcattctagatgttataccgcatgctttgtttcggtttctatgtcgataaatggtggccggatgctggttttcgtgctccgagccggccaccaggaagaagacctgcctgcccttgtgggtgcagcgttgttagaatgacctacggtgtatttgactttgacaggcctgctgcctagtggactgatattctgtt

SEQ ID NO: 29593 - DNA, 432 bp, Zea mays
  Clone ID: LIB3059-056-Q1-K1-G10
atccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacattgaaccgtgctgcttatttgcagca

SEQ ID NO: 29594 - DNA, 419 bp, Zea mays
  Clone ID: LIB3059-056-Q1-K1-G12
ggagaactgcctgcccctgctccctcttccgctcctccccgcgccccgctcgccatccccagacttcatttcaggccgggatggacgactacgcccgggagatgatggagctcaagacgctcgtcacccgcaccctcgagaagaagggcgtcctcgccaagattagggctgagctaagagcaagcgtgtttgaagccattgaagaggaggatcggctggagaatgatgatggagggaaccctgctttgcttggtagctgcaatgaccgagctaagcaactgcatgcttcaccttcaggtaggttactaactgcacttgtatgcgaatacttggagtgggcgcaactaagtcacacactgaatgtttacttgccagagtgtaacctgcccaaggacttctggaagaatgaactgaaagac

SEQ ID NO: 29595 - DNA, 356 bp, Zea mays
  Clone ID: LIB3059-056-Q1-K1-G2
caacaagcaacatagcaagcggcatccagtggcaacaatagagcaacaatggagaccacgatggtgaccctgcttatgctccttgctatgcctacatgtgttgctaacgcgacagttaaccctacatgctcacatgctcgtatagctgcccttattgctccataccttccatcaatcatagcatcagtatgtgaaaacccagctgttcaaccatataggctacaacatgcaatcgcagcaggcaacataccttgatcgacctcgttgtgtcaacaatcgccagccctatcttcggtgcaatcattggtacaaaccatgatggcacaacagctgcaacaactcgtgctacctgtgat

SEQ ID NO: 29596 - DNA, 424 bp, Zea mays
  Clone ID: LIB3059-056-Q1-K1-G3
cggacgcgtggggcaaaaattttcttcagtgctgcagttgaagcctgggatgcaaaagtttatgtcaaagttgaagataacattaatcttgacttagctgggttaattgagatgctcgaaggccgtccaggtagccaaggattgtacatgggttgtatgaaatcagggatggtcataagtgaagagggccaacaatggtatgaacctgagtggtggaaatttggagattcaaaaacgtattttcgacacgcttctggttctttgtttatcctctcaaaaaatttggctcgctacatcaacataaatagcgcgtcactgcagagttatgcacacgatgatatatcagtaggttcatggatgatgggactgaatgcaacttacgtggatgatgaccggttgtgctgcagcagttccagacaagaga

SEQ ID NO: 29597 - DNA, 441 bp, Zea mays
  Clone ID: LIB3059-056-Q1-K1-E9
cggacgcgtgggcggacgcgtgggcggacgcgtgggcggacgcgtgggtgaggatctggagagttgggatgccttgagagctgccttgcccgttggaacagtcagtggtgcaccaaaggtgaaggccatggagttgattgataagttggaagttacgaggcgaggaccatatagtggtggtctaggaggaatatcgtttgatggtgacatgcaaattgcactttctctccgcaccatcgtattctcaacagcgccgagccacaacacgatgtactcatacaaagacgcagataggcgtcgggagtgggtcgctcatcttcaagctggtgcaggcattgttgccgacagtagcccagatgacgaacaacgtgaatgcgagaataaggctgctgcactagctcgggccatcgatcttgcagagtcagcttttgtagacaaaga

SEQ ID NO: 29598 - DNA, 331 bp, Zea mays
  Clone ID: LIB3059-032-Q1-K1-H5
agcaacatagaaagcacaatagtgtaccaacattggctgccaaaatattttgcctgcgtatgctccttggtctttctgcaagtgctgctacggcgaccattttcccgcaatgctcgcaagctcctatagcttccattcttcccccgtacctgtcaccagcggagtcttcggtatgtgaaaacccaattcttgaaccctacaggatccaacaggcaatcgcagctggcatcttaccttgatcacacttgttcctccaacaatcatcagccctattacaacagttacctttggtgcatttattggcacaatacatcatggcatcatcaactac

SEQ ID NO: 29599 - DNA, 334 bp, Zea mays
  unsure at all n locations
  Clone ID: LIB3059-032-Q1-K1-H6
aacaaagttaggtttatccgctgtgttgttgataatgaaattatagttaacaaccggaaaagggcagatctatttttggagcttcggcagaagaattttgatcctttcccaaagaaaaaaaagagggctgaaccagctgctgtaggtgctttagaagaggaggaaaatgaagagagtcctgaagctgctggagcggaacctagtgactatgagtatctcctctcaatgtcaattggtacgttgactttggaaaagatacaggagcttaatgctgagaaacataaattagtggatgatngtgaggaattggagaatatgtcaccaaaatcactat

SEQ ID NO: 29600 - DNA, 387 bp, Zea mays
  Clone ID: LIB3059-032-Q1-K1-H7
cccacgcgttcgcccacgcgttcggccacgcgtccgattgagaccaacaagcgacatagaaagtggaatccagtagcaacaatagagcaacaatggcgaccaagatattttccctccttatgctacttgctctttctgcatgtgttgctaacgcgacaattttgcctcaatgctcacaagctcctatagcttaccttcttccaccataccttacatcaatgatagcttcagtatgtgaaaacccagctcttcaaccctataggctccaacaagcaatcgcagcaagcaacatacctttatcacccttgtttcaacaatcgccagccctatcttttgtgcaatcattggtacaaaccatcagggcacagcagctgcagcaactcgtgc

SEQ ID NO: 29601 - DNA, 384 bp, Zea mays
  Clone ID: LIB3059-032-Q1-K1-H9
gtgctggcgataccgatctcaccttcctaatctacacaaattttggatatcaggcgggtcacattgactaagctcttaaaaccactattcaccaacaaagagatgacgatccttatggcagatctctatgcacatggtaagaccaccatcctctactagctcaagctagtagaaatcgcgaccaccatccctacaatcgggtttaatgtggagactgttgaatacaagaacattagcttcactgtctgggatgttggaggtcatgacaagatcaggccattgtggaggcactatttccagaacacccaaggccttatctttgttgctgatagcaatgacagagatcgtgttgttgaagcaaaggatgagctccacaggatgctg

SEQ ID NO: 29602 - DNA, 390 bp, Zea mays
  unsure at all n locations
  Clone ID: LIB3059-033-Q1-K1-A1
cgcaacgcaaaaacaagcacaaacacgcgcgatccgatctgggccggccaagcagccgcccatccatggcgactagggtttggctcaccgccctcctgcttggtttcctcgtcgccgcctcccccttcaccggccgagttgctagagctgaatccgaggaagatgctgctgcagctgaggttgttgaaggggctgatctaggtattgtgggtgatgatacacaggtttccagtgatggacctttaagtcctgctcctggtgtagagacagtagttgtcttcccaaaaaatgctggcaaaattgtactagcaggtgaagaaactgaattactagttggtctgcaaaatgacggtgaatcaattttgaatgttgntgctgntcattcaactc

SEQ ID NO: 29603 - DNA, 416 bp, Zea mays
  Clone ID: LIB3059-033-Q1-K1-A11
ccggggtgtcgctgttcgacacgtgctacgacctgtcggaccggacgagcgtggaggtgcccgcggtgtcgctgcggttcgagggcggcggcgcgctgcggctgccggcgaagaactacctgatccccgtggacggagccggcacctactgcctggcgttcgcgccgacgaacgcggccgtgtccatcatcgggaacgtgcagcagcagggcacccgcgtcagcttcgacaccggcaggggcgccgtcggcttcacccccaacaagtgctagcctagcctagcctaagcctgacttctggctaaccgtgccctgttagccacggatgtcagtagcaatgacaagccggtgtttgactagcgggagaatgattagatggggggtaattgaccggtgggccctgccgaatctggggag

SEQ ID NO: 29604 - DNA, 421 bp, Zea mays
  Clone ID: LIB3059-033-Q1-K1-A12
cccacgcgtccgcccacgcgtccgggcgttggcagcaccccgatcctgggccagtgcgtcgagtttctgaggcatcagtgcagcccgacggcgacgccctactgctcgcctcagtgccagtcgttgcggcagcagtgttgccagcagctcaggcaggtggagccgcagcaccggtaccaggcgatcttcggcttggtcctccagtccatcctgcagcagcagccgcaaagcggccaggtcgcggggctgttggcggcgcagatagcgcagcaactgacggcgatgtgcggcctgcagcagccgactccatgcccctacgctgctgccggcggtgtcccccactgaagaaactatgtgctgtagtatagccgctggctagctagctagttgagtcatttagcggcgatgattgagtaataat

SEQ ID NO: 29605 - DNA, 312 bp, Zea mays
  Clone ID: LIB3059-033-Q1-K1-A2
gtcaacgtccgcaaatacctccagcctcgcatggaacatcatagaaactcaaaactggtagggccaacagattaacattcttcatcaacatatttttcgtctttaatctcatagctatttctgcatgcgttgcttacgctacaaatcagccttaatgctcacaacctcatatagcttacctaatagcgagatacctcttatcaatgatagcttacattattctaaaacccagcttttcatccatataggctacatccatccacttcatcacgcaacatacctatatcacccttcttgactcaactataatca

SEQ ID NO: 29606 - DNA, 378 bp, Zea mays
  Clone ID: LIB3059-033-Q1-K1-A3
agctactgcctactctcagcaacaacaacttcttccatttaaccaattggccgcactgaaccccgctgcttatttgcagcagcaaatactactaccatttagccagctagctgcagcaaaccgtgcttccttcttgacacagcaacagttgctgcctttctaccagcagtttgcggctaaccccgcaaccctcttacaactacaacaattgttgccctttgtccaacttgctttgacagacccagcggcctcctaccaacaacacatcattggtggtgccctcttttagattgcttattagttgtaattcaataataaagttttttggatgatgtatgtggccaaccagaaataagaagttacatttccagattctat

SEQ ID NO: 29607 - DNA, 345 bp, Zea mays
  unsure at all n locations
  Clone ID: LIB3059-033-Q1-K1-A8
accggttctcggaannntcccggcgtcgacccaacgcgtcgcgccgcacgccgtctcgtcccccgcgaatccaatttcagctctngccgccgctgccgtcagcaaggcaggggagcgagcaaggggatgccgtngctggccacgngtngctgcgcnntcgcggacccgcgcgacnnctgttcgcgccgcnctccttccgcaagaaagggggctacatnncccgctcaaccaacctaacctnnccgcacctaccaagaatcggcgaactacgtnncgacgtcaaagggtgaaccggcnngccgtccccacaagggggaatnngccgcacannagttctaaaccacg

SEQ ID NO: 29608 - DNA, 412 bp, Zea mays
  Clone ID: LIB3059-033-Q1-K1-A9
aacacaccaagcgaagcgcactagcaacgacctaacaccaatggctaccaagatatgagccctccttgcgcttcttgcccttttagtgagcgcaacaaatgcgttcattattccacagtgctcacttgctcctagtgccattattccacagttcctcccaccagttacttcaatgggcttcgaacatccagccgtgcaagcctacaggctacaactagcgcttgcggcgagcgccttacaacaaccaattgcccaattgcaacaacaatccttggcacatctaaccctacaaaccattgcaacgcaacaacaacaacaacagtttctgccatcactgagccacctagccgtggtgaaccctgtcacctacttgcaacagcagctgcttgcatccaacccacttgctctggcg

SEQ ID NO: 29609 - DNA, 406 bp, Zea mays
  Clone ID: LIB3059-032-Q1-K1-F8
gaccgcttcagtatgtgaaaacccagcccttcaaccctacaggctccaacaagcaatggcaacaagcaacttacctttatcacccctgttctttcaacaatcgccagccctatctttggtgcagtcattggtacaaaccatcagggcacaacagctgcagcaactcgtgctaccagtgatcagccaagtagctctggcaaacctttctccctactctcagcaacaacaatttcttccattcaaccaactgtctacactgaaccctgctgcttatttgcagcaacaacaactactaccattcagccagctagctactgcctactctcagcagcaacaatttcttccatttaaccaattcgccgcactgaacccctctgcttatttccagcagcaaatactactacca

SEQ ID NO: 29610 - DNA, 395 bp, Zea mays
  Clone ID: LIB3059-032-Q1-K1-F9
taaccaattaaaaataaaaaaaacaccattcctacaaccctacaaactccaacaagcaatgtcaacatgcaacttacctttatcacccctgttctttcaacaatcgccagccctatctttggtgcagtcattggtacaaaccatcagggcacaacagctgcagcaactcgtgctaccagtgatcagccaagtatctctggcaaacctttctccctactctcagcaacaacaatttcttccattcaaccaactgtctacactgaaccctgctgcttatttgcatcaacaacaactactaccattcagccagctagctactgcctactctcagcaacaacaatttcttccatttaaccaattcgccgcactgaacccctattcttatttccagcatc

SEQ ID NO: 29611 - DNA, 388 bp, Zea mays
  Clone ID: LIB3059-032-Q1-K1-G10
agaccttcttcgccgccgcgatattggctatgcgccatcccaggaaactggtcctggcaggctgtttgactgcactaatagtgatgacagctctatcagcttctctaggttgggttgcaccaaatctgatttcgcgtaaatggactcatcatgtgaccactctattgttctttgtatttggtatttggtcattgtgggaaggcttcaaggaagatggagattcagaagaattggctgaagttgaagcagagctggatgatgtctttaagagtaataaaggcgaatctaaaaataaaactaaggcaaacgatgatacgaagaaacagcaaagaccatttctcatgcaattcttctcaccaattttcataaaggcattttctattacatt

SEQ ID NO: 29612 - DNA, 371 bp, Zea mays
  Clone ID: LIB3059-032-Q1-K1-G12
caagcacaaggacaagctcccgcccaacttccgcaagcttctgaacgttcagctcaagaagctcgtcgccggcggcaagctgaccaaggtgaagaactcgtacaagctgtcgtccgccgccaccaagccgaatcccaagcccaaggccgccccgaagaagcccaagaccggcgctaagaagcccaaggccgctgccaagaccaaagctaagacccccgccaaggcgaagcccgccacaaagcccaagcccgccgcgaagccgaaagccgtagtgaagccgaagacacccgccaagcccaaggccaagccagctgccaaggcgaagcccaagaccgccggcgctaagccgaatccacttgctaagaaagccg

SEQ ID NO: 29613 - DNA, 377 bp, Zea mays
  unsure at all n locations
  Clone ID: LIB3059-032-Q1-K1-G2
attggaccaactagcaacatagaaagcacattagtgtaccaacaatggcagccaaagtattgtgcctccttatgctccttggtctttctgcaagtgctgctacggcgaccattttcccgcaatgctcacaagctcctatagcttcccttcttcccccgtacctctcaccagtgttgtcttcagtatgtgaaaacccaattcttcaaccctacaggatccaacatgcaattgcatcaggcatcttacctttatcacccttgttcctccaacaatcatcagccctattacagcagttacctttggtgcanttattggcacataacatcagggcacaacaactcgtgctagcaaaccttgctgcctactctcagcaacaa

SEQ ID NO: 29614 - DNA, 294 bp, Zea mays
  Clone ID: LIB3059-032-Q1-K1-G3
tcccggtcgcccacgcgtcctcccactcttccgcccactcgtccgctttctcgttcgctccactgacagccgcggaagatcaatactcaactatacaatcctacatggttcaagaggccatccaagcttgcatcttacgttcattaactaaaatcctacatcaaccatatactatattgcaacatccattcttaatgcatctgtataatcaacgaatttcataacaacaactactacatcaaattcataccaacaatcaatcaagtagtttcagcgaatctttgtgcttacttt

SEQ ID NO: 29615 - DNA, 199 bp, Zea mays
  Clone ID: LIB3059-032-Q1-K1-G4
ctgctatagcgatgaccaaccagggcgttcaagtctttccagagataatggttcctcttgttggatcacctcatgaattgggacatcaagtggcccttatccgtcaagtctctaactaagttttcaccagtatggggaaaactattgcgtacatgatcggaacgatgactgagattctcagggcagctctagcggctta

SEQ ID NO: 29616 - DNA, 422 bp, Zea mays
  Clone ID: LIB3059-032-Q1-K1-G7
ccgataccttccatcaatgatagcttcagtatgtgaaaacccatctcttcaaccctggaggcgccaacaagcaatcgcatcatgcaacatacctttatcacccttgtttcaacaatcgccagccctatctttggtgcagtcattggttcaaaccatcagggcacagcagctgcagcaactcgtgctacctgtgatcaaccaagtagctctggcaaacctatctgcctactctcagcatcaacaatttcttccattcaaccaactgtctacattgaaccgtgctgcttatttgcagcaacaactattaccattcagccagctagctactgcctactctcagcaacaacaacttcttccatttaaccaattggccgcactgaaccccgctgcttatttgcagcagcaaatactactaccattta

SEQ ID NO: 29617 - DNA, 393 bp, Zea mays
  Clone ID: LIB3059-032-Q1-K1-G9
cccacgcgtccgcgcacatatctactatactatactctaggaagcaaggacaccaccgccatggcagccaagatgcttgcattgttcgctctcctagctctttgtgcaagcgccactagtgcgacccatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtcttgccgagcatgatgtcgcaaatgatgatgccacaatgt

SEQ ID NO: 29618 - DNA, 388 bp, Zea mays
  unsure at all n locations
  Clone ID: LIB3059-032-Q1-K1-H10
atcctgcgtttgctgaacaccaacgtggatgggaagcagaagatcatgttcgccatgacctcaatcaagggtgtcgggcgccgcttctccaacatcgtctgcaagaaggccgacatcgacatgaacaagagggccggcgagctgacgcctgatgagctggagcgcctgatgacggtcgtggccaaccctaggcaattcaaggtgccggactggttcctcaacaggaagaaggattacaaggacggcaggttctcgcaggtcgtctccaacgcccttgatatgaagctcagggacgaccttgagaggctcaagaagatcaggaaccaccgtggtctgcgtcactactggggcctncgcgtccgtggccagcacaccaagactactggca

SEQ ID NO: 29619 - DNA, 380 bp, Zea mays
  Clone ID: LIB3059-032-Q1-K1-H11
ggacgatcactacgactggagaggggtggcgcctcgggaaaactacataaacaatcggctcaaggatttggacggggccatgaagacatcgactgcggcgtggaaggttgccgtgggccaccataccatgaggagtgtcagtgatcatggtgacaccaaggagctactgcagctactgcttccagtcctacaggccaacggcgtcgatttctacatcaacgggcatgaccactgcctggaacacatcagcagcagagacagcccaatccagtacttcacaagcggatgcggttccaaagcatggagaggagtgcagaaccccaccgaagatgacctcaagttcttctacgactggcaaggcttcatgtgcatacagctag

SEQ ID NO: 29620 - DNA, 388 bp, Zea mays
  Clone ID: LIB3059-032-Q1-K1-H12
cccacgcgtccgcccaaatctccctccagcgccgcagctagcccgagaagccgacggggaggaaaccgaccgccgacgccgagcaccctcggttcctggctttcccggcgcccaatctagacagctctttctcgttcgtctgtatccatggccgccgcctcgagcaagaccatcgctgtcctcctcgccgcgctgctcctcgcgctggtcgcgtccgcggtggccagcaggaagctggaggaggaggacgctttcctgggaagcctttcgccggcgcctgcccccgccgagggcggagccgcggggctcgctagcggcacgccgggggcgtgggccgtcgccgctctggtctctctcatcgccttcctcgcgaactgagcgggtcctg

SEQ ID NO: 29621 - DNA, 293 bp, Zea mays
  Clone ID: LIB3059-032-Q1-K1-H2
gctatcgcacgctatgttgctcgcttgaaggatgacaaccctctttttgggtcttgccgtattgaacaagcccacgttgagcaatggatggattttgccgcaacagaagttgatcctggtgttgcatggtacttgtatccaaggcttgggtacctcccttatgttagcacaactgaggaaacagctatttcttcattgaagaggtcgcttggtgctctgaacacacaccttgcttcaaacacataccttgttgggcatgctgttactctagctgacattgtaatgacatgcaa

SEQ ID NO: 29622 - DNA, 392 bp, Zea mays
  Clone ID: LIB3059-032-Q1-K1-D9
accttctgaaaccgtgtccgagaaattcccagtctcgaccaccgaagtggaaatgggggacaagtcagtggttgaggaagagctgactgtggcaaatgagagcaagatctcaccggtgaagtccaagcttccctacgaggctgatgaagaggaggaagtcgacgagtggcccgatgacgatgacgaccccaccgatgaggctggccaggcggcgggtgacaggactttgctagggcgggaggaggaggacgtatcgttcagtgatctggaggacgacgaggacgatgataggaggtagaaggggatgatgggcagtagccaagttggctaggggaagctcgtactatggtcccggcgcaaccacatgctggcttcattggagtaaggccgag

SEQ ID NO: 29623 - DNA, 383 bp, Zea mays
  unsure at all n locations
  Clone ID: LIB3059-032-Q1-K1-E10
gcgggcgcgcggggcctgcagctggccgtggtgctgccctgcatgaccacgggcccgatgctgcagcagacgctcaacttcagcaccaaccacgtcgcgcgctacctcatgggcaccaagcgctccatccccaacgccgtcgccgcctacgtcgacgtccgcgacgtcgcgcgcgcgcacgtgctcgcctacgagcgccccggagccaggggccggtacctctgcatcggcaccgtgctgcaccgcgccgacctcgtcgacatgctcagggacctcttcccgcagtaccccgtcacggccaagtgcgaggaggacggcaagccaatggcgaagccgttcaagttctccaaccagaggctcanggacctggggctggagttcac

SEQ ID NO: 29624 - DNA, 391 bp, Zea mays
  Clone ID: LIB3059-032-Q1-K1-E12
cggacgcgtgggggatgatggacgtgcagtccgtcgcgcagcagctgcagatgatggggcagcttgagcgtgccgctgccgccagcagcagcctgtacgagccagctctgatgcagcagcagcagcagctgttggcagctcagggtctcaaccccatggccatgatgatggcccagaacatgccggccatgggtggactctaccagtaccagctgcccagctaccgcaccacctcctgtggcgtctccgctgccattccgccctactactgattcatgatatttgggaaatctcctctatccatccctctctatctatatctgtaataatgcagtaagacgacacacattatcatgtgtggtatgaccaataatatatgcatgatcataat

SEQ ID NO: 29625 - DNA, 415 bp, Zea mays
  Clone ID: LIB3059-032-Q1-K1-E4
gtgccccgctactacccgtaccccaacgctggctcggggatgccgatgcttcctatggcaggaggtataggtggtggcgccggtgggctccacctcaacggcgccttcctgttcggcaatccgatggccgcgccccagcccatgagcttctaccaccagatgggcacggggactgcttgcgctggcggcttcgatgtttctgcgccggagagtaggccgtcctcgatggtgtcgcagaaggacgaccaggctaatggcgctgagatctcgtcgatgatgtccgtggccggcccagggcctgcgaccaccaccaccatagagatggatggcgtgtggaagtactgaaaacgtggagggtggagggcaaagacatgaattcgcataaattaaatatgcatgtaatatctatatctgc

SEQ ID NO: 29626 - DNA, 243 bp, Zea mays
  Clone ID: LIB3059-032-Q1-K1-E7
tctacccactcttcctactacttctagatctcgagcttccgcttttctttttctttccatttcttacttttcggcttggttctttttttggttttatatctccatcctatacatatatatctaaattctacattacaatgttccaaaaaaaatattaaaactttcaaattttaataaaatataattaacaaataataaaataattataaaaaattttaaaaaaatattaaactaaaaataata

SEQ ID NO: 29627 - DNA, 345 bp, Zea mays
  Clone ID: LIB3059-032-Q1-K1-E8
tcaacaacttacaatccatgttatcataacaagccttctaacacttaggtgtagaactcttttcgtcatgagctccaacctgacatatatatttaaactctaattccaatgtcccaaacaacaaaacaaacatattaaacaaaaatacaaactaaaacactaacattaataaaaaaaacaataaaacaacaaaaaaatacaatattaaaaccaaaaaattaaacctacaaaaaccactaacaatccacctatcataatacctctatcaccctcaatcctgcaacaaacataacatcttataaataaactacctaactttaatttacatcccctctttattaaaac

SEQ ID NO: 29628 - DNA, 392 bp, Zea mays
  Clone ID: LIB3059-032-Q1-K1-E9
cggacgcgtgggcggacgcgtgggcggacgcgtggggttggtgcacacattagtttgtttgtggttttatatgacctaggcaattttatcccagaaataattttgttaaaagactctgtactgttctcatgttctgtagcatggtgattttttgctagatgtcatgtttccttttaggaagatgagatgagatattttgatgtgccctcgtttacaattaccatgttatagttgctttacatttaaaaaaaaaggaacttactccatcagccatttggttaaacagcttgtttctgtctgagataggaagcatgagacttaaaaaatctactgaaatcatgttccagggtttgattgcaactgcctggatattggctctaatcctattagtg

SEQ ID NO: 29629 - DNA, 411 bp, Zea mays
  Clone ID: LIB3059-032-Q1-K1-F1
caagaagtggacaattcatggcatcagagggatggcctttgaagaggttggctgtgggatctctttctggtcatgagctccaacctgtacatatatatgtaaattctagattccaatgtcccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggccctttttaaaggccccatctttactacccctggctggcaaatcaaaactttttttatagggcccccaaattacattcattggcccgctttttaaaaatgtcaaaatgggaaaaaccttggggtacccaacttaaatgccttgg

SEQ ID NO: 29630 - DNA, 385 bp, Zea mays
  Clone ID: LIB3059-032-Q1-K1-F10
gtttcgccggagtatttagcttgcttcagggagcacgtggcggtggaagcttccctaggggtggcggaggcggtggtggtgcttggttgatgtcgatggcgcaggtctgctgtgactcggccgtagcggcgacggcggcaccggtggttggtgcggaggcggaggccagggccagggcgcgcgccgagaggcggagccgggccggagagtctggggcgtggaagcacgcggtggccgctggcacggccgatgctacgaggaagcggagtctcggggcaggggagctgctggtggcgcggaagcacggtgcggcgtcggtggccggccgcatgagggagatggaggatgccgtgtccgtgcgcgacgcgttctgcgcggagggcac

SEQ ID NO: 29631 - DNA, 327 bp, Zea mays
  Clone ID: LIB3059-032-Q1-K1-F11
cggacgcgtgggcggacgcgtgggataaggaagcccctgaaggaagctggacctgcgcagagtgcaacaacctgaactacccattccgcacggtgtgtaacaggaaaggatgctcgtacagcaagccagccccggcgaacaactgaacccaaccttcgcgcatcgtcgagctattgttgtacccgtagattgtatcctagtcgtgtgcaatctttgaactgcacaaagatgtttttgtgcctggagacgagagattcgattcgttacgcttaatttactattatacatttttattaaatgatgaaaactagggaagagcattatatc

SEQ ID NO: 29632 - DNA, 388 bp, Zea mays
  Clone ID: LIB3059-032-Q1-K1-F12
cccacgcgtccggcaacatataaagcacaatagtgtaccaacaatggcagccaaaggattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacaacagttacctttggtgcatttattggcacaaaacatcagggcacaacaactacaacaacttgtgctagcaaaccttgctgcctactctcagcaacagcag

SEQ ID NO: 29633 - DNA, 430 bp, Zea mays
  unsure at all n locations
  Clone ID: LIB3059-032-Q1-K1-F2
gatcagtcaaacataccggatttgccaaatgaaaagaagcagtttattccttttgcgtctcgaccgcccgttctttctccttcggtgggaaaagccgagacagttccctcaccttctctgtctcctccagtgaagccgacagagccagaaccagaaatcctcacaaagaaaattgatgaagtgaccacaccttcagtacttccctcagattatattttcacaaaacagccagaacaagtgcggacaatctctccttctgagagtggggcaaatattgacttggacgacgttttatctgctgcgcagacagctgctgaatcagctgagcgagctgcatcagcagcccgtgctgctgcanaccttgcacaactgcgcatttcagacctgaagaagaatccaaggtttatagcaattaccgtgatagcgtcca

SEQ ID NO: 29634 - DNA, 415 bp, Zea mays
  Clone ID: LIB3059-056-Q1-K1-D6
cggacgcgtgggaacgcaaaaccgcatcctctcatcagcttccttccacatgcgtctggagatctcgccccgtcgccatggacgcgatcgacagcgtggtggatcccctccgcgacttcgccaaggacagcgtccgcctcgtcaagcgctgccacaagcccgaccgcaaggagttcaccaaggtggcggcgcggacggcgatcgggttcgtcgtcatgggcttcgtcggcttcttggttaagctcatcttcatccccatcaacaacatcatcgtcggttccggctaggcttacaggagtacagggcgactagcatgggagtagtgcaatacttttgggagcaatagataacgaggatcctggtctttcgaatagtattggtaatgaaatttttcgttcggttgcgtttctgatgt

SEQ ID NO: 29635 - DNA, 404 bp, Zea mays
  unsure at all n locations
  Clone ID: LIB3059-056-Q1-K1-D8
cggacgcgtgggcggacgcgtgggcggacgcgtgggcggacgcgtgggagaccaacgtggcaacatagaaagcacaatagtgtaccaacaatggcagccaaaatattttgcctccttatgctccttggtctttctgcaagtgctgctaccgcgaccattttcccgcaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatntattggcacaaaacatcagggcacaacaactacaacaacttgtgctagc

SEQ ID NO: 29636 - DNA, 443 bp, Zea mays
  Clone ID: LIB3059-056-Q1-K1-D9
cccacgcgtccggaacaagaggatctccaagggaaagaagggtggcaagaaggagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagcttacaggaaaatcaggctccgtgctgaagatgtgcagggcaggaatgtgctcacaaacttttggggtatgaattttaccactgataaactgagatccctagtgaagaagtggcagacattaatcgaagcccatgttgatgtcaagacaaccgacaactacatgttgcgtttgttctgcatcggcttcacgaagaggcgcccaaacc

SEQ ID NO: 29637 - DNA, 410 bp, Zea mays
  Clone ID: LIB3059-056-Q1-K1-E1
atgattttgcaaggacaggaagtactgctatcgatacggttgagcttaaggaaggccctctggaacagttcacacatgagatggagccatttctacgcaagcaaggacttccagttcgcttgaacaaaggtgttgtagagttggttgcagaccatgtagtttgtgaggaaggaaagcccctttcgccagaagcagcgcagactctgcggctgcttgggatacaaatggcgacattccgtctataccttgtgtgtcgctggtcgggcgatgactttgaagtttacaaagaaggcttgatgcacctaggagctgatgaatcctcttaagcttttgtttcctgtatacacaaagggctcacttgctgtctttgctgggacagcttttggtaactgtgcgtgtggccatgtacc

SEQ ID NO: 29638 - DNA, 437 bp, Zea mays
  Clone ID: LIB3059-056-Q1-K1-E10
ccggatcgacggacgcacccacgcgtccgcggacacgtgcgacgactattcggctgtcgctatggactccgagtctcagggcgttgagcgacttccgatgcgcacttagatgtctccgtccgagtaccactacgcctctctacaagcttacatgctcatgctgaaacttattcatctcaagctaagattctacgaccagcatagggggctgtcggcgctaggcccatacatgggtacatgcatctggcagtgcatctttggaagatttgatcctcaaactgatctagctacatcagactctatcgatactacgacgccatataggtatcgacttgtcacgccatgctgcagatcgagagcactctcgctactatgctgaactgctcatacgatcaggcgtagtatcgaattcagagctgcataatctgactagtcat

SEQ ID NO: 29639 - DNA, 442 bp, Zea mays
  Clone ID: LIB3059-056-Q1-K1-E11
ctggcaccatagaaagcacattagtgttccaacaatggcagccaaaatatggggcctggttatgctccttggtctttctgcaagtgctgctaccgcgaccattttcccgcaatgctcacaagctcctatagcttcccttcttccaccgtacctctcaccagcggtgtcttccgtatgtgaaaacccaattcttcaaccctataggatccatcaggcaatcacagctggcatcttacctttatcacccttgttgctccaacaatcatcagccctattacagcagttacctttggtgcatttattggcacaaaacatcatggcacaacagctacaacatcttgtgctagcaaaccttgctgcctactctcagcaacagcagtttcttacattcaaccaactagctgcattgaactctgctgcttatttgcaacaacaactacca

SEQ ID NO: 29640 - DNA, 423 bp, Zea mays
  Clone ID: LIB3059-056-Q1-K1-E12
cccacgcgtccgcggacgcgtgggtctttaatctccttccaaatctgaacgtggatgggctaattaaagcctttgcagtgaaaactaacgacatgatgctggtgatatacctgtcttctctgatccggagcgtcattgcgcttcacaatttaatcaacaataagatgctaaacaaggagcacgagaaggccgaggattcgaaaccaaccgccattcctactgctgccggaagctaaacgtgcttttgatcactgattgcattggtggctaagaaaagggaagaaacttgtgatgacatgttagcacggttgtgctcgaaccaactgtcttgaccttgaatggacattcaatatgtgcattctatgtatgatcaggtcaacggcaagagaaaccaattacactgtatgagctttagatcacacc

SEQ ID NO: 29641 - DNA, 430 bp, Zea mays
  Clone ID: LIB3059-056-Q1-K1-E2
gctgcattgaactctgctgcttatttgcaacaacaactagtactaccattcagccagccagctgctgcctaccaccagcaatttcttccattcaaccaactagcagcattgaactctcctgcctatgtacagcagcaacaactactaccattcagccagctagctgctgtgagccctgctgccttcttgacacagcaacaattgttgtcgttctacctgcacgctgcgcctaacgttggcaccctcttacaactgcaacaattgctgccattcaaccaacttgctttgacaaacccagcagcgttctaccaacaacccatcattggtggtgccctcttttagattgcttatgagttatagttcaataataaagtttttttgatgatgtttgtggcttcccagaaataagaaagtacatttctagattctt

SEQ ID NO: 29642 - DNA, 379 bp, Zea mays
  Clone ID: LIB3059-056-Q1-K1-E3
acgacattgaactctgctgcttatcttttacatttactagtactaccattcaaccatgcatcggatacctaacacctgcaatttcttccattcaacccactcacagcattgaactctcctgcctatgtacagcagcaacaactactaccattcatccagctagctactgagaaccctgctgccttcttgacacagcaacaattgttatcgtactacctgcacacttcgcctaacctaggcaccctcttacaactgcaacaattgctgacattcaaacaacttgctttgacaaacctcacatcttactacctacatctcatcaacagccgtaccctctattacaatgcatatgacttatctttcaatactcaagtttctt

SEQ ID NO: 29643 - DNA, 398 bp, Zea mays
  Clone ID: LIB3059-056-Q1-K1-E4
cccacgcgtccgctcgctagtggctgtcctactcgtgctgcttgccctcgccgccgtgtcctgcacgcgcagcgcacaaaaggagtccgcggctgacaacgccgggatgttggcaggcggcatcaaggacgtgccggcgaacgagaacgacctccagctccaggagctcgcgcgcttcgccgtcaatgagcacaaccaaaaggccaatgctcttctggggttcgagaagcttgtgaaggccaagacacaagtggttgctggcacgatgtactatctcactattgaagtgaaggatggcgaagtcaataagctctatgaagctaaggtctgggagaagccatgggagaacttcaagcagctgcaggaattcaagcctgttgaagagggtgctagcgcct

SEQ ID NO: 29644 - DNA, 400 bp, Zea mays
  Clone ID: LIB3059-056-Q1-K1-E5
cccacgcgtccgcccacgcgtccgcggtacgcgtgggctagcaacatagaaagcacagtgagtgtaccaacaatggcagccaaaatattttgcctccttatgctccttggtatttctgcaagtgctgctacggcgaccattttcccgcaatgctcacaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctggct

SEQ ID NO: 29645 - DNA, 418 bp, Zea mays
  Clone ID: LIB3059-056-Q1-K1-E6
ctcacgcgtccgtatcctagttcctaccttcgtcgccgatgccggctgcgagtactggtgcgctcatctagacccagttcaatataagcggcaagggaagctgcagcaaaagctccgacgagaacctatagcttggggtttcagctggggataaagtggcgtcgaccgaggcggagacctagggagagcataggggatgcgatagggagagatgaatcaatcaatcgattcgtctgctgacgcccctgctaacgaccctactactatcctgacgatcatactgtcttttggcgttctttctccggctcttgttcgttagactgtggaacaccaggtgaagcgtcttcagaagattattcactatattagagtagatcgggtactggttcatggttagaatgattggaagaattaggtt

SEQ ID NO: 29646 - DNA, 421 bp, Zea mays
  Clone ID: LIB3059-056-Q1-K1-E7
gatccaacaggcaatcgcagctggcatcttacctttatcacccttgttcctgcaacagtcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgctgcttatttgcaacaacaactaccattcagccagctagctgctgcctacccccaacaatttcttccattcaaccaactggcatcattgaactctcctgcttatttacagcagcaacaactactaccattcatccagctagctggtgtgagccctgctgccttcttgacacaacaacagttattgccgttctacctgcacgctgcgcct

SEQ ID NO: 29647 - DNA, 327 bp, Zea mays
  Clone ID: LIB3059-056-Q1-K1-E8
cccacgcgtccgcccacgcgttcgcgtacgcgtgggggcgggtataaaggccaccatggcggcttcagcggtggtggcggttctggcggtggtggtggcttcggcgctggcggctacggtggtggcttctgcggctccttatggaaccgaagctccgctggtggttctgatggagaagctggcaaccgctgcggtggaggatgaaacggtggcggtgacggcgctggtggacgatactgcagcttccgaactggcgatgaacttcatggcgtatttggatttggccacctaggctaagctagctctaatggcaagggaccctccagc

SEQ ID NO: 29648 - DNA, 418 bp, Zea mays
  Clone ID: LIB3059-056-Q1-K1-D5
cccacgcgtccgggagaatttccccattcccttacagtattatctgctaaggcagcctctctgacgttcggtgtcattctagttatctcgctggtgatgggaatcgttctcaatttcactatgttttggtgcacaattgtgaactctgctctgactacaacaatagtaggagttctcaagggtgtcggatcaacgaccctcggtttcgttctgttgggaggtgtcgaagtacatgctctgaatgttactggactggtgatcaacacatttggcggcgtatggtactcttatgcgaagtataagcagaaaaggaaaacaccacggaagatccaacatgatgtagagtcgcatgcccacaagtagcgtcagattaactgtagttatacttcggtcttcgatctgattataactggatgca

SEQ ID NO: 29649 - DNA, 433 bp, Zea mays
  Clone ID: LIB3059-056-Q1-K1-C10
gagattcctggggttcctgttatatattttctgaataactctctatgcataggacggggctctatgcagcaacgcatgtttgctcaattggatgaggagaagcgtctcaatatggatatctctgaatacaataagttactgaaggctgcatcagaaggaaagacaattgccagtgaaaatggaagtggcgaataacaacatgagatgcctattagttctctcgtaaaaaatgcacttcatgttactgataataccaagtttaagaggtacaaagcatatggtccaaacccactctcctgtaagaagaagataccaaagctccccactgctattcaaaagcaggcaggtacggctgatggcgacgcatagaggaagagggttcggaagctgaagagaggccaaaacgattacaagcaattggaggctgcgaact

SEQ ID NO: 29650 - DNA, 443 bp, Zea mays
  unsure at all n locations
  Clone ID: LIB3059-056-Q1-K1-C11
gtgaaagacaaacggactatatggcgactgagcataatctcagacttcttctgggccattgtgagctttatcagaatcttctttgacacactgttctcattggacaaaactgacaacttcaagaaagggtatggtgctggtaagaagtgggatggtggacctggtggtggtgggcggggcccatatggcggtggaggaggtggaggattcggcggcggaggtggaggtggttcacggngtcctcgcactctatctgacatccaatccaatgaccacagttctctccctgcttgtggatcctgctgtggctaataagcgtgcaaccgttccgcctgatgactacgtataacanatgaatacacatgcttctgtatgttctgaagaacatcgtagctattgatatgtattntactgtcagacgattgtatcataatcgatatgtc

SEQ ID NO: 29651 - DNA, 392 bp, Zea mays
  Clone ID: LIB3059-056-Q1-K1-C12
gcgacacacacgctgactatatggcgactgaccatactgtaacacttcgcctgggcgatggagagctttctcagactattcattgacacactggtctcattgcacacaactgacaactctcagaaacggtatggggctggctagaagtgggatggtggacctggtgctcgcgtgcacagcccctatagcggtggacgaggtggaagattgctcggacaaagtgaacgtgcttcacaggagcactacaacactatctgacatccaatccaaagaccacagtactctcactgcaagaggatactgctgtggatgataaacgtgcaaaagcagagactgatgactacatataacaaatgaatacacatgcttctgtatgttctgaagaacatcgt

SEQ ID NO: 29652 - DNA, 356 bp, Zea mays
  Clone ID: LIB3059-056-Q1-K1-C2
cgcaaattgcaccaagaaatccatcgagaggccgtcgacaggggaattaatggcgtcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgc

SEQ ID NO: 29653 - DNA, 419 bp, Zea mays
  Clone ID: LIB3059-056-Q1-K1-C3
cccacgcgtccgcggacgcgtgggtggcgacacaactattgcatttctcctgatggagaaggaaatgtacactggcatgtcagacttgcagcctgcttcacctacaattgatcgagggattgcactccaaaagatgattcacttcatcacaatggcccttggaggtgatggctacttgaattttatgggaaatgagtttggtcacccagaatggattgactttccaagagaagggaacaactggagctatgataaatgcagacgacagtggagccttgtggacactgatcacttgcggtacaagtacatgaatgcgtttgaccaagcgatgaatgcgctcgatgagagattttccttcctttcgtcgtcaaagcagatcgtcagcgacatgaacgatgaggaaaaggttattgtctttg

SEQ ID NO: 29654 - DNA, 393 bp, Zea mays
  Clone ID: LIB3059-056-Q1-K1-C4
ccaccggcggcgcgcgcgacggcggcaagatggtgcagcgtctgacctaccgcaagcggcacagctatgccacgaagtccaaccagacgcgggtcgtcaagacccctggtggcaagctcgtgtaccagtacaccaagaagagagccagcgggcccaagtgtcccgtgaccgggaagaagatccagggcattccccatctgaggccagctgagtacaaaaggtccaggttgtctaggaaccgcagaactgtgaaccgtccctatgggggagtactatctggaactgcagttagagaaaggatcatccgtgctttcctggttgaagagcagaagattgtcaagaaggtgttgaaattacagaagaccaaagacaagactttcttaaaaaagttac

SEQ ID NO: 29655 - DNA, 422 bp, Zea mays
  Clone ID: LIB3059-056-Q1-K1-C5
cgatgctggggctgctaaggagctgatggcaaacctagtaagcatgcagtcgtcactttctgatgttaacaagttgatcaaggagatccggtctgatgtttctgaagtagttgcagctgacgagtttgagtacaaggatccagttgatggctctgtgtccaagcaccacggcatccgatacctcttcggagatggttcacgactggtgttccgtctatccggaaccggttctgttggtgccaccatccgtgtctacatcgagcaatacgagaaggattcctgcaagaccggcagggattcacaggaggcccttgctccactgagttgatgttgcgctcaagctctccaagatgcaagagtacactggccgctctgcccccaccgttatcacatagatttttgaagagtgatttacaatgagg

SEQ ID NO: 29656 - DNA, 403 bp, Zea mays
  Clone ID: LIB3059-056-Q1-K1-C7
caaagatttgtgagggtgatccgcgcttagaagagatggctaagatcgccgcggcgggggcggcggcgctgtgcttcgcggccctggtggccgtggccgtctgccaaggcgaggtcgagcggcagaggctcagggacctgcagtgctggcaggaggtccaggagagcccgctcgacgcgtgccgtcaggtcctcgaccggcagctaaccggcggctgcggctgcagcagcgttggcccgttccggtggggcaccgggctccggatgcggtgctgccagcagctccaggacgtgagccgcgagtgccgatgcgccgtcatccggagcatggtcaggggctacgaggaggccatgccgccgctgcagaaaggctggtggccatgggggcggcagcagcagccgcc

SEQ ID NO: 29657 - DNA, 413 bp, Zea mays
  Clone ID: LIB3059-056-Q1-K1-C8
attgagaccaactagcaacatagaaagcacaatagtgtaccaacaatggcagccaaggtattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcacaacaactacaacaacttgtgctagcaaaccttgctgcctactctcagcaacagcagtttcttccattcaaccaactagc

SEQ ID NO: 29658 - DNA, 448 bp, Zea mays
  Clone ID: LIB3059-056-Q1-K1-C9
gagattcctggggttcctgtgatatatggtctgaagaactctttatgcatagaacgggcctctatgcagcaacgcaagtttgctcaattggatgaggagaagcgtctcaatatggatatctctgaatacaagaagttactgaaggctgcatcagaaggaaagacaattgccagtgaaaatggaagtggcgaagaacaacatgagatgcctattagttctcttgtaaaaaatgcacttcatgttactgataaaaccaagtttaagaggaacaaagcaaagggtccaaacccactctcctgtaagaagaagaaaccaaagctccccacggctattcaaaagcaggcaggtacggctgatggcgaggcaaagaggaagagggttcggaagcggaagagaggccaaaaagataacaagcaattggaggctgcgaactagaaggatgggcttg

SEQ ID NO: 29659 - DNA, 423 bp, Zea mays
  Clone ID: LIB3059-056-Q1-K1-D1
ccgacgcgtccgcggacgcgtggggttttatatattacctggcattgaatccgtgtacgcgtgggatggaaaggtacaatctgatgctgaagaattactcatcatcaagaccagggaatcacttctggatgccttgactgcacatgtcaaagccaatcatgaatatgatgttcctgaagttattgctctgcccataactggtggtaacaccaagtatttggaatggatcaagaacagcacccgggacaagtgatctctttttttttggagctcgacataatgcgatgatcgaagtgcccatggctccttagctcttccagtggcttgcacacaagggtgtatcctctcttgacctggacatctcaattacgttgctgtaccgaatccatatctaccatcttcaggtaacaagtgatttggtgt

SEQ ID NO: 29660 - DNA, 329 bp, Zea mays
  Clone ID: LIB3059-056-Q1-K1-D10
cccacgcgtccggaaactcatgctctttagcgcaaagacggctacctagcaggagagggtacacccatactctaacaaggatcgctatgacgtcaaggcaccgtcgctgcacatcgtgcgctacatcgacaagactctcttattcatgacacatggttccaagattgcttctgacgatctgattcacagagcctatgacgttcgcctagctaatctttaaggcgactaggatcacattgactgaacgatcaagctcagcgctgaagataagcacgacagcaatgtgctcacaaactaatgctgcatgaaatttaccagtgacaaactga

SEQ ID NO: 29661 - DNA, 323 bp, Zea mays
  Clone ID: LIB3059-056-Q1-K1-D2
cccacgcgtccgccaacaagcaacatataaagtggaatccagtagcaacaacagaacggcaatggcgaccaagatattttccctccttatgctccttgctctttctgcatgtgttgctaacgcgacaattttccctcaatgctcacaagctcctatagcttcccttctttcccccataccttccatcaatgatagcttcagtatgtgaaaacccagctcttcaagcctataagctccaacaagcaatcgcagcaagcaacatacctttatcacccttggtggttcaacaatcgccagccctatctttggtgcaatcattggta

SEQ ID NO: 29662 - DNA, 423 bp, Zea mays
  Clone ID: LIB3059-056-Q1-K1-C1
cgacgtcggactcagcgagaaaggtggtcgagctgaaggctttcaacaagtttgagagcacatctgatgccctatccgcggcaaccctgattattgatagcaagcctagcaagggtctgcgcaagttcttgcagaaacattgtgagggtgaaacattagcagtagctgattctaagcttggaaatgctataaaagaaaagctgaaaattgactgccttcacaatagtgctgtgatggacctgatgagaggactgagaaatcagcttaccgagcttataactgggtcgggtgcacaagaccttggtccaatgagcttgggattgtcccacagcttgtctaggtataagctgaagttcagccctgagaaggttgatacaatgatcattcaagccattggattattggatgatcttgacaaggagc

SEQ ID NO: 29663 - DNA, 298 bp, Zea mays
  Clone ID: LIB3059-056-Q1-K1-A3
ccggaattcgacggcacgcgttcggcgacgcattcccaatacggtttggattcagaatgtgctggtgctgctgtgatctgtagcgtgggtgaactgatatacatgccaataacgaatatccagtacaagacgttcgtgcgtggccttgcctgtagcaaggtcaagtagtcctatgatagcgaattgaacaagtactggaagaggctcaatgcgcacaagaatcggatgatcgagacgcataggtgaactgtgttcatgctctgcacgatgaggtctgatgaagctattcagaaagaca

SEQ ID NO: 29664 - DNA, 421 bp, Zea mays
  Clone ID: LIB3059-056-Q1-K1-A4
cccacgcgtccgcacgaaaaccctaaaccctcgctacccggcggcggctacaagctcttcgtcggttcagcaccatgaggccaccggctagaggaggacgtggtgggaggggtggcaggttcgatggcggctgccgtgggggctgcggcggctagccgtgggtttggcggtggtagaggcctgagaggggacaggggagggagaggtggcaggacccgcagaggcggccgtggcggctgtggcaggggtggccgcggcggtggcatgaagggcgtgagcaaggccgtcgtggtggcgcacaagcacgccggtgtcttcatcttcaagtccaaggaggatgcgctctgcactaagaacatggtcccgggagagtccgtgtactgagagaagcgtgtcttcgttcagaatgaggatggaacaa

SEQ ID NO: 29665 - DNA, 299 bp, Zea mays
  Clone ID: LIB3059-056-Q1-K1-A6
aacacaataaatgaagctactatgtgtttcgtaagtataatcttacttaaaaaaaaggagaaaaaaaaaaaaaaaaaaaaaaaaaaaaaaaaaaaaaaaaaaaaaaaaaaaaaaaaaaaaaaaaaaaaaaaaaaaaaaaaaaaaaagggctagcctcaaatatatgacaaactaaaatttcccctacttacaactgtaaattatatttaaaatactacctaaaaaaaattaatggtccgaatattaaaaacatcaacactgaaaaaaaacatggcttacaaaattaaatacttttaaaa

SEQ ID NO: 29666 - DNA, 395 bp, Zea mays
  Clone ID: LIB3059-056-Q1-K1-A7
atgcaaaaccctcccatctcttaccctttgccgccgtctctgctctcaagagcgccagggcgtcagaaaagaagcagtcgaacccgatgcgggagatcaaggtgcagaagctcgtgctcaatatctccgttggagagagtggagatcgactcacccgcgccgccaaggtgttggagcagttgagtgggcagtctccggttttctccaaggcaaggtatactgtgaggtctttcggtattcgtcgtaatgagaagattgcatgctacgttacggtcaggggttagaaggcaatgcagcttcttgagagtggccttaaagtgaaagagtatgaacttctgaagaggaacttcagtgaatctggctggtttgggtttggtattccaggacccattgat

SEQ ID NO: 29667 - DNA, 418 bp, Zea mays
  Clone ID: LIB3059-056-Q1-K1-A8
agcgggggcggcaagcaaccacgggcggagctcggagcgtcctcctcctcccgtctgtaaattcccctccttttcttcctccatatataggggccatcagatccaagaagagggaaaagcaccaaggaccttcggcgcccgttcaggatccacatcttcccgagcgagttcttggttgacctcttcccccttcggaccacctgcaaggctcttggtgtagcttgccactctcaccaatcaagttttcatgtctgatctcgacattcagatcccaactgccttcgatcccttcgctgaggccaatgctggggactctggtgcggcagcagggtcaaaggactacgttcacgtgcgcatccagcagcgtaatggtcgcaagagcctgactaccgtccagggattgaagaaggagttcagc

SEQ ID NO: 29668 - DNA, 390 bp, Zea mays
  Clone ID: LIB3059-056-Q1-K1-A9
ccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaagcagccgcagtgcatcccgctggcggcggcgccctactacgccgggtgtgggcagccgagcgccatgttccagccgctccggcaacagtgctgccagcagcagatgaggatgatggacgtgcagtccgtcgcgcatcagctgcagatgatgatgcagcttgagcg

SEQ ID NO: 29669 - DNA, 435 bp, Zea mays
  Clone ID: LIB3059-056-Q1-K1-B10
agaaacacaccaagcgaagctacctatcaacgacttaacaacaatggctaccaagatattagccctccttgcgcttcttgccctttttgtgagcgcaacaaatgcgttcattattccacaatgctcacttgctcctagtgccattataccacagttccttcgaccagttacttcaatgggcttcgaacacctagctgtgcaagcctacaggctacaacaagcgcttgcggcgagcgtcttacaacaaccaattaaccaattgcaacaacaatccttggcacatctaaccatacaaaccatcgcaacacaacagcaacaacagttcctaccagcactgagccaactagatgtggtgaaccctgtcgtctacttgcaacagcacgtgcttgcatccaacccacttgctctggcaaacgtagctgcataccaacaaca

SEQ ID NO: 29670 - DNA, 387 bp, Zea mays
  Clone ID: LIB3059-056-Q1-K1-B11
aggaacacaccaagcgatgcttcctatttgcgaattaacaacaatggctaccaagataggagcacctacttgcgcttcttgcccttcatgtgagcgcgtcaaatgcgttcattattccacaatgctcacttgctcctagtgccattatgccacagtttctccgaccagatacttcaatgggcttcgaacacctagctgtgcaagcctactggctacaacaagctcttgctgctagcgtcttacaacaaccatttaatcaattgcaacagcaatccttgtcacatctaaccatacaaaccatcttatcacaacagcaacaacagttcctaccagcactgagccaactagatgtggtgaaccctgtcttctacttgcaacagcaagtgc

SEQ ID NO: 29671 - DNA, 428 bp, Zea mays
  Clone ID: LIB3059-056-Q1-K1-B12
aactggttgttggtggattggaccgtgtttatgaaattggaaagcaattcaggaatgaaggtattgatttaacacacaatcctgaattcacaacttgtgaattttatatggcgtatgcagattataatgatttgatggagcttactgaaaccatgttgtcaggcatggttaaggacctgacaggtggctataagataaaatatcatgcaaatggagttactaaccccccaatagaaattgatttcacgcctaccttcagaaggatagatatgattaaagatttggaggctatggccaatctcagtataccaaaagatctatcaagtgatgaagcgaatcgttatttgatagaagcatgtgtgaagtatgatgtgaaatgtccaccttcccaaacgacatcgcggttgcttgacaagttggttggccat

SEQ ID NO: 29672 - DNA, 233 bp, Zea mays
  Clone ID: LIB3059-056-Q1-K1-B2
acgagatgttttaagcggctgaacatatcaaaaataaaacctgaatcacccacaacagtgttcgtaaatactcaaacagaggtatttactgaaaaaaactgctgtacgttgtataggattcgatcttacttacgcactcttcctacggcatatctgtactataggattcataaagactaatgataatgccgccttcttaaattatcataactggcacaaccaattctgctcca

SEQ ID NO: 29673 - DNA, 315 bp, Zea mays
  Clone ID: LIB3059-056-Q1-K1-B3
acaggcttctacatgtggccttaaagaactggtttctaagttcattccggaagttagggccggggaacactgagaagtctacctgcagcatcttacgacttcaaaacgtcttcatccgcagggtgaagatactcaaggcccccaagtttgatctccggaagttgatggaggttcatggcgactacaaagaggacgttggtgtgaagcttgagaggcctgtcgagggtgatgaggctatgcatgaggttgctgctgccgagtagtttatttgctacttctttatctagacgaatctggacaggaggtcccttatga

SEQ ID NO: 29674 - DNA, 403 bp, Zea mays
  Clone ID: LIB3059-056-Q1-K1-B4
cccacgcgttcgaacggagccgacatgcttgagatctaaacccaagtcgtgcctacggtccggtcacccgtcgctccacgcaaccatgttgaggaggaagaccagggatcccaaggaggagaacgtcaaccttggacccactgtccgtgaaggagagtatgtctttgatgttgatcacatctttgcatactacaatgacacctacattgatatgactgatttgtctggtaaggaaactctggttcggatcaccggcggcatgaaggtgaaggctgaccgagactagaccgaaccttacgctactatgcttactgctcaagatgtatcacatagctgcaaggagcttggcattactgcactgcacattaagcttcgtgccaccggaggcatcaagaccaatacc

SEQ ID NO: 29675 - DNA, 316 bp, Zea mays
  Clone ID: LIB3059-056-Q1-K1-B5
gacactcgtgcggtggattgtacgggttcgatcatagggtaacaacaacgaggtggtgtcaacaaataggagatcaactagacatagtgtcggcttaagcatgcctagtagtagtacgtaacagtgacacttagtgatagtgaaaggatactgctgatgtgaagattaatattgatggatgagacatagcgctgtagaagctgtcaagcccgcagagcgaatatgatgtgcagacattgaatcatatccatgagatttctgcacatgaataatattaagattaatgagacagctactggttctatatgaatctaac

SEQ ID NO: 29676 - DNA, 409 bp, Zea mays
  Clone ID: LIB3059-056-Q1-K1-B6
gctgcaacagtttatgccagtgctcagtcaactagccatggtgaaccctgccgtctagctacaactactttcatctagcccgctcgcggtgggcaatgcacctacgtacctacaacaacagttgctgcaacaaattgtaccagctctgactcagctagctgtggcaaaccctgctgcctacttacaacagttgcttccattcaaccaactggctgtgtcaaactctgctgcgtacctacaacagcgacaacagttacttaatccattggcagtggctaacccattggtcgctaccttcctgcagcagcaacaacaattgctgccatacaaccagttctctttgatgaaccctgccttgcagcaacccatcgttggaggtgccatcttttagattacatatgagatgtac

SEQ ID NO: 29677 - DNA, 378 bp, Zea mays
  Clone ID: LIB3059-056-Q1-K1-B7
ctcgagtccaagatcatcctcgatcgggagacgcagaggtcccgcggcttgggcttggtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggctacggtggcagcggctgctacagtggtggtggcggcggctacggcggtggcaaccgtggcggcggctacggcaacttcgacgggaactggaggaactgaacggtggggccc

SEQ ID NO: 29678 - DNA, 409 bp, Zea mays
  Clone ID: LIB3059-056-Q1-K1-B8
aatatgagctctggagctctgtatcatctaaaacagatgtaagaaatgtttggtgctgctgaatacacaacagccattgatgttcggtctgctggctgtgtgctcaatgagctgcttctaggacagcctatgatcactggagaaagcggtgttgatcaccttgctgaaatcatcaaggttctgggcacacgcacacgtgaagaaattaagtgcatgaatccaaattatacccagtataaattcccgcaaatcaaagctcacccgtggcataagatattccataaaatgatgcctgctgaagcagtatatctcgtgtccaggcttctgcagtactcaccaaaacttcgatcgactgctatgaaagcatcggtccatccgttctttgatgaacttcgggatccaaacaccc

SEQ ID NO: 29679 - DNA, 445 bp, Zea mays
  Clone ID: LIB3059-056-Q1-K1-B9
gacactgcagcgtcttattgcattggttgaatcagagagaaactaccaccagaaggtgctacaaattcttgatcaacttgagagagagatggtatctgagcgccaaagaattgaaggggcacctcctccggtggttgagagttccatgcctccaccgcctgcatatgaagaagtcaatggtatattcatgaggaatacggtcgcagagttggtcgagaccgtggagtatttcctggctgaggcaatccaatcatatcgagcagagagcgacactgagctcaacctttcagctggtgactacatagtggtccgaaaggtgtcgaacaatggatgggccgaaggtgaatgcagggggagagctggctggttcccctacgattacatcgagaaacgagagcgtgtgcttgcaagtaaagtcgcgcaagttttctaaaactaaaacttt

SEQ ID NO: 29680 - DNA, 206 bp, Zea mays
  Clone ID: LIB3059-056-Q1-K1-A2
cattggatggatcgacagcttggcagaacttttttcatgctctgcaagatgagggctgttcaatttggtcagaaagacatcccctacctgaacacctacgacgactgcaccattcgctaccccgacctaagggtggtaatggattgtgatccatatggttcttcacaaaatgtcaaggacctaaataaattatagtttaaaaatga

SEQ ID NO: 29681 - DNA, 396 bp, Zea mays
  Clone ID: LIB3059-032-Q1-K1-B9
gcaacatagaaagcacaatagtgtaccaacaatggcagccaaaatattttgcctccggatgctccttggtctttctgcaagtgctgctaccgcgaccattttcccgcaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaact

SEQ ID NO: 29682 - DNA, 223 bp, Zea mays
  Clone ID: LIB3059-032-Q1-K1-C1
ttaaaatctaaagcacttctacccatactgatctatatcttactacaatttcttaattgtcttaactacttataataagaacacattgtatttacatacatttctacttcatcttcaccaatatcagtaaccacctatatcatactcactatctatagcacgcaatactacttacactccctttcaacctcataattataatatacctttacataaattcaat

SEQ ID NO: 29683 - DNA, 192 bp, Zea mays
  Clone ID: LIB3059-032-Q1-K1-C10
gtcagagtgagcaatgacctgaatgaacaattgaaatgaaaagaaaaaagtgttgtgccaaattaaaaaaaaaaaaaaaaaaaaaaaaaaaaaaaaaaaaaaaaaaaaaaaaataaaaaataaaaagaatccaaactcaaaaaaacgaacaaataactaaataatatatgaaatcaaaatacataaaactaa

SEQ ID NO: 29684 - DNA, 396 bp, Zea mays
  Clone ID: LIB3059-032-Q1-K1-C11
ctcaacactattgattctgaaggcgatacgccgctccatcatgctgctagaggagagcatttggatgttgtcaagcttcttctccaggctggggcgtcccccaagaaggagaacacttacgggcagacacccgctgatatggctgaccaagacaccgaagttcgaaccctgttgactgccaagcaaattgaggcaagcacacacatgagtgataattaagcggcattggaatccttagttgcaactggtaatgttgagaaatagccgtaacatcttatctgccatccaaacttcatttgaactgaagtaatactgtaatcagactagtatggaggggttagcttagctacatgatcatgctccttttccttatcgctgcattatactaaagatgaa

SEQ ID NO: 29685 - DNA, 166 bp, Zea mays
  Clone ID: LIB3059-032-Q1-K1-C2
ctgccattcaaccaacttgctttgacaaacctagcagtgttctaccaacaacccatgattggtggtgccctcttttagatttcttatgagttatagttcaataataaagttttttgtctgatgtttgtggcttcccagaaataagaaagtacatttctagattctg

SEQ ID NO: 29686 - DNA, 71 bp, Zea mays
  Clone ID: LIB3059-032-Q1-K1-C3
ttccctctctacccactcttcctgctacattttccttgacatttttatttaacagcttacccctactataa

SEQ ID NO: 29687 - DNA, 430 bp, Zea mays
  Clone ID: LIB3059-032-Q1-K1-C4
cccacgcgtccggtatatgcatatgcggctgcacaagttaagaaagctttggaggtcgctcactacctaggtggtgaaaactatgtgttttggggtggaagagagggttaccaaactcttctgaacactgatcttaagagagaacttgaccatttggctaactttcttcaagctgctgttgactacaagaagaagattggattcaacggaacactgttgatagagcctaaaccacaggaacctacaaaacaccagtatgactgggatgttgcaactacgtttgcttttctacagaagtatggtcttaccggagagttcaagattaatgttgagtgcaaccatgctactctatctggacatagctgccatcatgaactggagactgcacgcattaatgggctgcttgggaacattgatgcatacactggtg

SEQ ID NO: 29688 - DNA, 424 bp, Zea mays
  unsure at all n locations
  Clone ID: LIB3059-032-Q1-K1-C8
cccacgcgtccgctgctaaggagaataccgtgatctaccatcaagtattctcgtgtggtcccaacgatcacatccattctaggtatcaatttcgccaaagttttgctcatcgtaaggagaaaattggccacacaaccatagacttgggtgttgccttagaaaacctggaaacgcaacaggagggagacctggcatgtgccaaaccaatggaacggttgcaggacgttcggggtcatattgtttgcttccctttggagttcatgtgccaagaggacttgagacctttcttcagtgagagcgagtattatacatctccacaagttttccattagggcttgttcggttatttcaatttcatgtggattggtgtgtattggagtgaattaagatgaattttgacttgctatgggatntaaactgactc

SEQ ID NO: 29689 - DNA, 260 bp, Zea mays
  Clone ID: LIB3059-032-Q1-K1-C9
ctgagaaggaactaacattttatttagtgcagacaatccacagtatcaaaaggcatggcaaaatggacagtatcatcagcagaagtatccaaatgggcacggtagtgtacatcttcaaactgaactttcttcataaacagagattaatgactatatagctttgctataccagtcatctcatctttatcatggccctggaagagaaattcaaatcctagatacctgataatgaacatgatatgattgactcacttaaaatt

SEQ ID NO: 29690 - DNA, 426 bp, Zea mays
  Clone ID: LIB3059-032-Q1-K1-D1
cggacgcgtggggcagaaggtgacagtcaaaggcaatgtcaagcctgaggacgtctgccagacggtttccaagtcggggaagaggacctcctactgggagggcgaagccacggccccggacgctgcggcggcttctggagccgaagcagctcccggcaccgcggcagaagcgcctcctgctgctgctccggcggcgccagagatcaccccagccaaagctgacgcctgatcgtcacgctattattcactcacatgtgatgctgcggctgcgactcctaaaccttaaatctagaaatagctggggattgggtttgcattgcatcgtgttcttgccggtctagcaagtgactataagaataatggaataaacgatgacccagtgtgtgtatgatttccgttctgaagaacaacacattccttgcagga

SEQ ID NO: 29691 - DNA, 382 bp, Zea mays
  Clone ID: LIB3059-032-Q1-K1-D10
cggacgcgtgggctcgcgcacgggtgattgctgccctctggcagtatattggagcggggaagcttcagaacccaaatgatccttccttcttcatgtgtgaccctcaattgaagaaggtgtttggggaggacaagctcaagtttgcaatgctgtcacagaggatatctcagcatctgtctgccccgacacccatcaatttggagcacaagattaagctgtcggggaatgaatcgcatagcagtgcttgctatgatgtgctggtggatgttccctatccgctgcagaaagagatgatggcattccttgccaacacagagaagcacatggacattgaggcctgcgactaggtgatatctgcttcgatcatgaagatccatgagca

SEQ ID NO: 29692 - DNA, 251 bp, Zea mays
  Clone ID: LIB3059-032-Q1-K1-D11
gcagatacaatagagtatactatagcggttgttctctaggctgtagcatgcagtggggactggaaaatgttggggttgctctgttgtcggtagtttacatgcgcatgtcggtatgtgtagctaaagctggtggatctcagttctcagatcggactcgagacggggaaaaccattgcccagttggctggttctctgaagttttgtttggtgtaaagaaatggtggtccatcatctactcaaatttttttctc

SEQ ID NO: 29693 - DNA, 340 bp, Zea mays
  Clone ID: LIB3059-032-Q1-K1-D12
gggtcgcccgtgacgctggaccttcgccccgaccgcgtccgtatcttcgttgacaccgtctccatgactccgacagttgggtgatacataccaaatgcaataaacaaaccctactttttattttatgtttccagttaataataaaccaggccttagcttcttggttgtccttccttggttggtgttagcttctaagctactagtacaccattaaaaaaaggaggacctcatgtatggctaccgtgaaaaatgtgatcttgatggaataatatatcataaataagcaattaatgatgataaaaaaaaaaaaaaaaaataaatattatataatgtcacctaa

SEQ ID NO: 29694 - DNA, 377 bp, Zea mays
  Clone ID: LIB3059-032-Q1-K1-D4
cggactcgtggtcggacgcgtgggcataggcatcttccagtcggagtcgccccatggccccgcccacctattctccctgccggcggcagccttaaccctaatctcatcgcctcctcttccttctccagttcctcgaaggcccatcagacaacagcccctctttcttctcagccatgtcggaggacgaagcgaacgctgctgctgcgccggcagagggaaagaactggctgctgaaggggaagcacgacaagcccaagccgtgggacgaggaccccaacatcgaccgctggaagatcgacaagttcgaccctgcctggaacgagggcggcatgctcgaagtcagctccttctccaccctctttccccagtaccgagag

SEQ ID NO: 29695 - DNA, 206 bp, Zea mays
  Clone ID: LIB3059-032-Q1-K1-D6
ttggtacagttatccttttcgtcttttagagggtgaacctcaaggagtgtgatgagttctcaagttctgttgcctgtggcttgatctgtggtgattgtatcttcactgtttattttttcattctgttaaaatttatttttttttttttttctttatttttactattaatctatttattactattaatatttatttatcttatttta

SEQ ID NO: 29696 - DNA, 222 bp, Zea mays
  Clone ID: LIB3059-032-Q1-K1-D7
tcccactctacccatcttcctagcactcttcactctattcttctgatttacattttactcaatcatatcaactttaagactagcttaactattctcaatttcattataaactacatatcaatacataactacctctcctacctctacaatcataataaaatttccaacatatatacaatcctcaatcttactctctcatacatcctactatattaacattct

SEQ ID NO: 29697 - DNA, 379 bp, Zea mays
  Clone ID: LIB3059-032-Q1-K1-A2
aaagaagctcatggaaatttagttggtgtttgttctggctatttgctttccactgaagtaaccgttagactgtagtgtgacatcctaaatattagctccactgtcaactccaaccctgattctcacactcacaatttgattgttggaattctaattgtgctttagggttctatgtgaagatacaaaaaaatattgcattcctattctggtcccgtattgaaattgccagtggtccctctgaattttgatccaattgttataaatttcagatgaactgaataaaactactacttgtaggcaaacaataaaattgtacgggcatttggagagaagagagtagaggataatttgaagaaccacgtggacctttgcaggatgc

SEQ ID NO: 29698 - DNA, 363 bp, Zea mays
  Clone ID: LIB3059-032-Q1-K1-A3
agcactagagacatcatcatgagggagttccggtctggctcctcccgtgtgctcatgaccactgacctgcttgctcgtggtattgatgttcagcaggtgtccctggtcatcaactatgatcttcccacccagccagagaactacctgcatcgtattggtcgtagtggtcgttttggtaggaagggtgttgccatcaactttgtgacccgcgacgacgaacgtatgctgtttgacattcagaagttctacaacgtgttgattgaggagctgcctgccaatgttgctgaccttctgggatcaatttgagaaaaaacataacaaaaaaaggtggtgagggaacccggtaagggattggttttgtcg

SEQ ID NO: 29699 - DNA, 408 bp, Zea mays
  Clone ID: LIB3059-032-Q1-K1-A4
gctagatagcatccaagacaaatagcgctgttggcgatctgaggcaactggtaagcagtctgggcttgggcgcacgccaggcataaagggaaggctctgaacacgttatattcaaaaggcaagacaacatcttctaaaagcctggtgcgacaagcccacggtagttgccaattgcgtacatgcatttgaacagatctgggctctaaaaactgctaacttggtagcagaaagattgatgcattgcatatcataccactggatcaaagagtttagtgaatggccacaatgcatgttcttgagttggcatcaaagttccttccatataataataacaaaatatttgacataatgaatctgttggaggatagacttcaacatgcaaatggaaccgttgttttggcaacaatt

SEQ ID NO: 29700 - DNA, 428 bp, Zea mays
  Clone ID: LIB3059-032-Q1-K1-A7
gacgtacgcgtacgcgcacgaccacgcgtacgaccacgcgttcggtctggaaggccagatatgcggcagaggtgaaggtaatgcctggttcccgagtatcattactacagctctgttgcaagtctggaaggccagatatggcggcacatttaggtagtcagcattgtcgaggaaccctactaatgtctaatacttcctctgttttttatttgtcatgttttagtaaaaaataaattagcgggcgataaatattcgagaacggatgtagtattttttatgtacaggttcggctgcagtttcttgtatcacttttgctgtgttgtgttggacatacggtgttttgcttccaatgaattaggaaaggtgttagaggcttagagccaccgtgttactgattagcgttatgggctgtgtcaggtgcattatgc

SEQ ID NO: 29701 - DNA, 409 bp, Zea mays
  Clone ID: LIB3059-032-Q1-K1-A8
cggacgcgtgggtcatggttgaccacatgaggaagatgaagaacaatgccattgtctggaacattggccaatttgacaatgaaattgatattcttgggccttaaaacttaccttgccttaagcggattaacatataaccccaaaactagacctttgtgtgtccccagacccaaactgtgatatatgtgccctctctgaggctcctgaggaaaccttggtgtgctacagtgcatactactatctgtatagtctgctgattattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagct

SEQ ID NO: 29702 - DNA, 394 bp, Zea mays
  unsure at all n locations
  Clone ID: LIB3059-032-Q1-K1-A9
ctagcaacatacatagtgaagtacactagcaacatcttagcaccaatggcagccaagatttttgccctccttgccctccttgctctttcagcaaacgttgctaccgcgactattattccacaatgctcacaacaatacctctctccggtgacagccgcgagatttgaatacccaactatacaatcctacaggctacaagaggccatcgcagcaagcatcttacggtcgttagcattgactgtccaacaaccatatgccctattgcaacaaccatccttagtgaatctatatctccaaagaatcgtagcacaacaactacaacaacaattgcttccaacaatcaaacaagtagttgcagcgaaccttgatgcttacctncagcaacaacaatttc

SEQ ID NO: 29703 - DNA, 418 bp, Zea mays
  Clone ID: LIB3059-032-Q1-K1-B1
ggtgtaattgcgcaaaagatccttcaacatgcagattgtgctggagctgtgttctagtctgtcatgaagagtgcattactggctgcacaatctagtaatgatactcttttgaagacaactgctgacgcacttggcaagtggaaggatcttttgcgcaattacaccaagacagttgatgaagagatggagatacttttaaagtttgaggaaatgtgtcaagagaccacaaaagatttttctccgctgtttccaaagatcttgccatacctctatgatacggaggtagtaagtgaagatgcaattttgagatgggcggaagagaaagaacatgctgatgagtctgataaagtctttgttaaacagtcagaagcttttattcagtggctcaaggaagctgaagaggaagatgacgaagaag

SEQ ID NO: 29704 - DNA, 392 bp, Zea mays
  Clone ID: LIB3059-032-Q1-K1-B10
ctctcatgctgatggagactgtgagaatgacctccaaagcctgataagtgactgcaggacatacgtgatgttcccagctaatccaaaggtccctccttcggatgcttgctgtggtgtcatcaagaaggcaaacgtttcttgcttgtgctccaaggtcaccaaagaaactgagaaggttgtgtgcatggagaaggttgtgtatgttgctgagcagtgtaagaggccatttgagcatggcttccagtgcggaagctacaaggttccagcaaactgatgatatcacaagagggaagcgcttgacgtagtctttagatttcaattgttgcagccgatcaaccttcttagggttgtataatatgaagtcaatgttgagactaatgtgaggtgggaga

SEQ ID NO: 29705 - DNA, 396 bp, Zea mays
  Clone ID: LIB3059-032-Q1-K1-B11
cggacgcgtgggcggacgcgtgggtccgccgcctcgacatcccctccgcgcgacccggcgccatcctcaactccgccacggggctgggcggcggcggcgccacggccggcgcggcgggtgagaaggcggcggcggcagctgagaagacggtcttcgagctgcggctggaggcctacgatgctgcgagcaagatcaaggtgatcaaggagatccggtcattcactgacctggggctgaaggaggccaaggagctggcggagaaggcgcctgcggcgatcaagggaggcctatccaaggaggaggctcaggcgattgtcgagcgaatgaaggcagtcggcgccaaggtcattattgactgatcagaacaagccttttcagtggtgaagtcctgcaaat

SEQ ID NO: 29706 - DNA, 390 bp, Zea mays
  Clone ID: LIB3059-032-Q1-K1-B12
aaagaagcttctgattaccttgatatcatacggtacccaatggatcttggtgccatgagggacaaggtgagaaagatggtgtacagaaacagggatgaattcaggcacgacgtagcacagatacaactcaatgcacacatatacaacgacactcgctatcctcacatccctccgcttgctgacgagctcatggaggtctgcgaccatctgctttacgaaaacgcagatctgctcaccgaggcggaagatgctatcgagtagcaatataaaaagctagatttagcatttggatcttgctatatcctaacatagatgatgtatctatcttctgatctgtaagaggggaaaaggttgtacattttttgggcctagcagcaatctacatgtgat

SEQ ID NO: 29707 - DNA, 389 bp, Zea mays
  Clone ID: LIB3059-032-Q1-K1-B5
cggtaataagggaagcttgatcgggtttccttacggcggtgatgaagagcagcacaatcgtcgcgcttctgttggctgttgccattctgtcctcgctgtctccatgctacgaagccggcggctgcatcgggaaacccaagaagtcaccgtcgtcgccgagaaggccatacctctcgtcctattccgaggaccaccagaactgccgcttgatctgtagctcgaagggtttcaaggacggtggctggtgtgacgaaagcgtcgagcacaaagtgtgctgctgctcccattagaaatataatatcgtatgttatgttgatgcatatatatgcatcatccatctacctgtgtggtgcaaaattctgaataaaatctacctgtgtggtgcaaaa

SEQ ID NO: 29708 - DNA, 174 bp, Zea mays
  Clone ID: LIB3059-032-Q1-K1-B6
cccacgcgtccgagaagatcaaagccgtcggcggcgccgtcgtgctcaccgccgtagggtcagtccttattcgcctcttggttttgagatctatatctggactagcagtgctttcttgtctcacctatttgtgttaagaagacgtagtttttaaatccattgctccttcctgtt

SEQ ID NO: 29709 - DNA, 423 bp, Zea mays
  Clone ID: LIB3059-032-Q1-K1-B7
gtcaggatgcgacaaacgttggggatgaaggtggttttgcacctaacattcaggaaggcaaagaaggccttgaactattgaaggcagccatagaaaaggctggctacactggaaaggtggtcattggaatggatgttgctgcttctgagttcttcggtgagaaagacaagacttatgatcttaatttcaaggaggagaacaacgatggctcaaacaaaatttcaggcgacagcctgaaagacctgtacaagtcctttgtttctgagtaccctatcgagtcgatcgaagatccatttgatcaggatgactggagcacttatgccaaactcactgatgagattggacagaaagtgcagattgtaggagatgatcttctcgttaccaaccccaccagggtcgccaaggccatcaatgagaagacct

SEQ ID NO: 29710 - DNA, 396 bp, Zea mays
  Clone ID: LIB3059-032-Q1-K1-A12
cccacgcgttcgcccacgcgttcggctgtatgctctctgcaagtatgcgcagagacggcagatagagaatccagtatataaatcgactcaattcactgaaaaaaaagcaagatgaattcattagctgacgacacaaaaacagctaaaaaaagaaaagctcttactcctctacaaggaccaacgtgctcgcccgcgctgccatcaccaagccaggtggaggacatcaacgaaacttctgaaaagcattatgcagccctaaataacaagatatcagcactggaaagcagaagagaaccaggaactatcacagatgcatcagattaattctgagttgggcttatgtcatggttacatctgcccatgtgtccctgaatgctgcatgccatataaactgca

SEQ ID NO: 29711 - DNA, 181 bp, Zea mays
  Clone ID: LIB3059-031-Q1-K1-G2
cgcgcaaattgcaccattaaattcatcgagaggccgtcgacagtgaagatagtttcatcgtcaagtagcaccacccacccccgactcatcctcgcaaccgtcatactgctctccgtgctcgcagctgccaacaccagcgccgacacctcctgcatgccgcggttggccatcccatacaacc

SEQ ID NO: 29712 - DNA, 418 bp, Zea mays
  Clone ID: LIB3059-031-Q1-K1-G4
gacgccacgcgttcgcggacgcgtgggcaactagcaacatataaagctcaatagtgtaccaacaatggcaggcaaaagattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcaaccctattacaacagttacctttggtgcatttattggcacaaaacatcaaggcacaacaactacaacaacttgtgctaacaaaccttggtgcctactctcagcaacagcagtttctttca

SEQ ID NO: 29713 - DNA, 347 bp, Zea mays
  Clone ID: LIB3059-031-Q1-K1-G5
gacgacacaaacctcagttaagagtgccattgttcaagttgagctgggccattcaagcagtgggacctcactcactatggagttgacattgataggaagaagaaaacccctgctgcaaagaaggataatgctgaaggacaagaggttgatgcatcagctgacgaaacgaaaaagagcaaccatgtcacgaggaagcttgagaagcgcaaggagggacttacccttgacccacacattgaggagcaatttggcagtggacggttgctggcatgcatttcttcccgccctgtacaatgtggccgaactgatgggtacatacttgaaggtaaagagcttgagttctacat

SEQ ID NO: 29714 - DNA, 149 bp, Zea mays
  Clone ID: LIB3059-031-Q1-K1-G6
caacccgcacctgtttcgctctgttagcggagccatctcctgaagctaggtcagtacggtaggggcgccggccctacactatccggacgcacttgatggtcggcagcatcagcgactactccatggccagtgtgttccaatttatcatg

SEQ ID NO: 29715 - DNA, 180 bp, Zea mays
  Clone ID: LIB3059-031-Q1-K1-G7
cacgcattctaggtaagttagaccattcataaacagatcatttttactgaaagccaacgcaatgcacgaagggtttcaacagatagggtgcaaggactacgatgtactctatatggacaagctttacagatagcactgcaagaataagtcgcacaaacacaactacacacaccacattaa

SEQ ID NO: 29716 - DNA, 292 bp, Zea mays
  Clone ID: LIB3059-031-Q1-K1-G8
ccggctcgaccaccgtccggagaagatggcaggggagctttaatttaacctagagagaagatcacacggtggagtggctccagaaagttgcacacgagtaaaaggacgggcctcggacctccacaagattttgtcaacgtattttttgtatcaaaagaatcacattaacgagagagaaccctgtacttagcaataaaagattatatcaacatatcttgctcatgttaaggggccgaattttttgtattttaatccttttttcgaaacaatttcacgtttaaaaaaaaacaaa

SEQ ID NO: 29717 - DNA, 425 bp, Zea mays
  unsure at all n locations
  Clone ID: LIB3059-031-Q1-K1-G9
cccacgcgtccgggaggaactgtggaattatggcactaggagcaagtgagcagggtggggtaatgaacgcatttgttacttcaatgggcttcgaacacctagctgtgcaagccaacatgcaacaacaagcgcttgcggcgagcgttttacaacaaccaattgcccaattgcaacaacaatccttgccacatctaacaatacaagccatcacaacgcaacagcaacaacagttcctaccagcactgagccacctagccatggtgaaccctgccgtctacttgcaagagcagctgcttgcatccaacccacttgctctggcgaacgtagttgcaaaccagcaacaacaacagctacaacagtttctgccaacgctcagtcaactagccatggtgaaccctgccgnctacgtacaacaacaacaactg

SEQ ID NO: 29718 - DNA, 397 bp, Zea mays
  Clone ID: LIB3059-031-Q1-K1-H11
cccacgcgtccgctcccgcattgaccacaagttcgacctcatgtacgccaagcgcgcggtcgtgcactggtacgtcggtgagggtatggaggagggcgagttctccgaggctcgtgaggatctggcggcgcttgagaaggactacgaggaggtcggtgctgagtttgacgagggtgaggacggcgacgagggtgacgagtactagacgctctactggcgcggcgtcgtcgggcttgtgtgccactgctatcctgtgatctgccctgagtggctcctatcgtgttatgtttctgtcggttcttatctatctgtcgttgtgtggtttacaacttacgttgtaagactttattcccccgctttgctactgggttattaagtttggcgttattggtttctt

SEQ ID NO: 29719 - DNA, 408 bp, Zea mays
  Clone ID: LIB3059-031-Q1-K1-H12
cccacgcgtccgctcacgcgttcgcccacgcgtccagggcaatgtcgacgccagtggtgaggacttctgtgtcgagccagctgatgagaggaagcctttgcgtgctctctcggatgatggccttatcaggactacaacagggtaccatgtctttggtgccctcaagggagcattggatggaggcctggatattgctcacagctagaagaggtacgctggattcaagaaggacgacaagcacctgtatgctgatacccaccgcacgtacatgtatggaggccatgatgctgactacatgaagaaccttgctgaagaggagccagataagtaccacagccacttacatgcgtacattaagaagggagttgaggctgatgaaatagaagcgctgtacatgaaggttcatgc

SEQ ID NO: 29720 - DNA, 248 bp, Zea mays
  Clone ID: LIB3059-031-Q1-K1-H3
ggtgggttggcttctcctccccctccttttcgggttcgggttcgtgaggtctgcggggttctgtttcggggtgagcggatcgatatggccgcgtcgatgttgataccgctgcttcgtcggcggtctcgcctgggccacggacgaccactccctacacaacgccttcagcacctactgcgaggtcctcgagtccaaaatcatcctcgatcggcagacgcataagtacctcggcttccgcttcgtcacct

SEQ ID NO: 29721 - DNA, 156 bp, Zea mays
  Clone ID: LIB3059-031-Q1-K1-H6
gcctgatggtcaagtcattaccttttggtcagaaaggtttaggtgcccgcgagagtctgttgcaaccgtgccttgtccgcatggaatcgcctggcgtccatgaggccacgtacaactccatcatgaagtgtgatgttgatatcaggaacgatttgt

SEQ ID NO: 29722 - DNA, 349 bp, Zea mays
  Clone ID: LIB3059-031-Q1-K1-H8
aaacacaccaagcgaagctacctatcaacgacttaacaacaatggctacgaagagattagccctccttgcgcttcttgccctttttgtgagcgcaacaaatgcgttcattattccacaatgctcacttgctcctagtgccattataccacagttcctccgaccagttacttcaatgggcttcgaacacctagctgtgcaagcctacaggctacaacaagcgcttgcggcgagcgtcttacaacaaccaattaaccaattgcaacaacaatccttggcacatctaaccatacaaaccatcgcaacacaccagcaacaacagttcctaccagcactgagccaactagatgt

SEQ ID NO: 29723 - DNA, 423 bp, Zea mays
  Clone ID: LIB3059-031-Q1-K1-H9
ctcatggacggcgcgatcccgccgggcccggacgcgcagctggagggccgcctagaggacctgccgggctgcccgcgggaggtgcagaggggattcgccgccaccctcgtcacggaggccgagtgcaacctggccaccatcagcggcgtcgccgaatgcccctggattctcggcggcggaacgatgccctccaagtaactgcgaagagcatagtgcatgaggaatgagcttgtagctagctcatatgtctgaataataagcacagcaagaagatgaatgcatttctcggatcgctcatccggaacaataattaaaggggatccggatttgctcttgtgatactaataacgattcctgctatactcggaagcagctaggctcgtgcccatccaatgcatgcatagatctgacctaccataaaaa

SEQ ID NO: 29724 - DNA, 408 bp, Zea mays
  Clone ID: LIB3059-031-Q1-K1-G12
ggaagattcaggtagcaaggatcctactgcaagtgacggccaagaaatcctgatcgaggaaactgaaccaaatcagcagagcaagcatgcgttaactggctcatttgagaaagtccctgacattgagtctgttgggtcttctgctgagaaatctgtcggtacaggtgatgacttgcttcaatctggtaaaggtgcttgccactcagaaataccagtcgatatcatagctcagctgcaacttgaccctacctctggaacggcagatcatccggcaatctccaaaggggcagacaattttgaaggacaacattatcatacaacagatgaaagcatcggagcaataccaagtacatttgaacctgctgttggtgccaaagttgtatcagttgatgtcactgctgaccttac

SEQ ID NO: 29725 - DNA, 379 bp, Zea mays
  Clone ID: LIB3059-032-Q1-K1-A10
gggtgtcgagggtgcaacacagcagtgagattctttttgaactcatccgctttctcgggctccaacacagcagtgagagaaagcggatgagttcaaaaagggtgtcgagggtgcaaccaagtttctccttagcaagctgaaggacctccaattttttgttggtgagtccatgaaggatgatgcgtctgtggtattcgcctattacaaggatggtgccactaatccgacattcctctatttctctcatggtcttaaggagatcaagtgctaggcgtgcggcgaaattagttacccatgttgggtactatctatgtactattattatatccaaaactatagttgtcctggctgaattgaactcaaaagggtttgtctgaga

SEQ ID NO: 29726 - DNA, 397 bp, Zea mays
  Clone ID: LIB3059-032-Q1-K1-A11
atcgtgggctgtgacctgtcgtcttcgtctccggcagagcaaagcggcggcgaggcgggagatatagaggagagacgagagcgggatggggtacctgtggagggtgcggctgtcttcatttgctgccggcgcggcgacggcttcggcggcggggttcttcctcctctacaaggaccacgtgctcgcccgcgctgccatcaccagccaggtggaggacatcaaggaaacttctgaaaagcattatgcagccctaaataagaggatatcagcactggaaagcagaagagaaccaggaactatcaaagaggcatcagattaattctgagttgggcttatgtcatggttacatctgcccatgtgtttttgattgctgcaggcggtataaactgcagcattt

SEQ ID NO: 29727 - DNA, 314 bp, Zea mays
  Clone ID: LIB3059-055-Q1-K1-G10
cccccctcttccggacgaacttggattttatctcgagaagaaaatcttgtcaaccagtccgttataaagattgggccaaccacattaagtttctattctttttctttttcctttcccttaaccccttatctagctatataactttacattttctcatttttttctttttttttttttaaaatttattttttttttttctttttcttttttttttttttcttactctttatttttttttttttttttctttattttattttttttttttaattttttttttctattttatcttgttggtgtggtttttttttttt

SEQ ID NO: 29728 - DNA, 421 bp, Zea mays
  Clone ID: LIB3059-055-Q1-K1-G8
gcaacagtggtttgctcatgctctccttgaaggcgaagcatatgaaccgcctgtttacatacaaccttgggaaaagggagtggcagaaggttcctgattgcatgctaccatggagtcgaaaaaggcaatggataacatgtggcacagcatttgatccggtcccctgcgccttggtctgacatggaattttaccttctttgtctgagcactataatattttagtcctttcatatcattggcctatctttagatctttctatgttgttgtgacaagttctgcgaaaacgcgtgacttgtttttgctttgtataacgccttctatacattcgtactgtttattttattatcttttatattgtttatttttttattcttttatataatttatattttttttttaattatttttcttattatttta

SEQ ID NO: 29729 - DNA, 258 bp, Zea mays
  Clone ID: LIB3059-055-Q1-K1-G9
cgcacgcgtccgcggacgcgtggggttaatattttggaatgaaagggagtgatgaagtttcttattatagcagtaggaaccgcataaaaatatgggagccgtcattgtatgaaattgatgtctaatattggcgtattgttgtaggctctattgatttatatgttgtcgtttttattaaatatttatttatttttttattttatttattttttatatattatattctatttttttatttttttttttttatttattata

SEQ ID NO: 29730 - DNA, 359 bp, Zea mays
  Clone ID: LIB3059-055-Q1-K1-H10
ccgcgtgtttcaacaatcgccagccctatctttggtgcagtcattggtacaaaccataagaactcatcagcttcggcagctcgtgctacctgtgatcaaccaagtagctctggcaaacctttctccctactctcatcaacaacaatttcttccattcaaccaactgtctacattgaaccgtgctgcttatttgcagcaacaactattaccattcaaccagctagctactgcctactctcatcaacaacaacttctttcatttaaccaatttaccgcactgaacccctcttgcttagtgcatcttcaaatactactaccatttatcctgctagcttcatcaatctctttctttatttttt

SEQ ID NO: 29731 - DNA, 190 bp, Zea mays
  Clone ID: LIB3059-055-Q1-K1-H6
gtcatgatggacttgtgaatgattttcacatctactccaacaacttccaagaaagcgcacgtttattttaaccttcgccagtacgacccccacttctactcaaactagcgccactacaactaccacttgctctcctacttcctcgccttcaacaacatcttactcaacatacctctctacaacttcattt

SEQ ID NO: 29732 - DNA, 426 bp, Zea mays
  Clone ID: LIB3059-055-Q1-K1-H7
ggtagccaattagcgcaatatctgatatgcaccttacgacttctaactttgcaagatttgttctctgatagacatgggcatgcagatgcacttatgggtagatatatgaatcagttagtattataggtatatgttgtgtgcattatattggctaccaaatcacaaataaaaggtgcagagtccgcagtcgcttcattactgttgctagcgcaagttataattttgattttttctttttttttatattatttttatttttttttttttttttttttatttatttttttttggggggggtttgtttttttttatttattttttatttttttttatattttttttttctattttttttttattatattatatttatatttttattttattatttttttttttaattttttttttttttttttttatttt

SEQ ID NO: 29733 - DNA, 389 bp, Zea mays
  unsure at all n locations
  Clone ID: LIB3059-055-Q1-K1-H8
cctagtgccattattccacagttcttcccaccagttacttcaatgggctgcnaacacctatctgtgcaagccaacatgcaacaacaagcgcttgcggcgagcgtcttacaacaaccaattgcccaattgcaacaacaatccttgccacatctaacaatacaagccatcacaacgcaacagcaacaacagttcctaccagcactgagccacctagccatggtgaaccctgccgcctacttgcaagagcagctgcttgcatccaacccacttgctctggcgaacgtagttgcaaaccagcaacaacaacagctacaacagtttctgccaacgctcagtcaactagccatggtgaaccctgccgcctacgtacaacaacaacaactgctttc

SEQ ID NO: 29734 - DNA, 214 bp, Zea mays
  Clone ID: LIB3059-055-Q1-K1-H9
gacccacacgtcctgtcatcatcaacttctgcatgctttttgcgagacggacagagccatagagaaagtatctttcagattttggtacggcctcctcactctaaccagccagattatttcaagcttgtgaatgctctcttgtctaaacacaatgttcaccttgtcacttttccttctgctaatactcatatctatgtttcttatcttttcaata

SEQ ID NO: 29735 - DNA, 320 bp, Zea mays
  Clone ID: LIB3059-056-Q1-K1-A1
gtttctcggggtctcctatttcactggttcactccatctggacatgactgcggactcaacctgtttttcattgtcttcacgttgattcttgtttttgcgtttgctattgttgccctgcacccaaagatcaatggaagcttgttgcctgcatcagttattggtatgtactgtacatatctgtgctacagtggactctccagtgagccaagggattacgaatgcaatgggcttcacaatcactcaaaagctgtgtcaactggtagccttacattgggactccttaccacggtcctctctgtggtctattctgctgtccgcgc

SEQ ID NO: 29736 - DNA, 319 bp, Zea mays
  Clone ID: LIB3059-056-Q1-K1-A10
ctgaaccccgctgcttatttgcagcagcaaatactactaccatttagccagctagctgcagcaaaccgtgcttccttcttgacacagcaacagttgctgcctttctaccagcagtttgcggctaaccccgcaaccctcttacaactacaacaattgttgccctttgtccaacttgctttgacagacccagcggcctgctaccaactacacatcattggtggtgccctcttttagattgcttattagtcgtaattcaataataaagtttcttggatgatgtatgttgccaaccagaaatatgaagttacatttccagaaa

SEQ ID NO: 29737 - DNA, 387 bp, Zea mays
  Clone ID: LIB3059-056-Q1-K1-A12
gcaaagggtcagtggatcacatcttctttttctggacttgtgttccgccttggtaacggagctgagagttctttgagcctgacatgattggcttcccaagcactccttgatgcacccagtggagtttcaagttacatttgagatgtacataatgaccatatataatcctccagtagattatattttctggagcatgtaatgtagacgttagaggcttgtcctggtttgccaagatggttgttacctaaggtcctaacaagaggccgcaggcgagcccagtccaattagatgatgtgaaaaatttttggcctttttttagtctttggacatgttatcaaattaaggaggtcgtgctagcacgatacccaaactaagaaataacaaaaa

SEQ ID NO: 29738 - DNA, 464 bp, Zea mays
  unsure at all n locations
  Clone ID: LIB3059-055-Q1-K1-E1
ggctaacttctcataattcgtaacctgatttgtacgacagaagagctcttgtgtggtntgttcgtattgaaccattagaacctatgttgcatacctttaaatgatnncccctactgaagaccaatgtggataacctcttccctgtcatgccatctcagattaggaacatagcccgctttggcgtgtcctcagttgctgtcaagctctatgtaattggtggttccatttatctagtttttcctcttactgtatattattacattatcttttctattctattttgttatttctttttatatttttatatgtttgtgtttttattattcgtttttttatttttttattctttttcttttatttttttttttttatttttttatttttattatttatatttatttttattttttttttatattatttttttttattttttcatatttttttttattttattatttttt

SEQ ID NO: 29739 - DNA, 302 bp, Zea mays
  unsure at all n locations
  Clone ID: LIB3059-055-Q1-K1-E11
tgtatctagagcttgtaacctaagcttttttcattaaggtggtgtttatttntntttgcantttttaaatttgtttgtcccctattttatttttttttttttttattttatttttttatttatattttttttatttttttttatattatttatttattttttatttttatttatttatatattattttttttaattttatttttttttaatttttttttttatatttttttttttttattttttttttaatatttattttttatttttttattatttttttttttttttattattttttttt

SEQ ID NO: 29740 - DNA, 376 bp, Zea mays
  Clone ID: LIB3059-055-Q1-K1-E12
cggacgcgtgggtgctgcatactcttatcaacatcagtttcttccattcaaccaagttgctgcatagaactgtggtgcttatttgcaacaacaattaccattcagccagctagttgctgcctacccccagcaatttcttccattcaaccaactagcagcattgaactctgctgcttatttacagcagcaacaactactaccattcagccagctagctgatgtgagccctgctgccttcttgacacaacaacagttgttgccgttctacctgcacgctatgcctaacgctggcaccctcttacaactgcaacaattgctgccattcaaccaacttgctttgacaaactcatcagtgttctaccaacatcccatcatt

SEQ ID NO: 29741 - DNA, 421 bp, Zea mays
  Clone ID: LIB3059-055-Q1-K1-E3
cgtgacgtttagctttaagcttgctattaatggaactgttaacaatgttgattctgcaagtgtattctggctatgccgtgaggtgcaaagatcctatatctgctcatgaaatgacccatatggaagttcaagtttgcaacaacacaaaggaaattattcggatgaaccttaacatttcatgcaaagatgttgcaggacagaattgcttcgatgaaaatagtgcaactgttctctgggctgttgttcttagcgatattcaccttgaagttttatcttttcaagttatttttgaggggggtttattttctttatttttattttttttttttttttattttatttttttctattttttttttttatatttttttttttatttttttttctttttttttttatttttttttatatattttatttt

SEQ ID NO: 29742 - DNA, 375 bp, Zea mays
  Clone ID: LIB3059-055-Q1-K1-E8
cggtcgcgtgggctgacgctttggtttcagcattcaaaaacacaccaacgtaagtctactatcatcgatctgaacaccaatggctaccaagatattagccctccttgctcttcttgcccttttagtgagcgcaacaaatgcgttcattattccacagtgctcacttgctcctagtgccattattccacagttcctcccaccagttacttcaatgggcttcgaacattcagccgtgcaagcctacaggctacaactagcgcttgctgctagcgccttacaacaaccaatggcccaatttcaacaacaatccatggcacatctaaccctacaaaccattgcatctcatcatcaactacaacattttcttccatcact

SEQ ID NO: 29743 - DNA, 416 bp, Zea mays
  Clone ID: LIB3059-055-Q1-K1-E9
ggaaaaaaattagatgatctttgacttgcttaggatttaatcctgactcattctcactctatattcagatcgattgagagctaaccgaacaagccctaatgggttgttctgttatttcttatacacatgtgttttatttaatttattttatttatatgtttttatttttttttttttttatcccttttttttttttttttttctttttttttttatttcttttttttctttttcttttttttttttttttttttttttttctttttattattttttatttttttggggttgttttttttttttattttttttttttttttttttcatttttttatattttttttttttttttttattatttttttttattatcttttcattttttttttttattttattttttttttttttttttt

SEQ ID NO: 29744 - DNA, 368 bp, Zea mays
  Clone ID: LIB3059-055-Q1-K1-F1
gccacgcgtccgcccacgcgtccgtttaaaggtgcatgggactccttttgaaatggacggctctgaaggtgaatggtctgagtatgatgagaagggagaatgccccgttgagctaggcaagctgcagtcaacattcaaagtggtaagcaggcaattgcttcctgcactaccatatttatcatcatttctatccctccatatacttttgacattattgtgattgacaacaggtgaagaagcatgagaggggtgggaagactagatttgtctagatcgagtgacttggaatctgacagatattggagttggcggtgtataaatggtagatttgggctgaaggtcatgcgtgatccgatctctttttcttc

SEQ ID NO: 29745 - DNA, 427 bp, Zea mays
  Clone ID: LIB3059-055-Q1-K1-F11
tcccgcgcggccacgcgtccgaccccggggaggttattaaaccagttttcacaaggccattaacgatgaaggtatgcctcatcatggccttggctgcatgaacgaccgtctgtttgttgaattcaacgtcgcgattcccgagccttactctctctatcctgcccagatcctatctttttcataagatcctttcactcaaactctttttccttctttaatctcttcatctctatctgttctatttaatcatgctttacctattatcattttatttttttcattttttctttattcttttcttctctttattgggggggctttcattttttcttattttttttttattctttttttttatatttattattttttttttctttttattttctattttatttctatttttcttatttattattattttttt

SEQ ID NO: 29746 - DNA, 379 bp, Zea mays
  Clone ID: LIB3059-055-Q1-K1-F5
cgtaccattcagccagctacctgctgtctacccccagcaatttcttccattgaacgaactgtcagcattgaagtctcctgcttatttacagcagcaacaactactaccattcagccagctagctggtgtgagccctgctaccttcttgatacaaccacagttgttgccgttctaccagcacgctgcgcctaacgctggcaccctcttacaactgcaacaattgctgccattcaaccaacttgctttgacaaacccagcagcgttctaccaacaacccatcattggtggtgccctcttttagatttcttatgagttatagttcaataataaagtttttttgtctgatgtttgtggcttcccagaaataagaaagtacatt

SEQ ID NO: 29747 - DNA, 310 bp, Zea mays
  Clone ID: LIB3059-055-Q1-K1-F6
cgccacgcgtccggaaaggggttaatctaccaatccgcttaggggacctccggatggattctttgattgctatggcgtacctgccgctctataaggaatgcatgaattccaatgggcaacttttgcctcaaaggcttacaggtcagcttgtacagcctgcaatcatgctctagtaccagcaagcttaaagtaactcctccaccatataactcttttccatcttgaagcactacatacaactatctatgattcactcttcaatttactcttcattaatccattattaacgggggctttttttacattcttt

SEQ ID NO: 29748 - DNA, 403 bp, Zea mays
  unsure at all n locations
  Clone ID: LIB3059-055-Q1-K1-D9
attcccggtgcggccacgcgtccggcacgcgtccggccttctacagccttatgagcaaatttagaacttctacctctttgaataagaataaagcgtgtactctcaaagactctaaaatatgaaacattgggcttgtaaggaaaatggaccccgggccatttggctaattgagttttggtgtttgatgaacaacacaatccatgagctaataagttttctagtgtttatgtntgtaagtttatatttttcaatgatttttttgactttatgaatttatgtatgtttttttttttttttatatctttttattggggggggggtttttttttttttttatttattttttttttttctttattatttttttttttattatttttttattatttttgttttttttttt

SEQ ID NO: 29749 - DNA, 282 bp, Zea mays
  Clone ID: LIB3059-055-Q1-K1-F8
ggactgactcactgacccgtaccctttcccggcgggacttcctctcgaatgttggcagtcgagaccctagttgccccacgaaccgaggatccaagatgagtttcctgttcgggaagaggaagacgcccgccgagctgttaagagaaaacaagagaatgctagatcgatccatcagggaaattgagcgagagagacaaggattgcatgcccaggagaaaaagctcatcactgatatcaagaaaacagctaatgatggccagattggagcttgtcaaagtattg

SEQ ID NO: 29750 - DNA, 397 bp, Zea mays
  Clone ID: LIB3059-055-Q1-K1-B6
cgccacgcgtccggaccaactagcatctatagaaagcacaatagtgtaccaacgatggcagccaaaatattttgcttccttatgctccttggtctttctgcaagtgttgctaccgcaaccattttcccacaatgctcacaagctcctatagcttcccttcttcccccatacctctcaccagcggtgtcttcaatgtgtgaaaacccaattgttcaaccctacaggatccaacaggcaatcgcaacaggcatcttaccattatcacccttgttcctccaacaaccgtcagccctattacagcagttacctttggtccatttggtggcacaaaacatcagggcacaacaactacaacaacttgtgctagcaaaccttgctgcatactctcagcaacatc

SEQ ID NO: 29751 - DNA, 162 bp, Zea mays
  Clone ID: LIB3059-055-Q1-K1-B9
tactctccccacatattctcccaacaccaccaccagcaaccaaaagcaagctattaacactttcgggacctcaatccttacacctacaccaacattatccaatataactaaaacatccatcacaaatttatctactcctcccattttaaatatattaactta

SEQ ID NO: 29752 - DNA, 241 bp, Zea mays
  Clone ID: LIB3059-055-Q1-K1-C11
cgcgtccgggcgttctgtaaactgtaaattcgtatgtcgaatctgacaatctggacggattcagtccatatactaagatctggtgttgcgggatctgtggagttagttagggttactttgctacctcgttcagttgtgcttgtgaaatgaaactgcagatggttattaaatcccctgcattttccctaaatatattttttttattttttttattttttttttttattatttttcatctttt

SEQ ID NO: 29753 - DNA, 284 bp, Zea mays
  Clone ID: LIB3059-055-Q1-K1-C12
gaacaattgcttgaacaggttattgtttttgttgatgcttctgaggctgatgaatgtttaaaagttgcttggaagcctttagaatcattaccatatgattctcctgggcagacctttgtcgcttttgagaagccagaaagtgtcattgctactggcaagttctcaaatatcctgaaattcattgttaaggaggttgatccatccacgggtgaaactgaagatgattgtgttgaggatttgtttccatctttaatttcttgattttattttttgttgattatttt

SEQ ID NO: 29754 - DNA, 433 bp, Zea mays
  Clone ID: LIB3059-055-Q1-K1-C3
gccacgcgtccggtgtggtgcctcatttttcaaacccgggagagcgggcacgcagcttgcatagaggaggagctggtcccttccgcgctcctcaagttcattcccagggagactgattccgtggtcttcaccggtttgcttgatgagcttctggaggccagtgagccgcttcctgctgcatcacaatgaagtgtgtgtatatagcagttcgttctgttgctgtttctgcttgctgcatcacaggattacttggataacggtacgtatttgtattgtctgacatatcttgtggaaaggctgtcatactcttaaattcttttggcccattcttaactttatatgttctgtactgtgcttatctgtactttttaactttatttcattttcttgatttcttgtttattcttattttttattttatattttttttttt

SEQ ID NO: 29755 - DNA, 419 bp, Zea mays
  Clone ID: LIB3059-055-Q1-K1-C6
ggaagatgctctgacttttgaagacttcagcatcatgcctcagaagctgagagggtacccggtggagtacctggtgtcttacaggaagggcgggccatcgttcggctcgaccgtgagcgagaagatgaggagctcggagatgtagggagcctcgtaccacctccgaagatactgtagattcctatgatcatttggctgcattgttctggccacccgtcgccgtctcgcctgttggagcagcaggaccaaattcccttgcgtggctcctgctctttgccttgtttgtttgtacgccaataaggacccaaatttccgtgcatgttaagagatgaaagaatcgttccacagttttacagttgaaggtttttttctgtcactgtatgatacaatattattcttgtatctggaatttatatttt

SEQ ID NO: 29756 - DNA, 157 bp, Zea mays
  Clone ID: LIB3059-055-Q1-K1-C7
cccacgcgtcctcagacgcgttggctcaaattgcatgacatcatctcctggtaagtaaccttacaactttcgccacggccaccaatcacaagacctacaattctctcctattgaaagttaaccaaatcagatctgtgaccaatagtatctaatcttt

SEQ ID NO: 29757 - DNA, 367 bp, Zea mays
  Clone ID: LIB3059-055-Q1-K1-D1
agcaagctaagcgcactagcaacgatctatcaccaatggctaccaagatattatgcctgctttctcttcttgcccgtttagtgagcgcaacaaatgcgttcattattccacagtgctcacttgctcctagtgccagtattccacagttcctcccaccagttacttcaatgggcttcgaacatccagccgtgcaagcctacatgctacaactagcgcttgctgcgagcgccttacaacaaccaattgcccaattgcaacaacaatccttggcacatctaaccctacaaaccattgcaacgcatcaacaacatcatcagtttctgccatcactgagccacctagccgttgtgaaccctttttacctact

SEQ ID NO: 29758 - DNA, 406 bp, Zea mays
  Clone ID: LIB3059-055-Q1-K1-D12
caaatgatgaagtgaaaagtcagctatctcatttccttccaacttctcgccggatcgttcagttttcaaatgggcaggctccttcgccaggtgctcgtgttgtctatgtagatggcacatttgatcttttccacgctggccatgttgagttcctcaggagtgccagacaacttggtgactttcttcttgtgggtatctatgacgactagtcgatcagggatagaagaggctgtcgttctataatgctattttcatgagcgtactcttgttgttcttgccttctcttttgggggtgtatttatttattttttcatttttttatgtttttttttttctttatctttcttttttattttatattcttttatttttgttttttttttttttttttttatttttttttttt

SEQ ID NO: 29759 - DNA, 412 bp, Zea mays
  Clone ID: LIB3059-055-Q1-K1-D4
tgcgccagacttcgtagccgaggctttgttctaccaggagttcatcaacgtgaaggtctgttattacattgggaagaagtacgtcattctgttcttctaccccttggatttcaccttcgtctgcccgaccgagattactgcgtttagtgacagatacgaggaatttgagaagttgaacactgaggttcttggtgtttccattgacagtgtgttctcccaccttgcatgggtgctgacagacatgatgtctatttttctcttctttcttattttcttatttttttttgttgtgtctttatttttttcttttttcttttttttttttttcttttcttatttttttttattattttttttttttattttcttcatttcatttttttttattctttttttttttatttttttcttt

SEQ ID NO: 29760 - DNA, 429 bp, Zea mays
  Clone ID: LIB3059-055-Q1-K1-D5
tttgaagaaaaaacaaaacttaaatatggtggtgagggaacctggtaagggttggttttgttgaaatatcgtgggagaggttgtgataatttactttttttattttttttaattttatttttttttgttttattttttttttaattttttttttatttttttattttatttattattttatatttttttttttttattatttattttattttttttttttttattttttttttttttattatttttttttttttttttttttttttttatttttttattattttttttttattttttttttatttttttttgttttttttttatattttttattttatttttattttatttttatttattattttattttttattttttatttttttttattttatttatattttattattttttttttatttttttta

SEQ ID NO: 29761 - DNA, 379 bp, Zea mays
  Clone ID: LIB3059-055-Q1-K1-D6
gcttcagtatgtgaaaacccatctcttcaaccatataggcttcaacaagcagtcgggagcaagcaacatacctgtatcgcccttgttgtgtcaacaatcgccagccctatctttggtgcagtcattggtacaaaccatcagggcacaacagctgcagcaactcgtgctacctgtgatcaaccaagtagctctggcaaacctttctccctactctccgcaacaacaatttcttccattcaaccaactgtctacactgaaccctgctgcttatttgcagcaacaactattaccatttagccagctagctactgcctactctcaacaacaacaacttcttccatttaaccaattggccgcactgataccccgctgcttattt

SEQ ID NO: 29762 - DNA, 400 bp, Zea mays
  Clone ID: LIB3059-055-Q1-K1-D7
gccacgcgtccggcaccgtctaggtctggaaccttaccaactgcaagcttgtctgcactctggatgggcacggtggctatgttaacgccgtcgctgtgagccccgacgggtcgctgtgcgcctcctgctggaaggacggtgttactctgttttgttatttgtctgtaattttaatttcttttttttttttttttttttttttcatcttttttttttgtttctatttctttttttattttttttgtttttatattttatttttttttatttttcttcttctttttgtggggggggttttttattttttctttttattatattttttttatttatttatttatttatttttttatttatttttttatatttttttttttttattatttaattttatttattt

SEQ ID NO: 29763 - DNA, 425 bp, Zea mays
  Clone ID: LIB3059-055-Q1-K1-B4
gaggcatcagtgcagcccgacggcttcgccctactgctcgcctcagtgccagtcggtgcgttagcagtgttgccagcagctcatgcaggtggagccgcagcaccggtaccaggcgatcttcggcttggtccttcagtccatcctgcatcatcagcctcaaagcggccagttctcgtagcttttgtcattttcaattattttaacatctttatttttattttctttcctttttttttttcttattttttattattttttttattttttttttttttaaatttctattattttttttttggttgggtttttaatattaatattattattttttttttatttattatttttatatttttttttatttatatttttttttatattttttttttatattatattattttattttattatttttttatttt

SEQ ID NO: 29764 - DNA, 221 bp, Zea mays
  Clone ID: LIB3059-055-Q1-K1-D8
aaagtatatgaagggttgtactgctttgcaactagaaacttcaagaaagcgtctgttttattcttggattgaatgtcaactttcacgacatatgagctattcacatatgatacattcatcttctacacagtcctcacgagtgttatatctcttgaccgtgtatctctgaaacaaaaagttgtagatactcctgatatcttatccataattttcaaatttcc

SEQ ID NO: 29765 - DNA, 415 bp, Zea mays
  Clone ID: LIB3059-031-Q1-K1-E12
atcagtttcttccattcaaccaactggctgcattgaactctgctgcttatttgcaagggcaattaccattcagccagctagttgctgcctacccccagcaatttcttccattcaaccaactagcagcattgaactctgctgcttatttacagcagcaacaactactaccattcagccagctagctgatgtgagccctgctgccttcttgacacaacaacagttgttgccgttctacctgcacgctatgcctaacgctggcaccctcttacaactgcaacaattgctgccattcaaccaacttgctttgacaaactcaacagtgttctaccaacaacccatcattggtggtgccctcttttagattgcttatgagttatagttcaataatgaagttttttggatgatgtttgtggc

SEQ ID NO: 29766 - DNA, 301 bp, Zea mays
  Clone ID: LIB3059-031-Q1-K1-E2
ccggccggagccacgcgttcgcgggccggcgccgccgtgacggaaggttgaggatgagcaaggagcacgacgcgatagtcaggtcaacgggtggagcgcgcaccctaagaactacggccctggctcccgcgtctgccgggtctgcgcgaaccctcacggtctgatcaggaagtacgggctcatgtgctgcaggcagtgcttccgcagcaacgccaaggacattggtttcatcaagtaccgttgaagaggccactgtgctgctgtggagaactttctacatcaaagaaatgggttcttcatt

SEQ ID NO: 29767 - DNA, 252 bp, Zea mays
  Clone ID: LIB3059-031-Q1-K1-E5
gactgacaagcacagcaaggctcgtgagttcgcacacaccaagcaagcaggccagtagggcgcattcgggtcacagggtctccgtcgtttcccaacgcgctttccccggcgccatggccaggctggcgctagcgctcctactgctgctggccgtggcggcatccgcgtgggccggcgccggcgcgagccacctcgatctgggcctgggctttctatgctccggggaccgccggcgggaatgccgaggcacgg

SEQ ID NO: 29768 - DNA, 299 bp, Zea mays
  Clone ID: LIB3059-031-Q1-K1-E8
ggcagccaaaatattttttctttttatgctccttggtatttctgcaagtgctggtacttcgaccattttgccgcactgctcacaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacagcagctacctttggtgcatttattggcacaaaacatcacgtcacagcgactacaac

SEQ ID NO: 29769 - DNA, 337 bp, Zea mays
  unsure at all n locations
  Clone ID: LIB3059-031-Q1-K1-E9
acaatagtgtaccaactatgtttacncaaaatattttgcttccttatgctaagtggtctttctggaggtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatctgttggcacaaaacatcaaggcacaacaactacaacaacttgcgctaagaaacc

SEQ ID NO: 29770 - DNA, 83 bp, Zea mays
  Clone ID: LIB3059-031-Q1-K1-F1
accatcttacaactacaacaattattaacctttacacaacttactctgacaaacccaacaacctcctaccaacaacacattat

SEQ ID NO: 29771 - DNA, 424 bp, Zea mays
  Clone ID: LIB3059-031-Q1-K1-F10
gcacaatagtgtaccaacaatggcagccaaaatattttgcttccttatgctccttggggtttctgcaagtgttgctaccgcaaccattttcccacaatgctcacaagctcctatagcttcccttcttcccccatacctctcaccagcggtgtcttcaatgtgtgaaaacccaattgttcaaccctacaggatccaacaggcaatcgcaacaggcatcttaccattatcacccttgttcctccaacaaccgtcagccctattacagcagttacctttggtccatttggtggcacaaaacatcagggcacaacaactacaacaacttgtgctagcaaaccttgctgcatactctcagcaacatcagtttcttccattcaaccaactggctgcattgaactctgctgcttatttgcaacaacaatta

SEQ ID NO: 29772 - DNA, 305 bp, Zea mays
  Clone ID: LIB3059-031-Q1-K1-F11
gagaatgcatgcagtgagcttggagcccgtatgtctgccatggacagctctagcagaggtgctggcgatatgcttgatcgtctcacgcttacttacaacaggacacgccaagcatccatcaccacagagcttactgagattatatctggtgcatcagcccttgaaggataggccaacgacagtgatgatgccgtgcgcctttgcatattgcaaaaatgatgttctacatctatggtgaatggctggttttcataaatggtgatgatcaatatatgtatcttgcacatgattagcaagttcacgtg

SEQ ID NO: 29773 - DNA, 412 bp, Zea mays
  Clone ID: LIB3059-031-Q1-K1-F12
gaagaaccttgctgaaaaggagccagaaaagtgccagagccacttaagtgcgtacatgatgatgggagtagaggctgatgaaatacaatcgctgtacacgaaggaccatgctgacatcacgagccgatccttccattgataagatcaaccgaagcagtcaccaattgagcgtaagaggtacaaccccaagaagctgacatatgagcagatgaaggccagcctaattgaaaggctcaaccaactcaactgctccggaggtgctgatgacaacgatgaggacgactagtaaaggtaattgccatcgaagtagtgctatctcaatccagcgatcagcaattgtgtactgtcttatgcggggacctgtagtactgcaataggcattattgtttaagtcttgcgaagggaacaaaac

SEQ ID NO: 29774 - DNA, 285 bp, Zea mays
  Clone ID: LIB3059-031-Q1-K1-F2
atgagttgttccatacattttagtttatgtttgagattgaaccaagaagtgagcattatgctggaggggtggactcgctttgccgtgcaggaatggaagagcgagcttatgagatcatacaggggatgccaatgagaccttccatttctgtctggggagcactacttggggggtgcaagatgcatgggaagacagagctaggaaggattgctgctgacaagttgtttgaacttgatcctcaagatttatgcaatcatgttttgctctctaacatgcttgcatctg

SEQ ID NO: 29775 - DNA, 217 bp, Zea mays
  Clone ID: LIB3059-031-Q1-K1-F7
acacatcacatgcagctcgagatttatttatagagaaagattccgttttttaagcacgatcaccacaaccagtcggctccccctacctcccaccccaaccacacattcaacatcttctgccacaccaaccaaaactactgcctgaccactcttaacaacaccaccatactctcccccatcaaccccaaatactaccaccaacactaatacaaataca

SEQ ID NO: 29776 - DNA, 210 bp, Zea mays
  Clone ID: LIB3059-031-Q1-K1-F8
cacgcatgctcctttcgccatcaaaccggtgtatgacttatgactgccatgctgctcacttagatctgtatgaagttgacggccggatatccttcttcacgcctgtataagatgttgaaaggatctgaatggccgaacatcaccctaacgaccgccttcctgtttcctgggattgctatcagtattcccttcatccttaatgctctaata

SEQ ID NO: 29777 - DNA, 284 bp, Zea mays
  Clone ID: LIB3059-031-Q1-K1-F9
gcacaacaggacctactgcgctgaaattgctcacaacgtgtccactaagaagcgcaaggagatcgtggagcgtgctgcgcagctcgacattgtggtcacgaacaagcttgctaggctccgcagccaggaggacgagtagtctggtttcttgtcttaacgacgaactggatgttgccattcctttctgtaggaaactactttgcttgtgtcttgttagtactgaaaaccagagtcactcctacctttttgcaatcagtagctactaaaatgtggcagattccact

SEQ ID NO: 29778 - DNA, 288 bp, Zea mays
  Clone ID: LIB3059-031-Q1-K1-G1
cgacgctctatctctttcgttgtattcctcgaaaccctaggagcgtgctggaccggttgttgcgaggtgatggcgatggaccctgacgcggtagcgaaggccttcgtggagcattactaccgaacgttcgacaccaaccgcgcggcgctggttgggctgtaccatgagacctccatgctcaccttcaagggccagaagttccagggcccgtccgtcattgccggcaagctcggatctctccctttccaggcctgctagcatcatattctcaccgttcactgtcatcca

SEQ ID NO: 29779 - DNA, 411 bp, Zea mays
  Clone ID: LIB3059-031-Q1-K1-G10
cccaggccttgaaggttgccaaggctgtgaagtctgggtcagtaaagaagacgaagaggatccgcacgtccgtgacatttcaccgccccaagaccctgaagaaggctagggaccccaagtacccaagaatcagcactaccggaaggaacaagcttgatcagtaccaaattctcaagtatcccctcaccacagaatcggcgatgaagaagattgaagataacaacactctggtcttcattgtcgacctcaaggcagacaagaagaagatcaaggctgctgtcaagaagatgtatgacattcaggccaagaaggtcaacaccctgatcagacctgatggaaagaagaaggcttacgtgaagcttacgcctgactatgatgctcttgatgtggccaacaaaatcggcatcatct

SEQ ID NO: 29780 - DNA, 184 bp, Zea mays
  Clone ID: LIB3059-031-Q1-K1-E1
atttataccaacaagcattttacttattggaatccagtagcaacaatagagcaagcatttttaccaagataggttccctccttatgctccttgatatttatgcatgtattgctaactccacaattcatcccttaatgctcacaaactcctatagcttcccttcttaccccataccttccatcaa

SEQ ID NO: 29781 - DNA, 425 bp, Zea mays
  Clone ID: LIB3059-031-Q1-K1-G11
ggaggcgatgcggatactggagcaaggcgcctcgaacctgcagggaggaggcgagggcggtgccgaagctgttgggttgctcatgctcgctatgtccacgctgctttaccggagtggaagacgtcaagacgcagtggaaaagctcaaagcaacccaacaagttgccccttctgcagtttttagagttgcagcgtgggaagcactaatgggattacacatggaggcagggcaggagatgtcatacttgatttccccaaatgattcagttgatctgtcaatcaaatatgatagcaaatggtctgatcaggaccatcttaaatttcgggttaatgctgtcagaggacttgttacacttctgaatggagaaacagaatcagctgcccagctgttcgatggttggtgcagagacttttctagaggcgaaa

SEQ ID NO: 29782 - DNA, 316 bp, Zea mays
  Clone ID: LIB3059-031-Q1-K1-B2
ccggttcagaatccgcggcgggagccacgcgtgcgcttgttgctggcagcaatgattattcattatatgtctatgatcttcatgcaagcaaagtgacattacgttgatgtgctcatacatctgatgtcaatacagtagcatttgctgatgaaaccggccatctcatatattctggaagtgacgacactttatgcaaggtctgggacaggcggtgtttgtccgcatgacaggctgccggagttttgactggacatttgcatgggataacacatattgacagtcgtggacatggacgaagtctcatatccaatggaaa

SEQ ID NO: 29783 - DNA, 187 bp, Zea mays
  Clone ID: LIB3059-031-Q1-K1-B4
ccacgcatcctggcaccaccaatgatgggttgttggtataacactgttgaattataattcaatgatcgatttttttggatgatgggcgagccattccacaaataagaaagtacatttctaaaaaaaaaaaaaaaaaacaaaaacaaaaaaaaaaaaaataaaaacaaaaaaaaatataatacacaac

SEQ ID NO: 29784 - DNA, 213 bp, Zea mays
  Clone ID: LIB3059-031-Q1-K1-B5
cccactcgttcgcagactcattagaaaaaaaaaaaaaattaaaaattaaaaaaaaaaaaaaaaaaaaaaaagaaaagaaaaaaaaaaaaaaaaaaaaaaaaaataaaaaaaaaaaaaaaaaaaaataaaaaaaaaaacaaaaaaaaacaacacaaaaaaaaaaaacataaaaaaaaaaaaaaaaaacctaaacaaataaaaaaaaacaataat

SEQ ID NO: 29785 - DNA, 176 bp, Zea mays
  Clone ID: LIB3059-031-Q1-K1-B6
gccatctctcatgcatcatcatcagcagctgctgtcaccccaaggtctcaaccccatggccatgatcatggctcataacatgtctatcatgattgtactctaccaataccatctgcccaactaccgtaccaacccctgtagcatctcctcttccatttctacctactactgattca

SEQ ID NO: 29786 - DNA, 255 bp, Zea mays
  Clone ID: LIB3059-031-Q1-K1-B7
ggcgcgtggccctggtgaactacgggtatgactatggccgtctcgttgtcatcgtcgatgtgatcgaccagaacagggcacttctggatgcccctgatatggtcaggtgccaggtgaacttcaagcggctctcacttactgacatcaagattgacatcaaacgtgtccccaagaagacagccctgatcaaggcgatggacgaagctgatgtgaagaccaagtgggagaacagctcatggggcaagaagctgattg

SEQ ID NO: 29787 - DNA, 329 bp, Zea mays
  Clone ID: LIB3059-031-Q1-K1-B9
cccacgcgtccgcggacgcgtgggtgctgacgctgggttttcagatgttacaaagaatgtcttggctgtcctggcggacaatggcaggctgaaatatattgaacgcattgcggagagatttgttgatttgactatggaacataagggggagatgaaggttgtggtcaggacagttatttcactcaccaaggaggaggagaaagaactcaaggaaaccttgcaggatatccttggggaaaacaaaactattttggttgaacagaagattgactacagcatcatgggaggattagtgattgaattcgggcagaaggtgcttgatatctcaa

SEQ ID NO: 29788 - DNA, 313 bp, Zea mays
  Clone ID: LIB3059-031-Q1-K1-C1
gctgcattgaactctgtttcttttttgcaacaacaactaccattcagggatcggtctactgtctaccccgagcaactacttccattcaaccaactggcagcattgaactctgctgcttatttacaacaacagcaactaccaccattcagccagctagctgatgtgagccctgctgccttcttgacacagcaacagttgttgtccttctactcgcacgcttctcctaacgctagcaccctcttacaactgcaacaattgctaccattcaaccaacttgctttgacaaacccagcaggcgtctaccaacaaccca

SEQ ID NO: 29789 - DNA, 337 bp, Zea mays
  Clone ID: LIB3059-031-Q1-K1-C11
ggccaacaacaagctggacaggagcggtcacaatcaggctctggtgcaggcaatgtcggcctcaacaccttgatgaacatgttcagcgggcttggtgctggtggtggcctaggtgttccaaatgctcctaatgcaccgccagaagaactgtacgccacacaattagctcagctccaagaaatgggtttctttgacacacaagagaacatccgagccttggccgctaccgctggaaatgttcatgctgcagtggagcgacttcttggaaatatgggctaatagaatatgatgatcataactgtactcagatattgtgatttttattcatccttgatca

SEQ ID NO: 29790 - DNA, 259 bp, Zea mays
  Clone ID: LIB3059-031-Q1-K1-C12
gcgttcggcggagtgttccgtcgctggaggctgggcggcgcggtcgctgctgccggtgctgaagcccgtggaggagtgctggcagccggcggacttcctcccggactcctcgtccgagatgttcgggcaccaggtccgcgagctgcgcgcccgcgccgcggggcttcccgacgagtacttcgtcgtgctcgtgggcgacatggtcacggaagaagcgctgtccacgtaccagaccatgatcaacacgcttgacggggtc

SEQ ID NO: 29791 - DNA, 358 bp, Zea mays
  Clone ID: LIB3059-031-Q1-K1-C2
ccggttcggaatccgcggcgggacgccacgcgtgcggagcgattgcggcggcggaagtatagattcgatggggcactccaacgtgtggggctcgcaccccaagaactacgggcccggatcccgcgtctgccgggtctgtgcgaaccctcatggactgatcaggaagtacgggctgatgtgctgcaggcagtgcttccgcagcaacgccaaggacattggcttcatcaagtaccgctgaagtcagctgggcgggctatctgaatgccatctcttggacagtgtagtagaagcgatgccacaattttaattactgtcatttagatgttcccttggagactctgctatttaagttccccat

SEQ ID NO: 29792 - DNA, 206 bp, Zea mays
  Clone ID: LIB3059-031-Q1-K1-C6
atgacacaaagccttgactgaagctgtcttgttcaactgaaaatgtacacattgttaagatctgttgaatctgtttcttgacctcccaccataatcaagatcatcactgaattttttactaaagagccaaggcaaaccatgaatgcaactgagtgtgttgcacaacgatgtgctcttcaatatgctattctcagtcccactttcaa

SEQ ID NO: 29793 - DNA, 160 bp, Zea mays
  Clone ID: LIB3059-031-Q1-K1-C8
gccactcattcgggcatggtctggcaccacgactaggctgatccggacttcggttcctgccaggccaaggagcttctgtagcatggcgagaacgtgctggccaacgaacccgtggtggtgaagagaggccagcacatcgtggaggtgaacccccagggca

SEQ ID NO: 29794 - DNA, 420 bp, Zea mays
  Clone ID: LIB3059-031-Q1-K1-D10
caagaaacatcggttcaacaatcttctatagctgcccctacggctggatttccatctgaagctactgcaaagcaacaaggaaccagtggtattcaaggagcagcttcttctactgacagtaaattcagtggcaggaaagaacttccagcggatatctttactgcactatatccaccatcaactccaatgatgcctggttggcagagagccccccattttggaatgggatacgccgtgcaatatccacctggagtgttccagggaatgcaagcatatcctcagcctacatatcagcaacctgtatattcccaacctgcatattcccacccccaacctgtgaaagcttcaaacccttttgatcttgggaatgggccagctccaactcaagctcacatgcccccatctggaccaccaggagta

SEQ ID NO: 29795 - DNA, 425 bp, Zea mays
  Clone ID: LIB3059-031-Q1-K1-D11
gcaaaatacatagtgaagtacactagcaacatcttagcaccaatgggagccaagattggttccctccttgccctccttgctctttcagcaagcgctgctacctctactattattccacaatgctcacaacaatacctctctccggtgacagccgcgggatttcaacacccaactatacaatcctacatgctacatgaggccatcgtagcaagcatcttacggtcattagcattaaccctccaacagccatatgccctattgcaacaaccatccttagtgcatctgtatctccaaagaatcgcgacacaacaactacaacaacagttgctaccaacaatcaatcaagtagttgcagcgaaccttgctgcttatctccagcaacaacaatttcttccattcaatcaactagctggggtgaaccctgc

SEQ ID NO: 29796 - DNA, 356 bp, Zea mays
  Clone ID: LIB3059-031-Q1-K1-D12
ggcacttttgcgatacatccactcgggatcaggaatcaagaaacgagaatatggggagggccctttgccaatagcattggtagagaacagtggaaggtgcaagactaacgagcatggggagaagatacttccggatggaactccgtgggttccaaaactgatgaaagaaattacttgcgatatctcaaactggagcaagcccattcatgttgatcagaacttaattgatggttcaaaccctaacaatcgctggaagatgttcataccaattatacttgctgtggagtacttcttggtagtaaaacgaatccggacggcgatccatgcagatatcgcacatgggaaggtggatgact

SEQ ID NO: 29797 - DNA, 231 bp, Zea mays
  Clone ID: LIB3059-031-Q1-K1-D5
cgcgtccgtggacacgccgatccctctcctcaggttgtatttccaggctaacatcacctcgcagggccggctatgttgttgctgcctacctgcttgctattctcgctgggaatgccagcccctccgttcattatttgactggcattctggactcagctgactaagaagatgacaatgaatagatggaactgctgctgtcccaactgacctgtaaggacattaccgatctca

SEQ ID NO: 29798 - DNA, 407 bp, Zea mays
  Clone ID: LIB3059-031-Q1-K1-D9
aatacccggccggagccacgcgttcgcaggcatagtgaagtacactagctacattttatcaccaatgggagccaagagggctagcctacttgccctcgttgctctttcatcaagcgctgctacctcgacttttattccacaatgctcacaacaatacctctctccggagacagccgcgagatttcaatacccaactatacaatcctacatggaacaagaggccatccaagcaagcatcttacggtcattagcattaaccctccaacaaccatatgctctattgcaacagccatccttagtgcatctgtatatgcaaagaataggggcacaacaactacaacaacagttgctaccaacaatcaatcaaatagtagcagcgaaccttgatgcttacctagagcaacaac

SEQ ID NO: 29799 - DNA, 342 bp, Zea mays
  Clone ID: LIB3059-030-Q1-K1-H12
agactaccgagcagattgcatgtgatgtgcagatgggctgccagcgctggtactgtccatcgtgcctctgccgtgtctgcctgtgcgacacgtacgatgaccagatcatcctgtgcgactgctgcaatcatggctatgatctctactgactcagtcctgcaagaggaacagtgctcaatgtgcattgcaactgctaaccctgcaaggagccgatggagaaggagaacaggatactgatgctccacacgaaggattactatgaagacatcctgaagagtgtcgagttgcatgtaccgaacttgctgcttaaggccgcgaaaaacgtgaagcgcgatgaggagg

SEQ ID NO: 29800 - DNA, 409 bp, Zea mays
  Clone ID: LIB3059-030-Q1-K1-H2
cgcaattccgggctacgcgtacgagctgttgcagatcctattgacacaaccatctgactctctaccttcatttttttgcggtttttgggttgcctgtgaggtgttgttgttcctgagtatcttgtcaggtaacatgatatttcatatttactcttggaaataatagcttttgtatatggtgaaccatgcacaattaaacatagtggctgggggaggtgttcttatttctgaattgattcaagacatcgatactcccttagccaagggtgaaagggctataaagccaagaagacgaagaagggtgaagaattcaggttttcggaagcaatagtgaagactattttttggcttctctttgcaatatgctttattgggattggatcctcgatcactgctattaataatctaa

SEQ ID NO: 29801 - DNA, 231 bp, Zea mays
  Clone ID: LIB3059-030-Q1-K1-H3
tctacctcattccaaaaacgggttctgtaaccattgacatttctccttatcaccgactctcgaacaaattcacataatacttcaaatccactctcagaaacttaagacatacaataccaagcaccatacacaaccaaaccatactcccaaagtcaagcctccctactctactatggactcactaaccactgatacccatatacaatgacactacatcccaattactcaaca

SEQ ID NO: 29802 - DNA, 427 bp, Zea mays
  unsure at all n locations
  Clone ID: LIB3059-030-Q1-K1-H4
tccgaggctacgacgtacgatcagtgcagcccgacggcaacgccttaatgttggcctcaatgccagtcgttgcggcagcagtgttgccagcagctaaggcaggtggagccgcagcaccggtaccaggcgatcttcggcttggtccctccagtccatcctgcagcagcagccgcatagcggccaggtcgcggngctgttggcggcgcagatagcgcagcaactgacggcgatgtgcggcctgcagcagccgactccatgcccctacgctgctgccggcggtgtcccccactgaagaaactatgtgctgtagtatagccgctggctagctagctagttgagtcatttagcggcgatgattgagtaataatgtgtcacgcatcaccatgggtggcagtgtcagtgtgagcaatgacctgaatgaacaatt

SEQ ID NO: 29803 - DNA, 413 bp, Zea mays
  unsure at all n locations
  Clone ID: LIB3059-030-Q1-K1-H5
gggagaggctttacccttgaggagttgaaggctgcgggcattccaaaaaggcttgctccaaccattggcatttctgtggatcaccgccgcaagaacaaatcccttgaggggctgcaggccaatgtccagaggcttaagacatacaaggccaagctggttatcttcccaaggcgtgctcgcaaggtcaaggctggtgactctactctggaggagcttaccactgctacccaggtacagggtgactacatgccaattactcgcggtgagaagcgctctgtagaggttgtgaaggtcacagatgagatgaaggcgtttgcggcctatggcaagctccgccttgagcggatgaacaagaagcacctcggtgcccgccagaagaaggcagctgaggcagagaaggaagacangaagtg

SEQ ID NO: 29804 - DNA, 387 bp, Zea mays
  Clone ID: LIB3059-030-Q1-K1-H6
atcggatcagtctctaggatactggatagcataatgaagctttgcttgcaggtctgctggagcatagagcaatatgaaactcggccaaatatttctgagattgatcacataactgaggagttcaacaagaagtccaattcgctgtacactatcttgaggagtagtcgcctcgcgggtagtcagagagcacctttcctgaggcaatttctgatgaggctaaattttaactctttctttgagaccaccgcaaggggagtgatgaattcaggaaggctgcgaccaatcactgcaggtgctcagctgtaacggtgatggtatgtttgggggtagtgctgcagcaagagacaagggaggagtttctggtagttatgtaaattatgatcggat

SEQ ID NO: 29805 - DNA, 432 bp, Zea mays
  Clone ID: LIB3059-030-Q1-K1-H7
ccttgatggagctaatgttgaaataagagaggaggttggagaagataatttcttcctgttcggtgccaaagccgatgaagttgctgggctgaggaaggatagagaaaatggtctgttcaaaccagacccacgttttgaagaagccaagcagtttataaggagtggcgcttttggcagctatgactatgaacctctcttggattcccttgaagggaattctggatttgggcgtggtgattatttccttgttggctatgacttcccaagctacatcgatgcacaggatcgggtggatgcagcctacaaggataagaagaagtggaccaagatgtccatcttgaacacagctgggagtggcaaattcagtagcgatcggaccatcgcccagtatgccaaggagatatgggacatcaaggctagccctgtcgtgtg

SEQ ID NO: 29806 - DNA, 376 bp, Zea mays
  Clone ID: LIB3059-030-Q1-K1-H8
cgcaacatcaccgtcaacgaggcccagtcccgcggcggccgtggaggcggcggtggtgggtactgtggtggccgttgaggctgctgctacggcggtggctggcgccgtgatggcggtggcggctacggcggtggctgcagatacggtggcggctagaagctactgtggttgtggccagcgctacgtgtgtggcaaccgtggcggcggttacggcaactccgactgtaactggaggaactgagcggtggggcccgtgcggtcaagttatctctgttcgctaccgtgatgtttaccctagtccagatggtttatcttcgttcgtgtcgtgttagttgctgcccatctgcgtttttgattgcaaggtcgctctgtgtca

SEQ ID NO: 29807 - DNA, 399 bp, Zea mays
  Clone ID: LIB3059-030-Q1-K1-H9
cggacgcgtgggcttgatcttggccattgaagcaccgataaacttcgccaactccaactacctgaatgaaaggattaaaagatggatagaggaagaatcttttgaacaggataaacatactgaactccatttcataatcttggatctgtcagctgttcctgcaattgacacaagtggcatagcgttcctcattgacataaagaaatcaatagagaaacgtggtctggagcttgtgcttgtcaatccaactggagaagtcatggagaaaatacaacgtgcaaacgaggctgaaaactattttaggccagattgcttgtatctgaccactggcgaagcaatcgcttcactttctgcacttgccaagatgacaaaaccctaaatggattgctgaattgtcat

SEQ ID NO: 29808 - DNA, 408 bp, Zea mays
  Clone ID: LIB3059-031-Q1-K1-A10
cccacgcgtccggtctatccacttgatgctgtctacgattcccctgatgatgtgcctgaagatgtcaaatcgaacaaaagatatgcaggggcatcaaactggacagtaaaggaagttgttgaatcagtgaggaatgattttggcagcattgacatactagtgcattctcttgctaatggcccagaggtaacgaagcctttgttggaaacctcaagaagaggctatcttgcggcaatttctgcatccagttactcctatgtttcattgcttcagcacttccttcctataatgaatcccggtggtgctagcatctctctaacatacattgcatctgaaagggcgattcctgagtatggtggtgggatgagttctgctaaagcagatctagagagcgattcacggttgctt

SEQ ID NO: 29809 - DNA, 413 bp, Zea mays
  Clone ID: LIB3059-031-Q1-K1-A11
cccacgcgtccgcggacgcgtggggccacctgaggttctcaaggaaaggcttgctgggatttctgaaactgctgctatttttgctggtgttgatgtcaccaaggagcccattccagttttgcctactgtgcactacaatatgggcggtattccaacaaactaccatggggaggtagtggatatcaagggtgataatccagatgctgttgttcctggtctaatggctgctggtgaagcagcctgtgcatctgttcatggtgcgaataggctaggcgcaaattcgcttcttgacatagttgtttttggcagagcttgtgcaaacagggtagcagatatttctaaaccaggtgagaagcagaaacctctggaaaaagatgctggagaaaagaccataacctgcttggacaagctga

SEQ ID NO: 29810 - DNA, 417 bp, Zea mays
  Clone ID: LIB3059-031-Q1-K1-A12
agaccaactagcaacatagaaagcacaatagtgtaccaacaatggcagccaaaatatggtgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacaacagttacctttggtgcatttattggcacaaaacatcagggcacaacaactacaacaacttgtgctagcaaaccttgctgcctactctcagcaacagcagtttcttccattcaaccaactaggttcattga

SEQ ID NO: 29811 - DNA, 299 bp, Zea mays
  Clone ID: LIB3059-031-Q1-K1-A3
cgacccacgcgttcgatgaagatagattggtagtgaggaacattacacgattagtggcacaagattatatttgaatagaaggattgtattttggtgagacaattctcatgttgcaagattagaggcaatatgggttcttcttgcttatgcttgtgcttacaacattaaactctaccaaatggatgtaaatgacgttttttctaaatgctaagattagtgaactagtgtatgtggagcaacctctcggttctgaggacccccaaagcatttccacatgttcaagctttctaaaccttcta

SEQ ID NO: 29812 - DNA, 385 bp, Zea mays
  Clone ID: LIB3059-030-Q1-K1-H11
atgagcatgtgctgcttaagtaaccattggcaatatgctttcctttttttggctccctgtgggggaatgtttccgcaaacaatgtgggctgctgagttcgaaggcatatctggtgcacattgaacattggtgcacatggtgatgactgaatatgtgcagcatgtgcaccaatcttgcatgtgcattacatatgttctcgctgagtaatccacctgtggcgaatatataaagcagtcatttctcagtcactggagaaatcatggagaaaatcaacgtgcaaacgaggctgaaaactattttaggccacattgcttgtatctgaccactggcgaaacaatcgctttactttctgcacttgccaagatgacaaaaccctaaatggatt

SEQ ID NO: 29813 - DNA, 414 bp, Zea mays
  Clone ID: LIB3059-031-Q1-K1-B10
cctgcattggccatcatcgcaaaggttgaagacgtcgcaaaagcactgaatctcaggggaaggaagaaggacaacaacactgtcagcattcaagggaggaaggaggggggcaatggtgtccttaagtttgacacgcaaatctttgagatcacaccatcctgccatctcgttcagattaaacaaaccagtggcgatctacttgagtacgagaaactgttggaagagggcatccgaccagggttaaaggacgttgtctcggcctggcatagagatgatctgcagcagaagtagcttcggatgtctcccgtagattctgttctagtacatttcattccttatttttttagcagctacattccttttttgtattggtggtgatatgaaccattagcttgtgttttggttagtaataat

SEQ ID NO: 29814 - DNA, 391 bp, Zea mays
  Clone ID: LIB3059-054-Q1-K1-G8
aggtgacacctgaggtgatcgctccagtacaccgtccgtaccctccagaggagcgtgcctgctgctgtgcctgctgttgtcttcctctctggtggacagagcgaggaggaggccaccctgaatctcaatgccatgaacaagctcagcaccaagaagccatgggccctgtccttctccttcggccgtgccctccaggcgagtaccctcaaagcctgggctggcaaggtggagaacgtggagaaggctagagcggccttcctcgccaggtgcaaggccaactccgaggctaccctcggcacctacaaaggtgatgctgccgcctacacctagagccttcacgtcaaggactacaagtattgagttgcttctctttgccatcccgttgttttga

SEQ ID NO: 29815 - DNA, 197 bp, Zea mays
  Clone ID: LIB3059-054-Q1-K1-G9
gacccacgcgtgcgcgtccgcgtggagccggagcacggttttcaccagctgaatccgtcgccgtcatgttcttcgtttacgtggcgatcgtcacaagtccagtaccaaacgttccagctcgacatcaacaggcacaacgtctgcgccatggaggtataggcacaacagattaactgatgtaccattgcctacattat

SEQ ID NO: 29816 - DNA, 59 bp, Zea mays
  Clone ID: LIB3059-054-Q1-K1-H1
cccacgcatcctcgtctcctccccctcttaccaagtcctcctctgattagggttcctta

SEQ ID NO: 29817 - DNA, 370 bp, Zea mays
  Clone ID: LIB3059-054-Q1-K1-H12
actgaaccctgctgcttattggcattatcaactattaccattcagccagctatgtactgcctactctgagcggcaacaacttcttccatttaaccaattggccgcactgaaccccgctgcttatttgcagcagcaaatactactaccatttagccagctagctgcagcaaaccgtgcttccttcttgacacagcaacagttgctgcctttctaccagcagtttgcggctaaccccgcaaccctcttacaactacaacaattgttgccctttgtccaacttgctttgacagacccagcggccttctaccaacaacacatcattggtggtgcccttttttagagtgcttattagttgtaatttcaataatta

SEQ ID NO: 29818 - DNA, 287 bp, Zea mays
  Clone ID: LIB3059-054-Q1-K1-H2
cggtccggaatccggaaggagtactttgatggcaaattgacgccgttcaagaagtttgagcctattcctgaggtcaacaatgatgctggttatgtagttgtggctgacaacatccacgatgtggtcttcaagtctggcaaaaatgttcttattgaattctatgccccctggtgtgggcactgcaagaagctggcgcccatcttggaagaggcagccaccactctcctgagtgacgacgaagtacatggttgctgactaccacccataccttatgaaattctttctaa

SEQ ID NO: 29819 - DNA, 410 bp, Zea mays
  Clone ID: LIB3059-054-Q1-K1-H3
cgccattcgccacaaagccatttgaacccttcacgtctcctcgcctcgttccccatgtgctgcgtctccttgcccgcgccgccgctcgccgtttgcccctcgtctccgcaccgcgcgctgttgtccatccttgtgcagcaaaaatgacggctggctacattgttggctcactggtcggatcctttgccattgcatacctgtgtgacacatttatctctgacaagaaggcatttggaggtagcacccccaagactgtttctgagaaggagtggtggcaagccacagacaccaagttccaggcctggcctcgcactgctgggccaccggttgtcatgaaccctatcagccgccagaacttcatcgtcaagttcactgagtaggtttgggctggagaagctggttctgctact

SEQ ID NO: 29820 - DNA, 344 bp, Zea mays
  Clone ID: LIB3059-054-Q1-K1-H5
tactcggtctcggaattccgcgctcgactccacgcgtgcgcacaacaacaattgcaacagtttctaccagcgcttagtcaactagccatgggtaagcctgccgcctacctacaacagcaacaactgctttcatctagccctctcgctatggttaatgcacctacatacctgcaacaacagttgttgcaacagattgtaccagctctgactcagctagctgtggcaaaccctgctgcctacttgcaacagctgcttccattcaaccaactgactgtgtcgaactctgctgcgtacctacatcagcgacaaccattacttaatccactgtcagtggctaatccatt

SEQ ID NO: 29821 - DNA, 199 bp, Zea mays
  Clone ID: LIB3059-054-Q1-K1-H6
acgcgtccgcaagattcatgggttctaagggacctgtaaatgcttgttgcctgtattgtatgcctcgacagattggggagcttgaagcatcgacaagttactagtcattgcttacttatataagaacataagtagtatttgctattgtcaagtgtgccttgcttgatgcatgttgtgttttcgtattattattattatt

SEQ ID NO: 29822 - DNA, 417 bp, Zea mays
  Clone ID: LIB3059-054-Q1-K1-H8
gaagaaacgaaaggaagcacatagcctgaagaggctcgaggttaagaagaggagggttgagaggaggaactctctcgcctgcaacacttcaaaagaagctgctgggcagagtccaaaagagatgaatgcaaacactgacaaattagtaagttctgatgaaactattgtcagcgctaacgaaagtcatagcagtggcaagcatctggtgaaggggcttccaccaaagtaccaggccacaattacatcagaagacagttcgtcagcaatgcgaaagaagccaaactcggccttcaaagccatcactgatgagcagaactcatcatcgtctgttccttccttcggtgaatctataagtagcgtgactgcaccaattcttgccttgttgtctttggttcccattacatcaaccttttgttt

SEQ ID NO: 29823 - DNA, 247 bp, Zea mays
  Clone ID: LIB3059-054-Q1-K1-H9
attcaggcggagctgatgaagaaggtgcaccagtggtgcgacgaggccaactcgatttgcgacgcaggagagtctgccatcgttgcttctatggttgcgctgccgttgtggggtggcaacccagcggatctggtaacggcgctgtgcagccctgatgaaaaggcccatggtaacttggatggacagagtgggcgccaagtagcttctggactgtcttcagcagctgctgaaatgataaatatttgtg

SEQ ID NO: 29824 - DNA, 151 bp, Zea mays
  Clone ID: LIB3059-055-Q1-K1-A2
gaaaagcaaaaaaaaacaaaaaaaataacttatcaaactacaaaaaaaaaaaaatggaaagatttaatacaacgttggcccgcccataccaaactaacttacacacccatccaactcctaaccccttttaaaattaaacctaaattcaatt

SEQ ID NO: 29825 - DNA, 400 bp, Zea mays
  Clone ID: LIB3059-055-Q1-K1-A6
gccacgcgtccgctttggtccaactggcctgactaccgaggtgaagtctggtgagatgcactcacgaggcgcttcaggaggctcttccgggtgacaatgttggcttcaacgtgaagaacgttgctgtcaaggatctcaagcgtgggtttgtggccttcaactccaaggatgaccctgccaaggaggctgccagcttcacctcccaggtcatcatcatgaaccactctgggcagattggcaacggctattctccagtgctggactgtcacacctttcacattgttgtcgagggggctgatcttatttttaatttttacattttttttattttgttttttgtgtttgtttttttattttttttttttattttttttttttattttttattttttttcttttt

SEQ ID NO: 29826 - DNA, 298 bp, Zea mays
  Clone ID: LIB3059-055-Q1-K1-A8
cgccgtcatgtcgaagcgaggtaggggaggttcggctgggaacaagttcgggatgtcactgtgtctaccggtggcggccacggtgaactgcgcggacaacacgggcgcgaagaacctctacatcatctccgtcaagggaatcaagggccgcctcaaccgcctcccgtccgcctgcgtcggcgacatggtcatggccaccgtcaagaagggaaagcccgacctcaggaagaaagtgatgcctgccgtcatcgtccgccagcgcaagccgtggcgtctcaaggacggtgtgtacatgtac

SEQ ID NO: 29827 - DNA, 414 bp, Zea mays
  Clone ID: LIB3059-055-Q1-K1-A9
ggattttgatgtcgctgcactgatgtattttattgatgctagcaccatccctatagttgtttctttagacaagaaccctgacaaccacccatacctcatgaaattcttccaaagctcatcccccaaggctatgctgtttttgaacttctccaccggaccttttgattctttcaagtctgcctactctgcttcctcgtaggaattcaaggacaaggaaatcaagttccttattggtttacatctaatccatccagttttcctttccattacttttgccttaaagattatctgagcgcgccttattctctttctctatttttacttcatattattctttttatttttactttttttctttccttttttttctttatttttatatattctttttttatttatttttatttttatttt

SEQ ID NO: 29828 - DNA, 448 bp, Zea mays
  unsure at all n locations
  Clone ID: LIB3059-055-Q1-K1-B1
gccacgcgtccggagcacatcaagatacattttttctgagcaaccgccggntccggancgtttcaaccctgcatgcggggccagcttattatatataatatctgaggtggagcatatctatctggctgtgtactacaagcaatcctagtactccttcttctcgtttctactattacacattatacatattttctttttttttgcttatttcttttttcccttatttttttaatttattatttttattctttttatataattttatttttttaatctatcttattaatatttattatggtaggtatttatatttttttttatatattttatttatttttttatttttatatttataattttttatatttttcttttttattttaatttatatttttttttttattttttttttcttttttttttattattttattttattattattttt

SEQ ID NO: 29829 - DNA, 388 bp, Zea mays
  Clone ID: LIB3059-054-Q1-K1-G6
cgagaaacacaccaagcgaagcgcactatcaacaacctaacaacaatggctacgaagatattatccctccttgcgcttcttgcgctttttgcgagcgcaacaaatgcgtccattattccacaatgctcacttgctcctagttccattattccacagttcctcccaccagttacttcaatggccttcgaacacccagctgtgcaagcctataggctacaacaagcgattgcggcgagcgtcttacaacaaccaattgcccaattgcaacaacaatccttggcacatctaacaatacaaaccatcgcaacgcaacagcaacaacagttcctaccaacactgagccacctagccatggtgaaccctgtcgcctacttgcaacagcagctgc

SEQ ID NO: 29830 - DNA, 293 bp, Zea mays
  Clone ID: LIB3059-054-Q1-K1-E8
agcaactagcaacatagaaagcacaatagtgtaccaacaatggtagccaaagtatgtgcctccttatgctccttggtctttctgcaagtgctgctacgacgaccattttcccgcaatgctcacaagctcctatagcttctcttcttcccccatacctctcaccagcgttgtcttcagtatgtgaaaacccaattcttcaaccctacaggatccaacaggcaatcacagcaggcatcttacctttatcacccttgttccttcaacaatcatcagccctattacatcaattacct

SEQ ID NO: 29831 - DNA, 301 bp, Zea mays
  Clone ID: LIB3059-054-Q1-K1-E9
cgcacgcgtccggctacatcatccatcagacgcacacggggcgcaaccagggacgttcgctcggactgcgcttcgaccgactcatggcgctccccgccgcctgcaacctccccaactccaacgtctcgctctgcatcaccctgctgaacctgaagccgggctctgcggactacgccctcttcgccaacgcctccaagatcacgccgtcagccggcggcaaccctgcgagcgacagcgccgcgggcagcggcgtcaagctccgggctggggtcagcggcggcgtcgcgcgggggcgtgtctt

SEQ ID NO: 29832 - DNA, 405 bp, Zea mays
  Clone ID: LIB3059-054-Q1-K1-F1
cgtggattcaacgagtttatgacatttctgtatgaatcctctttacctgtttgccatgtttgttatttatcttgtttgaaaagccctttgattgcaatcataaattgtcatataattccaacattgatttctattcttatatttttttattttttattaattttatttttatttttatttattatttttatttattatatttttatttctttattttttttttttttttttttttatattattatatttttttttatttttattttattttttttttttttttttttttttattttatttttgttgtgtttttttattttttttttttctttttttattttttttttttttttatttttttattattttaattctttatttatattttttttttttttatttttt

SEQ ID NO: 29833 - DNA, 410 bp, Zea mays
  Clone ID: LIB3059-054-Q1-K1-F11
gcaacatagaaagcacaatagtgtactcaacaatggcagccaaaatattttgctgtgttatgctccttggtctttctgcaagtgttgctaccgcaaccattttcccacaatgctcacaagctcctatagcttcccttcttcccccatacctctcaccagcggtgtcttcaatgtgtgaaaacccaattgttcaaccctacaggatccaacaggcaatcgcaacaggcatcttaccattatcacccttgttcctccaacaaccgtcagccctattacagcagttacctttggtccatttggtggcacataacatcatggcacaacaactacaacaacttgtgctagcaaaccttgctgcatactctcaacaacatcaagttcttccattcaaccaactggctgcattgaac

SEQ ID NO: 29834 - DNA, 335 bp, Zea mays
  unsure at all n locations
  Clone ID: LIB3059-054-Q1-K1-F12
agggtgacaacattgttcaggatgctcctgcagatattccttccctcctataagtnaagcgtatctactatgaactgatgattcgatattacttgcacaacaatgattacctggaaatctgtcgttgttacaaggctatttatgatatcccagcaataaaggaagatccaaccaagtggataccgattcttaggaagatctgttggtacttggtgctagcacctcatgatcctatgcaatcgagccttctcaatgctacactagaggataaaaacctatcagagatgggggatttcaggatattgctgaagcagctggttaccatggaggtcatt

SEQ ID NO: 29835 - DNA, 359 bp, Zea mays
  Clone ID: LIB3059-054-Q1-K1-F2
gggagcttgcctcccccttagctactgccgccgctgccacggccggtgcctccttgtcggctgccgcctcgctccggggctggtgggacgatgtcaacgagtcgccccagtggcaagacggggccttcttctccctcgccgccgcctacgccctcgtctccgccgtcgcactgattcagctcgtcaggatccagcgccgggtgcccgagttcggatggaccacgcagaaagtcttccacctcatgaacttccttgtcaatggggtccgtgctctggtgttcggcttccatgtccatgtcttcctccttcgcacataagtatacaagttggtgttgctagatctccccgcttggtggttt

SEQ ID NO: 29836 - DNA, 389 bp, Zea mays
  Clone ID: LIB3059-054-Q1-K1-F3
cgccaagtttgtaaccctagccgccaagcttgaagctccagccgtgctcgtgtagggctgcatgccatctgggctccggcttccggcatccaccaggcgtcaatacggtgcagcgagcagcgagcagcaagtcaccgagcagccgagcgaccgccgagcacagggcaccaccgagcagccgagccaccgccgagcaccgagtcttctctgttcttctgtggcgaacaaggtcaatccagggccgtggtgcgggtgctggtttttttttccaacatgtttatgttggtcgctcgaccgctgcaacaatgaagatacagaaagcaaatgcaggtgtccttacaaacttcgaagtccttgacttcttgcggtcaagaggtgccaaaattgac

SEQ ID NO: 29837 - DNA, 146 bp, Zea mays
  Clone ID: LIB3059-054-Q1-K1-F6
gggtccctcttcatcgtgcccttctttcatgtcgtgtccaagatcgccgactacgtccgttatggagtggttgggcagcatcaccacccagaactccatgtacacccaccagtctgacaagacatccatgtcacaggaactgtctc

SEQ ID NO: 29838 - DNA, 315 bp, Zea mays
  Clone ID: LIB3059-054-Q1-K1-F8
ctctacctctacctaccggagcaggtagcacgccgcacgagccctttccgccgccgccaaaatggtgaacgttcctaagaccaagaagacctactgcaagaacaaggagtgcaagaagcacactctccacaaggttactcagtacaagaagggtaaggatagcctgtctgcccagggaaagcgccgttatgaccgcaagcagtcaggatatggtggccagaccaagcctgtcttccacaagaaggccaagaccaccaagaaaatcgtgttgaagctgcagtgccagagctgcaagcactactcacagcacgcaat

SEQ ID NO: 29839 - DNA, 409 bp, Zea mays
  Clone ID: LIB3059-054-Q1-K1-F9
caacaagcaacatagaaagtggaattcagtagcaacaatagagcaacaatggcgggcaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttc

SEQ ID NO: 29840 - DNA, 105 bp, Zea mays
  Clone ID: LIB3059-054-Q1-K1-G10
accacacctcttctttttcttcctcctcctcctagcacatctatctgctgctcccaaacttgtgtgatcatgtcttgcatcatcttcaagttcaactgtttcttc

SEQ ID NO: 29841 - DNA, 290 bp, Zea mays
  Clone ID: LIB3059-054-Q1-K1-G11
agtcggggaggattgtctgtaacgtgtcctagtagagtatctgcagctatgggacgtggtttatggggtagtgctgcaacctgacatcgcagaccaacacatctggcgcctctctgctcatggtacttattgtagcaaatcggcctatgatgctctctttgttggctctatcccttttggcccttggcgacgtgtctggaagacctgggcccccttaagatgcaaattctttgtatggttggcaatcaaaaacagggtttggacagctgatcgacttgcataatgagggg

SEQ ID NO: 29842 - DNA, 412 bp, Zea mays
  Clone ID: LIB3059-054-Q1-K1-G12
gcgggagaaagcacaatagtgtaccaactaatggcagccaaaatattttgcttccttgttctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggctgcattgaactctg

SEQ ID NO: 29843 - DNA, 70 bp, Zea mays
  Clone ID: LIB3059-054-Q1-K1-G3
attcccgctctacccaccctccgactttattatgaccatgcatatattttgttcataccacacatgataa

SEQ ID NO: 29844 - DNA, 237 bp, Zea mays
  Clone ID: LIB3059-054-Q1-K1-G4
ataaggagttacatttccagattctttttttccacatacatcatccaaaaaacttgattgtttaattacaacttataagcaatctaaaatagggcaccaccaatgatgtgttgttggtaggatgctgctttgtttttcaaattcaatatttacaaatttcttcaattgttattttttttaattttttttttatatatttcaatttcttttaattttttttttttcatttttttttat

SEQ ID NO: 29845 - DNA, 237 bp, Zea mays
  Clone ID: LIB3059-054-Q1-K1-G5
caaaatattttgcttcctgaccgttctttttcaatcttcaattcttctacctcaaccattttcccacaattctcacaatctcctatagcttcctttcttcccccatacctctcaccatctatttcttcagtattttaaaacccaattcttcaaccctacattatccaacattcaatctcatcatacatcttacctttatcaccctttttcctccaacatccatcatccctattacat

SEQ ID NO: 29846 - DNA, 332 bp, Zea mays
  Clone ID: LIB3059-054-Q1-K1-D1
cggacgcgtgggatgatcatcagtgctgccatttggatcagctcggttcttcttcggcgggaaggttccggcggcttccagtgatgtgttcgccacagaacgagcagcacctgctgcaggaacaaacacttaacaacaatgctcgtcctccggagaagaggcagcgggttccgtcggcgtataacagattcatcaaggaagagatacgcaggatcaaagcgaacaaccccgacattaaccacagggaagccttcagcacggcagccaagaattgggcacattatccaaacatccatttcggtttaaacgactccgggcgagaaggcaagaag

SEQ ID NO: 29847 - DNA, 287 bp, Zea mays
  Clone ID: LIB3059-054-Q1-K1-D11
gacaagattaacaaaaagcttggctttcggaaggaggatcttcccaagatctagtaggagcttgaattggaaattgccaaaagtgagctgactgaacttaagaaggaatgcgttgaagcaatggagactcaactcaagagggaggagtttcaagatgaggagatgcctgatgtcaggaaattggacatcagaaacttcctgtaggcctgatcgacgataatctttgaggcccaacgcacctctggtttaggtttcaagttgatcggtgcttcatacctattaatgct

SEQ ID NO: 29848 - DNA, 329 bp, Zea mays
  Clone ID: LIB3059-054-Q1-K1-D12
caaaaaatggctttcagatgtatacatcatggacacaatgtcactggagtttagataattagctgttactggatctgtgccacctccaagatgtgggcattcggcaaccatgattgagaagagactccttatatttggaggcagaggtggagcaggaccaataatgggtgatttatgggctttaaagggtattactgaagaagacaatgaggcgccaggttggacacagttgaaacttccagggcaatctcccttaccacgattcggtcattcattatcatctggtggggggtatctattgctttttggatgactattgtatctgtttt

SEQ ID NO: 29849 - DNA, 290 bp, Zea mays
  Clone ID: LIB3059-054-Q1-K1-D3
cgcacgcgtccgatttcaaatccttctatcgcgcagcgccgcccgccctctcgcaggttgtccgatggcccgcacgaagcagacggcgaggaagtcaactggcggcaaggcgccgcggaagcagctggccaccaaggcggcgcgcaagtcggctccggccaccggcggcgtgaagaagccgcacaggttccgccccggcaccgtcgctctccgcgagatccgcaagtaccagaagagcacggagctgctcattcggaagctgccctttcagctgctggtgcgtgtgatcg

SEQ ID NO: 29850 - DNA, 421 bp, Zea mays
  Clone ID: LIB3059-054-Q1-K1-D5
ctgggtcttcagaccattagctttatctactccagagcgcagaagaacccgagctgcaccatgagggtgttgctcgttgccctcgctctcctggctctcgctgcgagcgccacctccacgcatacaagcggcagctgcggctgccagccaccgccgccggttcatctaccgccgccggtgcatctgccacctccggttcacctgccacctcctgtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcggcgttggca

SEQ ID NO: 29851 - DNA, 332 bp, Zea mays
  Clone ID: LIB3059-054-Q1-K1-D6
cggactctttatcagacccatttgactatccttctatcaataccatcaatcatgatgcatcttattaatattggcaccaaatcaaatctgcaacatcaattatctaactccaaaaaccatgaatctggtgcttgtggttcttgctttcattgctttaatatcaagtgtttcttgtacacagacacgcagctgtatctttcatcaacaacaaattcatcatcatctacatcatccacatcaacatcatccacaaaaacatcaacatcaactacaaccacaacatcatcatcatcagcgacatctacaacaacattttcacattctacctcatt

SEQ ID NO: 29852 - DNA, 292 bp, Zea mays
  Clone ID: LIB3059-054-Q1-K1-D7
taaacatcaatggttgattgaattaatttaaaaaaaaaaaaaaaaaaaaaaaaaagaaagataaataaaaaaaatagaaagaaaaaaaacaaacaaaaaaaaaaaaaaaaaacacaaaaacactccctcccctctacatattccatctttactcccccttcctttcaacatcttccctcttctatacctccccctaatttcatttcacctccctccttttcaaaatttctcaccttcaaaaccccttcctttccccaacctattctcctttcttcaattcccccttttccca

SEQ ID NO: 29853 - DNA, 419 bp, Zea mays
  Clone ID: LIB3059-054-Q1-K1-D8
caaggagggcgcatattggggcactgttgctggagtttatgtgggcatggtggacgtcgtgtaaagggtccgtggccgcagtgactggaagaacgcgatgatcgggggcgccttgtccggcgccctgatctccggcgccagcaacagctacagaggcatggtcgtctaggactccatcaccgtctgcgcggttgccacagccgtttatttcattatctgcattacctatctgttcttttatcatctgcatttttatttttattgtcttgctttttttttatttttttcttggggggtggttttttttttatttatttttttttttattttttttttttttttatttttttctttttttattatttttttttttatttattttttttatttttttcttttattttttattttattttttt

SEQ ID NO: 29854 - DNA, 357 bp, Zea mays
  Clone ID: LIB3059-054-Q1-K1-D9
ggctgtgcaccagcgccaccgtgtcaattgcgctcatgagctacgtgcagtacgacgtgttctgggccctcggcttcggcgtgccgtccatggccatgctactcgcgctcgccatcttcctgctcggcacgaggacctacaggttctacggctcccgcggtggtgctgtttccaattccagcttcttttttattttttattattttatattatattttttatttatattatttatttatttattttttttttattttattttattttttttttttttttttatatttattggggggggggtttatttatttatttttttatttttttttttattttttattttttataatttttttt

SEQ ID NO: 29855 - DNA, 424 bp, Zea mays
  Clone ID: LIB3059-054-Q1-K1-E1
agcgcagcaagcaacatacctttatcgcccttgttgtgtcaacaatcgccagccctgtctgtggtgcagtcattggtacaaaccatcagggcacaacagctgcagcaactcgtgctacctgtgatcaaccaagtagctctggcaaacctttctccctactctccgcaacaacaatttcttccattcaaccaactgtctacactgaaccctgctgcttatttgcagcaacaactattaccatttagccagctagctactgcctactctcaacaacaacaacttcttccatttaaccaattggccgcactgaaccccgctgcttatttgcagcagcaaatactactaccatttagccagctagctacagcaagccgtgcttccttcttgacacaacaacagttgctgccgttctaccagcaatttg

SEQ ID NO: 29856 - DNA, 351 bp, Zea mays
  Clone ID: LIB3059-054-Q1-K1-E11
caatgccaacatggatacagaagcttacacagaagttcctcaacagtcctgttgcagtggaccttgttggtgaggatgaccagaagctggctgaaggaattagtctgctctctgtctcttcggaaaaccgtgaaaaaccagctgttcttgggaaattgattaaggaacatgcaaaaggtggcaagtgcattgtttttacacaaacaaaaagggatgcagatagattgtcacacaatatgagtcgaagtttccaatgtgaggcgcttcatggggatatctctcaatctgaaagagagaggacactggcaggatttcgggatgggcggtttaatatattgattgttactgatg

SEQ ID NO: 29857 - DNA, 231 bp, Zea mays
  Clone ID: LIB3059-054-Q1-K1-E12
cgcacgcgtccgcccacgcgttcgttctactctcagcaacaacaacttcttccgtttaaccaaatggccgcagtgaaccccgcttcttatttgcagcagcaaatactactaccatttagccagctagcttcagcaaaccgtgcttccttcttgacacagcaacagttgctgcctttctaccagcaatttgcggctaaccccgcaaccctcttacaactacaacaaattgtg

SEQ ID NO: 29858 - DNA, 416 bp, Zea mays
  Clone ID: LIB3059-054-Q1-K1-E2
cgcacgcgtccgggcaattgcagaatgcgacgacgtgaagagcaaaaacccggatggttgaatcgtagataaatacaacacctccaaacgatcagtgtcgcttgtgcagaagcaccgagagagcaaaaaggagaaaaagaagcaaaagcagcacgagaaagaggaatgggagggaaaccacccatggaagccatgggaccgggagaaggatctgtctgctgggcgccagaatgtggccttagacgcagagaacatgtcgcaaggattatcttcccgtttcgcgtctggtgctgttcagcggaacttcctgtgagctgtgtggaaagatactcctggagcatggtctaatcgatgatcaatgtccagttattacaatctggtccgcagatggcaaagaatatgcttacatataaaaa

SEQ ID NO: 29859 - DNA, 374 bp, Zea mays
  Clone ID: LIB3059-054-Q1-K1-C9
caacaggcatcttaccattatcacccttgttcctccaacaaccgtcagcccgatgacaagagttacctttggtccatttggtggcacaaaacatcagggcacaacaactacaacaacttgtgctagcaaaccttgctgcatactctcagcaacatcagtttcttccattcaaccaactggctgcattgaactctgctgcttatttgcaacaacaactaccattcagccagctagctgctgcctacccccagcaatttcttccattcaaccaactagcagcattgaactctgctgcttatttacagcagcaacaactactaccattcaaccagctagctgatgtgagccctgctgccttcttgacacaacaacaa

SEQ ID NO: 29860 - DNA, 406 bp, Zea mays
  Clone ID: LIB3059-054-Q1-K1-E3
agagacaccagacatcacatccattgctcccattcccactattgctgaaggcgatgagtctgtatttgtcaactccaattcaaacagctcgatggtgcctcctgtcctggagaacaatgctgttgatctcactgatgggctgacagatttggaatcctatatgaggtttcttatggatggcggtgcaagtgattcaattgatagccttctgaaccttgatggatcacaggatcttggtagcaatatggacctctggaccttcgatgacatgcccatcgctggcgatttcttctgaggaatttgaagcttggccataggactatgtacatagggactagggaataaagactgggagattgtgaagcacctgcttggcaccttgtggtagcatatgctcgtgtctagc

SEQ ID NO: 29861 - DNA, 313 bp, Zea mays
  Clone ID: LIB3059-054-Q1-K1-E4
ctcgactccacgcatccgagctgatacatatcatctttgagaatgtcgatctcatgcttatcaaatttgaacaagaatgatcgtctggatcatttggtgatctataccatgtgacgtactgtactcaaaatgtacctatcaaagtactcaagccttagcgtattagcgttgatattctacgtgagtatccacagcaagattatataatgacacaattttttaacactacagtattccactttatttcaccattcacatcacatccttattactctattatcaccaacaataatcattccaattacatcaatta

SEQ ID NO: 29862 - DNA, 378 bp, Zea mays
  Clone ID: LIB3059-054-Q1-K1-E5
cggacgcgtgggcggtgaagttgagtttattccaattttatcaactagcgttgcatgtggtgtgtacatggcagtttccagtaacctcaggtaccaggttttagctggagtgattgaacagcggatgctcgagccactactgcaccagcacaaactagtattgagtgcagcatgttttgcagttcggacagggaatacgtttttgggttccctactgtggatcgactatgccaggtggataggcttacagtacgctcaagcatgggtacacatatgcagttgctctgagtggcagcaatattgttacttcgtaattttatattatcactcctttcttcaactggcaagttctcttttgcttatatgtgttacttttat

SEQ ID NO: 29863 - DNA, 324 bp, Zea mays
  Clone ID: LIB3059-030-Q1-K1-F4
agatgacattatctgactcgatccagcaactatggcataggacttctcaaattctatgcgtgctgcacattaacaattctgaaacctaactgcaaggaatacaatgccatatgtgaaataatcacttagctagggcaatatggaacacatgagcttcattagatatgacctactggctattattggggagtcagcgtatagtgcaagtgctttagtgctcatgtatgatcattttgctagcttatcaactcgttgttcaagaagaaggctcgactttctgcggaaagctggtattatcatgatgatgatcgccacagatcttat

SEQ ID NO: 29864 - DNA, 383 bp, Zea mays
  Clone ID: LIB3059-030-Q1-K1-F5
ggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggctgtgggtacggtggt

SEQ ID NO: 29865 - DNA, 276 bp, Zea mays
  Clone ID: LIB3059-030-Q1-K1-F6
ccgaggagttcgcccgtggcatgaaggaagacctgccctgaacttgttcttgctagcttattatatactgctgatgatcatcctgagccctggctgcagggagatgatgaatggtgacgtaaacatgcttctgtttgttgttacttttggttgtattttttttgggttcactttatcttggtcaatacgtaccacattagatcacagcaaccaaattcgatcttaatttgtaccatttgatatgagaccgagacaataaaaaaggttatactgtcc

SEQ ID NO: 29866 - DNA, 433 bp, Zea mays
  unsure at all n locations
  Clone ID: LIB3059-030-Q1-K1-F8
cccacgcgtccggcaaagcggcagtgcgtagagaggatcgtcgaacagaacagcatggagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagacgagcgccatgtaccagccgctccggcaacagtgctgccagcagcagatgaggatgatggacgtgcagtccgtcgcgcagcagctgcagatgatgatgcagcttgagcgtgccgctgccgncagcagcagcctgtacgagccagctctgatgc

SEQ ID NO: 29867 - DNA, 383 bp, Zea mays
  Clone ID: LIB3059-030-Q1-K1-F9
ggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggctgcggcggtgggtacggtggt

SEQ ID NO: 29868 - DNA, 303 bp, Zea mays
  Clone ID: LIB3059-030-Q1-K1-G1
gcctgcagcagtagcggaacaattccaaagcatccagagcatccccttctgacacatgttgacctcattgagaagttgctcaactacaacaccctagagaagaccgagacaagttaagcgagcacatcatgctccaaaaacactactgtttggcagtatcatagagcttaggtagtatgttgtctcttctctatcagtagaaatgggttgtgagtgtgaacatgcttttcaaggacttttcatgcgacagtgcttgttgccacctatgcaacgatgttggatattttaagtgatataattgct

SEQ ID NO: 29869 - DNA, 403 bp, Zea mays
  Clone ID: LIB3059-030-Q1-K1-G11
cggattcccgctcgaccagcgtacggaggctatgaacaagcgctgaaggctctgatcgtattatgctgcacgtagttgggacgggcatccgatgtttggtccactctaaggcgttgttacgtgactatagtcgtgatcttagatctgcacctaaagttcctgttgacacaaccgtagctcgtgtaaagccagggagagtctttggctactgccttagcattctcgtggactcccctttgtgacctctacagcttgagtacgcctttaatgataggcaatcacgcatatttcactttgctgttgtctacccacatatgacatcatattgcacacattctgattcaatcttgttcttctgagcattttggtctgattgaaaatcatgacataccttacatttttt

SEQ ID NO: 29870 - DNA, 434 bp, Zea mays
  unsure at all n locations
  Clone ID: LIB3059-030-Q1-K1-G2
aggaaagtgaaccacccgcttaaattaagaatgggggattttggcccctaaaccatgggaaggagccttttccgttgcttttgaaggcctaattgcaatcgatccccaagggtggatttaaaacactggataagtgcctggtccgtgagtaccgaatgtccatgaatggaatctcaaagcaattntctcatgaattctgcgagggagtcagagcacgactagtcgacaaggacttcactcctaagtgggatcctnctgcccttgagtatgttacgaatgacatggttgacgcatacttcgcacctcttggcgattcggagcctgagttgaagctgcctatagaatcgcgagaggcatttgtatgatcacanatcattccaagaaccggatcattgcaagtaccggactgggacctgataaacgtgttataatct

SEQ ID NO: 29871 - DNA, 146 bp, Zea mays
  Clone ID: LIB3059-030-Q1-K1-G3
ctttgacaaacccagcagcgttctaccaacaacccatcattggtggtgccctcttttagattgcttatgagttatagttcaataataaagttttttgtctgatgtttgtggcttcccagaaataagaaagtacatttctagattct

SEQ ID NO: 29872 - DNA, 395 bp, Zea mays
  Clone ID: LIB3059-030-Q1-K1-G4
cgcggtattagtatttgagttgatttgtggaactcacgaagctgtgtttgcttagtatcgtggaaatacgagaagcgctggggctttggtactatatactcacccaaattttcatgtgtgcttgacgcgtgataagttcggagataacacgctcatagtttaagacctgtctgactactggcagaacatgacatcatttgattttctgttcatagttgggaaatcttgttttgtttcggactaatgcttgttccatggatttttaacgaatacatttagggtctgttcttctaatgttaattcatgtggattggaagaggttgaggccttccgtttctccagcattagatccagaattgttccagctgatcaaatcttatatattctagataagc

SEQ ID NO: 29873 - DNA, 433 bp, Zea mays
  unsure at all n locations
  Clone ID: LIB3059-030-Q1-K1-G5
caagaagatgaacgacatctacggcgactggccggaacaggactgagagcgcgtacgaggcatcacctgctcgatcgaagctaccatgtctaccttcctgcctttgatcaccgtgatcgacaacatcagattgttacaggctcctatagcttnccttcttcccccgtacctctcaccagtgttgtcttcagtatgtgaaaacccaattcttcaaccctacaggatccaacatgcaattgcatcaggcatcttacctttatcacccttgttcctccaacaatcatcagccctattacagcagttacctttggtgcatttattggcacaaaacatcagggcacaacaactcgtgctagcaaaccttgctgcctactctcagcaacatcagttacctttggtgcatttgttggcacaaaacattatggcacaacaa

SEQ ID NO: 29874 - DNA, 390 bp, Zea mays
  Clone ID: LIB3059-030-Q1-K1-G6
ggagagcaccagttggagaatgacatttcggagtacataaagaaggagttcggcaagaaccacggcccaacctggcactgcatcgtcggccgcaacttcggttcctacgtgacgcacgagacaaactactttgtatatttctacatcgactctaaagctgtcttgctattcaagtctgggtgattgtcgcagccaatagagtcaaccttgcatgcctacatcttctttctctcgtgtatgctccatccccttccctttcccctcagagtcgtctgcagccaaacctggaaaccggtaatcttatgaacctgcatgttgatgtatcaacaacggattattcttcgcatgccataatgtgagatcaagttgcatcttaattatggctgaaat

SEQ ID NO: 29875 - DNA, 254 bp, Zea mays
  Clone ID: LIB3059-030-Q1-K1-G8
accgtccggattcccggtcgcccacgcgtcgcccacgcgtccgtttttcccttctaagttcctagcatgactgtttgggtcagatgagatcagctgggggaaacaaaacctgtgggggttcctggcatctttgtttgctgtagtcagttgatttaatgaactccgaaatgtctcatggaggaaaattttcggtcgcctgtgtagcgctctgttaaatgagcaaccttcacaataattcaagctcggtagaattc

SEQ ID NO: 29876 - DNA, 418 bp, Zea mays
  Clone ID: LIB3059-030-Q1-K1-F3
caagagtatattcaatgatgagcactttaggtgctccttatcacctgattctcaaacaggagatagtggaagtgaagaatcaactgatgacgaaactgtggataccaagggtaatggatttcatgatgcggaaaatgatgtagatcaagaattagatgatgccgagcgaatgctgagtggaaaattcactgaaaccagtgcaagtgcttgtgctgacctctatgaccacaaggaagttaatggcaatagttcagacactgagctctttgttgaggatcacacatttgaatcaaatgtagatttaaatgatgctcccctaagtcgtttaacagaaaatggaaagggtccatcaaatctgatgtccgctcatgaaactccattatcagtgggagagattcttctgtctttggatgctgga

SEQ ID NO: 29877 - DNA, 380 bp, Zea mays
  Clone ID: LIB3059-030-Q1-K1-H10
aagtatcttgcctccttatgctccttggtctttctgcatgtgctgctacggctaccattttccggcagtgctcacaagctcctatagcttcccttattcccccgtacctgtcaccagtgctgtcttcagtatgagaatacccaattcttcaaccctacatgatccaacatgcaattgcatcaggcatcttaccttcatcacccttgttcctgcaacactcatcatccctattacagcagttacctctggtgcatatattgtcacaaaacatcatggcacaacaactcgtgctagctaaccttgctgcctactctcagctacgacagttacctttggtgcatttgtaggcactgaacattgcggcacaacaactacatcaa

SEQ ID NO: 29878 - DNA, 351 bp, Zea mays
  Clone ID: LIB3059-030-Q1-K1-D8
cggacccatacgcccacgcgttcactttctgcctactataagcaccacaaggggtccggcattcaaccaactacactgattgaactcatatccttatttgaaacaccaactaccattcagccagctaaacatcaacctacctaaaactaattccttttcatctaacgcaacattgatcaacgaactctactgcttattacactgcagcaacaactactaccatacagcctaatagctgacctgagccctgatacattcatgacacaatatcagctcattgccgctctaccatcacgatctcgactaacgaattgcaccacttttacacactgcaacaattagcttccatta

SEQ ID NO: 29879 - DNA, 118 bp, Zea mays
  Clone ID: LIB3059-030-Q1-K1-E2
ttcccgctctacccactcgtccgaaaaaaaaaaaaaaaaaaaaaaaaaatttttattaaaaaaacaaaaaaaaaatcaaaccgcaaaatttcaaacttaacaatacaaacaccccaat

SEQ ID NO: 29880 - DNA, 425 bp, Zea mays
  Clone ID: LIB3059-030-Q1-K1-E3
acgatatcaatatgggatatacgtacagggaagaaaccttgtatttctgtcaaagctgatgaagccgatgtgaatgttatctcatggaacaagcttgctagctgcatgatagcttctgggtgcgatgatggcagtttctcagttcgtgatcttagatcaattgaggaggactcgttggtggcacattttgagtaccacaagaaagcaattacatctatcgagtggagtccacatgaagcatcatcattagctgtaacatctgaagatcatcaactaacaatctgggacctttcactggaaagagatgcggaggaggaggctgagttcagagcaaagatgaaggagcaggcaaacgcacctgaagatttgcccccacaacttctctttgctcatcagggccagagagacttgaaagaactgcactg

SEQ ID NO: 29881 - DNA, 278 bp, Zea mays
  Clone ID: LIB3059-030-Q1-K1-E4
cctcagtatgccgaggcccactgcgatacctgtcgcagacccatggtcgtcgaagcgtgtcgcgggtggagtctctgcttccttctcggcctcaggtttcattccagatggaacaattggaccctgcaccagctagtatacctcatagctctgcgttggcaccacttcccggaagagggtgcttggttgaccaagatgtgaactctgatcctcaaaatcatctcttgttcggtgttagtatagactcgcagtcactgctaatgcaagggggcatttct

SEQ ID NO: 29882 - DNA, 419 bp, Zea mays
  Clone ID: LIB3059-030-Q1-K1-E5
cctgctggactcggactacacggcgaagctgtcggatttcgggctagcgaaggctggacctggagaagacgagacccacgtgtcgacccgagtcatgggcacgcagggctacgccgcacccgagtacatcatgacagggcatctaacgaccaagagcgacgtgtacagcttcggcgtcgtgctcctggagctgctaacggggcggaaggcgttggacaagaaccggccgccgcgagagcagagcctggtggaatgggcgcggccatgcctgcgcgacgctcgccggctggagcgcgtcatggaccggaggctgccgcgccccaccacgcccacccgagcagcccaaaaggccgccgggatagcccaccagtgcctcagtgtcagccccaaatcccggccccaaatgtcccacgttgtac

SEQ ID NO: 29883 - DNA, 437 bp, Zea mays
  Clone ID: LIB3059-030-Q1-K1-E6
catgttcaggatatgatcactgctggaatggacacaacagtcatctcagtcgagtgggcgatggcagaactggtcaggaaccctagggtgcagaagaagctgcaagaggagctcgaccgtgtggttggccgtgaccgcgtcatgctagagaccgacttccagaacctcccctacctacaggccgttgtcaaggaatcactccggctgcacccgccgacgccactcatgctcccgcacaaggccagctcgaacgtcaagatcggaggttacaacatccccaagggcgccaacgtgatggtgaacgtgtgggcggtggcgcgtgatcccaaggtctggagcaacccgctggagtacagaccggagcgcttcctggaggagaacatcgacatcaagggcagcgacttcagggtgctgccgttcggtgctggccggcgtgt

SEQ ID NO: 29884 - DNA, 426 bp, Zea mays
  Clone ID: LIB3059-030-Q1-K1-E7
cggacgcgtgggctagcaacatagaaagcacaatagtgtaccaacaatggcagccaaaatattttgcttccttatgctccttggtctttctgcaagtgttgctaccgcaaccattttcccacaatgctcacaagctcctatagcttcccttcttcccccatacctctcaccagcggtgtcttcaatgtgtgaaaacccaattgttcaaccctacaggatccaacaggcaatcgcaacaggcatcttaccattatcacccttgttcctccaacaaccgtcagccctattacagcagttacctttggtccatttggtggcacaaaacatcagggcacaacaactacaacaacttgtgctagcaaaccttgctgcatactctcagcaacatcagtttcttccattcaaccaactggctgcattgaactc

SEQ ID NO: 29885 - DNA, 394 bp, Zea mays
  Clone ID: LIB3059-030-Q1-K1-E9
gccatgccctcaggcgacaatccccataatggcttcaactttgggaaccagccctctgttccgtcaggtggattcaactttggctgaagatgcccatttggaatggccgatgtgccattatgccttggctagtgctctgggctagtcagaggtgtggggtagcggcgtcaaccaagtcatggttgagtcccattggtctggtctcagggagttgtcatgtcagtcccagtcagcagggtcagtccttgggctgcattaccagtggtgcagcttggtcggtggtcagtcttgaaggtcagccggttggatcatttgggctcttgctcccaccagcaccacctctggtgggaggcatcaggcatggagtcgcgggtgttgtcgggagttgggtttt

SEQ ID NO: 29886 - DNA, 394 bp, Zea mays
  Clone ID: LIB3059-030-Q1-K1-F10
cccacgcgtccgatccggagcagccgcagtcccaccgaccccgccgccggtcgccctgcatgtgctcgccgctgcctctcgtttctcttttcaataatcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatgcggccaagcaggttgctgctggggttaccagccaaaccaataactaccacagggctgatggtcagaacactggcaacttccttacggaccgtccttcaaccaaggtccacgctgctcctggcggtggctcttccctgggctacctgttcggtg

SEQ ID NO: 29887 - DNA, 435 bp, Zea mays
  Clone ID: LIB3059-030-Q1-K1-D7
cccacgcgtccgcccacgcgtccgcttgctgcctactctcagcaacagcagtttcttgcattcaaccaactagctgcattgaactctgctgcttatttgcaacaacaactaccattcagccagctagctgctgcctacccccaacaatttcttccattcaaccaactggcatcattgaactctcctgcttatttacagcagcaacaactactaccattcagccagctagctggtgtgagccctgctgccttcttgacacaacaacagttattgccgttctacctgcacgctgcgcctaacgctggcaccctcttacaactgcaacaattgctgccattcaaccaacttgctttgacaaacccagcagcgttctaccaacaacccatcattggtggtgccctcttttagatttcttatgagttatagttcaataat

SEQ ID NO: 29888 - DNA, 398 bp, Zea mays
  Clone ID: LIB3059-030-Q1-K1-B9
ggtctccatccagggcctcgtgctgaatgacaggccatacttcaatgagccaggatgcaagagctcggctgaaacgacaggtggtgagaggtgttccctggcttacaatcagacggccttcgtcagatcatgcaagacgatgctgtattcactccggaagcctccaatgcattttgagacccttgtgttgtggcacttccacgagcatgagcgtgccatcctcgacgcttgcagggcttacatgtctgggacagtcgttgggtcgtctgctgggactgggagcaaccgcagatacgtccatgacaagtgctttgcagaattccacaagtcgctgacgctctacactgaacatctcagggctgagtttgctgcaaacacaagacgagtgatggagcttg

SEQ ID NO: 29889 - DNA, 391 bp, Zea mays
  Clone ID: LIB3059-030-Q1-K1-C1
cccacgcgtccgcccacgcgttcaatgttttccggatgaagcttcttggtgcagaggggacgggggtacattctgggacagcaaccctgaaggatgcaacttcagaggctatccgtgactgggtcacaaatgtggagaccacacactatatcttgggctctgttgccggtccgcacccgtacccgatgatggtgagggagatccataagggacttggcaaggaaacccggaggcaggccatggacaagtggggtggcaagccggacgtattggttgcctgcgtcggcggtggatcgaacgccatgggcttattccatgagtttgttgaagaccaagatgtgaggctggttggagtggaggcagctggccatggcgtagacaccgacaagca

SEQ ID NO: 29890 - DNA, 64 bp, Zea mays
  Clone ID: LIB3059-030-Q1-K1-C12
cccacgcgtccgcccacgcgttcgcccacgcgtccgcccacgcgtccgaaaaaaaggagaaggg

SEQ ID NO: 29891 - DNA, 298 bp, Zea mays
  unsure at all n locations
  Clone ID: LIB3059-030-Q1-K1-C4
atgtccagcagcaaatactactaccatttggccagctagctccaccaggnccggttggcttgttgacccaccaccaatggcttccgttctaccagcagtttgtggctaaccccgcaacccttttacaactgcaacagttgctgccctttgtccaacttgctttgacaaacccagcagccttctaccaacaacacatcattggcggtgccctcttttagattgcttattagttgtcattcaataatgaagttttttggctgatgtatgtggcctcctagaaataagaagttatatttcc

SEQ ID NO: 29892 - DNA, 415 bp, Zea mays
  Clone ID: LIB3059-030-Q1-K1-C5
gtgaaccttatgatttgtcactgcaccatccccggcaagcaagggactgattgggagggtggatacttcccactcacccttcatttcagtgaggattaccctagcaagcctcccaagtgcaagttccctcagggtttcttccacccaaatgtctatccttctggaacagtctgtctttcgatccttaatgaagatagtggttggagaccagctattactgttaagcagattctcgtcgggatccaggacttgctagatcagccaaatcctgctgatcctgctcaaacggatggctatcacctttttatccaggatcctacagaatataagaggcgtgttaaactgcaggcgaagcagtatcccgcgttggtctgagaacttcgccctactaaggatccaagctgcacattcgcat

SEQ ID NO: 29893 - DNA, 294 bp, Zea mays
  Clone ID: LIB3059-030-Q1-K1-C6
cttcccctcttctatatgggattcatccttcccctcttctatatgctgctgagatcagtagcagtaaccagtttctgagtttgcatccctagagatggaaaccacacaatgtgtttgaatatgcgcttgtgcatgatgtatgatgtatcattcaaagagtatcttgatattctttctgcagaacatgaagaaactgtaggaagggaccgtatgagttttgatcaatgtcagtcactttaacagacattttgtactcatgcttcatgttgctagatagcatcttatctttatctt

SEQ ID NO: 29894 - DNA, 431 bp, Zea mays
  Clone ID: LIB3059-030-Q1-K1-C8
gagaccaactagcaacatagaaagcacaatagtgtaccaacaatggcagccaaaatggtttgcctccttatgctccttggtctttctgcaagtgctgctaccgcgaccattttcccgcaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgctgctta

SEQ ID NO: 29895 - DNA, 384 bp, Zea mays
  Clone ID: LIB3059-030-Q1-K1-D1
ctcttccagaggaaatttatgcgaagcttgtagctgcaaagaatttccgtgctggcggcttgagcctgcgtcagatacgatttgccagtgtagatatggagcttcatacaagttatgaccccaatggctcagtgtccatatatgatgtggaccaaagagttgcagaacggacacaagttcttgctcctctgccggaggacagattcctgtgcagctttagccatatttttgcaggtggctatgctgctggatactacagttacaagtgggctgaagtactgtcagctgatgcattctcagcttttgaagacgctggtttggatgatgagaaggcaatcgaggaaactggcagacgattcagagacactgttcttgcgcttggag

SEQ ID NO: 29896 - DNA, 394 bp, Zea mays
  Clone ID: LIB3059-030-Q1-K1-D10
cccagcgtccgagcttttgcgcttcgcaagctgcctttgaccaaggctaagcgatgccttgaggatgttattgctcacaagcaggcaattcccttccggagatactgtggaggtgttggtcgcaccgcacaagcaaagtctcgccactccaatgggcagggtcgctggcctgttaagtcagccaggttcatattggatttgctgaagaatgctgagagtaacgctgatgtgaaaggcttggacgtggacaacctctatgtttcacacatccaggtgaaccaagcccagaagcagaggcgccgcacctaccgtgctcacggacgcattaacccttacatgtcctccccttgccacattgagctgattctgtcagagaaggaagagcctgtgaaga

SEQ ID NO: 29897 - DNA, 317 bp, Zea mays
  Clone ID: LIB3059-030-Q1-K1-D12
agttcggcaacatgggcaccagcgccatcgccatcctcgtccacgccgtcatcttgggctggctgctcaccatctttgtcgtcgccatcggcatccacgtctacgccgcgtatgcgtacgtagcccagccatgctaggtagcttatgctccatacgttcgactggcttgcttcgcttcccacgatggtggtctctttgtaactttccaggtcttttgagtatgtaggctacggatggcgcaagatttagttgctcatctgctatgttgtgtagtgctcggcttttcactacaggaaacgcctaaattttcatgggcc

SEQ ID NO: 29898 - DNA, 432 bp, Zea mays
  unsure at all n locations
  Clone ID: LIB3059-030-Q1-K1-D2
gtattcaaaaacacaccaagcgaaacatattagctacaacctaacaacaatggctaccgagagtgtattccttcatggcgcttttgggctttttgggagcgcaacatatgcgttcattattccacaatgctcacttgctacaagttccattattacacaggtcctaccaccagatacttaatgggctttgacacccagctgtgcaagcctatatgctacaacaagcaattgcggcgagcgtcttacaacaaccaattttccagttgcaacaacaatccttggcacatctaacaatacaaaccatcgcaacgcaacagcaacaacaattcctaccagcactgagccacctagccatggtgaaccctgtcgnctacttgcaacagcagttgcttgcatcaaacccacttgctctggcaaacgtagttgcaaacc

SEQ ID NO: 29899 - DNA, 411 bp, Zea mays
  Clone ID: LIB3059-030-Q1-K1-D3
agctttatctactccagagcgcagaagaacccgatcgacaccatgagggtgttgctcgttgccgtcgctctcctggctctcgctgcgagcgccacctccacgcatacaagcggcagctgcggctgccagccaccgccgccggttcatctaccgccgccggtgcatctgccacctccggttcacctgccacctcctgtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcggcgttggcagcaccccg

SEQ ID NO: 29900 - DNA, 364 bp, Zea mays
  Clone ID: LIB3059-030-Q1-K1-D4
agcgttatctactccagagcgcagaataacccgatcgacaccatgagggtgtagatcggtgaggtcgctcttctaggtctcaatgttagcgccacctgcacgcatacaagcagcagctgcagatggcagccaccaacgacggttcatgtaccggctttacaacatctgccacctgaaaacacctgcgatctcctatgcatctgccaccgacgagacacctgtttgtcgccggtccacctgtaaccgacaggccatgtcccatcgccctttcatacgacgccgccaccatgacagtacattactcaaccgctgcagcctcagactaatccccagccacaccgatgctactgccaacaggagcatt

SEQ ID NO: 29901 - DNA, 399 bp, Zea mays
  Clone ID: LIB3059-030-Q1-K1-D5
cccacgcgtccgcggacgcgtggggttcgaaggagatatgctttcaccctccttggtgttcgaatgttaatgggttcgcatgtgatacgaacatgacctcctttagtcaacgaaatgtgtctacttgtttaagtggtaaagggtcgtttgcttatggaatctatttgggggctcttcctgttatatcgagcaattcgcttgctgtcaaaattctctatcctatattttggggactcatgacactcagtacttttggtaacgatcttgccccaacaagcaatggtattgaggtgatattcagcataatcaatgtcctcagtggcctgatgctcttcacattgctgatcggaaacatacaggtatttctgcacgcggtcctggcaaggaagcggaagatgc

SEQ ID NO: 29902 - DNA, 432 bp, Zea mays
  Clone ID: LIB3059-030-Q1-K1-B8
cccacgcgtccgcccacgcgtccggattgaagggctaaaacgccatccaaggtatggagctcgaattgagagcagcacatacaagggcatgtaccatgccctaaaggagattgtcgcaaaggagggatttggaggcctttataagggccttttcccctctttggtgaaatcggcccctgctggtgctgtgacatttgtggcatatgaatacatctcagactggttagagtcgatactgatgtgaaaatcttcaatgcagatagggagcaaggctggagttgagtgaggtcttgatggatcatggagctatcaagataccatgacgagaactttttgcacaccgtggacatggaggatggagaccggaaggtcaatcgtcaagtgcatacaattcctagagatccgatacatgtaaagccttacatagaaaag

SEQ ID NO: 29903 - DNA, 338 bp, Zea mays
  Clone ID: LIB3059-030-Q1-K1-D6
cggacgcgtgggtgaagttttgacggtacggttaccctcatcaccggacgtggttcgatggttgaagaagccgtgatggggaacgccaccaacagcaacaagcgatactgttacactgggtcagcaaaaagttttgttctgctctatcagtcggccaaagctgaaattttcaaatattctagatcagagtgattagcatgctacttctgaacagttgcagcaattgtctatcctgcggaactatttatgggactgtgtattgttaagtcggttttctccgagttatacgagacgtatggcatcttgagatgtgtcaccaaaaaaaaaacaaaaactaa

SEQ ID NO: 29904 - DNA, 405 bp, Zea mays
  Clone ID: LIB3059-054-Q1-K1-B11
cggacgcgtgggcaactagcaacatagaaagcacaatagtgtaccaacaatttgatccaaaatattttgcctgcttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctatgacaacagttacctttggtgcatttattggcacataacatcagggcacaacaactacaacaacttgtgctagcaaaccttgctgcctactctcagcaacagcattttctttcatt

SEQ ID NO: 29905 - DNA, 391 bp, Zea mays
  Clone ID: LIB3059-054-Q1-K1-B5
cggacgcgtgggcggacgcgtttgcttacgcgtgggggacttcaaaactgatggggttttccagagccatgcggtgcttgccctccaggaggctgctgaggcataccttgttggcctgtttgaggacaccaacctgtgcgccatccatgctaagcgtgtgaccatcatgccaaaggacattcagctggcaaggaggatccgcggcgagagggcctaatcgccacctcaaacatcgtgacaaaaacatgaagtcctggggttattgttaatctggtgccattgtaaggacatatgagtagggtttgttttgttgatcgcaagtttctcttttgctactgttgctgctacctttgctgatgttattgctaggttcttattcctaagttaacta

SEQ ID NO: 29906 - DNA, 292 bp, Zea mays
  Clone ID: LIB3059-054-Q1-K1-B7
cggacgcgtggggcgaaggctacccttcctccttcgctccttccgcgccgccgccggtccgtcgccgccatggtgaagtactcgcaggagccgggcaaccctaccaagtcggctaaggccatgggcagggatctgagggtccacttcaagaacacaagggagacagcctttgcgcttcgcaagttgtctttgaccaaggctaagcgataccttgaggatgttattgctcacaagcaggcaattcccttccggagatactgtgggggtgtttgttatttttttttaatcttaa

SEQ ID NO: 29907 - DNA, 271 bp, Zea mays
  Clone ID: LIB3059-054-Q1-K1-B9
ccaagaagtcaccgccgccaccgatataggccatacttctcgtcctattccgatgccaccataactgccgcttgatctgtagctcgaagggtttcaaggacggtggctggtgtgacgaaagcgtggagcacaaagtgtgctgctgctcccattagaaatataatagcgtatgttatgttgatgcatatatatatgcatcatccatctacctgtgtggtgcaaaattctgaataaaacctgaataaaacctgattgagcacataaaataaaa

SEQ ID NO: 29908 - DNA, 409 bp, Zea mays
  Clone ID: LIB3059-054-Q1-K1-C1
cgcacgcgtccgcccacgcgtccggcttgagccggagccggaggcctagtagatgaggacgttcgatccgtggccggtcttcttccgccgggagtggaagcgcaattggcccttcctcacggggttcgccatcaccggcttcatcatcactaagatgacggccaacttcaccgaggaggacctcaagaactccaagttcgtccaggagcacaagaagcgctgaccaaccaagtgttgtccgaattgcctgtctggacagccagttatgttatgctgtttgaatgaaaaattagcttctttttcttcatctaaatgcgtgcagcctatgctccatctgtaatgtaataagaggcaactgacttgatccaaaagctaccagcttctgattatgaatgatacttcaagtttt

SEQ ID NO: 29909 - DNA, 401 bp, Zea mays
  Clone ID: LIB3059-054-Q1-K1-C10
gttggtagccaagctgttatttcatcaacattctccattgtgaaacaatgccagtctttgggatgtttgcgacgagtgaaggttgttcacacatcgaggtggatctatgggcagatatatattccagaaataaattggattcttatggttctttgtgttgctgtcactattgcatttcgtgatactactcttatcggcaatgcctacggtattgcctgcatgactgctatgttcgttactacattcttgattgcttttataattaatattgtttgtcatttggtggtggggggtgtatttatttttttttatatttttgtaattattttattttataaatattatttatgttttttttttatatattttttttattttttttttttttttattttttttta

SEQ ID NO: 29910 - DNA, 405 bp, Zea mays
  Clone ID: LIB3059-054-Q1-K1-C11
cggacgcgtgggcggacgcgtgggttctacttctcgaagttgcgtgatatgaagatactgtgtcaacggcctgagttagagcatctaccgatgactaaggcggtccggaagatactttatgcagctgatgcaaaggattcaccgctacctgaggcgaatgatataatcacaaagtcaccaagcttgttctcaaatgaaaccgagtgagatgtgcggctacatgagctaattttggtgcttattttccatcattgatcgtcttagtttttagtttttttttttggggggggggtttgttttttttttttttgttttgttttttttttttttttttttttttttttttttgttttttttttttttttttttttttttttttgtgtttttttttttttttgttttttt

SEQ ID NO: 29911 - DNA, 184 bp, Zea mays
  Clone ID: LIB3059-054-Q1-K1-C12
aattccgggggacacgcgcacaatgctcgctcgggctgttactcgtgctgcttgccctccgtttcctcacgcggaaaaagagtccggctgcaacccggatgttggcggcgataagactccggcaacgaaacacctcactcaggactggcgcttgcctatgaccaccaaagcctgcttttgggtt

SEQ ID NO: 29912 - DNA, 301 bp, Zea mays
  Clone ID: LIB3059-054-Q1-K1-C2
cggacgcgtgggcgacgccgccgcctctagccgtccgccttgcccttcacgaaggcgtgggcctcctccttgtatctgcactccccccttcacagatccgttcctccagctagggttagcgttcctctgcagcgatggcgatcaagcggaccaaggcggagaagaagatcgcgtacgacaagaagctgtgcagcctgctcgatgagtacaccaaggtgctcatcgccctcgccgacaacgtcggttccaagcagctccaggacatccgccggggcctcatgggcgactcggtggtgctcat

SEQ ID NO: 29913 - DNA, 428 bp, Zea mays
  Clone ID: LIB3059-054-Q1-K1-C4
agcaacatacatagtgaagtacactatcaacatcttagcaccaatgggagccaatgtttgtgtcctccttgccctccttgctctttcagcaagcgctgctacctcgacttttattccacaatgctcacaacaatacctctctccggtgacagccgcgggatttcaatacccaactatacaatcctacatggtacaagaggccatccaagcaagcatcttacggtcattagcattaaccctccaacaaccatatgctctattgcaacagccatccttagtgcatctgtatctccaaagaatcgcggcacaacaactacaacaacagttgctaccaacaatcaatcaagtagttgcaacgaaccttggtgcttacctcgagcaacatcagtttcttccattcaatcaactagctggggtgaaccctgctt

SEQ ID NO: 29914 - DNA, 266 bp, Zea mays
  Clone ID: LIB3059-054-Q1-K1-C5
acccacgcgtgcgggtggcgtcgtaacgagccagtttcctgctggccgcggtgaccgcgctcttctcgtctgtcgttttcgtcgcggcgcttcacctctacgcgcggtgcctcctgcagcggcgcgtcgccctcgcggaaggcagccctcgcgtggtcgcgctgcagcggcagctcccgccggacggctacgtggttgaggtcgttcttatttttcttatacttcttcgttttcattttattatttttatttttttttattttttt

SEQ ID NO: 29915 - DNA, 298 bp, Zea mays
  Clone ID: LIB3059-054-Q1-K1-C6
gcgcacgcgtcggaagataacaatactacagatgtatctaccgattctacggagggattaaatcccaaacaattaccatttcatgaagttgcacaagattaccaggaggttgacagtgtcattccggagagcaatgaaaatcaggaccggcttttcactggagatgcaacccatcaggtttcatcgaatgattgttatgaagctggaattggtatcgcgtcagaggccagtaacatcattcacaatgatttaccagaagaatcagccgctgctgatttcccggtggtgatacctgatg

SEQ ID NO: 29916 - DNA, 286 bp, Zea mays
  Clone ID: LIB3059-054-Q1-K1-C7
cgcacgcgtccggaaatggaaaggaataatatataaggaaaaaagatgattggaaagtatgtactgtagtaataatgtaatggagccgctggctagctacctagctcgctagtttactcatttagcggcgatgagtaacgtagtgtcacccatcaccatgggtggcagtgtgagcaatgacctgaatgaaccattgaaatggaaaggaataatatataaggaaaaaagatgattggaaactgataaaattaataatttaaattataataaataaattttaatattt

SEQ ID NO: 29917 - DNA, 408 bp, Zea mays
  Clone ID: LIB3059-053-Q1-K1-G5
gccgcggcctcgatcggagtcggaggcgaacacccccatggcggcggctggcggcggcgcaggagggaaggtatccttcaagatcatcctcacctccgaccccaagctccctttcaaagtgttcagcgtgcccgaggcggcgcccttcaccgcggtgctcaagtacgccgcggaggagttcaaggtcccgccccagaccagtgccatcatcaccaacgatggaattggcatcaacccccagcaaagtgcaggcaacgtgtttctgaaacatggttcggagctgcgtctcatccctcgcgatagagttggagctgtagtcatgtcttccggttagaggatatatacagtccaatgcataatgagcaaaacttgagagaaataaagctttgatgttggccttgcttggct

SEQ ID NO: 29918 - DNA, 356 bp, Zea mays
  Clone ID: LIB3059-053-Q1-K1-G6
cccactcgtccgcagaaataagaagttacatttccagattctggttggaggcagggataacacaaaggaaagaatactaaaaaatcaaacaaaaaaaaaaaacacaaacaaaatgccaacctgtacaaagtacccaagcctacataccttcacctccgagctcaaatacgccacataggagcacaaaaacccaacccacaccacttccatcaacaccaacgatacaataaaaaccaacccccaaccaaactcaatcaacttgcatcacaaacatctttcgcaacttcgcctcatacctaacaatacagtaccaactgcactcacgaacagcggctaaaccatatatacaatacaaa

SEQ ID NO: 29919 - DNA, 412 bp, Zea mays
  Clone ID: LIB3059-053-Q1-K1-G7
ctagaatcgcattggttggtcccaatggtgcagggaagagcactcttctgaagcttatgactggtgaccttgctccattagatggcatggttcggcgccacaatcacctgcgcattgcacagtaccatcagcatcttgcggacaagctggatctggacatgccggctctggcttacatgatgaaggaataccctgggaccgaagaagagaagatgcgagctgctgttggcaggtttggcctatcaggaaaggcgcaggtgatgccaatgaggaatctttctgatgggcaaaggagccgtgtcatctttgcatggttggcatataggcagccgcaactgctactgctcgatgagccgacaaatcatttggacattgagaccattgactccctggcggaggcactgaatgaatg

SEQ ID NO: 29920 - DNA, 413 bp, Zea mays
  Clone ID: LIB3059-053-Q1-K1-G9
caaatctgcggcatcatcgcctcagatgagaagcgacatgaaactgcgtacacgaagatcgtggagaagctgtttgagatcgaccctgatggtaccgtggtcgctctggctgacatgatgaggaagaagatctcaatgcctgcccacctgatgtttgacgggcaggacgacaagctgttcgagcacttctccatggtcgcgcagaggcttggcgtttacaccgccagggactacgccgacatcctcgagttcctcgtcgacaggtggaaggtggcgagcctgactggtctgtcgggtgaagggaacaaggcgcaggactacctttgcacccttgcttcaagaatcaggaggctggaggagagggcccagagcagagccaagaaagccggcacgctgcctttcagctgggtata

SEQ ID NO: 29921 - DNA, 245 bp, Zea mays
  Clone ID: LIB3059-053-Q1-K1-H11
cccacgcgtccgcccacgcgtccgcccacgcgtccgatgaaaagaaaaaagtatgagtcattcaggtcattgctcacactgacactgccacccatggtgatgcgtgacacattattactcaatcatcgccgctaaatgactcaactagctagctagccagcggctatactacagcacccctatcctgggccattgcttcaagttcctgaggcatcactgcagcctgactgcaactccctactgct

SEQ ID NO: 29922 - DNA, 424 bp, Zea mays
  Clone ID: LIB3059-053-Q1-K1-H12
aaaccttgctgcctactctcagcaacagcagtttcttccattcaaccaactagctggattgaactctgctgcttatttgcaacaacaactaccattcagccagctagctgctgcctacccccaacaatttcttccattcaaccaactggcatcattgaactctcctgcttatttacagcagcaacaactactaccattcagccagctagctggtgtgagccctgctgccttcttgacacaacaacagttattgccgttctacctgcacgctgcgcctaacgctggcaccctcttacaactgcaacaattgctgccattcaaccaacttgctttgacaaacccagcagcgttctaccaacaacccatcattggtggtgccctcttttagatttcttatgagttatagttcaataataaagttttt

SEQ ID NO: 29923 - DNA, 416 bp, Zea mays
  Clone ID: LIB3059-053-Q1-K1-H5
cggacgcgtgggccgcgcctctacatttcttctctctctgctcctccgcgtccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacac

SEQ ID NO: 29924 - DNA, 170 bp, Zea mays
  unsure at all n locations
  Clone ID: LIB3059-053-Q1-K1-H7
cccactcgtccgctgccattctacccacaggatgtggcaaacaatggcagcaactgttgctgttgcaagaaggcgttaatgtttcccacaacctgtgggtaaaatggcagcggtcgcgtgggcggtcgcgtagttaattttgtggtatatgtagnttattgaatgggaaa

SEQ ID NO: 29925 - DNA, 424 bp, Zea mays
  unsure at all n locations
  Clone ID: LIB3059-053-Q1-K1-H8
gaattccctgcgattcctctcccctcgcctcctcgtctccccctaggggatcgggggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctccaagtgccacaaggagatgataacgaagcaggatcaggccaagctggctgcctcctctatcgacagcatcgtgaacggcagcgacgccgtcatggagccggttgttgctggcagcaacacggtagtagctgttgcccaagtcgagttgcaaacaatgaacgtgcagcagcccgctgatgttgccggacccagcgaggnggtggcggcgatctccaaaggggg

SEQ ID NO: 29926 - DNA, 424 bp, Zea mays
  Clone ID: LIB3059-053-Q1-K1-H9
gtgcgtgaggagtctggagtcggacggaaatcgaaaaggcgaaaactcagtgggtggagtttcctcggagcggaggcgatggctgggaagggagggaaaggcttgctcgccgcgaagactacggcggccaagtccgccgagaaggacaaggggaagaaggccccaatctcacgctcctcccgcgccggcctccagttccctgttggacgtatccaccgtcagctgaagcaaaggactcaggcaaatggacgtgttggtgccaccgcagccgtctactctgctgccatcctggagtatttgactgccgaggttctggagctggctgggaatgctagcaaggatctgaaggtgaagcgtatcacccctcgccatttgcagctagccattcgtggagacgaggaactggacaccctcatcaaaggca

SEQ ID NO: 29927 - DNA, 421 bp, Zea mays
  Clone ID: LIB3059-054-Q1-K1-A1
cagctagcaacatagaaagcacaatattgtaccaacaatggcagccaaaatattttgcttccttatgctccttggtcgttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggctgcattgaactctgct

SEQ ID NO: 29928 - DNA, 376 bp, Zea mays
  unsure at all n locations
  Clone ID: LIB3059-054-Q1-K1-A2
cgcacgcgtccgcccacgcgtccgcatcaatgcacacttctttcaatcaagactgntggagtcagtgaagattgttcttactgtcctcagtcatcaagatacaacactggattgaaggcccaaaaattgatgaacaaatatgctgtcttggaagcagcaaaaaaggcaaaagagtctgggagcacccgtttttgcatgggagctgcatggagagaaaccattggcaggaaatcaaacttcaaccagattcttgaatatgtcaaggaaataaggggtatgggcatggaagtctgttgcacactaggcatgatagagaatcaacatgctgaagaactcaagaaggctggacttacatcatataatcataacctagata

SEQ ID NO: 29929 - DNA, 409 bp, Zea mays
  unsure at all n locations
  Clone ID: LIB3059-054-Q1-K1-A4
cgcacgcgtccggatacaaagaagtttgcagctaagaatcgaggaacaagggaantgtctgcatatgatgctagagcagcagtgcatacccggggcagaaaaggcgcaggatgcttcaaccgctgcagatgaattgaggtcaccttctgagattccagaatcttctagagtcaaggaagttccagaaaacagtcaaaatggatcaaccaagcaaacaaaataagctaagggccgatgaagttgcaagcatgaaatgtgtttcatgatccgattggctgtttccaggcttaaatcaagtggtttttgtcctttcttgggaacagatttactctatagttaattttcttgctaaatctgtctagttctatttactaggtatttatttttttttttcttttctttatttttt

SEQ ID NO: 29930 - DNA, 236 bp, Zea mays
  Clone ID: LIB3059-054-Q1-K1-A5
cggacgcgtgggattcctgatatcatctattcgttggccagatgattagagggctggaaatatattaagaacaataccatagagagaagttcctcagtgctctcgcagcttaaggagcaaacagcaacactttacttcgttttttatactttattatagccgcactgtttattactcgggctacatttgtgaacagcgactgtaatatttttttactctatattcgtagtgagatg

SEQ ID NO: 29931 - DNA, 313 bp, Zea mays
  Clone ID: LIB3059-053-Q1-K1-G4
cagaaacacaccaagcgaagcgcactaatcacaaacctaacaacaatggctaccaggatatgatccctccttgcgcttcttgcgctttttgcgagcgcaacaaatgcgtccattattccacaatgctcacttgctcctagttccattattccacagttcctcccaccagttacttcaatggccttcgaacacccagctgtgcaagcctataggctacaacaagcgattgcggcgagcgtcttacaacaaccaattgcccaattgcaacaacaatccttggcacatctaacaatacaaaccatcgcaacgcaac

SEQ ID NO: 29932 - DNA, 408 bp, Zea mays
  unsure at all n locations
  Clone ID: LIB3059-053-Q1-K1-F1
ggcgctgaaaaggaacctggaaccaatggccccaggcctgatccatgtgattatgggcaaggaggttaaggttggttgaagttccagggaaaagaacctcttttaccggggtacccaaaccttcaaaataagaattttctggtagattgcaagagaatcacgagaacacccagccaagtaataatcataacgattcagtagatcagagtcaactgcccccttcttcaagccctactgagagtacagatgaaatttcatcagaagacgaagaaaataatgataaagagaacatggatccaagcgctcagaataatgatgtacatactcttgaacacctncaacaagccatcggaggaaactcacgtccagatgatgctatcttaaaggattttctagatgatgaagctg

SEQ ID NO: 29933 - DNA, 413 bp, Zea mays
  Clone ID: LIB3059-053-Q1-K1-F11
cggacgcgtgggcggacgcgtgggcggacgcgtgggagcaaagacacccaacgggtgcattcttcaacaatttgaaaatccagctaacccaaagattcactatgagactactgggcctgaaatctggaaagctacagcaggaaaaattgatggccttgtatctggtatcgggacaggaggtaccatcaccggtactgggcgatacctcagagagcaaaatcctaatgtcaagctctatggtgtggagccagtggagagtgctgttttgaatggtggaaaacctggaccacacaagattcaaggaattggagctggttttatccctggagtcttggatgttgatctccttgatgaaactctacaggtttcaagtgatgaagctatcgagactgccaaggctcttgctctgaaag

SEQ ID NO: 29934 - DNA, 384 bp, Zea mays
  Clone ID: LIB3059-053-Q1-K1-F5
cccacgcgtccgactgcctactctcagcaacaacaacttcttccatttaggcaaggggccgcactgaaccccgctgcttatttgcagcagcaaatactactaccatttagccagctagctgcagcaaaccgtgcttccttcttgacacagcaacagttgctgcctttctaccagcagtttgcggctaaccccgcaaccctcttacaactacaacaattgttgccctttgtccaacttgctttgacagacccagcggcctcctaccaacaacacatcattggtggtgccctcttttagattgcttattagttgtaattcaataataaagttttttggatgatgtatgtggccaaccagaaataagaagttacatttccagattct

SEQ ID NO: 29935 - DNA, 417 bp, Zea mays
  Clone ID: LIB3059-053-Q1-K1-F6
cccacgcgtccggcaccgctcaagctaagtcgcgccactccaatgggcagggccgctggcccgttaaatcagccaggttcatcctggatttgctgaagaatgctgagagtaacgctgatgtgaaaggcttggatgtggacaacctctatgtttcacacatccaggtgaatcaagcccagaagcagaggcgccgcacctaccgtgctcacgggcgcatcaatccctacatgtcctcaccttgccacattgagctgatcttgtcagagaaggaagagcctgtgaagaaagaggctgacaacattgtcgcagcaaggaagcagtgaagtatatcagcatgctgatcgaggccattttgtcgaagtattatagccgtagctcttttatgtaccttttcaggcagccttgcctctcgagacg

SEQ ID NO: 29936 - DNA, 414 bp, Zea mays
  unsure at all n locations
  Clone ID: LIB3059-053-Q1-K1-F7
gcgacgacgagcaagcaaaggaggccaagagccccaagagagcgcccgcggatggggcggcgcgcgcatctacgcccgtgaagaagaagctgaaggaccagaaggcggctgcggcaaacatgggtgtgtgcagcttctccatggcgcgggtgcggcagctgatgcgggccgaggaccccaccatccgcccttccagtgaggctgtcttcctcatcaataaggcttcagagttcttcttggggaagtttgcagaggatgcttatcacaatgccgcgaaggatcgtaagaaatccattatttacgataatctttcaacagctgtttccagccagaagactntaaagttcctttcagattttgtaccgcagagagttgcagccgaagatgctttgaagacaatgacgagcaacaact

SEQ ID NO: 29937 - DNA, 418 bp, Zea mays
  Clone ID: LIB3059-053-Q1-K1-F8
gccacgcgtccgcccacgcgtccggaacaatacacacttgtcttcacgcgttgggcgctttaatctggactggactgatccagaccagtcacttgagaaggagaatgcggcatttgaacaggcaatgatactagctggaagtgaatttatggagagggttcgcttccatgttaaatcatggttaccggcaaggtctattgtcctggagtgtttgttatcaaaaggaaacattgatccaagtggagaaatcttggttttggatagattctgcccgtggaaacttcatttatttgagcttgaagaggagctgaagactgatcctctgaccaagtatgtgctgtatcaggatgagaggagcaagagttggcgagtccaagcagtcgcagttgctcctgacaggttcgagagccgaaaggct

SEQ ID NO: 29938 - DNA, 412 bp, Zea mays
  Clone ID: LIB3059-053-Q1-K1-F9
ttactgggatcaagcaaggcctgagcaaagcttctgtgggggtggtccctcggcgaaagaagtccgttcggcaaaaggagatatcttggagaaagcagttggaaacgatgagtcttacgatataagatccagttttggaatacaggtcgtgcaggaaatgtacaaacagagtagctcggtctccggtttgacgcccaagactcagctcgcggtggcagctgcagattctgcagggtgccatcgtgacgcaatactcgcgttggcatccttcaacttgtctagccagagattggtatcaggcagcagagacggcgctgtcaaagtgtggaaatagcttctccagcatggggtaagattacaagtccacaggcgtgtacatattttggcctgtctagtgctcatacagtacata

SEQ ID NO: 29939 - DNA, 180 bp, Zea mays
  Clone ID: LIB3059-053-Q1-K1-G1
tgtgcatctcccaccgccggtccacctgccgtcgccggtccacctgccaccgccggtccatgtgccgccgccggttcatctgccgccgccaccatgccactaccctactcaaccgccccggcctcagcctcatccccagccacacccatgcccgtgccaacagccgcattcaaacccgtg

SEQ ID NO: 29940 - DNA, 413 bp, Zea mays
  Clone ID: LIB3059-053-Q1-K1-G10
aaaaaaaaaaaaaaaaaaaaaataaataaaaaaaaaaaaaaaaaaaaaaaaagagagggataaaaaaaaaacaaaatcatacatgcccggtctttcttgctgtttcatgttaacttaaatctttcttgtctagccatcgctatacaatgtagtgactgaaattaaattaactggccacagtttaataactttgcttctgataaacctttgcctttctccaatttaatctttttgcccctcatccatttttcttcagatcccttactatcgctcattcccaaattgttccccctttaaaacggttccttaccctcattgtctattggcattacccccgtcgtgactcattaacttccgcgctttttatggttcactccattgtgtcctttacctttgtcttttcccatactccc

SEQ ID NO: 29941 - DNA, 425 bp, Zea mays
  Clone ID: LIB3059-053-Q1-K1-G11
ctttccaacaatcaagatgagccgtggcggtagcgcgggtggtggtcaaagttgtgggggttacctctttggaagcggtgagccccccaaaccagcagtggcaccagctgtaagtgctccacctgctgctgcaggtgctccacctgctgagaaaccacctgctgcaaagcctgatggcaccagtcagattgctgctggggttaccagccaaaccaataactaccacagggccgacggtcagaacaccggaaacttccttacggaccgtccttcgaccaaggtccacgctgctcctggcggtggctcttccctgggatacctgtttggtggcaactgatgccgctcaccaagctatcaccccccactgtcgccgcatgctttttctgaatcgtgaacagccgttgtcatttcatgtgtacccaaac

SEQ ID NO: 29942 - DNA, 441 bp, Zea mays
  Clone ID: LIB3059-053-Q1-K1-G12
aacttgtgctagcaaaccttgctgcctactctcagcaacagcagtttcttccgttcgaccaactagctgcattgaactctgcttcttatttgcaacaacaacaactaccattcagccagctacctgctgcctacccccagcaatttcttccattcaaccaactggcagcattgaactctcctgcttatttacagcagcaacaactactaccattcagccagctagctggtgtgagccctgctaccttcttgatacaaccacagttgttgccgttctaccagcacgctgcgcctaacgctggcaccctcttacaactgcaacaattgctgccattcaaccaacttgctttgacaaacccagcagcgttctaccaacaacccatcattggtggtgccctcttttagatttcttatgagttatagttcaataataaaagttttt

SEQ ID NO: 29943 - DNA, 420 bp, Zea mays
  unsure at all n locations
  Clone ID: LIB3059-053-Q1-K1-G2
gcccggcgggcacattgtcatctgcggcatctttgattacctacaggagcgtgcaaaaggtagcaccttgcttggattcaagggaggccctgctgggatcatgaagtgcaaatatgtggagctcacttcagactttgtgtatccctacagaaaccagggcggattcgatatgatctgcagtggaagggacaagattgaaacaccggagcagttcaagcaagctgaagacacagccaacaagcttgatttggatggacttgttgtcattggtggtgatgattcaaacaccaatgcctgccttcttgtgaatactntangtcaaggaacctgaagactcgtgttattggttgcccaaagactatcgatggagatctgaaatgtaaggaggtaccaacaagctttggatttgatactgcttgc

SEQ ID NO: 29944 - DNA, 420 bp, Zea mays
  Clone ID: LIB3059-053-Q1-K1-E9
cccacgcgtccgaaaagagctaaaagcaatacagtacttggagagaagagagtgtgagtacgaccagaaaatatccattgatttctacaaggaaggagatcccttgaaaccagctgtgacgggcgtcttagtgttcgtttccactccagatccaattggcaacaagtactatcttggccctgctcctctgcaggatatggcaaggcaaattgctacagccaatggccctactggctataatagggattacctgttctcaatggagaaggcattagccagcattagccacgaagatgattcgatcatagagcttgcaaacgaggtgaggaaggtgctcaacagaacaaaggagaccaagatcactggtgccaatgcttccatgaaatcacatgcccctcttgtgcacctgtccgcgctttc

SEQ ID NO: 29945 - DNA, 352 bp, Zea mays
  Clone ID: LIB3059-030-Q1-K1-A11
ttcaacatcccatccccacctccacggctgggggctacctccttcttcacctacttgctctttcacttcctatcctacttacaccttttttccatatttctcacaccacttcctttctcctctgactgcctcaacattctattccccaactataccctccttcttgctacaataacccatcacaccatgcatcttactgtcctagcattcactgtccatcaaccatatgccctatcgctacagccatccttagtgcatctatatcttcaaacattcgtatcacatcaacttcaacatcaattgcttacaactattaatcacgtccttgcagcgaaccttgatgcttaccttc

SEQ ID NO: 29946 - DNA, 430 bp, Zea mays
  Clone ID: LIB3059-030-Q1-K1-A4
cgaaaagtttaactgctggagtttgcttgccaaagggcaacaaggatgataaaggcctggaaacagagacctggtatgatctagctctcttatacctaggtatggcacaatggagggatgcagaggtttgtgtattgaagataagatccatcagtccttattctgcattggcttggcatgctacaggaaaaatatatgaagcaaaaggtcttagaaaagaagctttgggagcttttttcagagccttagatcttgatcctaaacatgtcccaagtttaatatcaactgccactgttctacaacaacttggtgacaggccattgccttctatacggtgcttcctgactgatgcattacaactggatagaactaatcatgttgcgtggttcaatcttggccttctttacaaagaggaaggtggcaggtcagc

SEQ ID NO: 29947 - DNA, 426 bp, Zea mays
  unsure at all n locations
  Clone ID: LIB3059-030-Q1-K1-A8
caatgattcccgtgagaagcagcgcaaatttgttgaaaccattgagctacaaattgggctgaagaactatgaccctcaaaaggacaagcgcttcagcggttctgttaagctgcctcacatccctcgccctaagatgaaggtttgcatgcttggtgatgctcagcatgttgaggaggcagagagaatgggtatagacaatatggatgtggaagccctcaagaagatgaacaaaaacaagaagctagtgaagaagctggcaaagaagtaccatgctttccttgcatctgaggctatcattaagcaaattcctcgtcttcttggtcctggtcttaacaaggcaggaaaattccctaccttggtgacacaccaggaatcccttgagtccaaggttaatgagacanaggctacagttaagttccagctgaa

SEQ ID NO: 29948 - DNA, 374 bp, Zea mays
  Clone ID: LIB3059-030-Q1-K1-A9
ccgacatcgtcccttcgtccccacgagcaaccgataatccgccggcgttgagatgttggtttatcaggatctcctatctggcgacgagctcctgtcggattcattcacctacaaggagctcgagaacggcgtcctgtgggaggtcgagggaaagtgggtcacccaaggtcctgttgatgtggacattggtgccaatccatccgacgagggtggtgaggacgaaagcgttgatgacacagctgcgaaggtggttgatattgctgacacattccgtctacaggagcaacctccttttgacaagaaatcatttgtgtcttacatccaacaatacatgatgaatctcactgctgtggtggagccagagaaagcggatg

SEQ ID NO: 29949 - DNA, 405 bp, Zea mays
  Clone ID: LIB3059-030-Q1-K1-B1
aggaatgagggatgtgatatttgctgatattccaaagctcattccatttattgatctggaggatatgagcctattcagttgcttctacgattttgttttcttcatctgccgtgaaaaggtcaaaagagtgtcactattcagagagctgtagcagcatggaggattgttctaagtggaaggttccgtttgcttgatcgatggtgtaacttcgttgagaagtaccaacgccataacatatccgaggatacttggcagcagctgctagctttcagcaggtgtgtaaatgaagatctggaaggttatgacccacgaggtgcttggcctgttctgattgatgattttgttgagcaaatgcacagaatttatcactccactgacttgcacagtgcgatggaatcacagtgt

SEQ ID NO: 29950 - DNA, 393 bp, Zea mays
  unsure at all n locations
  Clone ID: LIB3059-030-Q1-K1-B10
cccacgcgtccgccgccgccggttcatctgccgccgccaccatgccactaccctactgaaccgccccggcctcagcctcatccccagccacacccatgcccgtgccaacagccgcatccaagcccgtgccagctgcagggaacctgcggcgttggcagcaccccgatcctgggccagtgcgtcgagttcctgaggcatcagtgcagcccgacggcgacgccctactgctcgcctcagtgccagtcgttgcggcagcagtgttgccagcagctcangcaggtggagccgcagcaccggtaccaggcgatcttcggcttggtcctccagtccatcctgcagcagcagccgcaaagcggccaggtcgcggngctgttggcggcgcagatagcgcag

SEQ ID NO: 29951 - DNA, 324 bp, Zea mays
  Clone ID: LIB3059-030-Q1-K1-B11
tccgcacgccacgcgttcgagcagctgtatggtgcatccaaattaactgattctactgctaatagtactgtttatgcgtggggtaccattataatatattaacgatgttcccattgctgcatttacaattcatagagacaacatagtataaatagtagaagccgttacggattaaaaccaaactagcaggctctatcttttataagtacaaaattgtgccgaatgctctatctttcataagtacaaaattgtgccgaaaaaaaaatgcgacagtcattgaagtcatctagctaaaaaaggtagcaacctctaatacatccatga

SEQ ID NO: 29952 - DNA, 290 bp, Zea mays
  Clone ID: LIB3059-030-Q1-K1-B12
cccacgcgtccgcccacgcgtccgcggacgcgtgggaaaaaaaaaaaaaaaaaaaaggaaaagagaaaaaaaaaaaaaaaaaaaaaaaaacaaaagtaactacttcagaaaaaaaaaaaaaaaaacataaataaagcaaaaagaggccggccattctaaagaatccaacattcaaaccgagaacgttgtacgcatgaagtacgttatgtatactgctaaacaaagtaagaggccatttgagcatagcttccagtgcggaaactacaaggttccaacaaactgatgatatc

SEQ ID NO: 29953 - DNA, 384 bp, Zea mays
  Clone ID: LIB3059-030-Q1-K1-B3
gcttaaactgaatgggattgatacttctgctttcctatcacccgtagatctgacacgaggatcaattgagagaaatctccaaatcgctgcagttctgggagggctttctgtatcagctgcattggaactttctcaactccaaatcctgtttctcatactaggtctactatctttgtggtccgtggactttgtatattttggtggtggggtgagaaacttggttcttgatacaattggtcactatcttagccagaagtatcacaacagagttatccagcatgaagctggtcacttcttgatagcttacttgcttggagtgcttccaaaaggatacacaatcacaagcttagatacacttatgaatcaaagatcgcttaatgtgca

SEQ ID NO: 29954 - DNA, 387 bp, Zea mays
  Clone ID: LIB3059-030-Q1-K1-B4
gccctcggggtcggatgcgacgagcagggagttggtggacttgtcgaagaggacgaaggcgtatgagccggtgagctgggcgagcatgaagctggccgggtagggcgcgcggtcgcgcagcgtcttgtaggcctcgatgacgaggagcacctcgttggcgcccttgcttgacagcccgtgctgctggctcagacgacccaggttgtccagcaccccctcgaacaggcagaacacctcgtccttggccgcgaacgacctgtggcggaggagcgcctggttggtgtgggagtaggcgaggtggccgtggtcgccgagctgcacggacacgggcggctcggaggcggccaggaagcgccccaccagctgcgacgccttcgtcttgggcga

SEQ ID NO: 29955 - DNA, 250 bp, Zea mays
  Clone ID: LIB3059-030-Q1-K1-B5
cactcgacccactcatcctcgcacgcatccacccactccttctcattttcctccaatactaaaaaaaaacagtaccgatcctcttccaatttaatataataaccatacacactaaaactacatctcacacaacaaatacacaacataaccaaactacaaacaacccgctactactaaaaaacccactaccatcatccaatcacccataactccaaaacattacctcatccccactattacataattacaa

SEQ ID NO: 29956 - DNA, 420 bp, Zea mays
  Clone ID: LIB3059-030-Q1-K1-B6
gaccaactagcaacatacaaagcacaatagtgtaccaacaatggcagccaagatatggtgcctgcttatgctccttggactttctgcaagcgctgctacggcgaccattttaccgcaatgctcgcaagctcctatagcttcccttcttccgccgtacctctcaccagcggtgtcttcagtatgtgaaaacccaattcttcaaccctacaggatccaacaggcaatcgcagctggcatcttacctttatcacccttgttcctgcaacaatcatcagccctattacaacagttaccttcggtgcatttattggcacaaaacatcatggcacaacaactacaacaacttgtgctagcaaaccttgctgcctactctcagcaacagcagtttctttcattcaaccaactaggttcattgaactc

SEQ ID NO: 29957 - DNA, 416 bp, Zea mays
  Clone ID: LIB3059-030-Q1-K1-B7
cggacgcgtgggcgcaaattgcaccaagaaatccatcgagaggccgtcgacgggggagattaatggcgtcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgcctagaggacctgccgggctgcccgcgggaggtg

SEQ ID NO: 29958 - DNA, 389 bp, Zea mays
  unsure at all n locations
  Clone ID: LIB3059-030-Q1-K1-A10
cggacgcgtgggggtagatgttggtagctgctctgcaacaaactgatacaacctaacaccaagccatgccaacctcagccaaagggttgtatgccctacattgcatattatttttcttaaatatgtttattcagattgtagatgattgctctcttgcagtcttgcttttggtatcaaagacacttccttatttggtcccctattacacaggcaaagagaagacgaggtagaaccccaacacctgggaagtatcttggcacaaaatcatcccgtggacggaggtactccacaagctactcacctgatcggaggggccgttacagttcccgctactcacctgatcggagggactgtcatggtagagaccggtcatactctncatatgacag

SEQ ID NO: 29959 - DNA, 455 bp, Zea mays
  unsure at all n locations
  Clone ID: LIB3059-029-Q1-K1-G5
ggaattacccgggctcgacgccacgccgtcccggttgcgatgggtgcctctnngaacgtggtatgttatacgagttccagaaaccaacctggtacggctacgcgnngaggatccacttgcatgctttcttcgtaccgctccagtcatctctgcntgagaaggggcctaccacgagcnnagctctctgtggctgagatcaccaacagcgccttcgagccatcttccatgatggccaagtgcgacccacgccatggcaagtacatggcctgctgcctcatgtaccgtggtgatgtggtccccaaggatgtgaatgctgctgtggccaccatcaagaccaaacgcaccatccagttcgtggattggtgcccgactggcttcaagtgcggcatcaactaccagcctnctagcgttgtgcctggtggcgacctggccaaggtgcagcgtgccgtgtgcat

SEQ ID NO: 29960 - DNA, 239 bp, Zea mays
  Clone ID: LIB3059-029-Q1-K1-G7
aaccattttgcttacgaggggcacctagctcgctctggtaacgtaccatggctgatcaccaccggcctgcgaccggaggtggcggaggctactgagacctccagcgccggggcggcatgcactgagaggcgcaacagcagcagaaacacggcgccatgatgacggcgctcaaggccgcgacagccgcgaccttccgccggtcgatgctgcagctgtacgggctgatcctggcctgcacc

SEQ ID NO: 29961 - DNA, 286 bp, Zea mays
  unsure at all n locations
  Clone ID: LIB3059-029-Q1-K1-G8
gcgtgcgtccacgcgtccgccacgcgttcgacaagcacatagaagtggaaccgggtacggcaacagagcaacaatggcgaccaagatattttccctccttatgctccttgctctntctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcaccc

SEQ ID NO: 29962 - DNA, 413 bp, Zea mays
  Clone ID: LIB3059-029-Q1-K1-G9
ctcagagcagccgcatccacaacctgcctctctcgctccctggcggcgtccgcggcaggatggcggaatctacggcgaggacggtgaaggatgtcaacccgcacgagttcgtcaaggcctactccgcccacctcaagcgctccggcaagatggagctccctgagtgggttgacattgtgaagactgcgaggttcaaggagcttcctccttatgatcctgactggtactacatcagggctgcatccattgcaaggaagatctacctaaggcaaggcatcggtgtgggtggctttcagaagatctacggtggccgccagaggaatggctcccgcccaccacacttctgcaagagcagtggtgctgttgcacgcaacatcctgcagcagctgcagattatgggcatcatcgatgtc

SEQ ID NO: 29963 - DNA, 433 bp, Zea mays
  Clone ID: LIB3059-029-Q1-K1-H1
gataccaccgccgctgcacacaaacccagaaaccaccggcaataaacaactcccgctcgcagtctccgatccgaggaagccggaagaggggatttcgagccgcggcgatcggggctagagtggccctcgacgcgtccgcgggtggaattgccgagaagccgagagagagggcttggagcggagttgcgggaggtgggagagaaggcggcgatggggcgcctgttcctgatgcacctggacggcaacgtctacagctgcaaacactgcaagacccacctcggcgttgccagcgacatcatctccaaggccttccagtgcaagcacggcaaggcgtacctcttccataaggttgtcaacgtgacttctggagtaaaagaagaccgcatgatgatcacaggaatgcatactgtatctgatatcttctgtgttggct

SEQ ID NO: 29964 - DNA, 393 bp, Zea mays
  Clone ID: LIB3059-029-Q1-K1-H11
atttgcattcacaaccgcagaagctggaaactacgttgcatgcttctgggttgatagtgcagagaaaggatcaggagtatctgtgaatcttgactggaagattgggatcgcaacaaaagattgggatgctattgctaagaaggaaaaaattgagggtgtagaactagagcttcggaaacttgaagtggcagtgcaggccattcatcagaacttgatatacctcaaagaaagggaagcagagatgcgaactgtgagtgagacaacaaattcaagggtcgtctggttcagtactctgtcgctatgggtctgcattgcggtatcggttttgcaagtccgacaccttcaagggttcttcagaaagaagaagctcatttagagtctctctgtaagatg

SEQ ID NO: 29965 - DNA, 327 bp, Zea mays
  Clone ID: LIB3059-029-Q1-K1-H12
cggtcggattccggctagcgtccggtccgcgtccgggcatctcacattctgccagttcttcttgagcaccatgtggaaggcgtacggggtgttctaagggtgctcttttgtgaagtctgctaggttctggcagcgaggttttattgaattaaactcttgttaaggatatgtttttggacgatcctatatttcgtcctggcgctactatggttcagaatggtggtactactataagtatcctagcgctataagtattgcttgaaaggatcaatataatttgcgtgtcatacccgcaaccttttctgccaaaaaaattaatactataag

SEQ ID NO: 29966 - DNA, 416 bp, Zea mays
  Clone ID: LIB3059-029-Q1-K1-H2
gtgatcctgagattgggatgccactgaccattcatcagtacaagctgcttactacaggggtgctcattggacgtctcattaatgctaatcagcaccttttggcccttcgcatctctgagtaccttaacctgaacccggaggttgtgataatgcattgggcatgtgagaagataacagcatcaacaactcttccagatacagtccttcttgatggtctgcttgataagctcaggctatgtaaagggatatcatatgctgcagtggcagctcatgcagataacagtggtcgacgaaggttggctgcaatgctcgttgatcatgagtcacagtcctctaagcagatccccttgttgctcagcatcgatgaacaagacaaagcattatcaaaggcaattgaaagtggcgataccgatctt

SEQ ID NO: 29967 - DNA, 427 bp, Zea mays
  Clone ID: LIB3059-029-Q1-K1-H5
atgggattaggccagggaccacagcatctggattggcgaaactgaaaccagtttgtaggaaggatggaactacaactgcaggcaattccagtcaagtgagtgatggtgctggagctgttcttctcatgaaaagatctgtggctctgaagaaagggctgcccattcttggtgttttcaggagctttgcggctgttggagtggatccagctgttatgggtgttggtcctgctgtggccattcctgctgctgtgaagtctgcaggccttgagattggcgacattgatctgtttgaactgaatgaggccttcgcctctcagtttgtctattgctgcaacaagttggggctggaccgttctaaagtaaatgtaaatggaggcgcgattgcccttggacaccctctgggtgcaacaggttgcccgtgtgtggc

SEQ ID NO: 29968 - DNA, 441 bp, Zea mays
  Clone ID: LIB3059-029-Q1-K1-H6
cccacgcgtccggcagctgcagcaactcgtgctacctgtgatcaaccaagtaggtctggcaaacctttctccctactctcagcaacaacaatttcttccattcaaccaactgtctacactgaaccctgctgcttatttgcagcaacaactattaccattcagccagctagctactgcctactctcagcaacaacaacttcttccatttaaccaattggccgcactgaaccccgctgcttatttgcagcagcaaatactactaccatttagccagctagctgcagcaaaccgtgcttccttcttgacacagcaacagttgctgcctttctaccagcagtttgcggctaaccccgcaaccctcttacaactacaacaattgttgccctttgtccaacttgctttgacagacccagcggccttctaccaacaacacatcattgg

SEQ ID NO: 29969 - DNA, 427 bp, Zea mays
  Clone ID: LIB3059-029-Q1-K1-H9
ggactcgctgctgttcttttgcttggtacccttggatctctgactccagcccgttccccgaaatttccagttcttgcttcttcctcttggaggaggagggctgcagcctgcaggggccggagagagcaggaggaggcggagacatgggtagcttcgctaagctggcgaggagggcggtggagacggacgctccggtcatggtgaagatacaagaactgctccgaggggccaaggatgtgatgtcgcttgcgcagggagttgtttactggcaacctcccgagtcagctatggataagatcgaaaagatcatcagggaaccaatagtcagtaaatatggttctgatgatgggcttcctgagcttcgagaagcacttctcgaaaagctaagcagagagaacaagcttaccaaatcatcagtcatggtcac

SEQ ID NO: 29970 - DNA, 441 bp, Zea mays
  unsure at all n locations
  Clone ID: LIB3059-029-Q1-K1-G4
ccgacgcgtncggtgaggacacaaactcttgtgaagagtgccattgtgcaagttgatggtgggccattcaagcagtggtacctcactcactatggagttgacattggtaggaagaagaaaacccctgctgcaaagaaggataatgctgagggacaagaggttgaggcagcagctgaggaaacgaaaaagagcaaccatgtcacgaggaagcttgagaagcgcaaggagggacgtacccttgacccacacattgaggagcaatttggcagtggacggttgctggcatgcatttcttcccgccctggacagtgtggccgagctgatgggtacatccttgagggtaaagagcttgagttctacatgaagaagctacagaggaagaagggcaagagcgctgtagcttagagcattctcatggattgtcttgcaccgaaatgtgtg

SEQ ID NO: 29971 - DNA, 436 bp, Zea mays
  Clone ID: LIB3059-029-Q1-K1-E8
cgcgatctgcttccagagccccccgccgtcgctgcgccctcctctcggtcctgccgtcggtcgaggtaaaaggacagcatggtgagggtcagcgtgctcaatgatgctctcaagtccatgtacaatgctgaaaagatagggaaacgtcaggtcatgatcaggccgtcatccaaggtgatcatcaagttcctgacggtcatgcagcgccatggttacattggcgagttcgagtacgtggatgaccacagagctgggaagatcgtggtggagctgaatggaagactgaataaatgtggtgttattagcccacgttttgatgtaggtgttaaggagatcgagggatggacggcgaggcttcttccatctcgccagtttggctacatcgtcctaacaacttctgctggaattatggaccatgaagaggcccgccgtaaga

SEQ ID NO: 29972 - DNA, 419 bp, Zea mays
  Clone ID: LIB3059-029-Q1-K1-E9
gaaagtggaatccagtagcaacaacagatcaacaatggcgaccaagatattttccctcgttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacac

SEQ ID NO: 29973 - DNA, 381 bp, Zea mays
  Clone ID: LIB3059-029-Q1-K1-F11
ccagcgttcgcggcgcgtgggtttgtctgcataccccctgcaattattattgaaggaccgcaattagtgcagcatggttttaaagatgcaattgccaaagttggattaacaaagctgatttctaatttttttgtggtgggcttattctatcacctttataaccagtatgctacaaacacattgtagctggtagcccctttaacacatgccatcggcaatgtgttgaaacgtgtcttcgtcattggcttttccatcatcgcattctgcaacaagatcaccacacatactggaatcggcacttgcattgctgtttctggcgttgccctctactcatttataaaggctaagattgacgacaaaaagcaccttaagagtgcataa

SEQ ID NO: 29974 - DNA, 394 bp, Zea mays
  Clone ID: LIB3059-029-Q1-K1-F2
aggaggcgctagtcggcaaggtcaacataaaccttgtttacctcatcaacatcgaggggggcgccgtcattggtctgtgccgcaaggacgctcgccttataaccgctcgaccgtctgcaaatgcagcggctctgggattcgacgacgaggtttatcgcgtggacgccaccgttctacatcccatcatcgacgagggccatattccggatatcggcaccgatggcgccgacgagactgggcaagcctataacatcaatgctgatacagcagctggcgagattgccgctgacgtgggcgccgagaagctgctgttgctcacacatgtgtctggcattttggcggaccgtaatgaccctgcgagcctggtgaaggtggtcgacattgctgcggtgcg

SEQ ID NO: 29975 - DNA, 424 bp, Zea mays
  Clone ID: LIB3059-029-Q1-K1-F4
cccacgcgtccggtaggtttgatgggaagcctgaagatgttctaaatccaaagaaaagagcagctggacaagattaccccggtacacttcagtggcctgtttgatatgatgtaacatcattgtcatggaatgttcttggctaacataacatactcaattatcagatcctgaattgaaacaccatgtttgtttttatttgatgaatgatgtcgcttattgctatactgtgcaaagtttaccactatggcgctaaccgcgttgtttatgcatccagcatcttcgtaccgacgagaatggaattgcaatgttcaaaggtgttccctttactacatcagctggcccatgtagatcttcgattcacaacggaaatgttaagtgagcagctcattagacatggttgcatagattgacatcaaacttatgc

SEQ ID NO: 29976 - DNA, 405 bp, Zea mays
  Clone ID: LIB3059-029-Q1-K1-F5
ctcggttcggattcccggccgcccacgcgtccggggttggcttctcctccccctccggttcgggttcgggttcgtgaggttctccggggttggggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggt

SEQ ID NO: 29977 - DNA, 335 bp, Zea mays
  Clone ID: LIB3059-029-Q1-K1-F6
aaaaaaaataataataaaaaataattaattaaaaaaaaaaaaaaaaaaaaaaaaaaggaagaaaaataaaaaaaaaaaaaaaacaaaaaaaaaaaaaaaaaataataaataccaaataattaaaaaaaaaacataactaaaaacacaaacaaccactccctccacaacaccttcaacacctacaattaactcctccactccaatatcatcctcgatcggaaaacccacagtttccccaaattcaacttcatcaccttctacacccacgaggcaatcccgaacaccatctaaaacatcaactgcaaggaactttacaaccttaacatcaccttcaa

SEQ ID NO: 29978 - DNA, 422 bp, Zea mays
  unsure at all n locations
  Clone ID: LIB3059-029-Q1-K1-F7
cccacgcgtccgcggacgcgtgggggactttttggaaactgaatttatagttgggcccgtaccantagatgatggaaatggaaaagaagtagcaactgaaattgttacaaacatggttacaaacaaaacattctacactgattccagtggacgtgatttcatcaaaaggataagagattatcgatcggagtggaagattgaagtgcaccagcctattgctggaaactattatcctgttaatcttggcatctatgtggaggatggcagcaaagagctgtctgtactggtagacaggtcaattggaggttccagtataaaggatggacaaatagagctaatgctacacaggaggctactccatgatgatgggaaaggcgtcgccgaggcgctaaatgaaacagtctgtctcgataagcaatgtg

SEQ ID NO: 29979 - DNA, 429 bp, Zea mays
  Clone ID: LIB3059-029-Q1-K1-G1
cggacgcgtgggcggacgcgtggggtcctgggctatgaaggccggctaaagccccaatgatgacatgtgaaacatagataagaaaaggagaaaaaaaatacctagagctattatgcaatgctgacgtgattctccaaatcccataccacgatcttaccatccaatcctgatgtgctgaatcgtttgatactaccgtcgcttacttttctcaagggtacaatacacgttatgcaattctcatgggccccgccacgaggttttgatggttcaacggtatcactactagtcccttgctttgattggccgtatagctttccaagggcttcagagagctgcgaggcttttgaagctgatggggcagctgtcctgtagtgcaagaatcttatgagagtccaaagcccagtatcatcagcagcacagatcatagga

SEQ ID NO: 29980 - DNA, 370 bp, Zea mays
  Clone ID: LIB3059-029-Q1-K1-G10
acaaattgtaccagctctgactcagctagctgtggcaaaccctgctgcctacttacagcaggggcttccattcaaccaactggctgtgtcaaactctgctgcgtacctacaacagcgacaacagttacttaatccattggcagtggctaacccattggtcgctaccttcctgcagcagcaacaacaattgctgccatacaaccagttctctttgatgaaccctgccttgcagcaacccatcgttggaggtgccatcttttagattacatatgagatgtactcgacaatggtgccctcataccgacatgtgtttcctagaaataatcaatatattgattgagatttatctcgataaaaaaaaaatacatgc

SEQ ID NO: 29981 - DNA, 399 bp, Zea mays
  Clone ID: LIB3059-029-Q1-K1-G11
gcagaagccaccgatcggcgtgccgcgtgcgtgaggcgatcggagcatcccgtcccggggaggaagacaaccggcgacgcggggggaacatggggaagacgccggtgcggatgaaggcggtcgtgtacgcgctgtcgcccttccagcagaaggtaatgccggggctgtggaaggacatcaccaccaagatccaccacaaggtcaccgagaactggatctccgccacgctcctcctcacccccgtcgtcggcacctaccaatacgccatgtggtacaaggagcaggagaagctttcccacagatattaaatgcgctgcccttcacagacagcacttggatttaacatttgtttgatcaatttcagttcaacgccttttcatcgttccatatgcatgtatg

SEQ ID NO: 29982 - DNA, 419 bp, Zea mays
  Clone ID: LIB3059-029-Q1-K1-E7
ggtcgccgtcctcgcaagcagacccgccgcgcccagcgcggagggatgctttggatgggtcgaccgtagcggctacgctggcgcatgagttgtcttggacccgtgactgcttggaggacccccgctgccgtgcggccgactcccggcgcccgtgtcccatcgctcgtgcgggcatcccgtgcctgctgcgttgagaagtgcttgcgtgctgctacccgtcccacgggaagccgtgctcgatacacgttgccttcgtcgagctcaccccccggggtgcggctcgtcggctcgagagcgcccgcggcgtttgcctcgtgccgccgtcggcctatggccggcggcaccgaggacacctcgctggcgcttttggtctcggatgtggctcacgctgaaggccggagacgcgttggcgtcacgcg

SEQ ID NO: 29983 - DNA, 408 bp, Zea mays
  unsure at all n locations
  Clone ID: LIB3059-029-Q1-K1-G2
cccacgcgtncgcggacgcgtgggccgtgatttaagatgctttaattcctagtggaaggatcatataaagtcagccaacaccatgtatataaggatgggttgcatcatatggtgatcgccaatgcgcatcaagttctctcatcccttgccagaccatgcttatttccattgcacaatcatcaagctctgcatcaacttgttgaggataataatgaaataatacatggtgccattacatggcaacatttttctgtcactagtatgaggcactaggctaaatgtactgacgactggaattcgaatatgtatgcttttgcaatcggacacctaaataccttgagcttatactcgttacctaaatatgctcactgtcatcttagattgttcgaaaatgtcatgcattacatg

SEQ ID NO: 29984 - DNA, 416 bp, Zea mays
  unsure at all n locations
  Clone ID: LIB3059-053-Q1-K1-D4
atgaccgttttgctccaatttatacacaacctcgacacctgccaccttcaaaggttcttgatcctgatgtgacagacagtgttattggtgaaggatgtgttattaaaaactgcaagataaaccattctgtagttggcctccgatcttgcatatctgaaggtgctatcatagaggacagtttactaatgggtgcggactactatgagacagaagctgataaaaaactccttgccgaanaaggtggcattcctattggtattgggaaaaattcatgcatcaggagagcaatcattgacaagaatgctcgaattggagacaatgttaagatactcaatgctgacaatgttcaagaagctgcaagggagacagacgggtacttcatcaaaggtggaattgtcacagtgatcaaggatgct

SEQ ID NO: 29985 - DNA, 414 bp, Zea mays
  Clone ID: LIB3059-053-Q1-K1-D5
cagagtgctatgagtgtcaaccaaagcctgtccctaaatcatatcctgtgtgcacgaattacaaacacaccatcaaagtttgttcattgcattgtttgggcgaaagatctgctttttgcaaaattatttggtgataaaaaacaggataatgatcttaatgtgcactccaaagatgataccagttcaaaaacagatgtttttgaaaggagtgtagatgaagatcttgagcaatacacccagagaatatatgaccacgtatttggttacaacattgaagttgcattggataataaggaaacttggaagaatcggagaaagccaaaccctatttacattagagatgcattgcctgaagacgctgttcaacaaaatggtcgctctcaggatcacgtgaatgaggagcaagatccttct

SEQ ID NO: 29986 - DNA, 417 bp, Zea mays
  Clone ID: LIB3059-053-Q1-K1-D6
cccacgcgtccgatgaaaagctatattacctcccgttctcgttatcccggtagtgcatttttaacgaaacagtgacaaatatgaactaaacagcaacaaataaaaagaaacggaggggtactacgcttttttttatttcagtgcgcgcgtgtctgctccagacggtgctgctgcgcccagtccttgacgatgtgcggctgctgacccgacgacgaggtcgtggtctgaaggtagcggtacacccacgccagcacagccaccgcagccacgccgaaccctcccgacgaaacgatgcctaccgtgagcagcgccaccgtgatggccgccggcaccagcacggggctgaagatcaccatcaatggcgtcgccacgatgagcgccagcaccgtgcccgtcaccgtcagccccgacaacaac

SEQ ID NO: 29987 - DNA, 164 bp, Zea mays
  Clone ID: LIB3059-053-Q1-K1-D7
ggaataaagcacaccatagcagatctatgttgcattgtttctagtttcgaagtcgatttatttacttctctatgatttctacacacggcctaataatcttgctaaggccctgattgaatggaaaatattttttgggagttttaggaaaatactacatttttgtg

SEQ ID NO: 29988 - DNA, 418 bp, Zea mays
  Clone ID: LIB3059-053-Q1-K1-D8
cccacgcgtccgccgccgccatgcctcgccgcagctcaggaaggtctgccccacgcccagctccccgtgctgcttcactgaggaacccgccacagccagcacgccaggctcctcctccagctcctgttcgagatggtggtggctccatgtttggaggaattgggtccaccattgctcaaggtatggcgtttggcacgggtagtgccatggcacacagggctgttgactctgtattaggtccccggaccatccagcatgagactcttgccacagaagctcctgctgctgcccctgctgctccagcgatgaatgctgatgcttgcagcttccattctaaggctttccaagattgtctcaacaactatggcagcgagatcagcaagtgccagttctacctagacatgctgaacgagtgccg

SEQ ID NO: 29989 - DNA, 360 bp, Zea mays
  unsure at all n locations
  Clone ID: LIB3059-053-Q1-K1-D9
cccacgcgtccgccttgttcctccaacaagggtgataattattacatcanttaggtgagttccatttggttgcacaaaacatcacttcacaacaactacaacaacttatgctatcaaaccttgctgcatactctcaacaacatcaatttctttcattcaaccaactggctgcattgaactctactgcttatttgtaacaacaattaccattcatccatctagttgttgactacccacagcaatttcttacattcaaccaactatcaacattgaactctgctgcttatttacagcagcatcaactactaccattcatccatctagctgatgttagccctgcttccttcttgacacaacaac

SEQ ID NO: 29990 - DNA, 303 bp, Zea mays
  Clone ID: LIB3059-053-Q1-K1-E1
ggattcccggtcgaccagcctcgggcaaccttcggcaaaaggcccctattggaagctcgggtcttaagaaaagtggggaggagattaaaccggtcacccgtcttcatttccctaaaggttattaaggcacctttctattctgggttgcccttaactacctgtgaattggtaccagtgggtacctcttggggttctgtggtcccgcgatgttgcagttggttgcttgatcgaaagatgtttcagcctcccatctgctagctatgatacagatggttcctgataataatgatgacatattctgtg

SEQ ID NO: 29991 - DNA, 433 bp, Zea mays
  Clone ID: LIB3059-053-Q1-K1-E10
cccacgcgtccgcttgaagagaagtaaaaagcgcagagtgtcatttagagatcaggctggaggtgaacttacccaagtggttgggatttcagatggtgcagatgttgaaactgaaccgggccctataggtgtaaaggaaggcagtcttgttgggaagtatgaatctcttgttcaggttactgtcataccgaagggaaaggagcaagcatcacggaaagagaaagactttacctctacctcaccaagtggggtaacggataagctacaagaggtgcttaaaagagtaaagagcacgaccaggcctggaatttacgacgacctttatggggattctattgcgacaaaagtgggctcatcttgggcgtacaaatcagatgatctgtcagacaaagcccagcctgttgaggagaagacacttggcatggattcaaac

SEQ ID NO: 29992 - DNA, 416 bp, Zea mays
  Clone ID: LIB3059-053-Q1-K1-E11
cccacgcgtccgcccacgcgtccggttgtatcagcttggactagtaacaggcagcagtaaatcccctgaagaatacaagataaatgatgtatcaacagatattcttttatgtatttccagcatacctgacatcaaaatttcaagtttgtcagatgaagaatacgaagaggaagaatgtcaagaccttcggctgctggccaagaatgaatcctttaaaaggcctactgttggggatctagaggagaaagcaagaagtttacgtagggagatagtgaatcattggatcagtaaagaactccagaggctagaaagattaattgacagggcgagtgagaaaggttggcgcaaggaaaagtttgaataccttgataagaaacaactcttgcgcaagccatctgaacaacaacgtttacttg

SEQ ID NO: 29993 - DNA, 423 bp, Zea mays
  Clone ID: LIB3059-053-Q1-K1-E12
gcagcttggagcaaatctctagagtatatggcaatcaggctgtagttgtcagtatggatcctcgacgggtatatgtcaaaagtcaagaagatgtgccatttaaaactgtaaaggtgtccactaaaggtccatcgggagaagaatatgcatggtaccagtgcacagtgaatggtggacgtgatagccgagctataggagcatatgaactagcgaaagctgtggaagaattgggcgcaggagaaatacttcttaactgcattgattgtgatggccaaggttgtggatttgacatagatttggttaaaatggtttctgatgctgtgacaatccctgtcattgcgagcagtggtgctggagctgttcaacatttttctgaaatttttgagaaaacaaatgcttctgctgcccttgctgctggcattt

SEQ ID NO: 29994 - DNA, 414 bp, Zea mays
  Clone ID: LIB3059-053-Q1-K1-E3
cggggacccttggccatccggaaacccaaaagtcccgccgcttccgcttcctcaacgttttggacgaagaagccattccgaacccccttcaaggccttaaccggcaagaacctgaacggccgcaccatcaccgtcaacaaggccaatccccgcggcggccgtggaggcggcggcggtgggtacggtggtggccgtggaggcggcggctactgcggtggcggtcgccgtgatggcggtggcggctacggcggtggcggcggctacggtggcggcggcggctacggtggtggtggcggcggctacggcggtggcaaccgtggcggcggctacggcaactccgacgggaactggaggaactgatcggtggggcccgcgcggccaagttatcctgttcgctaccgtgatgtttaccct

SEQ ID NO: 29995 - DNA, 341 bp, Zea mays
  Clone ID: LIB3059-053-Q1-K1-E4
gggaagaaagaggcattggcggtttttgaagagatgcttgatgctggagtcaggcggacacgcaaatcatataacattttgcttgatgcatttgcaatatctggattagtagaggaggctaatacagttttcaaggcaatgagaagacacagggttgagcctgacctttgctcttatacaactatggtcttagcttatgtaaatgcatctgaaatgaatggagctgagaaattctttcgtaggattaaagaggatggtctgaagcccaacgttgtggtttatggcactctgatgaaaggctattcaaagttaaataatcttgagaaagttatgcctgtgta

SEQ ID NO: 29996 - DNA, 405 bp, Zea mays
  Clone ID: LIB3059-053-Q1-K1-E5
ggcaaaacttgctcccagatatttgaggaggctggttgtgacacaccagggagtgctaattgtggtgcttgtttgggtggccctcgtgatacatatgcacggatgaatgaacctactgtctgcgtgtccaccacgaacaggaactttccgggcaggatggggcacaaggaagggcaaatctacctggcgtctccctacactgcggctgcctcagccctgacggggtacgttacggacccaagggacttcctcatgtaacgtcttgaaacaacaacagatttcatgatgtaacagagtggctgtactgctgtttttcgtgctgaacttttgtctaggcatgtccttcgttgagaaataaactgcactagaataagcagcgacttctcgggcgccatagcagatgtg

SEQ ID NO: 29997 - DNA, 366 bp, Zea mays
  Clone ID: LIB3059-053-Q1-K1-D3
gagccacctatccgtggtgaaccctgtcacctacttgcaacagcagctgcttgcagtcaagccaattgctctggcgaacgtaactgcataccaacaacaacaacagctgcaacagtttatgccaatgctcaatcaactagccatggtgaaccctggcgtctaactaacaataccttcatttaaccccgctccggtgggcaatgcaactaactacctaccacaacagttgctgcaacaaattgtaccaactctgactcagctagctgtggcaaaccctgctgcctacttacaacagttgcttccattcaaccaactggctgtgtcaaactctgctgcgtacctacaacagcgacaacagttacttaa

SEQ ID NO: 29998 - DNA, 109 bp, Zea mays
  Clone ID: LIB3059-053-Q1-K1-B8
ctttcccctcctcgcttcgcttctctgcggattcctcctccttcgccggtccgggtccctttttccgcgccccaacctggcccaaaatgccaaccccaaaaccggttgc

SEQ ID NO: 29999 - DNA, 403 bp, Zea mays
  Clone ID: LIB3059-053-Q1-K1-B9
ggtgggttggcttctcctccccctccggttcgggttcgggttcgtgaggttctgcggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaagcggcggcta

SEQ ID NO: 30000 - DNA, 376 bp, Zea mays
  unsure at all n locations
  Clone ID: LIB3059-053-Q1-K1-C1
cggacgcgtggccggacccttggccagtggatcatgggggattcaaaaacggagaaccagtggtacttgccagggaggtctttggcccgttgaaccctataacaaatcttcaaaatggtgggaatggttttgatatcggtgagatgcttaaggatgatggaaagcgatccacataatgcangtggagccgacgctggcatgggacagccctggtatcttgatgagctggattcgagtgtcttagagagcatgctccagccggagccggagccagagccagagccattcctgatgtctgaagaaccggacatgtttcttgctggcttcgaaagcgctggtttcgtcgagggtcttgagcggctaaactgaatttctg

SEQ ID NO: 30001 - DNA, 400 bp, Zea mays
  unsure at all n locations
  Clone ID: LIB3059-053-Q1-K1-C10
ccttgatggcagtgccatgtggatctcaggagatcactatcttgcctcaacagggaggagaaccttgtgtgttgcctcaacagggaaaagaaccgtctgtgttgcctcaaccgggaaaagaaccgtctgtgttgcctcaacagggaaaagaaccttctatgttgcctcaacagggaaaagaaccttctgtgttgcctcaactgggaaaagaaccttctgagttgcctcagcagggaaaagaatcttcaggagatatctctgtgaatcagaaggaccctcttaaggagatgaatggctttcctgaacaggaaaaaggacttgttgctggagaacttgtctctgcacatcataaggaccctctaatggatattacagatgcatttgaaatgantaaaaaaca

SEQ ID NO: 30002 - DNA, 363 bp, Zea mays
  Clone ID: LIB3059-053-Q1-K1-C11
cccacgcgtccgcccacgcgttttcttagcgtccgcggacgcgtgggaaaagaaagaataaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaggccgcactttttaaaaattcaaagtttacttacccataattgcaactttataacttttttatagtttaaccaaatttaaattcattgaccatatttttaaaacgtcattattggaaaaaccttgtctttaccaaattaaatctcttttcaaaaaatcctcttttttcaattttacttattacccaaaatgcccaaactcattaccttttc

SEQ ID NO: 30003 - DNA, 437 bp, Zea mays
  Clone ID: LIB3059-053-Q1-K1-C12
gcaaggctcagggagatccgaagctatttggatcttgtaattgaagggaagctcccgactgaatcatgagattttgtatcatttgcaggatgtctttaatctccttccaaatctgaacgtaaatgagctaattaaagcctttgcagtgaaaacaaacgacatgatgttggtaatatatctgtcttctctgatccggagtgtcattgcgcttcacaatttgatcaacaataagatgctaaacaaggagcatgagaaggctgaggattcgaaaccagccgccattccaactgctgccggtggagggggagctaaatgaacttttgatcacttattgatggccaagaaaaaggaggaaacgtgattgcatgtttatcacggttgtgctggaaccaaatcgccttgaccttgaatggatattttcatggttacttcacgta

SEQ ID NO: 30004 - DNA, 282 bp, Zea mays
  Clone ID: LIB3059-053-Q1-K1-C3
tgaagcagccgcagtgcatcccgctggcggcggcgccctactacgccgggtgtgggcagccgagcgccatgttccagccgctccggcaacagtgctgccagcagcagatgaggatgatggacgtgcagtccgtcgcgcagcagctgcagatgatgatgcagcttgagcgtgccgctgccgccagcagcagcctgtacgagccagctctgatgcagcagcagcagcagctgctggcagcccagggtctcaaccccatggccatgatgatggcgcagaacatgc

SEQ ID NO: 30005 - DNA, 348 bp, Zea mays
  Clone ID: LIB3059-053-Q1-K1-C4
ggcgaatggttaagcttgagacaagatatttttgatctgtcgaagctcgacatgggaatgccagataagatgattgtcgtttcacggttgaagtggatgtataactgcttgcttccattctcatcgagccgtttgccacgcctctagagcagtgagcaactgaacgtcgtgtgttgcattttggataaagattttgacacggatacctggaactctggaaggtttattggttctctatgtcggaaggatggttctttcatgcccacaagatgttctgtagattttagcagagctggatgaagcatatcggaagggggcagattgggtggatgcagtatccaccgagcc

SEQ ID NO: 30006 - DNA, 412 bp, Zea mays
  Clone ID: LIB3059-053-Q1-K1-C5
agggaatcacatcgccatggcagccaagatgtttgcattgtttgcgctcgtagcgctttgtgcaaccgccactagtgctacccatatcccagggcacttgtcaccactactgatgccattggctaccatgaacccatggatgcagtactgcatgaagcaacagggggttgccaacttgctagcgtggccgaccctgatgctgcagcaactgttggcctcaccgcttcagccgtgccagatgccaatgatgatgccaggtatgatgccaccgatgacaatgatgccgatgccgaatatgatgccatcgatgatggtgccgactatgatgtcaccaataacgatagctagtatgatgccaccgatgatgatgccaaacatggtttcaccaatgatgatgccgagtatgatgcct

SEQ ID NO: 30007 - DNA, 413 bp, Zea mays
  Clone ID: LIB3059-053-Q1-K1-C7
attttgagcattcagaaactcaccatgcgaagcgcactagctacaacctaacagcgaatggctaccaagatattatccctccttgcgcttcttgcgctttttgcgagcgcatcaaatgcgtccattattccacaatgctcacttgctcctagttccattattccacagttcctcccaccagttacttcaatggccttcgaacacccagctgtgcaagcctataggctacaacaagcgattgcggcgagcgtcttacaacaaccaattgcccaattgcaacaacaatccttggcacatctaacaatacaaaccatcgcaactcatcagcaacaacagttcctaccagcactgatccacctagccatggtgaaccctgtctcctacttgcaacagcagctgcttgcatccaaccc

SEQ ID NO: 30008 - DNA, 418 bp, Zea mays
  Clone ID: LIB3059-053-Q1-K1-C8
ggagaaggaagggtaggaggcccagcccaccagccagccatagtccttggtctggcaaccccaggttgcttctctcccctaccattcagttgctgccccgattgagccaccgccgcctcagattcatcgtcgtcgccgacgatttggatgctaccgccgacgattcggatgtcgccgccctggatttggcctccgccaccctggatttggcctccgccgctcccgattcggcgctgccaaccccgaaatggcgccgccccttccccttccccttcccctatgtcatcttgttgattcttacctaggcggcggggacgccttggatctttcgggcgtctgaacgcctaggtgacgcctttaaaacaggggggaatttgttcccacatattacttgcagtcaaagatcgacaacttagtt

SEQ ID NO: 30009 - DNA, 415 bp, Zea mays
  Clone ID: LIB3059-053-Q1-K1-D1
cccacgcgttccgccaggcgctcccttgacatttaaagggccaactacctcaacttggattggcttgtgtctcaagggatctcatcggttactggttctttgaaggtcgatggtgccctcaatggggatgtgaacgaattccaaaccaacctggttccttaaccgaagatccacttcatgcctctcctctacgcaccggtgatctcttctgcgaaagccttccacgagcagctgtctgtggcggagatcaccagcagcgcgttcgagccggcttccatgatggtcaaatgcgacccacggcacggcaagtacatggcttgctgcctgatgtaccgcggcgacgtggtgcccaaggacgtgaacgccgcggtggccaccatcaagacgaatcgcaccatccagttcgtggactggt

SEQ ID NO: 30010 - DNA, 401 bp, Zea mays
  Clone ID: LIB3059-053-Q1-K1-D11
cccacgcgtccgggagggctcttcgccttgatactggtaactactcatggggaagggaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgctgagggacaagaggttgaggcagcagctgaggaaacgaaaaagagcaaccatgtcacgaggaagcttgagaagcgcaaggagggacgtacccttgacccacacattgaggagcaatttggcagtggacggttgctggcatgcatttct

SEQ ID NO: 30011 - DNA, 413 bp, Zea mays
  unsure at all n locations
  Clone ID: LIB3059-053-Q1-K1-B7
agcaaccaacaagtcgtccaacgtccaggcttttctgttttgtttctcggtcacgcaagtcgcaaagcaaagcgtcccccaccatggcttccacgacgacgacggcatccaacaacctggcgggcgtgtggctcggcgagctctcgtcggcgctgcatgggacgtggcaggcggtggccgtggccgccacccacgggctcggcgaggacgacgacccgcggctgccgtgccagcagcagcagaggccgtggcgaggcgacgacaggagcagcagcaacaacaaggcgttgcgaggagccgcggcggccgggacggacaggcgggagggggacgtcgcgaggtgcggcggcgccatgtccgacaccacgctctacctnctnctcgaccggttcgcgcccagctgagcgggcccc

SEQ ID NO: 30012 - DNA, 424 bp, Zea mays
  Clone ID: LIB3059-053-Q1-K1-D12
cccacgcgtccgcgatccagccagctgcaaaggactcggctgtggtcctctcgactggcaagaccaagaagcagaacgcacctgcgaagctcagccacaagtctgtgatgcgcaaggagttccgcaagatggccaaggctgtgaaaaaccaggttagtgacaactactacaggcctgatctgaccaagccagctcttgctaggctaagctcggtgtaccgcagcctccaggttgccaagtccggtgtcaagaagaagaacaggcagtcctaagcgctaagtttgtgttctgtcagggggcatgttggtgctcgtagtcccagcttatatttatctatgttccaacagttgagacttgttagaactgagcaaaccatgttaagatgctgctgtgtgtcattccttaaaaaaattgccttgcactt

SEQ ID NO: 30013 - DNA, 296 bp, Zea mays
  Clone ID: LIB3059-053-Q1-K1-D2
cggacgcgtgttctggacccgttggcctgaccccttggccccaatttgccccaaaagggccttcaaaaggccctcaccggggaaataaatgccttcttcttttaccacaaccaccgccgcctaatcctcgaaccgccgtcctgtctccgtgctcgcggctgccagcgccagcgccggtaccttctgcgtgccggggtgggccatcccgcacaacccgctcccgagctgccgctggtacgtgaccagccggacctgcggcatcgggccgcgccttccgtggccggagctgaagagga

SEQ ID NO: 30014 - DNA, 419 bp, Zea mays
  unsure at all n locations
  Clone ID: LIB3059-053-Q1-K1-A2
gccacgcgtccgctgggagctcgcctgttgggtctgtgcccaaatcttctccacagtctcagcatcttaacttttcaatcttttagaaaaaaataaactccagccgcaaaggtacaataagttcaaacatcactgccttatggagcgtaagaaattaggcactggccagagtgagcaaatgaactcactgtatcgcttctggtcatactatctgagagataattntaatgaagatatatacaaggattttaagaaactcgcactggaggatgctgcagcgagctacagatatggtctcgagtgtctattcagattttatagttatggtttggagaanaaattccaacccaatgtatatgaagatttcgagaaacttaacttcgaattctaccgtaatggtgatctttatggactcgaaa

SEQ ID NO: 30015 - DNA, 396 bp, Zea mays
  Clone ID: LIB3059-053-Q1-K1-A3
acggcgagccctggcatcttgaagccagacgtcattgggcccggcgtcaacgtcgttgcggcagtggccgttcaaggtcgggccaacaacaaacaccgccggccgtgaccgtgacgactacgaccaacatggagcagcagcagctactttcaactccgtatctggaacatccatgtctgcacctcacctcagcggcatcgcagctgtcatcaagagcgcacaccctgactggtcgccggcggtgatcaagtcggcgatcatgacgacggcctatgtcgtgtatggtaacaacaaaaaccagccgatcttagacgagcagctcagtccggcgagccatttcaacgttggggccggacatgtcaacccttcgcaggctgtgagcccaggcctggtgta

SEQ ID NO: 30016 - DNA, 392 bp, Zea mays
  Clone ID: LIB3059-053-Q1-K1-A4
agcaacttacctttatcacccctgttctttcaacaatcgccagccctatctttggtgcagtgattggtacaaaccatcatggcacaacagctgcagcaactcgtgctaccagtgatcagccaagtagctctggcaaacctttctccctactctcagcaacaacaatttcttccattcaaccaactgtctacactgaaccctgctgcttatttgcagcaacaacaactactaccattcagccagctagctactgcctactctcagcagcaacaatttcttccatttaaccaattcgccgcactgaacccctctgctaatttccagcagcaaatactactaccatttggccagctagctacaacaagccccgcttccttcttgacacatcaaca

SEQ ID NO: 30017 - DNA, 402 bp, Zea mays
  Clone ID: LIB3059-053-Q1-K1-A5
ctagcaacatagaaagcacaatagtgtaccaacaatggcagccaaaatggtttggttccttatgctccttggtctttctgcaagtgctgctaccgcaaccattttcccacaatgctcacaagctcctatagcttcctttcttcccccatacctctcaccagcggtgtcttcagtatgttaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggc

SEQ ID NO: 30018 - DNA, 296 bp, Zea mays
  Clone ID: LIB3059-053-Q1-K1-A6
aaaaaaaaaaaaaaaaaaaaaaaaattaaaaaaaaaaaaaaaaaaaataaggcaaggatacaaaatactaaaaaatactaaaaaaaaaaaaaaaaaactaataactaaacataaattcactacatttgattactgtttaaaccttgtctatcaactgactcttaatcctacaaaccaccaaatttcaatctaccttaatattacattaatagcatctcaggctaacaccgttgcggacttgccaacccttgctcaccctgaattacatttgctacactccatttacctttgcatca

SEQ ID NO: 30019 - DNA, 406 bp, Zea mays
  Clone ID: LIB3059-053-Q1-K1-A7
gtccagaacaagaactcgtcctacttcgtggagtggatccccaacaacggcaaggccagcgtgtgcgacatcccgcccaggggcctgtccatggcgtccaccttcatcggcaactcgacctccatccaggagatgttccggagggtgagcgagcagttcactgccatgttcaggaggaaggctttcttgcactggtacacgggcgagggcatggacgagatggagttcaccgaggccgagagcaacatgaacgacctcgtgtcggagtaccagcagtaccaggacgcgactgccgacgaggaggagtacgaggacgaggaggaggtgcaggccgatgacatgtgaggggagggctgttatcgtgtgaagccttgtggtcctagggcaagcggacctcgatgagttc

SEQ ID NO: 30020 - DNA, 418 bp, Zea mays
  unsure at all n locations
  Clone ID: LIB3059-053-Q1-K1-A8
ccacagggtgtcccggccctctctagtttctaccccggcccccaacattggccggatgctgctgccatgtagcccagcgctcccccctcggcttcaccggcggcggcggcaacgacggtgaaaactacatcgggtgctagctccgacggtggtgcgtgccctgttgacgatagggcacgcggggcgcgggcagcttgtaagcgttcgatcggccatgtagggcaactatacatctttggcaggtctccaactctccatcatcctccgtgggagagaagatggtaatggagtgcgtgtgtatgtatgtgtatgcccagggcgcgcgcgcgcggctctgggcgagtcacagtagagatgcaatatcatgtatccagtatctttcttacaacacanacagtgagaaattattagtagaaaa

SEQ ID NO: 30021 - DNA, 134 bp, Zea mays
  unsure at all n locations
  Clone ID: LIB3059-053-Q1-K1-B1
gtagttcgaatgtcactactgttctgtttgcatagttacaggaanatttaaaaaggttttaataatgcaaacagaacaaaatttaaaaataaactaaatataaaaaaactaaaaatactaaaaaacataaataa

SEQ ID NO: 30022 - DNA, 432 bp, Zea mays
  Clone ID: LIB3059-053-Q1-K1-B10
cgcctctcgcgcatcctaccaggagggtgggagacccaggcagcggaggtgtgcgagagctcgcttcgcaccacgcgctgcggcctgcggggcgagagatcgaggcctgagctagggtctggtggcggagatgtcgacgccggcgaggaagcgcctgatgcgggacttcaagcgccttcagcaggacccgcccgccggcatcagcggcgcgccgtacgacaacaatatcatgctctggaacgccgtcatattcgggccggatgacacgccgtgggatggaggcacgttcaagctgactctgcaatttacagaagattaccccaacaaacctccaactgttcggtttgtttcgaggatgtttcatccaaacatctatgcggatggaagcatctgtttggacatctctacaaaccagtggagccctatatatga

SEQ ID NO: 30023 - DNA, 164 bp, Zea mays
  Clone ID: LIB3059-053-Q1-K1-B11
ggaataaagcacaccatagcagatctatgttgcattgtttctagtttcgaagggcagttatttacttctctatgatttctacacacggcctaataatcttgctaaggccctgattgaatggaaaatattttttgggagttttaggaaaatactacatttttgtg

SEQ ID NO: 30024 - DNA, 380 bp, Zea mays
  Clone ID: LIB3059-053-Q1-K1-B12
gggttggcttctcctccccctccggttcgggttcgggttcgtgaggttctccgggggtcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaaggtccgttcccgtcccagatccgtccatggcttcgtccagatctgacctgtcctgacacaccctcgcccggatctgtccctccttcccttctcccctgcagatcatcctcgatcgggagacgcagaggtcccgcggcttcggcttcgtcaccttctccacggaggaagcgatgcggaacgccat

SEQ ID NO: 30025 - DNA, 393 bp, Zea mays
  Clone ID: LIB3059-053-Q1-K1-B2
ggtggagccgctggaaccggtacccagtccgaccttccggtgtgggtccctggaagtcccttcgtgcaagccaacaaccgcaaggccgaagcctcgccggcgcttattgccgcccaagtagcgcaacaactgacggcgatgtgcggtctggaactgcagcaaccaagtccctggccttgcaacgcaactgccggcggtgtctactactgaagaaactatgtactgtagtaataatgtaatggagccgctgactagctacctatagctagttcactcgtttagcggcgatgagtaacggagtgtcacccatcaccatgggtggcaatgtgagcaatgacctgaatgaaccattgaaatggaaaggaataatatatatggaaaaaggatgtttgg

SEQ ID NO: 30026 - DNA, 184 bp, Zea mays
  Clone ID: LIB3059-053-Q1-K1-B4
ttatctttgctgctgaagccattttctctgcctagattttctcatatttatttgaggtgggggtggacgtggacgtggaactatggaagttatcacagcggagttttgcttagaaactttgtcatgctttaagtctgagacaattttatgaacattcctaggtacaatcgaagttaccagtgcc

SEQ ID NO: 30027 - DNA, 410 bp, Zea mays
  Clone ID: LIB3059-053-Q1-K1-B5
caacaagcaacatagaaagtggaatacagtagcaacaatagagcaacagtggcggccaagatattttccatccttatgctccttgctctttctgcatgtgttgctaacgcgaccatttttcctcaatactcacaagctcctatagctgcccttcttcccccataccttccatcaatgaccgcttcagtatgtgaaaacccagcccttcaaccctacaggctccaacaagcaatcgcaacaagcaacttacctttatcacccctgttctttcaacaatcgccagccctatctttggtgcagtcattggtacaaaccatcatggcacaacagctgcagcaactcgtgctaccagtgatcagccaagtagctctggcaaacctttctccctactctcatcatcaacaatttct

SEQ ID NO: 30028 - DNA, 380 bp, Zea mays
  Clone ID: LIB3059-053-Q1-K1-B6
ctcacgctgtgcctggctctgtgagttgctatcgcatctgcaatgcacatgccctgccactgcgcgtggctgtacgccttgctcggcgctttctccggcctgaccaccatgatggccaccatcatgctgtacccctacccggagtacctgacgcagccgctgtgcaacccgctgtccgcggcgctctactacgcccggtgctaccagccgagcgccatgttgcacgcgatgcggcaacagttctggcagcagcacatgaagatgatggacatgcagaccgacgcgcagcagctgcagatgatgatgcagattgagcgtgccgttgaccgcagcagtagcctgtacgagccagctctgatgcaacatctgctgcagctgct

SEQ ID NO: 30029 - DNA, 419 bp, Zea mays
  Clone ID: LIB3059-053-Q1-K1-A12
ggagatgccaacactgacagcacgccaaagacggcaaggaagataaccggcaagaaggtcaacgacctcaccggcaacgacatcttcaagggggacgtgccgccagcttctgcagagaagcatctgagcaccgcgaagctgaaggagatcactggaagcaacatttttgcagatgggaaggaaccaatccgcgagcgtgtgggcggaaaccgcaagcctcctggcggtgagagcagcatcgcgctgatttagcataatccgggactcagtgtcgacccctagaggaggatttccaccagcaccaggcagcaggctgttggatcgtcagtttggtgtcttgttcctgatcaaggtgcggcagtgaagagccccgttttagtcttgatgatgtttattaactgttggtgtgtgcatgtttg

SEQ ID NO: 30030 - DNA, 251 bp, Zea mays
  Clone ID: LIB3059-029-Q1-K1-D12
caccttaccaacgcaatagtgctgaatccactctcagcaatcatgtatggtactagagcatctgtgtttataaaaatgaagaaaccatctgctgccattcgtgatgtcaatgctgctctacacatcaacccatactctgcaaaatgctataaaactcgtggaatggcatatgccatgcttgtcaaatgggaggaagctgctcatgatctgcacacagcatctaacatggattacgactaggagatcaatgc

SEQ ID NO: 30031 - DNA, 431 bp, Zea mays
  unsure at all n locations
  Clone ID: LIB3059-029-Q1-K1-D3
cccacgcgccggtccctctnctctggaggtattcgcagtcgaccgtgtccctcgagccggatgaaaggtggtgctgcctacctgcttgctgtcctcgctgggaatgccagcccctccgctgaggatttgactggcattctggagtcagttggctgtgaagttgacaatgaaaggatggaactgctgctgtcccaactgagcggtaaggacatcaccgagctcattgccgcgggcagagagaagtttgcttcagtcccatgtggcggcggcagtgtggctgttgcggcaggtgcacctgctgctggcggagctgctcctgcagctgacgcaaagaaagaagagaaggtggaagagaacgaagaaagcgatgatgatatgggcttcagcctcttcgactaggttgcacagtcatcacagtattgtttcgggca

SEQ ID NO: 30032 - DNA, 435 bp, Zea mays
  unsure at all n locations
  Clone ID: LIB3059-029-Q1-K1-D4
gatgttttgcctccttatgctccttgctttttttgcatgtgttgctaacgcgacaatggtccgtcaatgctcacaagctcctatagctttccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacattgaaccgtgctgcttatttgcagcaacaactattaccattcagccagctagctactgnctactc

SEQ ID NO: 30033 - DNA, 419 bp, Zea mays
  Clone ID: LIB3059-029-Q1-K1-D5
ggtacgaccggttggagatcatggactttgtaccacacatctaagactgctgcgggaaggtcatgttatcttatggagatttcaagaagaaagcaagagaacaccgatggataatgtctcaatcacttattaacccgttacgagtaatattgtgtggagcagtaccacagtgattcaagccttcctcgttattgatgatgaagaggatgagacctttatcatacaattgctatgcgagtcagtgcaacttacttaggtcgacaatcagctcacgtgcatagtatgcaccataatgacatgagtcctgatcctgcacgaacagcacttgaacctggagcgttagatcgcaacaaccaccatgacaggtgagtgctgactcaagaagggtccgctaaggctccaaactgctgaagatcgac

SEQ ID NO: 30034 - DNA, 328 bp, Zea mays
  Clone ID: LIB3059-029-Q1-K1-D7
aaaaaaaaaaaaaaaaaaaaaaatttatttaaagaaaaaataaaaaaaaaaaaggaaggaaaaaaaaataaaaaaaaaaaaacaaaaaaataaaaaaacctaaacataaaaaaactgtccgtccttttacagcatcctaccttcctacccccttcatgcaacccaattaattttctttactgccccttaacttaatttaacttcccgtcttttcccaacatctccactcgaaaaacctctcccttccccaatttaatctctttgcaaaacatccccctttctccagctttccaattagcaaagaggccttaacctatcacccttccca

SEQ ID NO: 30035 - DNA, 204 bp, Zea mays
  Clone ID: LIB3059-029-Q1-K1-D8
aaaacaaacaaaaaatttctttacaaaaaaaaacaaaaaaataaaacagacagattaaaaaaataattaacccaacccaaaacaaacacaaaaaaaaaaaaaaacaacaaaaaaacacaaacaaaaaaaaaaactcaaaaaacaaaacacacaaaaaaaacacaaaacaaaaaccaaaaaaaaaaaaaaaaaaacaaacaaaaa

SEQ ID NO: 30036 - DNA, 433 bp, Zea mays
  Clone ID: LIB3059-029-Q1-K1-E1
caacaagcaacatagaaagtggaatccagtagcaacaatagagcaacaatggagaccaagatattttccctccttatgctccttgctctttctacatgtgttgctaacgcgacaattttccctcaatgctcacaagctcctatagcttccctttttcccccataccttccatcaattatagcttcagtatgtgaaaacccagctcttcaaccatataggcttcaacaagcaatcgcagcaagcaacatacctttatcgcccttgttgtgtcaacaatcgccagccctatctttggtgcagtcattggtacaaaccatcagggcacaacagctgcagcaactcgtgctacctgtgatcaaccaagtagctctggcaaacctttctccctactctccgcaacaacaatttcttccattcaaccaactgtctacac

SEQ ID NO: 30037 - DNA, 428 bp, Zea mays
  Clone ID: LIB3059-029-Q1-K1-E11
ccttgctctttctacatgtgttgctaactcgacaattttccctcaatgctcacaagcgcctagagcttccctttttgccccataccttccatcaattatagcttcagtatgtgaaaacccagctcttcaaccatataggcttcaacaagcaatcgcagcaagcaacatacctttatcgcccttgttgtgtcaacaatcgccagccctatctttggtgcagtcattggtacaaaccatcagggcacaacagctgcagcaactcgtgctacctgtgatcaaccaagtagctctggcaaacctttctccctactcttcgcaacaacaatttcttccattcaaccaactgtctacactgaaccctgctgcttatttgcagcaacaactattaccatttagccagctagctactgcctactctcaacaacaac

SEQ ID NO: 30038 - DNA, 359 bp, Zea mays
  Clone ID: LIB3059-029-Q1-K1-E12
gtgagcggatcgagatggcggcgtctgatgttgagtaccgctgcttcgtcggcggggtcgggtgtgccacggacgaccactccctccacaacgccttcagcacctacggcgaggtcctcgagtccaagatcatcctcgatcgggagacgcacaggtcccgcggcttcggcttcgtcaccttctccacggaggaagcgatgcggaacgccatcgacggcatgaacggcaaggagctggacggccgcaacatcaccgtcaacgaggcccagtcccgcggcggccgtggatgccgcggccgcgggtactgtggcggccgtagaagcggccgatacagcagccgtcggcgccgtcaaggccgt

SEQ ID NO: 30039 - DNA, 400 bp, Zea mays
  Clone ID: LIB3059-029-Q1-K1-E2
acccactcgatctcaagaatcaacatataaagttcaatcctttaatatcaatacagcaacaattcatatcagcatgttttcactacttatgctccctactctatctacatatgttactaacaccacaattttccctcaatgctcacaagctcctataacttccctttttcccccataccttccatcaattataactacaatatcttaaaacccaactcttcaaccatatacgcttcaacaaacaatctcaactaacaacatacctttataccccttaatatatcaacaatcacctaccctatcttttatacaatcattgatacaaaccatcatatcacaacaactacaacaactcctactaccctttatcaaccaattaactctcacaaaactttctacc

SEQ ID NO: 30040 - DNA, 428 bp, Zea mays
  unsure at all n locations
  Clone ID: LIB3059-029-Q1-K1-E3
gggttggcttctcctccccctccggttcgggttcgggttcgtgagggtcttccgggttgggggtcctgggtgaacggatcgagatggccgcgtcggatgttgagtaccgctggttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggncgcaacatcaccgtcaacgaggcccagtcccgcggcggccgtggaggcggcggcggtgggtacggtggtggccgtggaggcggcggctacggcggtggcgggcgccgtgatggcggt

SEQ ID NO: 30041 - DNA, 429 bp, Zea mays
  unsure at all n locations
  Clone ID: LIB3059-029-Q1-K1-E4
ggagcaggaaggctgttgtgatccacgttccataccgcttgcgcaaggccttcangaagatccatgtcaggatcgtcagggagctggagaagaaattcagcggcaaggatgtggtaattgttgccacaaggaggatcgtgaggccgcccaagaagggttcagctgttcagcgccctcgcaccaggactctgactgctgtccatgatggcatcctggaggatgttgtcttcccagctgagattgtggggaagcgtgtcaggtaccgtctggatggtgccaagatcatcaagatcttcttggacccaaaggagaggaacaacaccgaatacaagctggacacctacactacggtctaccgcaggctgtgtgggaaagatgtggtctttgagtaccctatggncgaaaatgcataaatatgacgcccggata

SEQ ID NO: 30042 - DNA, 389 bp, Zea mays
  Clone ID: LIB3059-029-Q1-K1-E6
cgcaaattgcaccaagaaatccatcgataggccgtcgacaggggaattaatggggtcggcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgcttagcatcctcatggacggcgcgatcccgccgggcccggacgcgcagctggagggccggctaaaggacctgccgggct

SEQ ID NO: 30043 - DNA, 383 bp, Zea mays
  Clone ID: LIB3059-029-Q1-K1-D11
gggaagaaatgaaccttttggcagaagttgatcaaccaggtagcctgattgacaactaggtggcccaactgagctttctgctgtcacgcaaggctgcaggcttggtcagcctccaagcacgcttggcacggttccagcaccggctcaaagagcaagagatccttagccgcaagaaacctcccagatagtatgatgatcagcaatgactctgtccttgtgccttgtaatctgattgcttggagctcagttgtggtccatcagctgttttttacgtgtgcgctccagtaaattctatagccccaagcaggccaagacatgtgggagtggcttaaggcggtcttgatgccgagggcgtggtcctggttgatatcacctgacacttt

SEQ ID NO: 30044 - DNA, 434 bp, Zea mays
  unsure at all n locations
  Clone ID: LIB3059-029-Q1-K1-B6
actgcactccgccaccgccctctacacctcgcgctcccaccgcccggtgtcagatgtcggcgccgcgatgggctccgcccactcgtccgtctccaccgccggcggcgaagacgaagaagacgacgaggatccgtccgcggcagccgtttcctccgcgggcgcacaggcgccaccgcccgctctgtcgccgtcgccggtccgcgtgcccccggcctccgcgtccaaagtgctggagcaggagcccgaggtgctgccgtgcctcgccgcggactcgccgctctcgccgcagccctcggcggcgggcaccccgcgcctcctcgcgggtcccggcatcaaggtctgggacccctgccacgttctcctgcccccgncgncgncgtctccgcacgcagggaggcaggttgacgccgcggccatcgaggtcgttgtggtca

SEQ ID NO: 30045 - DNA, 426 bp, Zea mays
  Clone ID: LIB3059-029-Q1-K1-B8
cccacgcgtccggatcaaccaagtagctctggcaaacctttctccctactctcaggaagaacaatttcttccattcaaccaactgtctacactgaaccctgctgcttatttgcagcaacaactattaccatttagccagctagctactgcctactctcagcaacaacaacttcttccatttaaccaattggccgcactgaaccccgctgcttatttgcagcagcaaatactactaccatttagccagctagctgcagcaaaccgtgcttccttcttgacacagcaacagttgctgcctttctaccagcagtttgcggctaaccccgcaaccctcttacaactacaacaattgttgccctttgtccaacttgctttgacagacccagcggccttctaccaacaacacatcattggtggtgccctctt

SEQ ID NO: 30046 - DNA, 218 bp, Zea mays
  Clone ID: LIB3059-029-Q1-K1-C1
cccacgcgtccgcggacgcgtggggcaggagttgtgccttgcgtgttttaagttgttcgagggtgaactcttgagttctcattgtctggatcatctttttctccttggatgtgttgcatcttttgagtgtggaaatggatggtactcctcgccatgaatttgctggctactttatacattgctttgtaactctgtttgatgataaactttgttgtggc

SEQ ID NO: 30047 - DNA, 416 bp, Zea mays
  unsure at all n locations
  Clone ID: LIB3059-029-Q1-K1-C10
attacatcaattacctttggtgcatttattggcacaaaacatcagggcacaacaactgcgacgactcgtgctagcaaaccttgctgcctacgctcagcaacagcagttacctttggtgcaattgttggcacaaaacatcagggcacaacaactacaacaactcgtgctagcaaaccttgctgcctactctcagcaacagcagtttctgccattcaaccaactagctgcattgaactctgctgcttatttgcaacaacaacaactactaccattcagccagctagctgctgcctaccaccagcaatttcttccattcaaccaactggcagcattgaactcttctgcttatgtacaacaacaactactaccattcagccagctagctgctgtgagccctgctgncttcttgacacagc

SEQ ID NO: 30048 - DNA, 403 bp, Zea mays
  Clone ID: LIB3059-029-Q1-K1-C12
cccacgcgttcggcaattagctcatcgactccagattggagaactcgacaccatgaaggtgctgatcgttgcccttgctctcctggcgctcgctgcgagcgccgcctccagtacaagcggcggctgtggctgccagacaccaccgtttcatctaccgcctccgttctatatgccgcctccgttctatctgccgccgcagcagcagccgcagccatggcaataccccactcaaccaccgcagctaagcccgtgccagcagttcggatcctgcggcgtcggcagcgtcggcagcccgttcctgggccagtgcgtcgagttcctgaggcaccagtgcagcccggcggcgacgccctacggctcgccacagtgccaggcgctgcagcagcagtgctgccaccagatc

SEQ ID NO: 30049 - DNA, 435 bp, Zea mays
  unsure at all n locations
  Clone ID: LIB3059-029-Q1-K1-C2
cggacgcgtggggatcagcaaagcggcagtgcgtagagaggatcgtcgaacagaacagcgtgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatgttccagccgctccggcaacagtgctgccagcagcagatgaggatgatggacgtgcagtccgtcgcgcagcagctgcagatgatgatgcagcttgagcgtgccgctgccgncagcagcagcctgtacgagccagctctga

SEQ ID NO: 30050 - DNA, 312 bp, Zea mays
  Clone ID: LIB3059-029-Q1-K1-C4
gccacacctgcctgtacgcatgcaaccatgcctacgctactcgtagatctcactatcaaggctgtgaaccacgttacttatgacacggacaagatactactaccattcaacgacgacgatgcaccaaagatcgctatcttcactacactggatcacttagttcttgtctaatacgacttaacctttaacacctaccccatgttactgatccagaacatggtgaccattgagcaagacgcattcaacaacctagcacactcgtacctacaactcataattgacgagggcctgtcttagatggaccatgagctg

SEQ ID NO: 30051 - DNA, 432 bp, Zea mays
  Clone ID: LIB3059-029-Q1-K1-C5
cggacgcgtgggctcgcccagctcaccggctcctacgccttcgtcctcttcgacgaggtgcaccaactccctgctagtcgcatctgaccccgagggcagggtgccgctcttctgggggatcaccgccgacggctgcgtcgccttctccgacgacatcgacatgctcaaaggctcatgcggcaagtcgctcgcgccgttcccgcaaggctgcttctactccaacgccctcggagggctcaagtgctacgagaaccccaagcacaaggtcaccgctgtccccgccgacgaagaagagatctgcggtgccactttcaaggtggtggaagggtctactgtcctgacggcgctgcactgatctatcatcatcaggcggaggcgatgcgatgatgatgcagaactttgtacatgcgttggtggatggtggtgtaacat

SEQ ID NO: 30052 - DNA, 432 bp, Zea mays
  Clone ID: LIB3059-029-Q1-K1-C6
cgggcgcgtggggccgacgtgacatcattagcgtcagccgtcacgcgagccctggagcgttacgacaccccggcattccatgagatggttcagaactgcatggcgcaagacctgtcctggaaggggcctgcgaagaagtgggaggaggtgcttctgggccttggagtcgaggggagtcgagctggtatcgacgacgcagaggagatcgccccacttgccaaggaaaacgtagccactccgtgagggcttggtggtgcctcggactcggaaacacgcgttggtgataggaagcgtcttgtgggagcctcctgcgcggtcttgaggctggtggagtgaggtgttcagcctgacactgtttcctctctactaccacagtaccactactacttcattgtcatataatccctaggcattctcaaaaaagccatgcct

SEQ ID NO: 30053 - DNA, 432 bp, Zea mays
  unsure at all n locations
  Clone ID: LIB3059-029-Q1-K1-C8
ggaggcctagccgcctagggtagtcccgtccggtctcccgcggccagcgacggggtgcgtggcgccggcgaatcgatgggctactggtggcaccgcgtcgtgctgccggtgcggcgggcgtggctcggcgtcgcgtcccgcttcggggttcgccaaaccgggctgtggaggctgcggcaggaggtgagcacgtgcgagtacgaggacgtgcacgtgatgtgggagatgctgagccgcaccacggcgccggcgcccgcgcccactaggcggcagcacagtcggttccggccgcagccgcagccgcggccgtggggcgacaggttccgcctctgccgaggcttctagtagaccaaggccgccgccgccgccgccgccgccgncgncgncgncggcgncgcgcgtgtcagctccgctgctgttgctgcgggatag

SEQ ID NO: 30054 - DNA, 299 bp, Zea mays
  Clone ID: LIB3059-029-Q1-K1-C9
cccacgcgtgcgcccacgcgtccggggttggcttctcctccccctccggttcgggttggggtgcgtgaggttctccggggttcggcttcgcgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggctttctcaccttcttcaccgaagaggcgatgcggaac

SEQ ID NO: 30055 - DNA, 340 bp, Zea mays
  Clone ID: LIB3059-029-Q1-K1-D1
gcgccatccctcactctcctccgaagccatcgtccacgtcccagcctccccggactctgaggggcagaagctgcagcgtcgagatggtgaaggggcgcacggggcagcgcgtgaggctctacgtccggggcaccgtccttggatacaagcggtccaagtcgaaccagtacgagactacgtcgctggtgcagatcgagggggtgaacaccaaggaggacgtcgcgtggtactgcgggaagcggatggcctacatctacaaggccaagaccaagagcagcggcacccactaccgctgcatctggggcaagggtcgccgcccgcatggcaactccggcgtcgt

SEQ ID NO: 30056 - DNA, 406 bp, Zea mays
  Clone ID: LIB3059-029-Q1-K1-B5
gaagcaactgttgaaatggtcgaacaagtagttcagcaagtttggtgctattaaagctgggggtgtacaagtcaaatgccagcctgatcagttttgctttggctttgtcgaatttgagtctcagcaatccatgctagcagcaatcgaggcttctagggtttatttcggcacaagagaatcatatgttgaggagaaaagaaccaaaacacgagttgttgatggtgttatcacccgtggggatgacaatggcaatggcggtggcggtcggttccattctggcagaggtggtggttactatggggacggctacaagcggcagtggggcggtcagaacaacgggtactacaacggcggggataacatgaggaacgactactcatgtcgtgtccgtggaccgcaagggaac

SEQ ID NO: 30057 - DNA, 404 bp, Zea mays
  Clone ID: LIB3059-029-Q1-K1-D10
caacaagcaacatagacagtggaatccatctagctacaatacagcaacaatggcgaccaggatattttccctccttatgctccttgctctttctgcatgtgttgctaacgcgacaattttccctcaatgctcacaagctcctatagcttcccttcttcccccataccttccatcaatgatagcttcagtatgtgaaaacccacctcttcaaccctataggctccaacaagcaatcgcagcaagcaacatacctttatcacccttgattcaacaatcgccagccctatctttggtgcagtcattggtacaaaccatcaaggcacagcagctagcatcaactcgtgctacctgtgatcaaccaagtagctcttgcaaacctttatccctactctcagcaacaacaa

SEQ ID NO: 30058 - DNA, 323 bp, Zea mays
  Clone ID: LIB3059-028-Q1-K1-H8
cgagccacgcgttcgctctgctaccgatccatgtacatttgccgagcgcggtagatctccgttcggcagcgtgtgatctgaccgatccgtgcggttgggtctggatcgggtggtgaaggtagcggtcgcggaagaagatggggctcgcgttcggtaagctcttcagacggttctttgccaagtatgagatgctgattcttatggacggtctctactcctacggtaaaaccaccatcctctacaatctcaagctcggcgagatctgcacatccatccgcaccatcggtttcaatgtttacactgctgactgcaagagcattatc

SEQ ID NO: 30059 - DNA, 394 bp, Zea mays
  Clone ID: LIB3059-028-Q1-K1-H9
ctcaagagtgatccaatgtgcaatgcttgtgagatggctgtggtatggatgcagaaccaacttgcccagaacaagacacaggagctcatcctgaactacattaatcagctttgcgagcgtcttccgagtccgatgggagaatcagccgtggactgtggcagtcttgcgtccatgcctgacattgcgttcaccattggaggcaagaagttcaagctgaaaccagagcagtacattctgaaggttggtgaaggacaggctgcccagtgcatcagcggattcacagctatggatatcccaccaccccgtggccctctctggatcttgggtgatgttttcatgggagtctaccacaccgtcttcgactatggcaagctgagggttggcttcgcagagt

SEQ ID NO: 30060 - DNA, 433 bp, Zea mays
  Clone ID: LIB3059-029-Q1-K1-A1
gtcgtcaccagcagggtgtcccggccctctctagtttctaccccggcccccaacattggcctgatgctgctgccatgtagcccagcgctcccccctcggcttcaccggcggcggcggcaacgacggtgaaaactacatcgggtgctagctccgacggtggtgcgtgccctgttgacgatagggcacgcggggcgcgggcagcttgtaagcgttcgatcggccatgtagggcaactatacatctttggcaggtctccaactctccatcatcctccgtgggagagaagatggtaatggagtgcgtgtgtatgtatgtggatgcccagggcgcgcgcgcgcggctctgggcgagtcacagtagagatgcaatatcatgtatccagtatctttcttacaacacaaacagggagaaattattagtaaagtgtgcattg

SEQ ID NO: 30061 - DNA, 413 bp, Zea mays
  unsure at all n locations
  Clone ID: LIB3059-029-Q1-K1-A10
cgcaaatggtaaaacgcttgggaaacacaattcagccctggcctttttccagttgagtgcacgtcttggctcttgcctcctgcatctctagagaggcacatcccagctccaagcttcgcgccttgttggatcgtggcgtccaagcaacggtggtagcggagcgcgaggcagtggccgcagaaggaagcgcgaagcatccatggaccaacgccaggtggttagcgagaattatgccaatcccataacatgcttcttccatgtgctattcaaggcggnggcgctagccttctacatcctattctcgctctttgtgaagagcttcgtcatcatcttcgtgatcacggtgctcctcgcagcgcttgacttctgggtggtgaagaacgtcagtggcaggatactagtcgggctgcggt

SEQ ID NO: 30062 - DNA, 365 bp, Zea mays
  Clone ID: LIB3059-029-Q1-K1-A11
cttgctcggttcgccgcctccgccgacaccgactgcctacctcagctgccgtcgccatgggcggaaagcctgctagatgctatcgccagatcaagaacaagccgtaccctaagtccaggtactgccgtggtgtccctgtcccctagatcaggatctacgatgtcgggatgaagaggaagggtgttgatgagttcccctactgtgtgcaccttgtctcttgggagaaggagaatgtctccagtgaggcgctcgatgctgcccgcattgactgcaacaagtacatgaccaagtctgcaagaaaagatgccttccaccttatggtccgggttcacccgttccatgttctccgtatcaacaagatgctt

SEQ ID NO: 30063 - DNA, 432 bp, Zea mays
  Clone ID: LIB3059-029-Q1-K1-A2
gaacaatgcacatgttccatatgcatttcgaatgggtttgatttcagatgaattgtttgagaggttagttactacatgtaatggaaagtattggaataactccaatccatcatgccaagagaacatggagcaattttatactcaaatcataggtattaacatggagcatattctatgtccgccgtgtcgatacaagatggggataaccaatcaattcattgaatatgattctggtcaaatgtttgagagcctttcgaaaacctccaagcatggtttagaatgcaatgatcaagagttggcccttgagaaactctttgatacaagatcaggtagagaaaaattgcatgccaaaaaggttgaagtatcaggaccatggaagaggtgccccaagcgtgttctgtacacgagggatattctaacattgatagagta

SEQ ID NO: 30064 - DNA, 356 bp, Zea mays
  unsure at all n locations
  Clone ID: LIB3059-029-Q1-K1-A3
gccaacatgcaacaacaagcgcttgcggcgagcgtcttacaacaaccaattgcccaattgcaacaacaatccttgccacatctaacaatacaagccatcacaacgcaacagcaacaacagttcctaccagcactgagccacctagccatggtgaaccctgccgcctacttgcaagagcagctgcttgcatccaacccacttgctctggcgaacgtagttgcaaaccagcaacaacaacagctacaacagtttctgccaacgctcagtcaactagccatggtgaaccctgccgnctacgtacaacaacaacaactgctttcatctagcccgctcgctgtgggcaatgcacctacata

SEQ ID NO: 30065 - DNA, 433 bp, Zea mays
  Clone ID: LIB3059-029-Q1-K1-A4
gtgcactgaagaagcctggaggagatgaaatgctgataggcatttctcataagccatcgggccatacatctcatctagcatttcctggccaaacctctgcaacaaattctgatgtccgagttcacactaaagctgttacttttgaagacgacaaatatgtagttagttcgtcaaagtctcctcccttgctactggattctatacagtctgatcctgtgctcaagaattcttcagaccccgctctatctcgtgacagaaagataatatcaagtggacgaaaggcctttacaggatctatcattgagcacgacgacaatgtttccaccattgaaccttctgtggctagttcgttggcaaaacctggtacttgtgcttcttcaaggcccgagtcaaggttcaagatgcagaaaggagggcggcgagtctggacact

SEQ ID NO: 30066 - DNA, 252 bp, Zea mays
  Clone ID: LIB3059-029-Q1-K1-A5
gacgcactcatccggggcgcccttttttttttttttttttttttctgctctctgagctcatctttcctagtggaacttaaatatgattacaaccaaataacgtcaaaatatagaaaacatagcattgtcacattcaactacgatatgcattgctcaacataactttgctaagtagtacacatatgcttacactcttgtttcatacaacaacacaataatgatctttcgctcatacacaaacatgataaccat

SEQ ID NO: 30067 - DNA, 421 bp, Zea mays
  Clone ID: LIB3059-029-Q1-K1-A6
cctggctctcgctgcgagcgccacctttacgcatacaagcggcggctgcggctggcaagcaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcggcgttggcagcaccccgatcctgggccagtgcgtcgagtttctgaggcatcagtgcagcccgactgcgacgccctactgctcgcctcagtgccagtcg

SEQ ID NO: 30068 - DNA, 177 bp, Zea mays
  Clone ID: LIB3059-029-Q1-K1-A7
gcgtgatttagttcttcattaagtaaggttcaaaacattgtcaaaacattatcaagagcgtatgttaccacaatgcccaccaatttaatcgggcataagcaccgtaccacacagtctaacggtgacattgctctgacgctacgctcacgtcctgagtctacaaaacactataccttg

SEQ ID NO: 30069 - DNA, 316 bp, Zea mays
  Clone ID: LIB3059-029-Q1-K1-A8
gtcagcatcgtcgtcgtcgacctcaagcacagggactgagtcagtgagtgagtggggggatccggtttctgatcctgcagcgcatcagcgtaatcgatctagggctgagctgaactgatactgtgaggaggtgatcgtctagatcgtctagacctttgacatttccttggttctttcgattctaagatataagatttgtagcctaaaaaaaaaaaaaaaaaaaaaaaaaaaaaaaaaaaaaaaaaaaaaaaaaaaaaaaaaaaaaaaaaaaaaaaaaacacaaaaataaaaattagcgggggggcgactcctatta

SEQ ID NO: 30070 - DNA, 333 bp, Zea mays
  Clone ID: LIB3059-029-Q1-K1-A9
aacaaatggagtgactcccaggcgttggatccggttttgtaatcctgcattaagtgcattaatttcaaagtggattggttctgatgactgggtgcttaatacagacaaactggcagaactgaagaagtttgctgataatgaagatctgcattcagagtggcgtgctgctaagaaggctaacaaaatgaaggttgtttctcttataagggagaagacaggatatattgtcagtccagatgcaatgtttgatgtgcaggtgaaaaggatacatgaatataagcggcagctgctaaatatccttggaattgtctaccgctacaagaagatgaagga

SEQ ID NO: 30071 - DNA, 382 bp, Zea mays
  unsure at all n locations
  Clone ID: LIB3059-029-Q1-K1-B1
cccacgcgtccgacgcgctagacaagcaccttgagaggcggtcgcatcgccgtccacgtcgagggggtcagcgggcggcggcggtgtgcgcgaccaccaccgcctcgtcgtgccgtcctccgtgtcgtccatccccaagggccgctgctccgaaggggagtctgattctgatagtgaagcatcagatgttagtggctctgatggagaagacacctcgtggatttcatggtattgcaacttaagagggaatgagttcttctgtgaagtcgatgatgactacattcaagacgacttcaacctttgtggcctcagcagccaagttccttattatgattatgctctggatctcatnttagatattgaatcatctcatggtgatatg

SEQ ID NO: 30072 - DNA, 233 bp, Zea mays
  Clone ID: LIB3059-029-Q1-K1-B11
aggagaagaaccctaagaacaagtctttagtttcggtggggaaagctgctggcgagaggggttaatccctgagggagtcagacaaagctccctatgtagccaaagctaacaagctcaagctcgagtacaacaaggccatcactgcctacaacaagggcgagagcactgcagctaagaaggctcctgccaaggaggaagaagaggaagatgaacacgaatatttcaagaccaaa

SEQ ID NO: 30073 - DNA, 390 bp, Zea mays
  Clone ID: LIB3059-029-Q1-K1-B12
ggacgtcagcctagcaattagctcatcgactccagattggagaactcgacaccatgaaggtgctgatcgttgcccttgctctcctggcgctcgctgcgagcgccgcctccagtacaagcggcggctgtggctgccagacaccaccgtttcatctaccgcctccgttctatatgccgcctccgttctatctgccgccgcagcagcagccgcagccatggcaataccccactcaaccaccgcagctaagcccgtgccagcagttcggatcctgcggcgtcggcagcgtcggcagcccgttcctgggccagtgcgtcgagttcctgaggcaccagtgcagcccggcggcgacgccctacggctcgccacagtgccaggcgctgcagcagcagt

SEQ ID NO: 30074 - DNA, 317 bp, Zea mays
  Clone ID: LIB3059-029-Q1-K1-B2
gcgcgacaacctgatcgctaggcacaccaaccttgactggtacaaaagcccaaccctgagtgaggctcttgaccagatcaccgagcccaagaggccttcagacaatcccctgcgtgtgctcctccaggatgagtacaagattgctggtattggaactgtaccgggtggccgagtggaaactgtagtaatcaagcctgttatggtaatcacctttggtccaactggactgactaccgacgtgaagatctgatgagatgcaccacgaggcacttgatgacgttcttccggacgacaatgatggcttgaacctgaagaat

SEQ ID NO: 30075 - DNA, 282 bp, Zea mays
  Clone ID: LIB3059-029-Q1-K1-B4
caggagcttctgcttgctctggggggaatgagatagagagagagcgagagagagatctgttggggatgctagtaggcggtcctagaacgaacaagctcgcggtgttcatcgggcaggtcgtcgaggtgcccatgccaactggtcgcgctgcttcaaaccggactccgtactccaagacgaaagcagtagaattggtggtgctcttcctagaaccatccgagccaatcgcatgcctacagatctgagaccacagtcacctcacctactaccacaccaaccact

SEQ ID NO: 30076 - DNA, 376 bp, Zea mays
  Clone ID: LIB3059-028-Q1-K1-H7
gcgaggaaccccgtgttttgcgtggagaaggcaagtcgttcaacgctcgtcggatgcggggagcgatgcacaaatcggaatcgccatcgtccttacaaacatcgattgggtttatttatggtgagccgatgtatgtcgctctcggtcgactcgattaattattttgaatggatgtgtgtaaaatgtttcggttatgcgcattggtaggatcgcgtttgctattggagaacaagagattatttgatgtgtgcgaattgtagtgagtctaattaggttttgatcgatgaagtgcacgtgtgattatgtgtgtgaaaaaaaaaaaaacataatacatcgcaatgaaatgagctacaggacatgaaaaaaaaaagggcgg

SEQ ID NO: 30077 - DNA, 427 bp, Zea mays
  Clone ID: LIB3059-052-Q1-K1-G9
cgcacgcgtccgatgaggctctgcattacccatacttggcttcacttcatgagatcgaggatgaacctacctgccctgcacctttcagctttgattttgagcaaccatcctttacagaagcgcatataaaagaacttatctggagggaatctttagcatttaacccggatcctccctactaatatcaaaaggatgatgagttatctgctagacgcatatgaagatctctagctccagcggacgcaagaacttatgtcagtgtcagtgtgcgttgattatttacgtgcggtttgttgggcatgcgggcatgggttggtgctgcaatagcaactctattatggcttgtgagagcaaacaaacgtctgtattcattttcaggtgcctgaacccaggcttgtattataccgcttgactccataaattattc

SEQ ID NO: 30078 - DNA, 393 bp, Zea mays
  Clone ID: LIB3059-052-Q1-K1-H1
cggacgcgtgggcggcatcgagggttacggcgacatggtcagcggcgtcgtcctccggtacccttatttctgggggaaggagccgctgggcgcggagcccacggatcccggctaccgcgcaatgttcgatcccacttgggaattcatctgcggcggaaagttcggcctcgaccacccctacgtcaacccaatggcatcgccggaggagtggaggcagcttggttcccgccgcgtgctggtgaccacggcggaccagtgctggttcgtggagagggcaagggcttacgcagagggaatcaagaagtgcggctgggaaggggagctcgagttctacgagaccaagggtgaggcgcacgtcttcttcttgcctaaacacggcagcgaaaaagccgt

SEQ ID NO: 30079 - DNA, 420 bp, Zea mays
  Clone ID: LIB3059-052-Q1-K1-H11
cccacgcgtccgcggacgcgtgggtgctgttgaagcttatgtgtatgacatgcgtagcaagctatatgacaagtacagtgattttgtcacacctgaggacaaggaaggtttgatcggtaaacttcaggaggttgaagactggctctatgaagatggcgaggatgagaccaagggagtttatattgctaaactagaagaacttaaaaaggttggtgatcctattgaggtgcgcttcaaagaatgggagattagaggttctgctgttagccaactgctatactgcataaaaagcttcagagaagctgcactgtctaaggaccagaagtttgaacacatagacatgtcagaaaagcaaaaggtcattagcgagtgttcggaagcagagacttggctaatggagaaaaggcagcagcaggatgc

SEQ ID NO: 30080 - DNA, 439 bp, Zea mays
  Clone ID: LIB3059-052-Q1-K1-H3
tccggattcccggtcgaccagctccgggcgagatgttcacttcaaggctaactgaaaggctgtaccagggaatggatgggcgtgtccaccgactacaaaggcaacatgatgctggtcggggactacccctggaatgagttctgcagcatggtgcacaagatcttcgtgtacacgagggaggaggtccagcgcatgaacccgggcgccctgaactcgaggccggaggacagcggcctcgccaattcgacggagaggggctccgcatctactgctgctgctagagaagcacccggctaccagtccgtctcgtcgcttaacttcgacaactgctgatgccttggcagctaacttgtcctcccaagtagtagaagaccaggcatatgtatccatagatctccttgtagcggaacctaatgcctttttttccctttctaatatg

SEQ ID NO: 30081 - DNA, 427 bp, Zea mays
  unsure at all n locations
  Clone ID: LIB3059-052-Q1-K1-H5
gccaaagaacacatcgtgcttgtgcccgtgcttctcttctgtcacttcagggccgggtaccagatcttttgtggattggtctttctgagaccaatgcccggcggatttttgtggaacaatctaggttccaggaagctcttattgttgctgaagcatacaacataaatcaacctatagaatgggccccagtcttttggaatcaaatgctaaaaccggatctaatcgagcaattcgtggctgagtttgtctcagtgctgcccctgcagccaccaatgcttctcgagcttgcaaggttttacagggcggaggttgcagccaggggggagcagtcacacttctctgtctggctttcacctggaggcttgcctgcagagtgggtgaaacatcttggtagatccttcangagcctgctgcgtagaacaaggga

SEQ ID NO: 30082 - DNA, 421 bp, Zea mays
  Clone ID: LIB3059-052-Q1-K1-H6
gcaagtatccaggacaaggatggcattccaccggaccagcagcgcctgatgtttggtggcaagcatctggaggatggccgtaccctcgccgactacaacatccagaaggagagcaccctccacctggtgctccgcttgcgaggtggtatgcagatctttgtgaagaccttgactggcaagaccataaccctggaggttgagagctccgacaccatcgacaacgtgaaggcgaagatccaggacaaagagggcatccccccagaccagcagcgtctgatcttcgccggcaagcagctggaggatggccgcaccctatcagactacaacatccagaaggagagcactctccacctggtgctccgccttcgcggtggtcagtaagccatggttcatttaagctgctgctgtacctgggtatctg

SEQ ID NO: 30083 - DNA, 415 bp, Zea mays
  Clone ID: LIB3059-052-Q1-K1-H8
tgaccttagtttacattgtctttgtggtgctgcacacagtgcctgtcctgtatgagaagtacgaggatcagattgactcgtatggcgagaaggggtgggctgaaattaagaagcagtatgccgtgttcgatgagaaggttctgagcaaagtacccaggggtcctgcgaaagacaagaagcactagatgcaagtgattcgaggtccctgttagtagggaatgctagcaaaaccggttcgagtttctccggaggggcagcacttgtgggtgtgagcaccagtttgccacctgtgcattacgttgcgtatggctgcttagttgtttggtcttgatgggagtaagccgaattgctagctttgcgcttcatcagtgatgcagacgcagcatacgaatttctgtagtgctgtttgagtttg

SEQ ID NO: 30084 - DNA, 411 bp, Zea mays
  Clone ID: LIB3059-052-Q1-K1-H9
gccggctcccgcgggctcccgcggccgtcctgcgcacgctaccgaggacgacgacggggaggagggcgagatcgccaccgacgccccctcgcccgccctccccgccgcgcacccgctcgagcactcgtggaccttctggttcgacaacccgcacggcaagaacaagatggccgcctgggggagctccatacgacccatccacaccttctccaccgtagaggacttctggggcctctacaataatatccatcaccctagcaagttgatcggcggagctgacttccattgcttcaagaacaagattgagccaaaatgggaagatcctatttgtgctaatggcggtaaatggaccatcagctgtggaagaggaaaatctgacacgctttggctgcacaccctgttggctatgat

SEQ ID NO: 30085 - DNA, 402 bp, Zea mays
  unsure at all n locations
  Clone ID: LIB3059-053-Q1-K1-A1
ggcgccgccctccgcgatatgcaggccaaggtcgccaaggagatgcaaggaggtggccctagtgcatctacagctgaggcaaaggagcaggtggatgcccgttctgtgtatgttggaaatgtggattatgcttgcaccccagaagaagtgcaacagcatttccaagcttgtggaactgtcaacagggtcacaatcttgactgacaagtttggacagccaaaaggttttgcttatgttgaatttctggaacaggaaagtgttcaagaagctcttaacttgaatgaatctgaattgcatggtcgccagaattaaagtcgcgccaaagaggactaatgttcctgggatgaagcagcgtncaccacgtggattatatccataccatggctacccttatagatcata

SEQ ID NO: 30086 - DNA, 303 bp, Zea mays
  Clone ID: LIB3059-053-Q1-K1-A10
cgcactcgttcgcccacgcgtccgattataaaactccttccgtgtgtaaccagagctgctagcatcggtggaacctcggtctcgtttagttcgtaaagctgagtccaattctttgagtaacctgagtcctgagctaggttttcagtcgtttctaactaacagttctttggcgacgtacgtacgtacagctcggagaccgacagaagcgagcgatggcgtgcaagactaagagcctgctgttgacgctctgcgtggcggcgctgctcgcggcgcatctcaagtcccaccgcctaggctacttca

SEQ ID NO: 30087 - DNA, 408 bp, Zea mays
  Clone ID: LIB3059-052-Q1-K1-G6
cccacgcgtccgcggacgcgtgggcctattgaggtgcgcttcaaagaatgggagagtagaggttctgctgttagccaactgctatactgcataaaaagcttcagagaagctgcactgtctaaggaccagaagtttgaacacatagacatgtcagaaaagcaaaaggtcattagcgagtgttcggaagcagagacttggctaatggagaaaaggcagcagcaggatgctctgccaaagcatgctaatccggtcctccttgctgctgaccttaagaagaaagctgaaacacttgacaggttctgcaagccgatcatgacgaaaccgaagccagttcctaagccacagactccgcctccggcagaaacccaagctcctgagcctcagacaccggagcagcagcgatcaaat

SEQ ID NO: 30088 - DNA, 433 bp, Zea mays
  Clone ID: LIB3059-052-Q1-K1-F12
acaagatcgacgagcggtcgcgcgccgtgctggtggacaaggtgggcggccccggggaggggtacgaggagctcgtggccgcgctgcccggcgacgactgccgctacgccgtcttcgacttcgacttcgtcaccgtcgacaactgccagaagagcaagatcttcttcatcgcctggtcaccggcggcgtcgaggatcagggccaagatcctgtacgcgacatcgaagcaaggcctgcggcggctgctggacggggtccactacgaggtgcaggccaccgacccctccgagatgggcttcgacgtcatcagaggccgcgcgcaatgaggcccccgctgcgctctgctcctatttacgtacttacctgtgcgtgggcgtgttctcctactactcactgctcagtagtcagtagtcatctgcgttcgtgtgtgtgt

SEQ ID NO: 30089 - DNA, 430 bp, Zea mays
  Clone ID: LIB3059-052-Q1-K1-F2
cggtcgattgaagaaagtccaaaagaagccgatgggaaaccagggtttataagaatggctggttgggccagaaaccaaaggtcattcaatggaaaccatggaaccaggaattggtgaagaagaaccagaccagaaggaagggcttgggaattttcaattaagctggaaaaacttaaaggtttaagttataacatgctaaaaccaagtgaaagtgagatagatgcagatataaaggatgggggtatgatgctgataactgcattgagtccttatgcaaactggcttcaaggctatgctgatgttctcctgcaggttaaaggcactgttgatcagcctgttgttgatggatcagcaacgtttaaccgggctattgtgaactctccttttcttcggacaccattgacaaattttgcgggtacaattcaagtca

SEQ ID NO: 30090 - DNA, 357 bp, Zea mays
  Clone ID: LIB3059-052-Q1-K1-F5
cctgaattccctcgtctaccctctcttcctaaaaaaaaaaaaaaaaaaaataaaatttaaaaaaaaaaacaaaaaaaaaaaagaaaagctaaaatacacaaacaaacaaccaaaaaacctctactataacaaacattaatttcattacactctccctcctttctacaacttcctctcttactaaatccctttcttttcccaacttattctcctttctacactttcaaatcccttcctcttccttacttactcaacattccctcacttacccctcttcccaactttcacacttcctaaatatccaacttttccctccctttctcacctttttaccccttcatcccctctctttccccc

SEQ ID NO: 30091 - DNA, 419 bp, Zea mays
  Clone ID: LIB3059-052-Q1-K1-F6
gttggcttctcctccccctccggttcgggttcgggttcgtgaggttctgggggggtcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtga

SEQ ID NO: 30092 - DNA, 416 bp, Zea mays
  Clone ID: LIB3059-052-Q1-K1-F7
cggacgcgtggggcgccgccgccgctgcagactcctccttttcgatccctgcacagagcgcctccgtcgccccatcgaacatggctccgaagaaggataaggccccgcccccgtcgtcgaagcccgccaagtccggcggtggcaagcagaagaagaagaagtggagcaagggaaagctaaaggagaaggtgaacaacgcggtgctgttcgaccaggctacctacgacaagctgctctctgaggtgcccaagtacaagcagatcaccccctccatcctatccgagcgcctcaggatcaatggctccctggctcggagggctatcaaggacctgatggcgcgtggcctcatccggttggtctcggttcactcaagccagcagatctacaccagggcaacaaatacctaaggatgggat

SEQ ID NO: 30093 - DNA, 434 bp, Zea mays
  Clone ID: LIB3059-052-Q1-K1-F8
agaagatcaaacacaagctcaagaaggttaagctctccgtgctgcagttgtataaggtggacgacaccactagcaaggtgacccgcctccgcaaggagtgccccaacacagagtgcggcgcgggcgtcttcatggccaaccacttcgaccgccactactgcggcaagtgcggcctcacctatgtctacaaccagaaggcgtaattgcttgccccgatttgctttatccgcctaccctatcgaacatccagctgttggttactcgaattgtatctcatgtagatctgtctgaggttgaaacttaaatggagcagtagtatctgtcatattggtacccctgttactgaattgatgtgatgctgagtttaattttgttttcaaaaaaattaaacgcagcggctcatcttcgccggcaagcaactcgaggaccgtcgc

SEQ ID NO: 30094 - DNA, 406 bp, Zea mays
  unsure at all n locations
  Clone ID: LIB3059-052-Q1-K1-F9
agcaatcgcagcaagcaacatacctttatcgcccttgttgtgtcaacaatcgccaggcctatctttggtgcagtcattggtacaaaccatcagggcacaacagctgcagcaactcgtgctacctgtgatcaaccaagtagctctggcaaacctttctccctactctccgcaacaacaatttcttccattcaaccaactgtctacactgaaccctgctgcttatttgcagcaacaactattaccatttagccagctagctactgcctactctcaacaacaacaacttcttccatttaaccaattggccgcactgaaccccgctgcttatttgcagcagcaaatactactaccatttagccagctagctacagcaagccgtgcttncttcttgacacaacaacagttg

SEQ ID NO: 30095 - DNA, 341 bp, Zea mays
  Clone ID: LIB3059-052-Q1-K1-G1
atggtcagcgtcgtcttcctcgtgtacgcttatttctaagggaaggagccacttggctcttatcccactgatccctgctacctcgcaatgttctatcccacttgagaattcatctgctgctgaaagttctgcctctaccacccctacgtcaacccaatggcatctcctgatgagtggaggcagcttggttcccgcctcgtgctggtgaccactgctgaccattgctggttcgtggaaaaggcaaagtcttactcaaagggaatcaataaattcggctgggatggggagctcgaattctacgagaccaagggtgaagctcacgtcttctttttgcctaaaca

SEQ ID NO: 30096 - DNA, 118 bp, Zea mays
  Clone ID: LIB3059-052-Q1-K1-G10
ttatataaaacaaccatcctttacaaaatctcatatataataacttatctaaaaataatctttatcatttaacccacatcctccctactaatatcaaaattattataatttatctact

SEQ ID NO: 30097 - DNA, 408 bp, Zea mays
  Clone ID: LIB3059-052-Q1-K1-G11
cgacttgctgccatgaaatatgcattttagactgatacattgtcatatcttttatcggtggtgaaaggtaagtatcaagatggaataagagtgttatccatctacagtggcattggaggtgcagaagtagcacttcatcgtctaggcatccctttgaaatgtgtgatatctgttgaggaatctgaggtgaatagaaaaattctaagaaggtggtggttgaaaactgaacaaactggagtactaaggcaacatgcaggaatttggaagctcaaaacacatgtgattgaagacttggtgaaagagtttggtggttatgatctgattatcggtgggaattatacttcttgcaaaggtggtactacagttaatacgacaatgggcatggattcgaaccgcttctatgagtat

SEQ ID NO: 30098 - DNA, 278 bp, Zea mays
  Clone ID: LIB3059-052-Q1-K1-G3
aacttgaggtactcaaggaagggcaataagaagagttgtgaggctgagtcagaggagtgagatgatgcctgagtttgtggcgacaaatgcatctcttgtatcgttagggtcttagttgtgaacttaattttcacatctgtatgattaaaagagattcatcaattggtactgaagtgttgtttttttgtcttgttgcctatctggagtttatttaactaaaatcatcagttgtgtccttgagaatcgggcacttaatgtatcattttcggttctctgtg

SEQ ID NO: 30099 - DNA, 398 bp, Zea mays
  unsure at all n locations
  Clone ID: LIB3059-052-Q1-K1-G4
ggaagaggcagctctcttctctgcagctgagccttgttgtcgctaagaagagccgagctgctgatgatgcggccactagagcagctcggactgattgtactcctacacatgcgcagtatgactctgaagatacattatccaccgggactcgtacacctgaagtgatcgagtcgaaacacgacaaccacaaccctgaagctaaagtttcagcaggaaactcggataggcgagtgaatgctgtgaaccacctagcaaaggagtttgaagacagacgacaggtgttcgaagacgatgcgggcttnctagttgcagtcaggtccggtcagaatggttcaaatatgaacccagatgaggaactccggaagctcaaggaccgctttgcgacatggaaaaaagac

SEQ ID NO: 30100 - DNA, 428 bp, Zea mays
  Clone ID: LIB3059-052-Q1-K1-G5
ctgcagtgaagtcgccggcgccgcctcgacaggaggaaggagcagcagcgggagcggaggcccggcgatctcgtctgctgcgtgcggcgagggagtaaccggagccgcgacaggatgcactcctttgggcaccgcgccaacgcggtggcaacgttcgcggtcaccatactggccgcgatttgcttcgccgcctccttctccgacaacttcaacaccccgacacccactgcctccgttaagatcttgaatctaaactggttccagaaggaggccaacggcaacgacgaggttagcatgacgctgaacatttcggccgacctttcgtctcttttcacgtggaacacaaaacaggtgtttgtttttgtggcagcagagtatgagactccacagaatgctttgaatcaagtttccctttgggatggcattat

SEQ ID NO: 30101 - DNA, 418 bp, Zea mays
  unsure at all n locations
  Clone ID: LIB3059-052-Q1-K1-F11
gagataaccttactggaacttctgctagttctggtcatgatgaggtttataacctgcaaatgctagaagctgcattccacaagcttccacaaccaaaggactctgagcgtgctaaaacttacatcccgcggcaccctgcagttacccctgctagctatccccaagttcagccatcaattgtatctcatccctccttctgggaaagaattggtagcgacacattagctaccgacatgctattctttgcgttctattaccagcagaacacatatcaacaatacatggctgctagagaattgaagaagcaatcgtggagatttcaccggaggtacaatacctggttccagcggcatgtggagccacaggttacgactgatgagtatgagcggngatcatatgtatactttgatttccatgt

SEQ ID NO: 30102 - DNA, 436 bp, Zea mays
  Clone ID: LIB3059-052-Q1-K1-D6
ggcagcagctctcgctccactggcttccctggtatcagctctcgcttctggatcggtcctgtcagaagcgctcgcttctcgggcattgctggcgccagattggacaacgactaggagagtgaaaccaaggagaggccactggtgcttcgtaataagccgcctaggtggcacgaacagctgcagtgttggtgcctcaacttccgtggccgtgtgacaattgcctcggtgaagaacttccagctgatcgccgcggctaccccgccaccggcaggtgcgccaaccccctctcagcctgccccgtcagatcccgacaaggtgattctccaatttggcaaagtggcaagggatatgttcacgatggactatcgctaccctctctcggctttccaagcctttgccatttgtctgagtagctttgatacaaagttaacctgtg

SEQ ID NO: 30103 - DNA, 433 bp, Zea mays
  Clone ID: LIB3059-052-Q1-K1-D7
cggactcgtgggcgaatattgtcaagttcattggtgcgtgcaggaagccattggtgtggtgtattgtgacggagtatgcgaagggtggatctctcaagaatttcttgagcaagaggcagaacaggtctgtcccgctgaagttggcagtcaagcaggcattggatgttgcacgtggcatggcctatgtccatggccttgggttcattcatagagatcttaagtcggacaacctcctgatttctggtgataagtccattaagattgctgactttggagtggctaggattgaagtcaagactgaggggatgacacctgaaactggaacataccgctggatggctcctgaaatgatccagcataggccatacaaccagaaagttgatgtctacagttttgccattgtcctgtgggagttagtgactgggaatgtccc

SEQ ID NO: 30104 - DNA, 416 bp, Zea mays
  Clone ID: LIB3059-052-Q1-K1-D8
aacgagcactcgcctgcgctcttctctctctcgtggcgacgactgggtgggtgcgggcgccccaggcctgaggctccatcttcgggcccttcactggctacgagcaccacctgaggattatggattggctggggcagaagcgcgcggagatgctgatgcaggtgctgctggtggcgtctgctgtggcggcgttcctggtgggctacgtgcgctcggacttccagctcatgctgctcgtctacgccggcggcgtcgtgctcacagcgctcgtcaccgtccccaactggcccttcttcaaccgtaacccgcttaagtggctcgacgctgccgaggccgagcgccacccgcgcccccaggtcagcgccggtgcggcagcagggggaaagaagaagtccgggaagaacaagtaatcgatc

SEQ ID NO: 30105 - DNA, 419 bp, Zea mays
  Clone ID: LIB3059-052-Q1-K1-D9
gggaggaaggaggcgatcctgctgctgaatgcggcggcgaggagacggaggtggagggggcggcggcgaagaagccgaagttggaggaggccaaggaggcggagaaggggagggtagaggagacggcggaggggaagacacaggaggcaaatgaggagaaggcagtggaggcggaggacaagcctgtgacagaggaggcaaatgagaagaaggcagttgaagcggagggaaagcctgtgacacaggaggcaaatgaggagaaggcagcggaggcggagggcaagcctgtgaagctggggcctaaagaattcgcctcggccatcgatatgttcaactacttctacgctctgctccactcctggacgccgcagcttgagttcaataagtatgaacaaatggtgcttgaggatttgcttaag

SEQ ID NO: 30106 - DNA, 390 bp, Zea mays
  unsure at all n locations
  Clone ID: LIB3059-052-Q1-K1-E11
gaaacacaccaagcgaagcgcactagcaacgacctaacaacaatggctaccaagatgttagccctccttgcgcttcttgccctttttgtgagcgcaacaaatgcgttcattattccacaatgctcacttgctcctagtgccattattccacagttcctcccaccagttacttcaatgggcttcgaacacctagctgtgcaagccaacatgcaacaacaagcgcttgcggcgagcgtcttacaacaaccaattgcccaattgcaacaacaatccttgccacatctaacaatacaagccatcacaacgcaacagcaacaacagttcctaccagcactgagccacctagccatggtgaaccctgccgnctacttgcaagagcagctgcttgca

SEQ ID NO: 30107 - DNA, 428 bp, Zea mays
  Clone ID: LIB3059-052-Q1-K1-E12
cggacgcgtggggtcgagcaacatcttgcttgatggcagtttcgaggcccgtgtagtgagggtttggacttgcaaagcttttagaggatgaagaatcacatattactacaatagttgcaggaacatttggctaccttgcaccagagtatatgcaatttggcagagccaccgagaagactgatgtctacagttttggggttttggtactcgaaatactcagtggaaagcggcctactgatgcatccttcattgagaagggactaaacattgttggatggttaaattttcttgctagtgagaaccgggagagggaaattgtcgacctgaactgtgaaggagtgcagactgagaccttagatgctctgctctctcttgccaagcaatgtgttagctcctcgccagaggagaggccgacaatgcacaaggtg

SEQ ID NO: 30108 - DNA, 432 bp, Zea mays
  unsure at all n locations
  Clone ID: LIB3059-052-Q1-K1-E2
gaaactcataaaggttgtctatgagcatcatcctcgaccaaaacaggtcatagtagagaatgacctccctcagaagctacaaaacctgattgaagaacgcaagggtggacaacggggcggccatcaagtgttggtcaaacaaatggccacctcattgctgaaagcgctgcacatcaatacagtattgtgattttgatgggtcatgtgttttcctctcaagttagtgtttacgttttcgctagaggaagaaaaggggcgtccttctctttntgcctccttttctgctgtggtgggcttctcacgagcaccagactcatttgttgtacctgatccctccttttttgggagaaaggttcaacgttttggtgcaggataaaatgggcttgctatcctccagtgctgtttatatctagcgtatgttagtgaagaaat

SEQ ID NO: 30109 - DNA, 401 bp, Zea mays
  unsure at all n locations
  Clone ID: LIB3059-052-Q1-K1-E4
gccagccgcttcgcgatcggngactcggagaggggaaaggcgagtcgtcgtccgtgcacggcagcttccctccctctcctctccggccccgcttacctaacccggcccctcctacgcccccccttccgccgtcgcacgatgagcacctctccggcgggcgtcgtgcaacgcgcttgccaccgcgtacctgccgtcgctgctggccccggaccacgcggtggtggaggaggacgacgaggagggcgcggacgacgaggacgaggacgagggccagcacgggcgcggcgggctcaggggcaggaggccgtccacgttcccgtccccgcggctgatcgcgcacgccaccgtcggccagatggcgagggcccggtcgtttcggtccccgaggtccttctccatga

SEQ ID NO: 30110 - DNA, 425 bp, Zea mays
  Clone ID: LIB3059-052-Q1-K1-E6
agagcttcgactcatatgttctgtccgagtccagcctctttgtgtatccggacagggttgttctgaagacctgtgggacgacgaagctgctgctcgccattcctcgcatccttgagcttgctgcagggctgtcactgcctcttctttcagcgaagtactctcgtgggaccttcatcttccccggcgcgcagcccgcgccacaccgcagcttctcggaggaggtatctgtgctgaacgctttctttggtaacctcaagtccggtggcaatgcctacctgatcggtgaaccgttcaagcccaacaagaagtggcatgtctactacgccacagaggagcctgagcgtcctatggtgacgcttgagatgtgcatgacagagcttgacgttaagaaagctgctgtgttcttcaagaactccactggtggc

SEQ ID NO: 30111 - DNA, 421 bp, Zea mays
  Clone ID: LIB3059-052-Q1-K1-E7
cccacgcgtccgcggacgcgtggggattggactcctttttgagctgctggtcatcggacccatgagggtgcctattgatgagagccctgtcttcctattgtatcaggattgggctctggggttaatattcttgaaaatatggactagactggttatgttggatcagatggcacctttggttgatgaaagctggaggtcaaagtttgagagagttagagacgatggcttctcccgtttaaagggtctgtgggtcctccatgaaattataatgccgatcgtgaccaagctccttactgctctctgtgtcccatacgtccttgcaaggggcatcttcccgttgctgggttacccactcatcgtgaactcagcggtgtaccggtttgcctggcttggaagcctgatcttcagcgcactcttcttt

SEQ ID NO: 30112 - DNA, 414 bp, Zea mays
  Clone ID: LIB3059-052-Q1-K1-E9
cggggctcgccgtggccacagctcatgaatccaatcccccactcctcaccggcgccggcggttttataaatagattccctcgtcactgtcgcggtcgcggcttgatcggattcaactcacctaccccaccccctcgattccttcccagctctggctacttcctacgccaccaccgcccgctccggcctcggctcctcgagcaagctgccatggctgccgccgcgctgagggagcaactcaacgctctcctctcctccatgttcgcctcgggtctggtggacgagcagttccagcagctgcagatgctgcaggaagacgggggcacgccgggcttcgtcgccgaggtcgtcaccctcttctgcgacgacgccgacaggatcatctccgagctcgccgctctgcttgaccagccca

SEQ ID NO: 30113 - DNA, 405 bp, Zea mays
  Clone ID: LIB3059-052-Q1-K1-F10
ggcacgcgtccgcccacgcgtccggccggtgatcgccgtggtgctgaaggtgcacaggcgctgcgaggcctgcgcccaggggatcaggaagaggatcctcaagatgaaaggcgtgcaatctgcagagccagacctcaaggcgtcggaggtggcagtgaagggcgtgttcgaggagtccaagctggcggagtacgtgtacaagcgcaccggcaagcacgcggccgtcgtcaagtccgagccggtcccggcgccaccgccggagagcggcgccggcgacaacacgggggccaaggaggaggagaaggggcaggaggaggagaaggagaaggaaggaggaggcgatggcggtggcgaggagaagaagaaggaagggggcaaggaggaagagaagaaggactgcgagaa

SEQ ID NO: 30114 - DNA, 408 bp, Zea mays
  Clone ID: LIB3059-052-Q1-K1-D5
ggcagcagcgctcgcttcacgggcgttcctggtagcagctctcgcttcgcgggcggtcctggcagcagcgctcgcttctcgggcattgctggcgccagattggacaacgacgaggagagtgaaaccaaggagaggccactggtgcttcgtaataagccgcctaggtggcacgaacagctgcagtgttggtgcctcaacttccgtggccgtgtgacaattgcctcggtgaagaacttccagctgatcgccgcggctaccccgccaccggcaggtgcgccaaccccctctcagcctgccccgtcagatcccgacaaggtgattctccagtttggcaaagtggcaagggatatgttcacgatggactatcgctaccctctctcggctttccaggcctttgccatttgtctg

SEQ ID NO: 30115 - DNA, 383 bp, Zea mays
  Clone ID: LIB3059-028-Q1-K1-G10
gggaacttcaatgagtattttggctttgccaccgatgtagatgcagtggtttacttgatgctggtaaatgatctaattcatggactttatcctgaggctgtaaccattggtgaagatgttagtggaatgcctacatttgcccttcctgttcacgatggtggggtaggttttgactatcggatgcatatggctgtggctgacaaatggattgaccttctcaagcaaagtgatgaaacttggaagatgggtgatattgtgcacacactgacaaataggaggtggttagagaagtgtgtaacttatgctgaaagtcatgatcaagcattagtcggcgacaagactattgcgttttggttgatggacaaggatatgtatgatttcat

SEQ ID NO: 30116 - DNA, 364 bp, Zea mays
  Clone ID: LIB3059-028-Q1-K1-G12
cgaaacccgctcgcgttttcttctttcagaaaacgaaatccactcaggagcgaggagggagggacagacgagggatagatcctcgggcttcacgcctacacaaccattcgtcccgatcccgaccagctttgagatcgcgatggctgacggccgctgctgcaccttactggagatcctcttcgccatcatcctcccgcccctcgtcgtcttcctccgattcggctgctgcagaatagagttctgcatatgcctgctgctcacaatccttggatactaacgcggaatcatctacgcgatctatagacgtgctgctcttgactctgaccatcacgagatggaatactacacccttgcttagagcatc

SEQ ID NO: 30117 - DNA, 336 bp, Zea mays
  Clone ID: LIB3059-028-Q1-K1-G2
cggacgcgtgggcgggctggcaagacagactacagggccaggataaggctgattaacgaagacaaaaacaagtacaacacacccaaatacagatttgttgtgcgatttaccaacaaggacatcactgcccaaatcatatctgctagtatagcgggtgatatggttcttgcttctgcctactcgcatgagttgccacgatatggtcttgaagttggtctgaccaactatgcagctgcctactgcactggccttctgttggctcgccgtgtgctcaagatccgtggtttggatcaggagtacgagggcaatgttgaggccactggtgaggacttctct

SEQ ID NO: 30118 - DNA, 287 bp, Zea mays
  Clone ID: LIB3059-028-Q1-K1-G3
ccgcatcaaggagggaaggcagctagttaacattccctcggtcatggacaaggtccaagcagggaaacacattgacttatacctcaacaaccctttgggtggtggtcctgcccgaagggttaaaccgaagaaacagaaaaaaggcttatggggccgctaagcttaagaagacgaagagtataaggccaacttaggattctgcgaccggaaatggttgaaatgctaagtggaaactttaaatggtgtgcccgaatgagtatggtcattggaaagaattccaaaaatct

SEQ ID NO: 30119 - DNA, 211 bp, Zea mays
  Clone ID: LIB3059-028-Q1-K1-G4
gtgatgctcggacccactgaaagcacatgatataaaaaatctacttaggcgtgtaacattgaccgagcatctgaagtcactgttacacgcctagtagtattttttgttcagacccaacgaaagcaatggaaaaaaaaatctactatgcgtgtatcagtacccatcgtctgagtcactgttactgatttgccttgcaaaatagaataaaact

SEQ ID NO: 30120 - DNA, 412 bp, Zea mays
  Clone ID: LIB3059-028-Q1-K1-G6
gaccaacaagcaacatagaaagtggaatccagtagcaacaacagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttcttcctactctcagcaaccacaatttc

SEQ ID NO: 30121 - DNA, 118 bp, Zea mays
  Clone ID: LIB3059-028-Q1-K1-H1
ctcgtgcggcatagccatccccaatgctaagcaagcgctctgcgtcgtcgcttcgctggctcttgctcttgtgtgtaacatatccagcttatgaataaattatgtggatcagttaatt

SEQ ID NO: 30122 - DNA, 407 bp, Zea mays
  Clone ID: LIB3059-028-Q1-K1-H12
gggaaaggttatggaaggtgcggatgaaattgagattgggcaagttgactgtggtgtgagcaaaccagtatgctcaaaggtcgatatacactcctacccaacattcaaggtgttttatgaaggcgaagaagtagtaaaatataaaggacctagggatgtggaatcgctgaagaacttcgtgttgaatgaagctgagaaagcaggcgaggcaaagcttgaagctgattgaggcaggggagtttcagcaagcatgtggcgagtggcgtagacaaggaacaatgctttgcaacattgtcttctatcctgtcatttacaaagccagtttacaggaaagaaatgaccttatgagctcgtatcagagtattcctcttacaaagtaactccgaatcagttcatagaagctgtac

SEQ ID NO: 30123 - DNA, 350 bp, Zea mays
  Clone ID: LIB3059-028-Q1-K1-H2
gtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcg

SEQ ID NO: 30124 - DNA, 412 bp, Zea mays
  Clone ID: LIB3059-028-Q1-K1-H3
cccacgcgtccgcctttcttcttcctaattcgtgatggtgaagctttgtcggatatgagagtacggattcagaagagacttcaagttcctgatgagcagtttctaaagtggaaatttgctcatgttacattcagtaagccagaatacctccaagattcagatattgtaatgaacagattccataaacagagacctgtttatggaggttgggaacaacaccttggattggagcatacagccaccaccccaaaaaggtcctacttaggcaacaaccagaaccgccattcttttgagaagcctgtgaggatttacaactaaagctaggaatactttttacatgcgatgaatgatgaacaggatatgaagcagtcttgttccaaaagcagtcttttggtgatgtacatggagcttt

SEQ ID NO: 30125 - DNA, 183 bp, Zea mays
  Clone ID: LIB3059-028-Q1-K1-H4
caactggtgtatatgaaactctggagttgaaggatggtggctctgactatttggggaagggtgtctccaaagctgtgaacaatgtgaattctgttattggacctgctctgattggcaaggaccctacagcacagactgagattgataacttcatggttcaacaacttgatgggaccaaaaatg

SEQ ID NO: 30126 - DNA, 407 bp, Zea mays
  Clone ID: LIB3059-028-Q1-K1-E5
tggctcgaccgacgcatgcgtgcacacaggggtcagcattcacaaccatactacgccaatcgcactcgcaacgacctagcagcattggctaccaggtatattataccattcttgcgtctcgttgcccttttagtgagcgcgataaatgcctacattatctcacattgctcactcagctcctacagccattattgcacagatacttcaacaacttacttcaatgacctactagcatccacacgcgctagcctacaggctactacttgcacttgcctcgagcgccttacaatagccagtcgtatatttgcagcaacaattgttgcaacatataacgctacaaccgatggagacgcatcagctacctctgcacaacctggcatctctgagccacctagctgcgtagtatc

SEQ ID NO: 30127 - DNA, 437 bp, Zea mays
  Clone ID: LIB3059-028-Q1-K1-E7
gcgtttcaagaaagcagatgctggcgaggctggatgtgtgcatgggaggaagagtgggtgaggagcttatatttggggaaagcgaggtaaccaccggttcctcgtctgacctaaactacgcgactaggctggcaagagccatggtgaccaagtatggtatgagtaagcgtgtgggtcttgtttcctacagtgagaatagtgttagcggccaaacaagtgtgattgataaggaggtgaaggaaattctggagaaggcgtacaataacgcaaaggcaattctgacaactcacgataaggagcttcatatgctagcgaacgcccttcttgagcatgagacactgtctggagcgcagatcaagaaattactgccacaggtggacaatagtaacaataagcagaagaaggctgccaaggtgccgcagaagacaccggcagcc

SEQ ID NO: 30128 - DNA, 394 bp, Zea mays
  Clone ID: LIB3059-028-Q1-K1-E8
gcgccatggtcgccgcccgcgaccgcgacgactggatcaacagcgtcgtggccgggctaggcaccggcgcgctcttccgcgccgctaacgggccgcgctcggcggtcgtcgccggggccgttggtggggttcttgctggcgccgccgccgctgccaagcaggttgggaagagatacctccccgccctctaaatctgattgcggtacttgtctctgccctgccatgccgtgatcaagggaaatcatttcgtcgcgtggatgttatttcttcgttctcgttaattatttgggaagagtcatgttcttctcgacattcctatatattgttgacatccatatgctggtactatatatgtcaaagaacgatctgatctcaccagatcacgaaatttttg

SEQ ID NO: 30129 - DNA, 414 bp, Zea mays
  unsure at all n locations
  Clone ID: LIB3059-028-Q1-K1-E9
acgacttctgcccagtgctgagcatgcagcaactgtaccggatcagcacgatgtactgcgacgacaagtttgggaccctgggcattccatcagaagtcgtctccagcatgcggaccaagatgatcgagggctcgtcgagcagcccgtcggcgcacgacgacatcaactcgttcctgctagacgatgacttcagcataccgttctccgtggatgacttcacgaagctgatagtgcacgtcgacgtagcggacatggatttgccaccgctcattcaggagagcagcggcggcggctccaaaatgggacattgaggagtgacaatatgcacgccttttttgtgtgtgttgcggtgatgtgcatagtgcgtgacatattgctctgagaccagngttttgtttttttcttcgtcgactg

SEQ ID NO: 30130 - DNA, 429 bp, Zea mays
  unsure at all n locations
  Clone ID: LIB3059-028-Q1-K1-F1
ctacaaacacagaagaatttcagagttgatcacctttcttttccattcgtaaattgttgttcattggtttcagctttcctgcttatccctactactctataagcacggtgtgtaggcgtncacaccgtgcaccatgttcttagttntggtagaattctttgtcttaaagctgactggaaacctcagcttaggggccctgatgctcggggaatcaagggaaatatggcacaactattgtccctggtctgtatgcaccagttcatctacatttctttgttgctcgtatggacatggcttgtgattgcaaattgaatgaggttcataaccaggtgggggttgccatctatttgcaccttttttaattgatcagattgcccactaaaatttgtttgcaatctaaatgggaccacaacgaaacgaattctaact

SEQ ID NO: 30131 - DNA, 407 bp, Zea mays
  Clone ID: LIB3059-028-Q1-K1-F10
cggacgcgtgggtctgactgcacctgaaagtttacaactgtatcttgatacacgtgtggagcagcttaaagttgctacagaactctccctttggcaggaagccttccgatcggtggaagatatccatggtttgatgaccatggtgaagaaaatgccaaaaccatctatcctggtggtctattatgcaaagttgactgagatcttctggatatcggacagccacttatatcatgcgtatgcgtggctcaagcttttcaacttgcagaagagctacaataaaaacttgtctcagaaggatctacagttaatagcatcttctgttttacttgctgcactatccgtgtcaccttatgacaaaaaatatggtgcatttgagacagagaatgagaaagagcgcaacatgcgtc

SEQ ID NO: 30132 - DNA, 393 bp, Zea mays
  unsure at all n locations
  Clone ID: LIB3059-028-Q1-K1-F12
ccacaccaccagatctgctgccgtccgcgcagaggacgagagcaacttcatcgggatgggggcggtggtgacggcggtgatcgcgatcgccgcggtggtgctcggctggatcaccatcgagatggcatgcaagccctgcctcgagaccggccgacgcgccatggaccgcgcgctcgaccccaaccacgacccggactcccccaccaacgccgccggcgcctccgccaacgagccgctcctcgccgacctctccgcctccaccgcgccacccgcaaaggccatctgaatctcatcacctcccagagcgagccagaggcggaccacccttttcccctcgccttgtaatcttgcttctttctatgtcattntgtgcttatgagtttgctattaatg

SEQ ID NO: 30133 - DNA, 385 bp, Zea mays
  Clone ID: LIB3059-028-Q1-K1-F2
cccacgcgtccgcccacgcgtccgagagatttggaaagtttcagagaattttttggaggtccagcgttccgggctgatggtctgaagatttatccaacacttgtgattcgtggaactggtctttatgagctctggaaaactggcagatatagaaattatccacctgagctgttggtggatattgtggcaagaattctgtctttggtaccaccttggacacgagtgtatcgggtccagagagatattcctatgcctcttgttacttctggtgtcgagaaaggtaaccttcgcgagcttgctttggctcgaatggaagatctgggcttaaaatgccgggacgtcagaacccgtgaggcaaggattcaggatatccatcacaagatcc

SEQ ID NO: 30134 - DNA, 379 bp, Zea mays
  unsure at all n locations
  Clone ID: LIB3059-028-Q1-K1-F3
cgaagggactcactttatgattccatggtttggaccacccatcatttattatggtccgggttgaaccgattttggtgaaaagtccttctggaattcggaatctcaaatgtgaaaatgtctccggtccttcaaggctatgccaaagctccactattacgactctggagagaacttaatgagagagtttgccttcaatcatccatgaaacactgaaagctgttgttgctcaatataatgctagtcagctgatcacacagagagagactgtgagtagggagattaggaagatactgactgagagggctagattcttcaacattgctcttgatgacgtctncatcacaagcctgagctttggaaaggagttactcatgccatt

SEQ ID NO: 30135 - DNA, 407 bp, Zea mays
  Clone ID: LIB3059-028-Q1-K1-F4
caattcttcaaccctacaggatccaacaggcaatcgcagcaggcatcttacctttatgaccgttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggctgcattgaactctgctgcttatttgcaacaacaactaccattcagtcagctagctgctgcctacccccagcaatttcttccattcaaccaactggcagcattgaactctgctgcttatttacaacagcaacagctaccaccattcagccagctagctgatgtgagcccttgtgccttcttgacacaacaa

SEQ ID NO: 30136 - DNA, 195 bp, Zea mays
  Clone ID: LIB3059-028-Q1-K1-F5
acccactcatccgcccactcatccacacactcaaccttcatatccacacatccatcatcaataaccgtcgcactatttaaaaattttacacgactatccatctcactctatctatcatacaacaacatcaacaaccacccacatacaaactacaaccatatcaaacccatactcccatatatacacaacaacaca

SEQ ID NO: 30137 - DNA, 114 bp, Zea mays
  Clone ID: LIB3059-028-Q1-K1-F6
ccaacaacccatcattggtggtgccctcttttagatttcttatgagttatagttgaataataaagttttttatctgatgtttgtggcttcccagaaataagaaagtacatttct

SEQ ID NO: 30138 - DNA, 410 bp, Zea mays
  Clone ID: LIB3059-028-Q1-K1-F7
ctgggataccgcagggcaagagaagtttggtggcctcagggatggatactatatgcatggccagtgtgcgatcatcatgtttgatgtaacttcaaggcttacttacaagaatgttcctacgtggcatagggacctgtgcagggtctgtgaaaacatccccattgtcctctgcggtaataaggttgatgtgaagaacaggcaggtcaaagccaagcaggttactttccacaggaagaagaatctgcagtactatgaaatttctgccaagagcaactacaactttgagaaacctttcctgtaccttgcaaggaagctggctggtgatccgaaccttcactttgttgaagctgttgctcttaagcctccggaagttaccatcgacatggctatgcagcagcagcatgaagctg

SEQ ID NO: 30139 - DNA, 359 bp, Zea mays
  Clone ID: LIB3059-028-Q1-K1-F8
accacacgtccgtttcgttagacagagtcatcgcaccggacgcaacacgtacgcgagggagcgcaagctatagccgacgccatggcgagcaagcacctggacctcgtcgcatgcctcctcctggtcctgcccaacgtctcggtcgccaacgacctcgactactgcagtaagaaggactacccggtgaaagtgaactgcgtgcacaccctgcacgagccgaccaaacccggcaagcccttcagtatcaagatcaacgctgctactgatgaacccatcgccaacggcaagctggatattgacatcaagcatctatagttctacgtgcactcggagaccatcgacatctgcggtgagactta

SEQ ID NO: 30140 - DNA, 349 bp, Zea mays
  Clone ID: LIB3059-028-Q1-K1-F9
cccagcaatttcttccattcaaccaactggcagcattgaactctcctgcttatttacagcagcaacaactactaccattcagccagctagctggtgtgagccctgctaccttcttgacacaaccacagttgttgccgttctaccagcacgctgcgcctaacgctggcaccctcttacaactgcaacaattgctgccattcaaccaacttgctttgacaaacctagcagtgttctaccaacaacccatcattggtggtgccctcttttagatttcttatgagttatagttcaataataaagttttttgtctgatgtttgtggcttcccagaaataagaaagtacatttct

SEQ ID NO: 30141 - DNA, 354 bp, Zea mays
  Clone ID: LIB3059-028-Q1-K1-E4
gaaagtggaatccagtagcaacaatagatcaacaatggcgaccaagatattttccctgcttatgctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgtttcaacaatcgccagccctatctttggtgcagtcattggtacaaaccatcagggcacaacagctgcagcaactcgtgctacctctgatcaaccaagtagc

SEQ ID NO: 30142 - DNA, 375 bp, Zea mays
  Clone ID: LIB3059-028-Q1-K1-C8
ctagcaacatagaaagcacaatagtgtaccaacaatggcagccaaaatattttgcctggttatgctccttggtctttctgcaagtgctgctacggcgaccattttcccgcaatgctcacaagctcctatagcttcccttcttcccccgtacctctcaccagcagttgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaaacatcagggcacagcaactacaacaacttgtgctagcaaacgttgctgcctactctcagcaac

SEQ ID NO: 30143 - DNA, 417 bp, Zea mays
  Clone ID: LIB3059-028-Q1-K1-C9
cccacgcgtccgcccacgcgtccgggcggccatcagggacgtccaggaagcatgcgtgtatgatggctacgtcctcccgaagctgtacgccaaggtgcaccactgcgtctcgtgcgcgatccacgctcacatcgtccgcgtccgatcccgtgagaagcgcagggaccgcaagccgccggagcgcttcaggcgcagggaggataggcctgctggtggacaaggaggcccccgccctggtcctggtgctgctgctccagctccagctccagcacctgttgctgctcgcccataggctttagcttttcgaccgtgttaagtcttctgcccactcagtttcggaattgtcgcctatgggtgtgtgaagctgctatattagagttactttttgtctaaagcctgaacattttcaaagaattt

SEQ ID NO: 30144 - DNA, 398 bp, Zea mays
  Clone ID: LIB3059-028-Q1-K1-D10
gtgctcggcaggggaacggtgcgaagcggaggagcggcgatgcagatccgggtgcagtgcgcgtgcggcgagtcgtcgtgcccggaatgggccgtcgtggagctgcagggcgtggtgcagccgcaggcctccttcgccggcgacatccggggactccacatcggccgcctctgctcctccccttccccagcctccgcctcgtccaaggcagggttcaccttcacggtggggtaccacgagctcgccggcacaaaggtgacgctcaagaagcccctgctggtgctcaggaagaagaaggttaatgctggtgctcaggaagaagagccaccgacggcggcggaggtggagctggaggtgatcggcatcatccggcacaagatcctattcaagggaccgcc

SEQ ID NO: 30145 - DNA, 416 bp, Zea mays
  Clone ID: LIB3059-028-Q1-K1-D12
ggcgtcttcgtactcgcctacctccgcggctcaaacctttcccccttctcccagtgtggcgccgccgctccatcccgtaacgcgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgaggactggcacctaccgccagctcttccaccctgagcagctcatcagtgggaaggaggatgcagccaacaactttgcccgtggtcactacacc

SEQ ID NO: 30146 - DNA, 219 bp, Zea mays
  unsure at all n locations
  Clone ID: LIB3059-028-Q1-K1-D3
attcctctgaaatgagctgttacccggctttgtagtctcccaagagtcaattggcaatggtcggtcaacttttctaacttgtttgaacaagttaaattgcccagatattttggtttggtccattccagctcaagaattcaaagctaagcattgcacaattatgctngntttgttggaaagtttttggagttaattcatatcttaagcntgagtttgctt

SEQ ID NO: 30147 - DNA, 441 bp, Zea mays
  Clone ID: LIB3059-028-Q1-K1-D4
caactagcaacatagaaagcacaatagtgtaccaacaatggcagccaaaatattttggcgtccttatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaagaaaccttgctgcctactctcagcaacagcagtttcttccattcaaccaactggctgcattgaactctgcttgctatttgcaacaacaac

SEQ ID NO: 30148 - DNA, 378 bp, Zea mays
  Clone ID: LIB3059-028-Q1-K1-D6
ataagggtcggtgagaaggaaaaggccctggaacagcttaaagtcactgaaggagaagctgtagctgttggccaaaagatggatcttgtgttccacactttgcagattggttttttctacatggattttgatctgatatcaaaatccatcgataaggcaaagaacttgtttgaggaaggaggcgattgggagaggaagaacaggttgaaagtatatgaaggcttgtactgcatggcaaccagaaacttcaagaaagctgccagcttatttttagactcgatttcgactttcacaacttatgagatattcccatatgatacgttcatcttctatacagtcctcacaagtgtcatcacattggatcgtgtatctctgaaa

SEQ ID NO: 30149 - DNA, 437 bp, Zea mays
  Clone ID: LIB3059-028-Q1-K1-D7
tggcggcggcgaggagcctgcttctgaggcacctccgcttggcggcggccccgtggggggcgtccgtgaggccgacggcgtcgttgcatgaggccctgtgggggcagcggtggatgtcttcggaggatgccaagggctctttcctggacaagagcgaggtcactgaacgcatcatcaaggtcgtcaagagcttcccgaagatcgatgacccctccaaggtgacaccagatgcccatttcaagaatgatcttggcctagacagtttggatgcagtggaggttgtcatggccctggaagaggaattcagattcgagatacctgacaatgaagctgacaagattgactccgtcaaagttgcagttgacttcattgcctcacacccgcaagcgaaatgataaagatgcgttgcctggtatagcaaagctatatcgtcatta

SEQ ID NO: 30150 - DNA, 390 bp, Zea mays
  Clone ID: LIB3059-028-Q1-K1-D9
gagagtggaaaccagcgtcagcattggagcaactgaggagaccctgatatagaacttggttatgcttcatgctgtttctacatacgttgctgacgccacaatgctcccttaatgctaacacgctcctatagctatcattaatgcggcatacgttccatacattatagctccaatatgtgaaaacccagatattcaaccatatctgcttcaacacgcactcgccataagcagcatacctaaatcgcccttgtggacacaacatttgtcaatcctatctttagcgcatgcatcggaacataccatcatggcacaacatcagtagcatctcgtgctacctctgatcaactcaagtagctctggcaaacctttctacatactgtcagcaacgac

SEQ ID NO: 30151 - DNA, 390 bp, Zea mays
  Clone ID: LIB3059-028-Q1-K1-E10
ctcgatcgacaggatcaacgagcgtgttgaagagaaagaaggaattactaccgtgcagaaaaggctgatctatgctggttagcagcttgctgatgacaagaccgcaatggactacaacatcgagggtggatctgctatacatcttgtacttactgtgaggggtggacactagtctaaacctgatgaactatcaataagataaactgttgtgttggctgcgaaatgtgcacgcctgatgatgaacttgcaaggagataataacaaagtatcagatttgctcatgttcccaatggaaggggctgtgttccaagttatggtctgatatggaagcgatgcagaatatgatgtgtcgacgctgacccattatgatgatttgattagaaccttact

SEQ ID NO: 30152 - DNA, 383 bp, Zea mays
  Clone ID: LIB3059-028-Q1-K1-E12
cccacgcgtccgcggacgcgtgggctgccgggagctggcggacatcccggcgtactggcggtgcacggcgctgagcatcctcatggacggcgcgatcccgccgggcccggacgcgcagctggagggccgcctagaggacctgccgggctgcccgcgggaggtgcagaggggattcgccgccaccctcgtcacggaggccgagtgcaacctggccaccatcagcggcgtcgccgaatgcccctggattctcggcggcggaacgatgccctccaagtaactgcgaagagcatagtgcatgaggaatgagcttgtagctagctcatatgtctgaataataagcacagcaagaagatgaatgcatttctcggatcgttcatccggaa

SEQ ID NO: 30153 - DNA, 406 bp, Zea mays
  Clone ID: LIB3059-028-Q1-K1-E2
cccacgcgtccgcatggtgaaccctgccgcctacctacaacagcaacaactgctttcgtctagcccgctcgctgtggccaatgcacctacatacctgcaacaacaattgttgcaacagattgtaccagctctgactcagctagttgtggcaaaccctgctgcctacttgcaacagctgcttccattcaaccaactgactatgtcgaactctgctgcgtacctacaacagcgacaacagttacttaatccactagcagtggctaacccattggtcgctgccttcctacagcagcaacaattgctgccatacaaccagttctctttgataaaccctgtcttgtcgaggcagcaacccatcgttggaggtgccatcttttagattacatatgagatgtactcgataatg

SEQ ID NO: 30154 - DNA, 423 bp, Zea mays
  Clone ID: LIB3059-028-Q1-K1-E3
acccacgcgtgcgtggacgcgtgggtcagcattcaaaaacacactaagcgaagcgcactagcaacgacctagcgggaatggctaccaagatattagccctccttgcgcttcttgcccttttagtgagcgcaacaaatgcgttcattattccacagtgctcacttgctcctagtgccagtattccacagttcctcccaccagttacttcaatgggctttgaacatccagccgtgcaagcctacaggctacaactagcgcttgcggcgagcgccttacaacaaccaattgcccaattgcaacaacaatccttggcacatctaaccctacaaaccattgcaacgcaacaacaacaacaacagtttctgccatcactgagccacctagccgtggtgaaccctgtcacctacttgcaacagcagctgc

SEQ ID NO: 30155 - DNA, 350 bp, Zea mays
  Clone ID: LIB3059-028-Q1-K1-C7
cccacgcgtccgcccacgcgtacttccacgcgtccgagacaatgctgatgccttgatgcttatcgttttctgtaatgttcgtaaataggctcttcgtcgccttgttgtctgactgctacattgtcaatatttcaaaacatacgtatttgaatcaaatgtctggattggttatgcctaaaaaaaaaataacttaattggatacgaacacataaataaaaaaaaaaaaatacaacaactaaaaacttaaaaaaataatattacaacaacaaaaaaaaacaattacaacaactataaataaacggggctgacatttcaagaaatcacaacttaacatcatcactagcaactac

SEQ ID NO: 30156 - DNA, 393 bp, Zea mays
  Clone ID: LIB3059-052-Q1-K1-C1
cggactcgtgggcacgtatatggacttgcaatcaaggtgaactgggcatatgcaagtacgcggagggaggatacgtcagggcatttccatatttttgttggtgatttaagttctgaagtgaatgatgcaactctttatgcctgtttctcagcatatccttcttgttctgatgctcgagtcatgtgggacaacaaaactggacgctccaggggttatggttttgtctccttccgtaatcaacaggaagctgaaactgctataactgaaatgactggaaaatggcttggaagcagacaaataaggtgcaactgggcaacaaagaacaattcggaagagaaaccagaaactgacaatcataacgcagtcatactaacaaatggtagcttcaacaat

SEQ ID NO: 30157 - DNA, 401 bp, Zea mays
  Clone ID: LIB3059-052-Q1-K1-C10
cgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcggcgttggcagcaccccgatcctgggccagtgcgtcgagtttctgaggcatcagtgcagcccga

SEQ ID NO: 30158 - DNA, 367 bp, Zea mays
  Clone ID: LIB3059-052-Q1-K1-C11
gtggctgccaacaagtcatgctcatgcaaaccgatgaatctatctctgtatcatcggtctcggttgcttgctagtccagactccagacatggctatatatatatagctggtgctaataaataggagtataatcgtcatatcgatcggttgcgtgtggaatgccaatcatgtgtgtaatctgttggcaaataacaaacctctgttcctccctgctgctgttgtccgtgcgatcatgattcagaactggcgtgggcgccaataactcagaagagagacttgctgtatatgcatgctagtatgcattgtccctctcttgtcaatgcttgtaatcgaactttattatgaaaaccaaaacgagaatccaacc

SEQ ID NO: 30159 - DNA, 380 bp, Zea mays
  Clone ID: LIB3059-052-Q1-K1-C12
gggagattatgttgaccgtggttactactctgtcgaaactgtcacacttttggtgggttgaaaagttcgttatcctcagaggatcaccattctcagaggaaaccatgaaagccggcagattactcaagtgtatgggttctatgacgaatgcttaaggaagtatggaaacgcaaatgtctggaaaacctttacagatctatttgattacttccccttgactgcattggtcgagtcagaaatattttgcttgcatggtggattatcgccatccattgagaccctcgacaacatccgcaactttgaccgcgttcaagaagttcctcacgaaggtccaatgtgtgatcttctgtggtctgatccagatgatcggtgtggttggg

SEQ ID NO: 30160 - DNA, 136 bp, Zea mays
  Clone ID: LIB3059-052-Q1-K1-C3
tctcaacacttacacatttaaccataatctcaattcatgccttacatcaaaacatacctccctttcataccttgcttcatctaattacccatatttcattaatcttacactgcattaactcaaatctccgactaac

SEQ ID NO: 30161 - DNA, 347 bp, Zea mays
  Clone ID: LIB3059-052-Q1-K1-C4
ttcccgtgctctacccactcttcctcccactcgtcctataaataataaagtccatttctaggaagccacaaacatcatacgaatagctttattatttctgtgacgccacaattctgatctcgatcttcctctcactatctatgttcaccctcttacaacttctacaatttcttccattcaaccaacttgcttttacaaacccatcatctttctaccaacaacccatcattgctggtgccctcttttagatttcttatcacttatagctcaatactaaagcttcttgtcttatatttactgcttcctatatattatccattccatttctaatcaacttttctctcaca

SEQ ID NO: 30162 - DNA, 334 bp, Zea mays
  Clone ID: LIB3059-052-Q1-K1-C6
actcatccaaaaaaaatttaaattaaaaaaaaaaaaaaaaaaaaaaaagataagatttaatttcaaactagccaacccatccaaactaacaaacacatacatacaacaacataacactactataaaacaaccaaaattcaattcactacccatcatttaacaacaacataacaataaaaaaccctttcataacccaactaaatcaccttacaccacatccccctttctccaactaaccaaaaaacaaaaaaacccacaccaatcacccttcccaacaattacccaacctaaataacaaataaaacacaccctaaaactacacataaaacccaac

SEQ ID NO: 30163 - DNA, 383 bp, Zea mays
  Clone ID: LIB3059-052-Q1-K1-D1
cggacgcgtgggcggacgcgtgggtgctgagagtaggcagcagtttcttccattcgaccagctggctgcattgaactctgctgcttatttgcaacaacaactaccattcagtcagctagctgctgcctacccccagcaatttcttccattcaaccaactggcagcattgaactctgctgcttatttacaacagcaacaactaccaccattcagccagctagctgatgtgagccctattgccttcttgacacagcaacagttgttgccgttctacctgcacgctgcgcctaacgctggcaccctcttacaactgcaacaattgctgccattcaaccaacttgctttgacaaacccaacagcgttctaccaacaacccatcattg

SEQ ID NO: 30164 - DNA, 374 bp, Zea mays
  Clone ID: LIB3059-052-Q1-K1-D10
cgcacgcgtccgcccacgcgtccggtaaattcgcaggaacaattagcttagcctggggcgagaatcgatatgatttatcctaaaagaaggtgttaagatgatgggacatggctttcaaaactttcagctgttgcctgctggtagccaagacacactgaatccgaaggaaggcgttgaagggtagctgttagtgattttgtgatataaagagtactggggcagttagcatcggcatttttagcggatttaagttcttgttatgtatatctgtcttctgtcttcatcagtagtgctgcttagtacctcactctctcgtcagcaggatatttctatatattgtctgtacttggtagatatatgtattggttgatcct

SEQ ID NO: 30165 - DNA, 408 bp, Zea mays
  Clone ID: LIB3059-052-Q1-K1-D12
cggacgcgtggggcaaattgcaccaagaaatccatcgagaggccgtcgacaggggagattgatggcgtcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgcctagaggacctgccgggctgcccgcg

SEQ ID NO: 30166 - DNA, 327 bp, Zea mays
  Clone ID: LIB3059-052-Q1-K1-D4
agcttgcgcactaacaccctgtgggtcaacctcaaagctatctatacactcgtaggggctgccgcacttaagagggaaagcttatcaaaccccagtgaaggtgatggtgtgaaagtcgctcgactcctaaccgaaactggttcagctctacgattgttcgacataacgactggaactaatgttactcgatcaaggcttctcccagtgacagctacatgtgatctgtagctcgtgcagcctgatctttacaccttgacagaaggcttcgtcattcgctgcccattctgagcgatcttcagctaacgcttctattgagctaggacctga

SEQ ID NO: 30167 - DNA, 416 bp, Zea mays
  Clone ID: LIB3059-052-Q1-K1-B9
agcctgtggagaagtgcttgcgcgacgccaagatggacaagagcagcgtgcacgacgtcgtgctcgtcggtggctccacccgcatccccaaggtgcagcagctgctgcaggacttcttcaacggaaaggaattgtgcaagagcatcaaccccgacgaggctgtggcgtacggcgccgctgtccaggctgccatcctcagcggcgagggcaacgaaaaggtacaagatctgctcctgctcgacgtcacgccactgtctctcggcctggagactgcaggtggcgtcatgacggtgctgatcccgaggaacaccaccatcccgaccaagaaggagcaggtcttctccacgtactccgacaaccagccgggcgtcctgatccaggtgtacgagggtgagcgcgcgaggaccaaggacaac

SEQ ID NO: 30168 - DNA, 400 bp, Zea mays
  Clone ID: LIB3059-052-Q1-K1-A5
agcgtcctgctggtagacgtgctggtggaatgcagcagcccatgccaatgggtgggcagcaacaggtgttccctagaggtggtcgtggctatcgctatcctactggacgtggaatgcctgatcctggcatgcacagtgttggtgctgtgatgccaccttcatatgagatgggagggatgccaatgagagaagctgccccccaacctgttccaattggggcgctagccactgcacttgctaacgccccaccagatcagcagagacttatgcttggtgagaacctgtatcctcttgttgaacagctggaacgtgagcaggctgccaaggtcactggcatgcttttggagatggatcagacggaggttcttcacctgctggagtcgccagatgctctgaaagc

SEQ ID NO: 30169 - DNA, 421 bp, Zea mays
  Clone ID: LIB3059-052-Q1-K1-A6
agtttccaagatctagtttctttcaaacaacccccggcagatgataaaatagctctgattgacctaactactaacagggaattgccttctcagatggatctcgacatcactgatgcagagacaaaaaggtctaatgcggtctggaaaaatcttgagctcgcaaccatgaaattgtcccaagaactggcagagcaattgcgcctggttatggaaccaactcttgctagtaagcttcaaggggattatagaactggaaagagaataaacatgaagaaggttattccatatattgcgagtcatttccgcagggacaagatatggttgcgccgaactaagcctaataaacggaattaccaagtggttattgctgttgatgactctagaagtatgtctgagggcaaatgtggaaaatttgctatcg

SEQ ID NO: 30170 - DNA, 428 bp, Zea mays
  Clone ID: LIB3059-052-Q1-K1-A8
atcaaggacaagcttatattccctttcgtagacctcgatagatttccagagcaccggggtcatctatcaaggacaagcttatattccctttcgtagacctcgacatcaaatattttgacctcgggcttccacaccgtgatgctaccgacgacaaagtcacagtggaggctgcggaggccacactcaagtacaatgtggctatcaagtgtgccaccattacaccagatgaagcaagggtaaatgagtttggcttgaaggctatgtggaagagcccaaatggcacaattaggaatattctgaatggcactgtgttcagagaaccaatcatctgcaaaaacatcccacggcttgttccagggtggacaaaacccatttgcatcgggaggcatgcattcggtgatcagtaccgggcaactgatgcagttatc

SEQ ID NO: 30171 - DNA, 388 bp, Zea mays
  Clone ID: LIB3059-052-Q1-K1-A9
ccaactagcaacatagaaagcacaatagtgtaccaacaatggcagccaaaatatttggcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcacaacaactacaacaacttgtgctaacaaaccttgctgcctactctcagcaacagcagtttct

SEQ ID NO: 30172 - DNA, 424 bp, Zea mays
  Clone ID: LIB3059-052-Q1-K1-B1
cgcacgcgtccgcccacgcgtccggtgactcccatggctccggccatgtcggcgcggttcagaagaataaccttcagcaacctgtttgtccgtcgggctggcccaggcagcacggagctgaccgtggagggaaggccatccgaccagctgggcaggagaaacctcactgacagccccgtatttgacggccgtggccctgacgccagcctcgtggctcgcgtacagggagtcgctacccagatgggcgacgtgcgccagttgtacaccgtcgtgttccaggagaggccgctcaagggctccacgctcgtcaccgaaggcgcgatgacagaagggtcagacgagtgggcgatctacggtggaactggagtgttcgcgatggcgagaggcgtcataaggagaacgtttcttgccgacacgagccggc

SEQ ID NO: 30173 - DNA, 429 bp, Zea mays
  Clone ID: LIB3059-052-Q1-K1-B10
gctcgatagaggaaagtccagaagaggcagatgggaaacaaggtatcataagaatcgctgtttgggcaagagacagaggatcatcgaatgagatcagtgaagcaagaatggtgagagacaagacagaggagggctgggaatttcaattagctgaaaaacttaaaggtttaagttataacatgctagaaccaggtgaagtgaggatagatgcagatataaaggatgggggtatgatgctgataactgcattgagtccttatgcaaactggcttcaaggctatgctgatgttctcctgcaggttaaaggcactgttgatcagcctgttgttgatggatcagcaacgtttaaccgggctattgtgaactctccttttcttcggacaccattgacaaattttgcgggtacaattcaagtcatattcaacagac

SEQ ID NO: 30174 - DNA, 390 bp, Zea mays
  Clone ID: LIB3059-052-Q1-K1-B12
ctggaagggccctgccaagaactgggagaacgtgctgctcagcctcggggtcgccggcggcgagccaggggtcgaaggcgaggagatcgcgccgctcgccaaggagaacgtggccgcgccctgaagagttcggcctgcagggcccctgatctcgcgcgtggtgcaaagatgttgggacatcttcttatatatgctgtttcgtttatgtgatatggacaagtgtgtgtagctgcttgcttgtgctagtgtaatgtagtgtagtggtggccagtggcacaacctaataagcgcatgaactaattgcttgcgtgtgtagttaagtaccgatcggtaattttatattgcgagtaaataaatggacctgtagtggtggagtaaataatccctgct

SEQ ID NO: 30175 - DNA, 444 bp, Zea mays
  Clone ID: LIB3059-052-Q1-K1-B2
cgcactcgttcgcccacgcgttcgcccacgcgtccgggctagttgtgcaagcccttgatcgtgctgatgagagccaaaagcgcattctatttgaaaattatggcaagaaagatccagcctgtgtggcaaaagtgaagaacctctacaaagaacttgacctagaggcggtatttcaggagtacgagaatgagagctacaagaagctgattgcagacattgaagcccagccaagcattgcggttcagaaagtgctgaaatccttcttgcacaagatctacaagaggcagaagtagggtgctcttggataaacgagctcaggagtcgttactccttcgcatgcttgacataaccggacttcctcacctggttgctctagtatgatgtggagcgtctagttaaaaaaaatcgatgtagtatgaagcaccttgctgctctgaatattaa

SEQ ID NO: 30176 - DNA, 280 bp, Zea mays
  Clone ID: LIB3059-052-Q1-K1-B3
cccacgcgtccgcggacgcgtgggatctctctgatctggtctgttcggccgccctggctccgtcatcgtcgactccccctgcgtccgttcctttggatctgaataagatggtggtgatctgagtggtggtcttagtttatcatgtatcgctcgcagtttaatttagcggtttaggtgtggatctgtgaaccccatggcgcctctgcttgattcgtgtttcacctgttatgttctgagattcatgataatgctatgagaactgaaattcccgtttcatgct

SEQ ID NO: 30177 - DNA, 205 bp, Zea mays
  Clone ID: LIB3059-052-Q1-K1-B4
gcgcactcgttcgcccactcgtccgcttctctagtatttatttacttatattaaactgcatagggtttgttaaatgttatagattccaggagacagaaatcgagcgttcgatcggcgcgtcctgtgatttctgtcattctgagctatgaacatgtttgctttaatcatgttatcggattcagatgcattaattaatcagtttggt

SEQ ID NO: 30178 - DNA, 433 bp, Zea mays
  Clone ID: LIB3059-052-Q1-K1-B6
cgcactcgtccgcccacgcgtccggcaacatagaaagcacaatagtgtaccgacaagtgtagccaaaatattttgcctccttatgctccttggtctttctgcaagtgctgctacgacgaccattttcccgcaatgctcacaagctcctatagcttctcttcttcccccatacctctcaccagcgttgtcttcagtatgtgaaaacccaattcttcaaccctacaggatccaacaggcaatcacagcaggcatcttacctttatcacccttgttcctccaacaatcatcagccctattacatcaattacctttggtgcatttattggcacaaaacatcagggcacaacaactacaacaactcgtgctagcaaaccttgctgcctacgctcagcaacagcagttacctttggtgcaattgttggcacaaaacatc

SEQ ID NO: 30179 - DNA, 434 bp, Zea mays
  Clone ID: LIB3059-052-Q1-K1-B7
cccacgcgtccgcccacgcgtccgctgacgcgtgggcgcgccgccgccggcgccgggactgaaggaagaggaggagcaaggagcacgacgcgatgggccactccaacgtttggaactcgcaccctaagaactacggccctggctcccgcgtctgccgggtctgcgcgaaccctcacggtctgatcaggaagtacgggctcatgtgctgcaggcagtgctttcgcagcaacgccaaggacattggtttcatcaagtaccgttgaagaggccactgtgctgctgcggagaacttcctacatcaaagaaatgggtccttcattagaaggcctaatttatgcgctttagctttttgttcagaacttgagactcatgtgttaaactcgacttgttaaagttttgatggctactttgtgcttgttggaccagctataatc

SEQ ID NO: 30180 - DNA, 321 bp, Zea mays
  Clone ID: LIB3059-052-Q1-K1-B8
ctatactatactctaggaagcaaggacaccaccgccatggcagccaagatgcttgcgattgttcgctctcctagctctttgtgcaagcgccactagtgcgacccatattccagggcacttgccaccagtcatgccattgggtaccatgaacccatgcatgcagtactgcatgatgcaacaggggcttgccagcttgatggcgtgtccgtccctgatgctgcagcaactgttggccttaccgtttcagacgatgccagtgatgatgccacagatgatgacgcctaacatgatgtcaccattgatgatgccgagcatgatgtc

SEQ ID NO: 30181 - DNA, 430 bp, Zea mays
  Clone ID: LIB3059-052-Q1-K1-A3
cccactcgtccgacacaatagaccactgatttcacaatgaaaagggagacaatgcgttcatggctagaactgttgcttgcaacacaattctttacgacttgtgctaaccatcttcttgctagtcgcaatgaatgtaacctattttgcacccagtgtgagaccaaaccagctgctttctgtaactattgtcgttcaagtgatcattccacccaccgtgtaatccagataaggcgttcatcgtaccatgacgttgtgagggtgtccgagattgaggatatccttgatgtcagcgatgtgcaaacttatgtaatcaatagtgcaaggattgtattcctgaatgagcggccacaactgcgtgcttctagtgtccccatttgtaaggcacccacatcatcaacacataactgtgagacatgtaaccgtgtgctac

SEQ ID NO: 30182 - DNA, 393 bp, Zea mays
  Clone ID: LIB3059-049-Q1-K1-H1
agcgcacttactcccaaacggagaactttacaccatgaaggagctgatcgatggacttgctctgatggcgctgcctggcagcgcacgctccagtacaagccgcggctggcgctgccagacacaaccgtttgatctaccgcctcaaggctatatgccgtctccgctctatctgccgccggagcaacatccagaacgacggcaatacccaactcaagcaccgcagctaaccccgtgccatcagctccgatcctgatgcgtcagcagcgtcggccgcccgttcctgcgccagtgcgtcgaaggactgaggcaccactgcaatccggcggcgacactgtaccgctcgacacagtgccaggcgctgcatcagcagtgctgtcaccagatcacgcatgt

SEQ ID NO: 30183 - DNA, 164 bp, Zea mays
  Clone ID: LIB3059-049-Q1-K1-H10
ccgacgcgtccgcccacgcgtccgcctttgcgttcgcccacgcgtccgcccacgcgtgcgagcaaacatgctgagacatttagttgaacgaacctgagttgttccgagatttctgtcgggattattcaattggaatttttgaagcttggtattctattggatct

SEQ ID NO: 30184 - DNA, 440 bp, Zea mays
  unsure at all n locations
  Clone ID: LIB3059-049-Q1-K1-H11
cacagttcctccgaccagttacttcaatgggcttcgaacacctagctgtgcaagcctacaggctacaacaagcgcttgcggcgagcgtcttacaacaaccaattaaccaattgcaacaacaatccttggcacatctaaccatacaaaccatcgcaacacaacagcaacaacagttcctaccagcactgagccaactagatgtggtgaaccctgtcgcctacttgcaacaacaggtgcttgcatncaacccacttgctctggcaaacgtagctgcataccaacaacaacaacaattgcaacagtttctgccagcgctcagtcaactagccatggtgaaccctgccgnctacctacaacagcaacaactgctttcatctagccctctcgttgtgggtaatgcacctacatacctgcaacaacaattgctgcaacagattgta

SEQ ID NO: 30185 - DNA, 286 bp, Zea mays
  Clone ID: LIB3059-049-Q1-K1-H2
aaaacacatgctactacacgtagaaagttacacattgaagctgcatccacaacgcatgcatcggggggcgttgcaacgctctgtacaagaccacctaatgcgacgcatattccactagacaggactccaggtatgcacattcttaagacgaacccatacatgcagtactgcataatggaacatacgctcagtagcttgattactcgacagtccatcatgctaaatcccctggtggacatacctcatcacacgatgccaaagatgacgcctcagatgatgacgccta

SEQ ID NO: 30186 - DNA, 439 bp, Zea mays
  Clone ID: LIB3059-049-Q1-K1-H3
ctactatactatactctaggaagcaaggacaccaccgccatggcagccaagatgcttgcattgttcgctctcctagctctttgtgcaagcgccactagtgcgacgcatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtcttgccgagcatgatgtcgcaaatgatgatgccacaatgtcactgcgacgccgtctcgcagattatgctgcaacagcagttaccattcatgttcaacccaatggcca

SEQ ID NO: 30187 - DNA, 423 bp, Zea mays
  Clone ID: LIB3059-049-Q1-K1-H5
gtgaatatggtcagccatccagttcccatctcttctacttctctactactacttatggacctaacgtaggcgtccacactcaaaattggtgcacggttctgcctttctccacgcgctggccgcgaatctcgtcggtctaccaaatccgtcgcgaatctcgtccacaaaacttccagccatggctgccgtgaccaatccatggcagccgcgccctggtccctcgaccgcgccggcttccatccatggtgcttcttcttgttgtggtgttcggatcgcagtccactgaccgaaccgaaccactgttcgacggagcagatgacacgatggccatcttcctggcgctgcggtcgccgaagctggaggtgtcgggcctcaccactaccttcggcaacgtccacaccgccctcgccacgcgcaacgcgc

SEQ ID NO: 30188 - DNA, 437 bp, Zea mays
  Clone ID: LIB3059-049-Q1-K1-H6
gtggaatgtcaaataagatgtgggacagccttgttgagcatgcaaagacatgtgtcttaagtggaaagcattatgtatactatgctagagactcaagaaacgtgggtgcaatattcaataacatctacgagttcactggtttgattgccgatgatcagttcatttcagctgaaaatctcacagacaaccagaaggtctatgctgatgcattggtaaagaaagcatatgaggactggatgcaagttgtagaatatgatggcaaggcactcttgagcttcaagcagaaaaagaaaactgtcacgacaagaagtgacgttgcatctgcctcaacaagcaatcctgcttcatatggttcggccaattcacagaaacagttgtctcttccagcaaaagctggacaaacttcctcagcgggtactatgaatgaagatggaact

SEQ ID NO: 30189 - DNA, 416 bp, Zea mays
  Clone ID: LIB3059-049-Q1-K1-H7
cggacgcgtgggtgctgcttatttgcaacaacaactaccattcagccagctagctgctgcctacccccagcaattacttccattcaaccaactggcagcattgaactctgctgcttatttacaacaacagcagctaccaccattcagccagctagctgatgtgagccctgctgccttcttgacacagcaacagttgttgtcgttctactcgcacgctgcgcctaacgctggcaccctcttacaactgcaacaattgctgccattcaaccaacttgctttgacaaacccagcagcgttctaccaacaacccatcattggtggtgccctcttttagattgcttatgagttatagttcaataatgatgttttttggatgatgtttgtggcttcccagaaataagaaagtacatttctag

SEQ ID NO: 30190 - DNA, 414 bp, Zea mays
  Clone ID: LIB3059-049-Q1-K1-H8
gcttatttgcagcaacaactattaccatttagccagctagctactgcctactctcagggacaacaacttcttccatttaaccaattggccgcactgaaccccgctgcttatttgcagcagcaaatactactaccatttagccagctagctgcagcaaaccgtgcttacttcttgacacagcaacagttgctgcctttctaccagcagtttgcggctaaccccgcaaccctgttacaactacaacaattgttgccctttgtccaacttgctttgacagacccagcggcctcctaccaacaacacatcattggtggtgccctcttttagattgcttattagttgtaattcaataataaagttttttggatgatgtatgtggccaaccagaaataagaagttacatttccagaaaaa

SEQ ID NO: 30191 - DNA, 439 bp, Zea mays
  Clone ID: LIB3059-049-Q1-K1-H9
cccacgcgtccgcccacgcgtccggtaatcaccccaaatcctagggttctagtcgcttgtcgtcgtttcgttcgtagatcacagcgacaatggtgaaggcagttgctgtcctcgccggcactgatgtcaagggcaccatcttcttttcacaggagggggatggtccgaccaccgtgactggaagtatctctggcctcaagccagggctccatgggttccatgtgcacgcgcttggcgacaccaccaacggctgcatgtcgactgggccacacttcaatcctgttggcaaggagcatggcgcaccggaagatgaggaccgccatgccggtgatcttgggaatgtgacagcgggagaagatggtgttgttaatgtcaatattactgacagccagatacctcttgctggaccccactcgatcattggccgagctgttgttgt

SEQ ID NO: 30192 - DNA, 421 bp, Zea mays
  Clone ID: LIB3059-052-Q1-K1-A1
cggacgcgtgggcgattcttaccaatccccctggcctgctgctttcctgataatcgaccagttccccagtcttgctccctgcagtcctccctcctccatctccagcgttgtgttctgactcacctgcaccaatggctgttctttctgctgctggtgctcccccggcctcagctatcgggtttgagggctatgagaagcgccttgagatcacattctctgaggcacctgtctttgtggacccccatggcagcggtttgcgtgccctctccaggtcccagattgactctgttctggatcttgcacggtgcacgatcgtgtccgagctctccaacaaggattttgactcctatgttctctccgagtcaagcttgttcatctatcctctgaagattgtcatcaagacctgtggcactaccaagct

SEQ ID NO: 30193 - DNA, 361 bp, Zea mays
  Clone ID: LIB3059-052-Q1-K1-A10
cgcacgcgtccgaaaaaaaaaaaaattaaataaaaaaaaaaaaaaaaaaaaaaaaaagaaagaataataaaaaaaaaaaaaaaaaaaaaaaaaaaaaaaaaaaaaaaaaaaaaaaaaaaaaaaaaaaaaaaaaaaataaaaaaaagtgcctccccttttaaatattccaagtttactatcccttatttccaaattcaaaccttttttatatcgtcccttaaattaaataccatacccgtcattttacaattatcaccctggaaaaaccttgacttatccaacctaaaacattttttacaaaatccccttttacccacttgccatattaccaaaaaacccctaccaaaactccttctaaaaa

SEQ ID NO: 30194 - DNA, 429 bp, Zea mays
  Clone ID: LIB3059-052-Q1-K1-A11
cgagcagtaccggcgacatcaggaagctcatgatggaggacatgccgatggtgtcggccaaggtagaggggcctaacgccaggaggatcgacggcttcctgtacaggtacaagaagggcgaggacgtaaggatagtgtgcgtctgccatggcagcttcctcacccccgcggagttcgttaagcacgctggcggcggtgacgtatcgaacccgcttcgacatatcgtcgtcaaccctgcgccgttctcgtgaagagggagggttacgctcctgttgctgctggtatcgatcgtgctgtaacatgttgtagtaggctccttgtttccgggagttcaatggaaggtctctctctatatttgacatggattgagtgtgacagcaaatccaagagaaacatcatctacaaatgttagacttgtctacaaattga

SEQ ID NO: 30195 - DNA, 383 bp, Zea mays
  Clone ID: LIB3059-052-Q1-K1-A12
cttcctggtatttctgaaactgctgctatttttgctggtgttgatgtcaccaaggagccgattccagttttgcctactgtgcactacaatatgggcggtattccaacaaactaccatggggaggtagtggatatcaagggtgataatccagatgctgttgttcctggtctaatggctgctggtgaagcagcctgtgcatctgttcatggtgcgaataggctaggcgcaaattcgcttcttgacatagttgtttttggcagagcttgtgcaaacagggtagcagatatttctaaaccaggtgagaagcagaaacctctggaaaaagatgctggagaaaagaccatagcctggttggacaagctgaggaatgcgaatgggtcatt

SEQ ID NO: 30196 - DNA, 271 bp, Zea mays
  Clone ID: LIB3059-052-Q1-K1-A2
ctcacgcgctacgtgcctatcaagagtgcgaatgatacatactgtgatactcaagggctggggctcaattgtacgcacattcagtagagccgtattggagctctatggaacattataaatggcactgtgtccagagagcctaatgtacgcagcttccttacacgaccatgccaaggatggactaagcccatgtgcatcgtaaggcatacctactgtgatcaataccacactaccgatgcagttatgaccgtgcctgtcaagctcgatacta

SEQ ID NO: 30197 - DNA, 325 bp, Zea mays
  unsure at all n locations
  Clone ID: LIB3059-049-Q1-K1-G9
gctgcaggggagacagacgggtacttcatcanaggtggaattgtcacagtgatcaaggatgctttactccctagtggaacagttatatgaagtgaacgtgcgacatgcagctgtgtgtctcgacattcgacaatgatcagcacctggttacatgcgtgatctgcagatcagtctgttggagatcatcggagcaataaaagtgtcatccaaggcattttttctttctttttgctcttttgtgtccttcaatgttgtagggtagaatgttgtagcagcaaatgttagttacatgttgaatcgacattgggggcctggatttggggat

SEQ ID NO: 30198 - DNA, 380 bp, Zea mays
  unsure at all n locations
  Clone ID: LIB3059-028-Q1-K1-B12
gcgaggagtcctacaaggacagcactttgatcatgcagctccttcgtgataacttgaccctatggacttctgacatctcggaggaccctgctgaagagattagggaggcacccaagcgcgactcgagtgaggggcagtaaagccggctttatgtgcctagaaactagtagctagtgtttgctgctgtcgaatgacactatgcaatgtgatctggaacctggtttcttgggtgcgacgcttgttatgactgtcgtcagtaaaatttgggggctccccgtatgagatgctgccgggcaaggcctcggtgtcccacctcgtttgtggcggngggcgctggagcccggtctggttgggttgggaagccctttaaactgttgtca

SEQ ID NO: 30199 - DNA, 381 bp, Zea mays
  Clone ID: LIB3059-028-Q1-K1-B2
caggacaaggcacctcagaagcccttctcgtccgcgccgcctccttgaccccgctggccggcgagctgctcagcgcggcttttttttgcatccacaatgccgcagcttggcacatgttcattgcctggagctgcaatctatggcacttcaactaggagatttggaggtttggagtttcagcaacataaagttaatcacatctcatttggtcggaaagcgtctgttaaagcaacattgaaaactgtgagatgcaatgccactcaaacacaaagcgtccaaaagaaatcttcaagtgcaactattcagcgtgataagaaaggaaatgtacaagggccaaaactggatgacggaagcggtgggttccctccattccgctttggc

SEQ ID NO: 30200 - DNA, 389 bp, Zea mays
  Clone ID: LIB3059-028-Q1-K1-B3
catcgcctcggacagcggctccagaacctccgcgttgcagaaacacagtagcgagaactattcggtggggccgaagatggtgtcgctgaaggtgccaaagcgcctcgccgcaagcgttctcaagtgtgggaaaggcaaagtgtggcttgaccccaatgaagttagtgagatctccatggcgaactcccgccataacatccggaagttggttaaggatgggtttatcatcaagaagcctcagaaaatccactctagatctcgtgcaagaagggcgcacgaggctaagcagaagggacggcactcaggatatgggaagcgtagaggtaccagggaggctaggctccccaccaaggtactgtggatgaggaggatgcgcgtgctgaggcgcc

SEQ ID NO: 30201 - DNA, 367 bp, Zea mays
  unsure at all n locations
  Clone ID: LIB3059-028-Q1-K1-B4
gctccatgatgtttactcattcagggccttcatggttctggcgaaaaatgatgttaaggctggcatcgaacttgaacaagtgactgtgcaaaatgctttggatgtgcaataccaggtgcatggtcgacgacagtgttatacttgtttacagacaaataccttgctggaagtcttagagggattgtctattccaggagttcgacggcttgttgttattgaacaaagtaccagatttgtggaaggaatcatctcattgagagacatatttacatttctccttggatagcatctgtgtagccattccatacatgaaaaagcttgttgtacttggttcanacgaaataaaaaggttacaaatgtgatagcc

SEQ ID NO: 30202 - DNA, 417 bp, Zea mays
  Clone ID: LIB3059-028-Q1-K1-B6
aactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcacaacaactacaacaacttgtgctagcaaaccttgctgcctactctcagcaacagcagtttcttccattcaaccaactagctgcattgaactct

SEQ ID NO: 30203 - DNA, 390 bp, Zea mays
  unsure at all n locations
  Clone ID: LIB3059-028-Q1-K1-B8
gccggccgctcagacggcgcgtggtgcgtgtgccggtcggacctggcggacagcgcgctgcagaagacgctggactacgcgtgcggcggcggcgccgactgcaagcccatcctgcagggcggcgcctgcttcgccccggacaccgtcaaggcccactgctcctacgccgccaacagcttctaccagcgcaacggccagaacgcgcaggcctgcgtcttctccggcacagccgcgctcagcaacgtcgacccgagcgccaatggctgcacgtaccctgcgaccccaagtgctgctgcaacgacgagcagcagcagcggttcggccggcgtgtacagccctncagcgatgggtccgtcggccctcaacgaccacagcgctgccgccggcgtc

SEQ ID NO: 30204 - DNA, 415 bp, Zea mays
  Clone ID: LIB3059-028-Q1-K1-B9
caatgctcacttgctccgagtgccattattccacagttcctccctccagttactgcagtgggcttcgaacacccagctgtgcaagcctataggctacaacaagcgcttgcggcgagcgtcttagaacaaccaattgcccaattacaacaacaatccttggcacatctaaccatacaaaccatcgcaacgcagcagcaacaagcactgagccacctagccgtggtgaaccctatcgcctacttgcaacaacagctgcttgcatccaacccacttgctttggcaaacgtagctgcataccaacaacaacaacagttgcaacagtttctaccagcgctcagtcaactagccatggtgaaccctatcgcctacctacaacagcaacaacttctttcatctagcccgctcgctatgggca

SEQ ID NO: 30205 - DNA, 87 bp, Zea mays
  Clone ID: LIB3059-028-Q1-K1-C11
gtttttttcaatatacatttatcttaaaaacagcggtactgatgtttttttgtctaaagttaatgagtttgcaatggttctgagtct

SEQ ID NO: 30206 - DNA, 422 bp, Zea mays
  unsure at all n locations
  Clone ID: LIB3059-028-Q1-K1-C2
cccacgcgtccgtgttcttagccctctcctttgtagcagctatgtttgccataggctgtcatgctgatggagactgtgagaatgacctccaaagcctgataagtgactgcaagacatacgtgatgttcccagctaatccaaaggtccctccttcggatgcttgctgtggtgtcatcaagaaggcaaacgtttcttgcttgtgctccaaggtcaccaaagaaactgagaaggttgtgtgcatggagaaggttgtgtatgttgctgagcagtgtaagaggccatttgagcatggcttccagtgcggaagctacaaggttccagcaaactgatgatatcacaagagggaagcgcttgacgtagtctttagatttcaattgttgcagccgatcaaccttcttaggggtgnataatatgaagtcaat

SEQ ID NO: 30207 - DNA, 406 bp, Zea mays
  unsure at all n locations
  Clone ID: LIB3059-028-Q1-K1-C4
cccacgcgtccgagaggctgcagtggaggcaactggcgaattcctgaaccagggcgtggagccagtccttggcggccggcccaaactgggtgtgggaaaaggcagaaaaggctttggtcgatatgggtagaatcccatggctatgcctatgccgtgatgccatcggccaaaggtcttgtgccagagactcacccncacttcatcggcacctactggggcgccgtcagcaccgncttctgtgcggagattgttgagtccgcagatgcctacctctttgcaggccccattttcaatgactacagctctgttggctactcattcctcctcaagaaggaaaaggccatcatcgtccagcctgaacgtgtgataatgggggaatgggccggcattcggatgtgtgatgatg

SEQ ID NO: 30208 - DNA, 442 bp, Zea mays
  unsure at all n locations
  Clone ID: LIB3059-028-Q1-K1-C5
cggacgcgtggggcattcagaaacacaccaagcgaagcgcactagcaacgacctaacggcaatggctaccaagatattagccctccttgcgcttcttgccctttttgtgagcgcaacaaatgcgttcattattccacaatgctcacttgctcctagtgccattattccacagttcctcccaccagttacttcaatgggcttcgaacacctagctgtgcaagccaacatgcaacaacaagcgcttgcggcgagcgtcttacaacaaccaattgcccaattgcaacaacaatccttgccacatctaacaatacaagccatcacaacgcaacagcaacaacagttcctaccagcactgagccacctagccatggtgaaccctgccgnctacttgcaagagcagctgcttgcatccaacccacttgctctggcgaacgtagttgca

SEQ ID NO: 30209 - DNA, 374 bp, Zea mays
  Clone ID: LIB3059-028-Q1-K1-C6
ctgtaatagtcagattgagagagttatggaaatatggaacaaaaacgaggacttccggaagcagtatgttgaatcgaacaaggttagcacactaaagagattagggacccatgacggacgaaaacttggccctggtgaggatcctccggtcattccaagccgaagaccaagcaacattggtccattgtctgcctcaagcccggaaatgatcaccttagcttcaacaccagcacctgtattggctgctgcagctgcagtcctttccaaagagaactcctttcctgctttggcagcccctcagaccagtaagcgcgccatatcaaaagcatgtggtagctctgcccatattaacaacaaatctgttatagtatcag

SEQ ID NO: 30210 - DNA, 411 bp, Zea mays
  Clone ID: LIB3059-028-Q1-K1-B10
ggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagcttacaggaaaatcaggctccgtgctgaagatgtgcagggcaggaatgtgctcacaaacttttggggtatgaattttaccactgataaattgaggtccctagtgaagaagtggcagacattaatcgaagcccatgttgatgtcaagacaaccgacaactacatgttgcgtttgttctgcatcggcttcaccaagaggcgcccaaaccaggtcaagagaacctgctatgctcaggcatcccagatccgtcagatccgccgtaagatggttga

SEQ ID NO: 30211 - DNA, 342 bp, Zea mays
  Clone ID: LIB3059-027-Q1-K1-H5
ctcacactttaggagtctagcaaggtttgagagatatatagaaccatgagataagagagttactgatagagttaccagataccacttagaggctgctgaatgagcactgtatacttagaacatggatcagatgaataaggttgattgcccaaatccgaccgatcatgctgcactttgatcctgtcgctctacagcagaacgttcccaatgactgggaccaggcggtcctgaatctgaccatgaatgtcaacaaaatcgtatctgaaatggaccactatataatttcaacattccttgccaaataccaggatcaagaagtacatccctcaacactaaaagcct

SEQ ID NO: 30212 - DNA, 374 bp, Zea mays
  Clone ID: LIB3059-027-Q1-K1-H6
cggacgcgtgggccttgatcctcctggaaatacaggacaccctgaagtcacctgcgggcgagaacaagacgatgaagagggcgtcgatgatctcgatcctcgtcacgacattcttctacctctgctgcggctgcttgggctacgccgccttcggcagcgacgcgccgggcaacctccttaccggcttcggcttgtacggtccgtactggctcatcgacttcgccaacgcgtgcatcatcctccacctgctgggcgggtaccaggtgtacagccagccgatattccagttcgcggagcggctcttggcggagcggttcccggacagcgggttcgtgaacggcggctcctacaccgtccggttcgcgtgcctgcag

SEQ ID NO: 30213 - DNA, 227 bp, Zea mays
  Clone ID: LIB3059-027-Q1-K1-H7
ctcacacttactcactcttacttctttttttactcatacacaatagtacatccggcggactacttatactttcaaatctgcccttattcactcttatcccatatacaaatacattcagatcaatactcaaaccataatctatatatgcattagcttactctaaacattgcaaaacatcttactacaaatatttacacattgaaattaaaaccttaactcaacctatt

SEQ ID NO: 30214 - DNA, 425 bp, Zea mays
  Clone ID: LIB3059-027-Q1-K1-H8
ggcaatcgcaacaggcatcttaccattatcacccttgttcctccaacaaccgtcggggctattacaagagttacctttggtccatttggtggcacaaaacatcagggcacaacaactacaacaacttgtgctagcaaaccttgctgcatactctcagcaacatcagtttcttccattcaaccaactggctgcattgaactctgctgcttatttgcaacaacaactaccattcagccagctagctgctgcctacccccagcaatttcttccattcaaccaactagcagcattgaactctgctgcttatttacagcagcaacaactactaccattcagccagctagctgatgtgagccctgctgccttcttgacacaacaacagttgttgccgttctacctacacgctatgcctaacgcttgcaccc

SEQ ID NO: 30215 - DNA, 355 bp, Zea mays
  Clone ID: LIB3059-027-Q1-K1-H9
caaccagttctctttgatgaatcctgtcttgtatggcagcaattgttgctgctgtaggagaggcggtgaccaatgggttagccactaccaatggattaagtaactgctgtctctgttgtaggtactcagcatagttcgacagagtcagttggttgaatggaagcagctgttgcaagtaggcaatagggtttgccacagcagcaacatttgctgccttacaaccagatctctatgatgtatcctatgttgccgaggcatcatcccatcgttggaggtgccattttttagattacatatgatatgtactacattacggtgccctcctaccgacatgtgtttactagatgtaatcaat

SEQ ID NO: 30216 - DNA, 317 bp, Zea mays
  Clone ID: LIB3059-028-Q1-K1-A1
gcctgaccagcctttgagcaataatgaattcactatgaaacatgatgatatccaatttgggagtgcactactggatgatgaaccacataatgatatatacagaagctttactgatatcataaaaaatcctggtcctaagacaactttcgaagttggaatgttagctggtgattcatggaagaaggtcaagagcgacaaacgaaatgaccagagcaatgccaatgacattaccaataaatccaaaataccggttccttctattgtagacccacagcctaagcaacaggatcacaattccgattcagattttgaggaaa

SEQ ID NO: 30217 - DNA, 414 bp, Zea mays
  Clone ID: LIB3059-028-Q1-K1-A11
atctacttctcctagagatcaatggtctggtatctgaagtcaagcagatcttacctggtatggttcggcgacatcggcattcagatagcactggtagcacgacttcctccagaagcaatccaatgcgagaagacatgttgaaccgatcaaacacacatcgtgctagaagtcagtttttagaaaatcacctggcaaagttatttgagcaaaaaatggaaatattcaccaaagttgaatacacacaggaatctgttatttctactgtcctcaagctctgcctgaaaagcttgcaagaatttgtccgtcttcagactttcaacagaagtggatttcagcagattcagctggatatggaatttctcaagacctctcttaaggaatttgtggatgatgaagcagccattagctttttac

SEQ ID NO: 30218 - DNA, 416 bp, Zea mays
  Clone ID: LIB3059-028-Q1-K1-A12
gtgcaagccaacatgcaacaacaagcgcttgcggcgagcgtcttacaacaaccaattgcccaattgcaacaacaatccttgccacatctaacaatacaagccatcacaacgcaacagcaacaacagttcctaccagcactgagccacctagccatggtgaaccctgccgcctacttgcaagagcagctgcttgcatccaacccacttgctctggcgaacgtagttgcaaaccagcaacaacaacagctacaacagtttctgccaacgctcagtcaactagccatggtgaaccctgccgcctacgtacaacaacaacaactgctttcatctagcccgctcgctgtgggcaatgcacctacatacctgcaacaacaattgttgcaacagattgtaccagctctgactcaactagctgt

SEQ ID NO: 30219 - DNA, 406 bp, Zea mays
  Clone ID: LIB3059-028-Q1-K1-A2
ggcatgaaagcagctgaacttcatggcaccttacccaagcccaacggcttgaggctgtggaacttttcaagaaaaaagaagtagattttttgattgcaactgatgtcgctgctcgtgggattgatattgttggtgttcagactgtaataaatttcgcatgcccaagagatgtgaaaacttatcttcatcgtgttggccgcactgcgcgggcaggaagagaaggctatgctgtgacatttgtaaccgatgatgatagatgcctcttgaaagcaattgcaaagaaggctggttcacagctgaaaagtcgcattgttgcagagaaacctgtggctgagtgtgcacgactgattgagcaactagaaggccaaatttctatcatcattcgagaagaaagggttggaagaga

SEQ ID NO: 30220 - DNA, 341 bp, Zea mays
  unsure at all n locations
  Clone ID: LIB3059-028-Q1-K1-A3
cccacgcgtccgcccacgcgtccgcccacgcgtccgcccacgcgtccgagaccatggggtcggacagtgactacaccgagtttgagaacttcaccaagtggctcggagtgacgcagtgaagcggcctttgaggcctagttaagttttgagtagttgtgtcgctgaacttgtattgagacgaaatagtatttttatcaatctgtcttatcctgcgtcttcacaacaagttgcctatctgtggactttaagcctgcatgttcgttntatttctccattgccgtgggagcatagtatttgcatgttcgaaccaattatctggattatggtatggatntgtgcac

SEQ ID NO: 30221 - DNA, 293 bp, Zea mays
  Clone ID: LIB3059-028-Q1-K1-A5
gcctgcccagcctttgagcaataatgaagtaactatgaaacatgatgatatccaatttgggagtgcactactggatgatgaaccacagaatgatatataaagaagctttactgatataataaaaaatcctggtcctaagacaactttcgaagttggaatgttagctggtgattcatggaagaaggtcaagagcaacacaggaatggaccagagcaatgccaatgacattaccaataaatccaaagtaccggatccttctattgtagacccacagcctaagcaacaggatcaca

SEQ ID NO: 30222 - DNA, 433 bp, Zea mays
  Clone ID: LIB3059-028-Q1-K1-A6
cttcccccgtacctctcaccagcggtgtcttcggtatgtgaaaacccaattctgggacgctacaggatccaacaggcaatcacagctggcatcttacctttatcacccttgttcctccaacaatcatcagccctattacatcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctacctgctgcctacccccagcaatttcttccattcaaccaactggcagcattgaactctcctgcttatttacagcagcaacaactactaccattcagccagctagctggtgtgagcc

SEQ ID NO: 30223 - DNA, 378 bp, Zea mays
  Clone ID: LIB3059-028-Q1-K1-A8
gttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggt

SEQ ID NO: 30224 - DNA, 411 bp, Zea mays
  Clone ID: LIB3059-028-Q1-K1-A9
acgcgtgcgagtgagaccaactagcaacatagaaagcacaatagtgtaccaacaatggcagggaaggtattttgcctccttatgctccttggtctttctgcaagtgctgctaccgcgaccattttcccgcaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattc

SEQ ID NO: 30225 - DNA, 420 bp, Zea mays
  Clone ID: LIB3059-028-Q1-K1-B1
cccacgcgtccgcggacgcgtgggtcagcattcaaaaacacaccaagcgaagcgcacgagcaacgacctaacaccaatggctaccaagatattagccctccttgcgcttcttgcccttttagtgagcgcaacaaatgcgttcattattccacagtgctcacttgctcctagtgccagtattccacagttcctcccaccagttacttcaatgggcttcgaacatccagccgtgcaagcctacaggctacaactagcgcttgcggcgagcgccttacaacaaccaattgcccaattgcaacaacaatccttggcacatctaaccctacaaaccattgcaacgcaacaacaacaacaacagtttctgccatcactgagccacctagccgtggtgaaccctgtcacctacttgcaacagcagct

SEQ ID NO: 30226 - DNA, 413 bp, Zea mays
  Clone ID: LIB3059-027-Q1-K1-H4
catcgatcactatctgttaaatgtttcaaagtttaatatccatatatgtatttttttgagcttttgaacagtcttttgtatgcaccacttgtcataactttcatgtgaatcagaaaattaaccaaaaattggttgattcactttggagttagattagtgtgcatatataggattcattagctccattaaatccttgtcacccaatgtgtacttcgtgtttgcgtgtgctgcttcaggtgccagctctccagagattcatgcgaagtcgagcacacattcaccagcaaacaggtgtccacattacatcctcaactatctacacttctaccttacacattgctagggtaaatgtgagggaccctggtacaataaacgatggcctcggtgctgctcgtgaagcagatgccctattg

SEQ ID NO: 30227 - DNA, 422 bp, Zea mays
  Clone ID: LIB3059-027-Q1-K1-F6
cccacgcgtccgcaatgacaagttcggtatcgttgagggtctgatgaccactgggcgggccatcactgctacccagaagactgttgatgggccctcatctaaggactggaggggtggaagggctgctagtttcaacatcattcccagcagcactggagctgctaaggctgttggcaaagtgcttcctgtccttaacggaaagttgactggaatgtctttccgtgtcccaaccgtcgatgtttctgttgttgatttgactgttaggcttgaaaagtcagcaacctatgatgagatcaaggctgcggtcaaggccgaggcagaaggtagcctcaagggcatcctgggttacgttgaggaggaccttgtttccaccgatttccagggtgacagcaggtctagcatctttgatgctaaggctggca

SEQ ID NO: 30228 - DNA, 425 bp, Zea mays
  Clone ID: LIB3059-027-Q1-K1-F8
cccacgcgtccgcccacgcgtccgggcggaccaggtaagcagcagcaggaaccctaggaccgccgcatccgcagccatgggtatcgacctcgttgccggtgggaggaacaagaagaccaagcgcacagcgccgaagtccgacgatgtttatctcaagctccttgtcaagctctaccgtttcttggtcaggaggaccaagagcaacttcaatgctgtcattctcaagaggctcttcatgagcaaaaccaatcgcccaccaatctccatgcgccgccttgtcaagttcatggaaggaaaggagaagaacattgctgtgattgttggcacagtcacagatgacaagaggatccaagaggttccagcaatgaacgttactgccctgaggttcaccgagactgctagggccaggattgtcaatgctggtg

SEQ ID NO: 30229 - DNA, 263 bp, Zea mays
  Clone ID: LIB3059-027-Q1-K1-G1
ggcgagaagctgaccgactgagttgcttttattgctaccaatatattagacctccaggagggtcttccccttttagtgatctctacaaatactttcattattccacaatacttacttcctcctagtgccattattccacatttacttctaccacttactctcatcggctattaacatcaaactttgcaatcttacaagctacaactatctcttgccgctagcgctttacatacaaccaattgcccaatttcaacatcaattct

SEQ ID NO: 30230 - DNA, 412 bp, Zea mays
  Clone ID: LIB3059-027-Q1-K1-G10
cagtccagcactggggcatagccgtcaagtttgctgagctcattaccaagatcgacaggcggtctggcaaggagcttgagaaggagccaaagttcctgaagaacggtgatgctggtatggtgaagatgataccgaccaagcccatggtggtggagacgttctcagcgtatcctccccttggtaggtttgctgtccgtgacatgaggcagacggttgctgttggagttatcaagagtgtggagaagaaggacccgaccggcgccaaggtgaccaaggcggctgccaagaagaaatgatgcgatcctgcgcctgctttagcaatacctagttttcatcatcacaagttttgtttgtgatcgttgctgttatcgtgtgaactgttgagatctgttagcatgtgcacttttatcta

SEQ ID NO: 30231 - DNA, 385 bp, Zea mays
  Clone ID: LIB3059-027-Q1-K1-G12
ctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttggcatcagaggccatcatcaagcagattccccgtctccttggtcctggtctcaacaaggcaggcaagttcccgaccctggttactcaccaggaatccctcgagtccaaggtgaacgagactaaggcaacagtcaagttccagctcaagaaggtcctttgcatgggtgtcgccgtcggcaacttggcgatggaggagaagcagatccagcagaacatccagatgagcgt

SEQ ID NO: 30232 - DNA, 426 bp, Zea mays
  Clone ID: LIB3059-027-Q1-K1-G2
cccacgcgtccggggtgggccgttccagaacgacaccttcgtggactcccgtgacagcgccgtgcagacggagtccagcacctacaacagtggcaccctggtcggtctcctctccggcctcgtcaccacttcctccgtggtacagtcgttcacctagacggctcctcctatgttctggcctggagcgatgcatgtacgagtacgattgcagtttttttgcttggcgtggctgatggtgatgcgcgatctgtgactgtgagagagaaagcttggttgccaaccgttcagttcagacggatggcatatgcaggatgcagcagtagtttagtagtgcccacgcgtttcttctgttgtgtgtgtacaatgacggtgctgctcctgcagtgcagctatagtttttcaccgcgtgctcctatctggtttgct

SEQ ID NO: 30233 - DNA, 352 bp, Zea mays
  Clone ID: LIB3059-027-Q1-K1-G3
ccggaaacgacagctgacgctgagagactcgaccgccccgccactggctgctgggggggacggacatcgtccctggctgacgggcaggaggaggtaactaactgaccgacgaccatttcctcgccgctcggtttccacaatctatcggcgtcgtcgtcgtccctgaaatcctgaaaatctatcggcatcggtggccacaatgctgtgtgatgatgacaggccaagaccctggaggccaggctcacccaggtcagcgaggagaaccggcggctcaccgagatcatcgcctacatgtacgccagccaggtcgccgcgcagcggagtcccgacggcaggaagaggagcagggaca

SEQ ID NO: 30234 - DNA, 149 bp, Zea mays
  Clone ID: LIB3059-027-Q1-K1-G5
agcaaacctacactgcctaaagagtatcttctaacacaacagcatgaacatggtcatggctctcgtcacgtgcctgactctgtcagctgccatcgcctctgcaatgcaaatgccctgcccctgcgcggagctgcacggcttgtacagct

SEQ ID NO: 30235 - DNA, 405 bp, Zea mays
  Clone ID: LIB3059-027-Q1-K1-G7
aaaatgcatataaactccaaattaattcattccagttcctaaaattttgcaattggaggctctataacctagagcctctgttttgtaatgaaaccagtaaaaaattgattcttcacttaatcctatttaaaacacatgaaacctttgaaaattcataactcaaatgctataactccaaaaattatgattcctgttcctaggattttattataatgtgtagaatattactgtgtgttttgtttacatgtttggtgtgatgttaatttccctatatacggtgtttgtttgtattgtggcgagtagaagaacccgtgaccgaggatcctggtgagcagcaggttgaagtagctgagcaggagctcataaaaggcaagttgtgcccttgaccactttttacccaataat

SEQ ID NO: 30236 - DNA, 421 bp, Zea mays
  Clone ID: LIB3059-027-Q1-K1-G8
gcttcgaacacctagctgtgcaagcctacaggctacaacaagcgcttgcggcgagcgtgttacaacaaccaattaaccaattgcaacaacaatccttggcacatctaaccatacaaaccatcgcaacacaacagcaacaacagttcctaccagcactgagccaactagatgtggtgaaccctgtcgcctacttgcaacagcaggtgcttgcatccaacccacttgctctggcaaacgtagctgcataccaacaacaacaacaattgcaacagtttctgccagcgctcagtcaactagccatggtgaaccctgccgactacctacaacagcaacaactgctttcatctagccctctcgttgtgggtaatgcacctacatacctgcaacaacaattgctgcaacagattgtaccaactctgac

SEQ ID NO: 30237 - DNA, 415 bp, Zea mays
  Clone ID: LIB3059-027-Q1-K1-G9
cccacgcgtccggagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctccctactcttagcaaca

SEQ ID NO: 30238 - DNA, 393 bp, Zea mays
  Clone ID: LIB3059-027-Q1-K1-H11
atccagatcagcaaagcggcagtgcgtagagaggatcgtcgaacagaacagcatgaagatggtcatcgttctcgtcgtgtgcctggctctgtcagctgccagcgcctctgcaatgcatatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagacgagcgccatgtaccagccgctccggcaacagtgctgccagcagcagatgaggatgatggacgtgcagtccgtcgcgcagcagctgcagatgatgatgcagcttgagcgtgccgc

SEQ ID NO: 30239 - DNA, 248 bp, Zea mays
  Clone ID: LIB3059-027-Q1-K1-H2
cccacgcgtccgcgagttttaaaggtggtgacgtctgaatttcgtggaattgacaatgacatgtctgtatgattggtgtcgcaactctccagttcggaaatttgttagcacaaaaaaaaaaaaaaaaaaaaaaaaaaaaaaaaaaaaaaaaaaaaaaaaaaaaaaaataaaaaaaaaaaaaaaaaaaaaaaaaaaaatgaaaaataaaaaatatataataagacaacgaaatagaaaacaaaaacata

SEQ ID NO: 30240 - DNA, 129 bp, Zea mays
  Clone ID: LIB3059-027-Q1-K1-H3
tcccagctcgacccactcatcctaacacacatacaaatactcaaccacttttttttttacaccatcattcacatcccaatagacgtctctaataactcattctacctcctattaaattccttactaaaa

SEQ ID NO: 30241 - DNA, 408 bp, Zea mays
  Clone ID: LIB3059-027-Q1-K1-F5
cccacgcgtccgcaacaacaactaccattcagtcagctagctgctgcctacccggaggagtttcttccattcaaccaactggcatcattgaactctgctgcttatttacaacagcaacaactaccaccattcagccagctagctgatgtgagccctattgccttcttgacacagcaacacttgttgccgttctacctgcacgctgcacctaacgctgtcaccctcttacaactgcaacaattgctgccattcaaccaacttgctttgacaaacccaacagcgttctaccaacaacccatcattgctggtgccctcttttaaattgcttatgagttatagttcaataatgaaattttttggatgatgtttgtagctatccagaaataaaaaagtacatttctagatctt

SEQ ID NO: 30242 - DNA, 420 bp, Zea mays
  Clone ID: LIB3059-049-Q1-K1-F3
cggacgcgtgggcggacgcgtgggtgcaacaacaattaccattcagccagctagttgctgcctacccccagcaatttcttccattcaaccaactagcagcattgaactctgctgcttatttacagcagcaacaactactaccattcagccagctagctgatgtgagccctgctgccttcttgacacaacaacagttgttgccgttctacctgcacgctatgcctaacgctggcaccctcttacaactgcaacaattgctgccattcaaccaacttgctttgacaaactcaacagtgttctaccaacaacccatcattggtggtgccctcttttagattgcttatgagttatagttcaataatgaagttttttggatgatgtttgtggcgtcccagaaataagaaagtacatttctagatt

SEQ ID NO: 30243 - DNA, 367 bp, Zea mays
  Clone ID: LIB3059-049-Q1-K1-F4
cccacgcgtccgatgcgaagaagaaagtgatggatgtggtccacaatataaccgactttttcagggacttgttcaatgactcagccgaggcccagaccggagcaggcccttcagctgagaagggcttttctgcaacagagatggctgtgggaggatccttcatggctctgaccatagcggtcatcctagttgttctgttcaagagggcatgatagctcaagagtcatgggtaccttctgggacccatcgtgctttaaatctgtcgaaaattactcgtctgtcgtatggtcaataattccgaatgcaatgtatagcttgtccgtttctttggaaacagtacaataaaggatttatctaaagtatgctc

SEQ ID NO: 30244 - DNA, 416 bp, Zea mays
  Clone ID: LIB3059-049-Q1-K1-F5
cccacgcgtccgctacactcctcaaattcttgagcaagcaggcgttggtgttcttctgtcgaacctcggccttaacgcttcttcggcatcaatcctcattagcgccctgacgaccttactgatgctcccaagcatcggcattgcgatgaggctcatggatatgtccggaaggaggtttctcctcctcgcgacgatcccagtcctaatagtcgcgctactcgtcctggtggtgtccaacatcgtggacgtgggggacgtggcgcacgcggcgctctccacggccagcgtcatagtctacttctgcttcttcgtcatggggttcgggcccgtccccaacatcctctgcgcagagatcttccgcaccacggtccgcggtgtctgcatcgccatctgcgccctggccttctggctcggtg

SEQ ID NO: 30245 - DNA, 436 bp, Zea mays
  Clone ID: LIB3059-049-Q1-K1-F7
gagagggtgttttgtctctcttcaactccacatcaacaaaaccaatggaaccaactcgggatgctacttggtctttctgcaagtgctgctaccgcgaccattttcccgcaatgctcacatgctcctatagcttaccttcttcccccgtacctctcaccagcggtgtcttcggtatgtgaaaacccaattcttcaaccctataggatccaacaggcaatctcagctggcatcttacctttatcacccttgttcctccaacaatcatcagccctattacagcagttacctttggtgcatttattggcacataacatcagggcacaacaactacaacaacttgtgctagcaaaccttgctgcctactctcagcaacagcagtttcttccattcaaccaactatctgcattgaactctgctgcttatttgcaacaacaac

SEQ ID NO: 30246 - DNA, 164 bp, Zea mays
  Clone ID: LIB3059-049-Q1-K1-F8
ggtggacgatgggggggtggcgtgggaggtcgtgggcacaagggcaagggtggcgaatagtggcagtgtcagtgtgagcaatgacctgaatgaacaattgaaatgaaaagaaaaaagtattgttccaaattaaacgttttaaccttttaataggtttatacaac

SEQ ID NO: 30247 - DNA, 395 bp, Zea mays
  Clone ID: LIB3059-049-Q1-K1-G1
cacgctcttgcgcccagacccaaatatttctccactcaatcactgcagtcatggacgccaacggagccagtagcaaggcgaagaacggggcggctgggcgcaaggctggcggccccaggaagaagtccgtgtctcggaccgtcaaggacgggatgcaatttcccgtaggtcggatcgggcgctacctcaagaagggccggtacgcgcaacgcgtgggcaccagcgcccacgtgctatctcgccgtcgtgcttgagtacctagccgacgaggtgctggagctggacgtcaacgcttcgaaggacaacaagaagacgcgcatcgtaccgtgccacgtgctcctggcgatcgcgaactacgttgaactcggcgcgctactgtctggcgtcaccatctg

SEQ ID NO: 30248 - DNA, 307 bp, Zea mays
  Clone ID: LIB3059-049-Q1-K1-G10
cggctcgacgcatgcatccacgggtacaatgattgacaacaatgctctaacagtttacactaatataatactcaattgtgactgtgttcaagaagctgctatgtagacagaccgatacttcatcaaaagtgcaatcagtcacactaatcaaggatgctttactcactactggaacagttatatgaagtgaactttcgacatgcagctgtgtatctctacattctacaatgatcagcacctgattacatgcatcatctgcacatcagtctgatcgagatcatcgcatcaataaaagtctcatacaagg

SEQ ID NO: 30249 - DNA, 410 bp, Zea mays
  unsure at all n locations
  Clone ID: LIB3059-049-Q1-K1-G11
gaagataagaagcggaggtcctactctcctgccagtagagatgatgctgacaatgtttatgagaagaggtcgcccccagcagacagcgatggatcttctctgcatcgcaagtcccccaaagagtactcgggctcaacttctggatcccggttcaagtcccgcgacgaatcccctgttgccagtgactgatcgaccgatggatgctacaatatgaatgatatgcgcatgaccagcatggtcatgcngtcatcagtcctatgcctntgtcagactgagctcactaaacttacccccctttgggggtcgatgttgtattgctaagttccgtttgtgctaagtattagcgcatactgctagactgccactgtcgtctgtactatgcatgctnttgatctcgagtgatcgtgttg

SEQ ID NO: 30250 - DNA, 317 bp, Zea mays
  Clone ID: LIB3059-049-Q1-K1-G2
cccacgcgtccgcccacgcgtccgggctcacaccagctagctggctgaatggtagtagttgttgtgagccctgctaccttcttgacacaaccacagttgttgccgttctaccagcacgctgcgcctaacgctggcaccctcttacaactgcaacaattgctgccattcaaccaacttgctttgacaaacctaacagtgttctaccaacaacccatcattggtggtgccctcttttagatttcttatgagttatagctcaataataaagttttttgtctgatgtttgtggcttcccagaaataagaaagtacatttct

SEQ ID NO: 30251 - DNA, 364 bp, Zea mays
  Clone ID: LIB3059-049-Q1-K1-G4
ccagagcgcagaagaacccgatcgacaccatgatggtggtgctcgttgccctcgctcggctggggctcgctgcgagcgccacctacacgcatacaagcggcggctgcggctgccagccaccgtcgtcggttcatctaccgccgtcggtgcatctgccacctgcggttcacctgccacctacggtgcatcttccaccgccggtccacctgccgccgccgtaccacctgccaacgacggtccatgtgccgccgacggctcatgtgtcgtcgccaccatgccgataccctactcaacctgcacggactcaggctaacattagtcatacgcatgcccgggctaactgtctcatgcaagcccgtgccag

SEQ ID NO: 30252 - DNA, 257 bp, Zea mays
  Clone ID: LIB3059-049-Q1-K1-G6
ctctaattaaatggaaatgtgaagtggtaggaccgttgaagtaaatcgctgggattggctcatgcacgttgggagatcagatcttcgcttgcataggatgcagactagcctacctactcatacgtataactagatattgtatattatatcactaagaacaattccctatccgctttaatacatggtcctgactagcaataccataactgcacccatcttaatgctctgccaatacatcacacatatgacatctgtcc

SEQ ID NO: 30253 - DNA, 426 bp, Zea mays
  Clone ID: LIB3059-049-Q1-K1-G7
cccacgcgtccgcccacgcgtccgcccacgcgtccgcggacgcgtgggcgccggcctggccttcctggtgctgctgctgggtgcccaggatcacgggcgtggagagcaagcgaccggcggcggcccggccgttggagcagcagccgccgccgctgctcctcccgcgcgggaggctgtaatcatcagccggcaccagcattcgcagccgtcggccgcggcgatggcggagagcaagcggctccccatccctccgtccgggccgtccactaagtggaactacgaggcgaatcacgagaagccgtcgtcgtcggagtcgggctcgggccgccgccgcctcgggtggtggtggtccccgtgacgcggccggtggcggtgggttcttgagagctgcagagatctcaaggctcagctagcgtcgtgtgtgtc

SEQ ID NO: 30254 - DNA, 436 bp, Zea mays
  Clone ID: LIB3059-049-Q1-K1-G8
acctttctccctactctcagcaacaacaatttcttccattcaaccaactgtctacactgaaccctgctgcttatttgcagcaacaactattaccattcagccagctagctactgcctactctcagcaacaacaacttcttccatttaaccaattggccgcactgaaccccgctgcttatttgcagcagcaaatactactaccatttagccagctagctgcagcaaaccgtgcttccttcttgacacagcaacagttgctgcctttctaccagcagtttgcggctaaccccgcaaccctcttacaactacaacaattgttgccctttgtccaacttgctttgacagacccagcggcctcctaccaacaacacatcattggtggtgccctcttttagattgcttattagttgtaattcaataataaagttttttggat

SEQ ID NO: 30255 - DNA, 394 bp, Zea mays
  Clone ID: LIB3059-049-Q1-K1-F2
cccacgcgtccgcggacacgtggggaatcagctgtggcggcagcaaacgcaggcgaatgcgacggtgtgagggaaggagcaccagccatggtgcacgtcaacttctaccgtaactatggtaagacgttcaagaaaccaatgcgttcttatgagaaggagcgtctagatgctgaactgaagctggtccgtgagtatgggctgatgtgcaagcgtgagctttggagggtccagtatgcactgagcaggatccgtaatgctacaaggcacttgctcacccttgacgagaagaactatcgtcgtatctctgagggtgaggcgcttcttcgccgcatgaaccgctatgatctgctagctgagggtcacaacacgcttgattatgtacttgccctcaccg

SEQ ID NO: 30256 - DNA, 420 bp, Zea mays
  Clone ID: LIB3059-049-Q1-K1-D8
cccacgcgtccgcccacgcgtccgcaggaaggacatggagtgtgcccactgcaagtcggcagagagcaacatgtgtgatctgctcaggatcaacaccgaccgcggtgtgatgattgccgatggcaagtcgcggttttcaatcaatgggaagcctatctaccactttgttgggacttacaccttcagcgagtacaccgtcatgcatgtgggttgtgttgcaaagatcaaccctcaggctccccttgataaagattgcgtccatagctgaggtatatctaccggtcttggtgcatcaattaatgttgcaaaacctgcgaagggttcgacagtagctgcattcggtgtacgagccgttggtcttgccgctgcagaaagtgcacggattgctggagcgtcaaggatcattggtgtcgacctgaa

SEQ ID NO: 30257 - DNA, 388 bp, Zea mays
  unsure at all n locations
  Clone ID: LIB3059-049-Q1-K1-D9
gccacgccttcgtgaagtacaaagaaggtcttactagggaagaaggaattccgattgggggccaagcaatctgggctggtattttcaatgacttgggtaatgggaacaaccttgaccttttctttataaccaaagtgaagacagaatactggaaaaaccaaccagtgccgaatccaagacttatgctaggtcaaagggatacatgttcacgaaggtgcagactgaggtactgacttaaggtcacactttaaacacaaagtgaggtcgacgagggtggagatgctatcgaggagtgatcttgcatgcctgcattcatacaagcatatnctgaatctgtgtaactttgcttagtgaatcagctagaacatgaaaaatgaaaatttggaga

SEQ ID NO: 30258 - DNA, 431 bp, Zea mays
  Clone ID: LIB3059-049-Q1-K1-E10
ctccatacaagggaagcgcgacacacaagctacaggttttagaagatagcattcccagcttccaaagggctggtacaattgtgccaagaaaggacagattcagacgcagttctactcagatggtgaatgatccatacactctggtgatagcactcaatagctcaggtgctggagaaggcgaactttatgtggatgacgggaaaagttatgagtaccagcaaggggcattcatccatcgccgatttgtctttgcagacaataagctaacttcattcaatattgggcctgacgatttgggcaagaaatttagaagtgattgcgtgattgaaagaattataatcctcggtttacgatccggagtgaagaaggctattattgagcctggaaatcaagaactagaaattgaatcagggccaattagtttaaggagt

SEQ ID NO: 30259 - DNA, 169 bp, Zea mays
  Clone ID: LIB3059-049-Q1-K1-E11
ctgcctactatttttttatcgaattcctcgagtaaaaaggaaacctgctcgatgtccgtttgtttgttgtttggtaataccgttctgtttgctataattatcgatcagcgggatgtgaagtactgtttacattgctcgcgttctaataaagtactgtttggacttgctt

SEQ ID NO: 30260 - DNA, 433 bp, Zea mays
  Clone ID: LIB3059-049-Q1-K1-E12
gagcatcatgtagtaccactcaacgtttgtccatgtgagactcgtatcacatgctcagatacctggcttaaatctatcacattacaagcctattacatgcttcaattactagagtagcaagcggaagcggcatggcgaaagcgtcatcgtgggcggcggcgatgagcgtcggcaccgtaaaggcgctcaaggaccagtccggcctgtgccgctggaactacgcgttccggcaggcggcgcatcaacgcgccaggaggccagcggcaagcgcgagcggctcagtctgccccggcagcgcgcactcgccgactgcttatgctccctcggactgcacacgtgcggagaggaggagagccaggcaacatcaggaggatgagctccggacggtcatgtacctcatcaactgcagtcccaacaactagctacgaactat

SEQ ID NO: 30261 - DNA, 326 bp, Zea mays
  Clone ID: LIB3059-049-Q1-K1-E2
gtgacacgtcttttttcaatttcttagttattttttatcgctgtatgattcacgaacggcatggggcttatgtaagaactctttaacatgtgaaatgcaactgctaacatcaacattgagataagtacttgaatctattgtcgatatgaactaactaatattgtatgacctgaagggacgaaagaccaacgaaattgtgtacatccaacttgaaagacgcagtaattgcagtgctcatagggctgaatatgatatccaataaaccactaactaagtgtttaaacgaactactataatcgactatcaatacacaaacatctacttta

SEQ ID NO: 30262 - DNA, 397 bp, Zea mays
  Clone ID: LIB3059-049-Q1-K1-E4
cctactcagacccgagaagcgcagctgctgccatggacgccaccggcactggagctggagggaaggcgaagaagggagcggcctgtcgcaaggccggctgtccgaggaagaagtcggtgaccaggtccgtgaaggccgggctccagttccccgtcggccgcatcgggcgctacctcaagaagggccgctacgcgcagcgcgtcgtctgcggtgcccccgtctacctcgcggtcgtcctggagtacctcgccgctgaggtcctggagctcgtcggcaacgctgccaaggacaacaagtagacgcgcatcgtcctgcgccacgtgctgctggcgatccgcaacgacgaggagctcgtgaagctgctgaccggcgtgaccatcgtccacggctgcgtgtt

SEQ ID NO: 30263 - DNA, 402 bp, Zea mays
  Clone ID: LIB3059-049-Q1-K1-E7
catggatgcagtactgcatgaagcaacagggggttgccaacttgctagcgtggccgaggctgatgctgcagcaactgttggcctcaccgcttcagccgtgccagatgccaatgatgatgccaggtatgatgccaccgatgacaatgatgccgatgccgaatatgatgccatcgatgatggtgccgactatgatgtcaccaataacgatagctagtatgatgccaccgatgatgatgccaaacatggtttcaccaatgatgatgccgagtatgatgccttcgacgatgacgccgagtatgatgccaccgataatgatgccaagtatgataccaccgatgatgatgccgagcatggtgtcatcaatgataatgccaaacatgatgacagtgccacaatgttact

SEQ ID NO: 30264 - DNA, 435 bp, Zea mays
  Clone ID: LIB3059-049-Q1-K1-E8
gaccaactagcaacatagaaagcacaatagtgtaccaacaatggcagccaaaatattttgcctccttatgctccttggtctttctgcaagtgctgctaccgcgaccattttcccgcaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgctgcttatttgca

SEQ ID NO: 30265 - DNA, 379 bp, Zea mays
  Clone ID: LIB3059-049-Q1-K1-F1
cccacgcgtccggctacgcgtccgcactgagttctaaccacgcagacctcaacaagaagcagcgtgctcgtctccgaaaggtaaggcacgtgacaagatgtcgatacaagcatacgtcgaatagctcctgatgtcctagatcgaatgacagcatctaatctcctactacatcttctgtcacgacagcagcgtttgggcgcagtccgagtgcttaccccagttaaagcctgctgaggttactgctatcataaacgacttatatgaaccttgtactcttgtaccaactggtattttaattggatgtacaaagtacattatgatccaaagtgaacctggaattatcatccgatgacagaaggtcactgctggcattactatc

SEQ ID NO: 30266 - DNA, 410 bp, Zea mays
  Clone ID: LIB3059-049-Q1-K1-F10
cccacgcgtccggccggatcggacgagtggactacatttgcttccattaagctccaaagaaaaagagggcaggcacgaagaggagaaagacagtaaactgaaggacgagttccacaagttactgaatgggaaccatgcggatcctactgatcgtcgacagcggacacacatgaacgggaggcacgacgaagacatcaatcacgcgctctccgaggccactgccaacggcacgtaagggcccgtcggcatctgctttcaaccgggggctttgaccttggcgctcgcaggagaatcctcgcgggggtcgagaaaacctgcctggtgtggtgccccggccgcctttttctgaattatgaagctgtccgagattccagcgatccagccattcacatcatgcatcttcctgaacc

SEQ ID NO: 30267 - DNA, 443 bp, Zea mays
  unsure at all n locations
  Clone ID: LIB3059-049-Q1-K1-F11
ccgacgcgtccgcccacgcgtnccgcgtacccttggttcctggcccagaacccacggaggacacttcaaaggttgggcacctaattagccatcgattcaggctcttatccatgggctgaacaggcactactactcaattgcaatcaattaccggaaaaatgagctagaggagaaaatgttgttgaacttgcacaaaaagaaatggacagatggactaattttgaagaggtttgacactcactcaaaaaccaacgagcagactgtccaggaaatgctaaacctagccatcaagtacaacaaggcagtgcaagaggaggacgaactgccacctgagaaacttgcgatagcaaatgtgggtcggcaagatgcanaaaagcatttggaagagcatgtgtccaatttgatgtcatcaaacatagttcagaccctangaaccatgctcg

SEQ ID NO: 30268 - DNA, 420 bp, Zea mays
  Clone ID: LIB3059-049-Q1-K1-F12
aaaccatcagggcacaacagctgcagcatctcgtgctacctgtgatcaaccaagtagctctggcaaacctttctccctactctccgcaacaacaatttcttccattcaaccaactgtctacactgaaccctgctgcttatttgcagcaacaactattaccatttagccagctagctactgcctactctcaacaacaacaacttcttccatttaaccaattggccgcactgaaccccgctgcttatttgcagcagcaaatactactaccatttagccagctagctacagcaagccgtgcttccttcttgacacaacaacagttgctgccgttctaccagcagtttgcggctaaccccgcaaccctcttacaactacaacaattgttgccctttgtccaacttgctttgacaaacccagcag

SEQ ID NO: 30269 - DNA, 434 bp, Zea mays
  Clone ID: LIB3059-049-Q1-K1-D7
ggcgttgactatatggtccataatgcagccttcgaacgtcctaaacggagggctctagaagaaagtgaggaaggtcttaaggctacattgaatgtcaatgtcttcggaactattactttaactcgccttctagcaccttacatgcttgatagagggatgggccattttgttgtgatgagtagtgctgctggaaaggttcctgctcctggtcaggccatttactctgcctccaaacatgctcttaatggttactttgcttctctgcgatctgagttgcgtacaaaaggcattaaggtcactgttatctgccctggaccgattgaaacactacaatcttctgctgcagcttcttcatcgcaaacacattctgctgagaaacgtgagaaacgtgtttcggtggaacggtgtgttgaactgacaattgttgctgctac

SEQ ID NO: 30270 - DNA, 433 bp, Zea mays
  Clone ID: LIB3059-049-Q1-K1-C12
aaaacccttctttttgtgaaaaaggagttgcctgggttggcttgaaggacccttgaggggttcccttggggttgggttggtgctgattatgtggttgagtctactggggttttcactgaccaggaaaaggctgcagctcacttgaagggtggtgccaagaaggttgtcatctctgctcctagcaaggatgcccccatgtttgtcgttggtgtcaacgagaaggagtacaagtctgacattaacattgtctccaatgctagctgcacaaccaactgccttgctcctcttgctaaggtcatcaatgacaagttcggtatcgttgagggtctgatgaccactgtccatgccatcactgctacccagaagactgttgatgggccctcatctaaggactggaggggtggaagggctgctagtttcaacatcattccca

SEQ ID NO: 30271 - DNA, 439 bp, Zea mays
  Clone ID: LIB3059-049-Q1-K1-C2
ctctatcgtcccgatccgtcgttcatcagagtcgtaaccgtacgccctcgttcccctcgtcgctctcccaagtcccaaccccggttcctttggtctgcgcgagcgagcatggcgtcgccgtcgcccgccgtctcgtctctggagacggaggcgccccaggctaccgtcacgagggagcgcaggctcaaccccgacctgcaggagcaccttcccaagccatatctcgcgagggctatggtggcggtggacccggaccatccgaccgggaccgaggggcgcgacccccgcggcatgagcgtgcttcagcagcacgtggctttcttcgaccgcaacggcgacggcgtcgtctacccctgggagactttcaaaggcatgcgagcaatagggtgtgggttctttacatccctcgtcatctcgttcctcatcaacctcgtcatga

SEQ ID NO: 30272 - DNA, 166 bp, Zea mays
  Clone ID: LIB3059-049-Q1-K1-C3
gtattgctatgggatcctgtgccaaaacaatactactacgcaacaggatcccatagcaatacgagaaatgtgcaacgtctcataagaacaggcactgcataaattgaaggaaagaatgatttccatcgatttatgcagtgcctgttcttaagagacgtagcacata

SEQ ID NO: 30273 - DNA, 251 bp, Zea mays
  Clone ID: LIB3059-049-Q1-K1-C4
ccccgctatcgcatactcttccacggtcgcgcttctacgcatcaggatcccatagcggtacgagcaatgtgcaacgactcacaagaacacgcactacgtaaatagaaggaccgactgatttcacatcgattaacgaactgcctgcacgaccgagacgtagcacatattgaggacagcgacatgattctgacgcttcctgtcagagacatctcgcacgagctgatgacagatccgaatgcgtccatcgaccc

SEQ ID NO: 30274 - DNA, 415 bp, Zea mays
  Clone ID: LIB3059-049-Q1-K1-C5
caagggcaagcggttccgcgccggcgacgtgctcgcgttcaggtacaacgccaaggcgcacaacgtggtgcccgtgagcgcggctgagtacaggtcgtgcagtgcgcccaagggcgtgagggcgctcaccactgggaacgaccgcgtcactctgaagcgcggcgccaactactttatctgcagcttcccaggccactgccaggccggcatgaagatcgctgtcaccgacgcgtgaggccttcggccgatcagccgtgctggctacgacgaccgctggacacacggtctcgatcggtggccagcttattattattgttatttccctgttcaaagtaaaagcgtcgcgtccttaacctgcgtgtaggtagagcggtgttaggtgtgtagagaccggccggcactattgaaaacttaa

SEQ ID NO: 30275 - DNA, 429 bp, Zea mays
  Clone ID: LIB3059-049-Q1-K1-C6
gagaccaacaagcatcatagaaagtggaatccagtagcaacaatagagcaacaatggcgaccaagatattttccctccttatgctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgtttcaacaatcgccagccctatctttggtgcagtcattggtacaaaccatcatggcacaacagctgcagcaactcgtgctacctctgatcaaccaagtagctctggcaaacctttctccctactctcagcaacaacaatttcttccattcaaccaac

SEQ ID NO: 30276 - DNA, 418 bp, Zea mays
  Clone ID: LIB3059-049-Q1-K1-C7
cggacgcgtgggcttggacaagggggttttgggaaagtatataaaggagcacttccagatggcactaagattgctgtaaaacggttaactgattacgaaagtccaggtggagaggctgctttcttgcgtgaggttgagctaattagtgttgcagttcaccggaatcttttaagattgattggtttctgtacaacacaaacagagcgcctacttgtttatcctttcatgcaaaatcttagtgtggcctaccgactacgagaatttaaacctggggagccaatattagactggtctgcaaggaagcgagtggctataggcacagctcgtggactggagtatttgcacgagcactgcaatcctaagattatacatcgtgacgtcaaggctgccaatgtcttgcttgatgaaggttttgaac

SEQ ID NO: 30277 - DNA, 420 bp, Zea mays
  Clone ID: LIB3059-049-Q1-K1-C8
cccacgcgtccggcgcggagagtgagagcccgggagaagcagcggctgggagcaagatggtgcagcgcctcacctaccggaagcggcacagctacgccaccaaatcgaaccagacccgcgtcgtcaagacacctggtgggaaacttgtgtaccagtacaccaagaagcgcgcgagcggaccgaagtgcccagtcaccgggaagaagatccaaggaattccacacctgagacctgctgagtacaagaggtccaggttggcaaggaaccaaaggactgtgaatcgtccatatggtggtgttctgtctggtactgcagttagggagaggatcatccgtgcctttttggtcgaggaacagaagatagtgaagaaggtgttgaagatccaaaagaccaaggataaggccttcaagagctagacga

SEQ ID NO: 30278 - DNA, 414 bp, Zea mays
  Clone ID: LIB3059-049-Q1-K1-D1
cccacgcgtccggatggaagaggttagacggttgcgagtgcagcagcgtatccgaacttctgaaagcaaagatgccaacactgaaggaaatgaaatgcctgagattccatcaactattccatttatgcctgatgcgtcaccaaagactatgaagcaactctatatgacatcgttctctgtcatatctgggataatcatttttggaggcttgatagccccagtacttgaactgaaactagggctgggtggcacatcttatgaagatggtataaggaccttgcacttacctcttcaattgagtcacgtagatcctatagtggcatcattttcaggtggcgcatttggtgttatctcagctttaatgttggtcgaagtgagaaatgtcaggcagcaagagaagaaaagatgcacata

SEQ ID NO: 30279 - DNA, 278 bp, Zea mays
  Clone ID: LIB3059-049-Q1-K1-D10
aacctgtgctggtcttttcaatgactctgtgtagtgcgagcaacgtgtacgtctgcgtgataaccaatgtgaacacagaatacttgagaaaccaccagttgccgaataccacgacttatgctagttcaaaggcatacagtttcacgaacgtgcagactgatgtactgtcttcaaaggtcacacttctaaagcacaaggttgaagtccccgaggttggtaatgctattcacgagtgatcttgcatgcctgcattcatacaatcatattctgaatctgtg

SEQ ID NO: 30280 - DNA, 378 bp, Zea mays
  Clone ID: LIB3059-049-Q1-K1-D2
gccacgcgtccggatccactacctcagacagttgtgagtgcaccagcgtacacgaactgcagggggcaaaggtaccagctctgaatgacatgaactgcccgagatgtcatcaactgtgcgatctatgcatgactcgacagcctacactatgaagccactgtatatgacctgatccgatgtcatatctgggatcatcatgttagacaggctcgatcgccccaatacttgaactgaaactacggctgagtaccccatgttatgaagatggtacaaggagcttgtactgacctctacaatcgacttacgttaaccctatacctgcatcatacgcaggaggcgcatcagctgttatctcagcatatactgatggccgaagtg

SEQ ID NO: 30281 - DNA, 404 bp, Zea mays
  Clone ID: LIB3059-049-Q1-K1-D3
cacaagcccacggagtgccttcctctgatcctcatcatcaggaacaggctcaagtatgctctgaactaccgggaggtcatttctatcctgatgcaactccatgtacttgttgatggcaaggtcaggactgacaagacctaccctgctgggttcatggatgtcatttccatccccaagacaatggacaactacaggctgctttatgacaccaagggccgcttacgtcttcacacaatcacggatgacgatgccaagttcaagctctgcaacgtgaggtctgttcagcttggccagagaggcatcccctacctgaacacctacgacagccgcaccatccgctaccccgactcgctcatcaaggccaactacaccatcaagatcgatctgtagaccaacatgatcat

SEQ ID NO: 30282 - DNA, 439 bp, Zea mays
  Clone ID: LIB3059-049-Q1-K1-D4
cccacgcgtccgcggacgcgtggggtcaatatagtacctggcattgaatccgtgtactggtgggagggaaaggtacaatctgatgctgaagaattactcatcatcaagaccagggaatcacttctggatgccttgactgcacatgtcaaagccaatcatgaatatgatgttcctgaagttattgctctgcccataactggtggtaacaccaagtatttggaatggatcaagaacagcacccgggacaagtgatctctttttttttggagctcgacataatgcgatgatcgaagtgcccatggctccttagctcttccagtggcttgcacacaagggtgtatcctctcttgacctggacatctcaattacgttgctgtaccgaatccatatctaccatcttcaggtaacaagtgatttggtgtcccgtgtgggtaatcca

SEQ ID NO: 30283 - DNA, 415 bp, Zea mays
  Clone ID: LIB3059-049-Q1-K1-D5
gcgtggagcgcacccgctcggtcgactcgagcaagccggtctcgaggtcgctggctgctgagttcgaccaggaggctgacggggaggaagaggacaatgctggagagaccagcgatccagatgacggcagtgtgcagtacctgaggaggaggctcaaggaggagatgctgctgaaggaggttgcgctcgaggagctggagaaggagaggcatgccgcagcgtctgcagccgacgaggccatgtccaagattgcgtgcctgcgtagcgagaaggcgctggtggagagggaggcgcggcaattccaggagatgatgcagcagaagcagatgtatgaccggcaggtgatcgagtcacttcagtgggtgatcatgaagtctggaatgcaaggctgggagccagaggccataactgatcg

SEQ ID NO: 30284 - DNA, 436 bp, Zea mays
  Clone ID: LIB3059-049-Q1-K1-D6
cggacgcgtgggttgtgattgcggcagcaccgccgaccacgagcccgccgaaaggctcctccgcctgccgttccagggtgcactgccgccattgctcatctccccgtggtgcggaggtccacccgggcgccaattggtctcctctttcgttggcagactgagtggcatccaatcctgaatcaatgaggggctggggtttgctcgtgttatcgctacatgttctttcatgcctggttagtggcgttgcttctggtcgaacaagctcttatgtgcgcacagagttcccatctacagatatacctctagaaagtgaatggtttgctattccaaagggatacaatgctccacagcaggttcatatcactcaaggtgattatgatggaaaggcagttatagtatcttgggttactccagaagaacctgggccaagtgaagt

SEQ ID NO: 30285 - DNA, 392 bp, Zea mays
  Clone ID: LIB3059-027-Q1-K1-D9
accggtattgcctgcccggccggacccacgcgtccggagagtggaaaccagcatcaacattggtaccactgaggctaccctgatattgacgtgggttatgctccatgctgtttctacataccttgctgacgccacaatgctccctcaatgctaacacgctcctatagctatcattattgcgccataccttgcatacattatagctccaatatatgaaaacccagctattcaaccatatctgctgcaacacgcactcgccataagcagcatacctaaatcgcccttgttgacacaacattcgtcagtcctatctttagcgcaggcatcgtgacataccatcatggcacaacacctgtaccatctcgtgctacctctgatcaaccaagtagctc

SEQ ID NO: 30286 - DNA, 420 bp, Zea mays
  Clone ID: LIB3059-027-Q1-K1-E1
cattgttggacgcgttcccctcctgcacgcaacctcatctcgtcctccagatcctgggtggccgtcctccttgataccttgcctcgcgagtgctctcggtgagctactttgttttgatttatcaggaaatccgtttgcttcatgttatgcaggctcagatctgattgctggattcggcatcttacgggcttgaatagagctaggactgggagaaaacaacaaacccgcgttggatcctgtatcggttagtccttgccttcaaggttcatgttgttttgttttggtggtcgagcatcgcatgttctgcttctggttccagatctggagaaatttctaagtcgtcgtcgtcgtcgtcgttcggttcggagcggatctgaggcgacgatggctggaggcggcgggatctcttggtctgcagtc

SEQ ID NO: 30287 - DNA, 404 bp, Zea mays
  Clone ID: LIB3059-027-Q1-K1-E10
cccacgcgtccgcggagaagttggacccaagaccattcatgttcctactggggagaaggtttctgtttttgatgcggccatgagatacaaatctgagggccatgctactataatcctcgctggtgctgagtatggaagcggcagttctcgtgattgggctgctaagggtccgatgctcctgggagttaaagctgtaattgccaagagctttgagcgtatccacagaagcaacttggtggggatgggaatcattcctctgtgcttcaaagctggtgaggatgctgattcgcttggcctcactggacatgagcggtacagcatcgatctccctaccaacctcagtgagatccgtcccggccaggatgtgactgttactaccgacaatgggaaatctttcacttgca

SEQ ID NO: 30288 - DNA, 398 bp, Zea mays
  Clone ID: LIB3059-027-Q1-K1-E11
cccacgcgtccgcccacgcgtccgatgacacggaagattacatcaatatccagcttgggaaccaccgtaatcagttgattcagctagagttattcttgagttctggtaccgtctgtctgtcgctgtactcattagttgctggagtctttggtatgaatattccgtatacctggaatgacggccacggatacatcttcaaatgggtggttcttgtatcagggcttttttgtgcctttatatttgtctccattgttgcttacgcacgacacaaggggctcgtcggatcctgaatagctgaaataaccgcgtacttgcttccctcaactgtaaatttgagccagtgagcatcgactttgcggggtgattcatctgttgtaccaaattcggtagtatcaaat

SEQ ID NO: 30289 - DNA, 413 bp, Zea mays
  unsure at all n locations
  Clone ID: LIB3059-027-Q1-K1-E12
ggcgtcgtcgtctagcagcagccaccgccgcctcatcctcgcagccgccgtcctgctgtccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgcctagaggacctgccgggctgcccgcgggaggtgcagaggggattcgccgncaccctcgtcacggaggccgagtgcaacctggccaccatcagcg

SEQ ID NO: 30290 - DNA, 415 bp, Zea mays
  Clone ID: LIB3059-027-Q1-K1-E3
caaacgcccaatcacaacaacaatccttggcacatctaaccatacaaaccatcgcagcgcgagcatcaacaagcactgagccacctagccgtggtgaaccctatcgcctacttgcaacaacagctgcttgcatccaacccacttgctttggcaaacgtagctgcataccaacaacaacaacagttgcaacagtgtctgccagcgctcagtcaactagccatggtgaaccctatcgcctacctacaacagcagcaacttctttcatctagcccgctcgctatgggcaatgcacctacatacctgcaacaacagttgttgcaacaaacaggtgctgaacaaaattgtaccagctcttactcagctagctgtggcaaaccctgctggctacttgcaacaactacttgcattcaaccaa

SEQ ID NO: 30291 - DNA, 288 bp, Zea mays
  Clone ID: LIB3059-027-Q1-K1-E5
cgcaaattgcaccaagaaatccatcgagaggccgtcgacaggggaattaatggcgggggcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctaccgtggccggagctgaagaggagatgctgccgggagctggcggacatccc

SEQ ID NO: 30292 - DNA, 428 bp, Zea mays
  Clone ID: LIB3059-027-Q1-K1-E6
gagagacaggagtgaaggaaagaagcataagggtggctcttcaggagctggatctggggttctcgtgccccttcaactttcggatgatttagtaaaatttatcggcactggtgagagcatgttatcacgatctgatgtcgtgaagaaaatgtgggattacataaaagggaacaacctgcaggatccttctgaccggaggaaaataatctgcgatgagaagctgaaggacctatttggagtggaaacattcaccggctttactgtttcgaagctgcttgcccctcattttaccaagacgaagtagcaacctgccatccacatcttctaaaaccaaaaaggcttggtaattttgtttttgcagaatgtgtaatcatggaacagttaggagctatgtgggtggtgtgaatttttttttggttacctatggg

SEQ ID NO: 30293 - DNA, 357 bp, Zea mays
  Clone ID: LIB3059-027-Q1-K1-E7
ggagcactgctgtgaggaaggccatccattttgtcaacctgcggacagctggaaggggtagtggaaacctggctatgaactccgtaccgaaaccagcacttgggtccgaaacatcttggagggaggattttgctgtgggggataaggatgctgtggtcattgttgatcatgggtcaagacgccaagaatccaatctcatgctaaatgactttgttgagatgttccgggcgaagactagctatagtattgttgaggctgctcatatggaactagcgaaccttcctataaagaatcttttggaaaatgtgttccaccaggaacattaacaggtaatggcaagccatattttcttttccc

SEQ ID NO: 30294 - DNA, 357 bp, Zea mays
  Clone ID: LIB3059-027-Q1-K1-E8
ggagcacactagcaggaacaactctgatcaatccagtacaaccacgacaacatgggggacgttcctaaaacgagactgacgcactgcatgaacatagagtgcagcaagcacacactccacacggtgactcacagtaacaagggcactgatagacaatctgacaaatcaaagcgcactaattaccaagggcagtcaggatatggacgtcagaccaatcctgtcttccacatgatggccaagagcacctacaagattgttctgaaactgccatgactgagcagcaagcactactcacaaggagcatatctataaattcacgcattttcagattggtagcaacactaactgcaacggcac

SEQ ID NO: 30295 - DNA, 382 bp, Zea mays
  unsure at all n locations
  Clone ID: LIB3059-027-Q1-K1-E9
gctctgggcagcgtgcgcacgtggggtacctagctcgctctgctagcctaccatgggtgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccggtgctggtgccggccgncatcgcgctggcgctcatggcggccgggttcgtcacctccggcggcctcggcgtcgctgcgctgtccgtgttc

SEQ ID NO: 30296 - DNA, 326 bp, Zea mays
  Clone ID: LIB3059-027-Q1-K1-F11
gcagcagtgacagggcacgccgaagctgttcatccgatggaccttctatgacttccaggcgagcaacatgtcgctgtacgactacatcgctgtgaacgccacgaactactccatgtacctgacgtacaccacatcacgttactgcaataagcggctccgctaggcgctctgcccgatcgtcgtgcgccttacaaactgcatcatgatgcacgagctgctcatcggcgacaaggtcatcgatgtactgatcatcgagcataccctggagatcattcacctgctcaccgatgccaaccccatccaggtacctgtccacgcgatcatca

SEQ ID NO: 30297 - DNA, 406 bp, Zea mays
  Clone ID: LIB3059-027-Q1-K1-F12
ggtatggccacaaaggaaataatctgtttctaggcgactggacctgttgtcctgcttggagcccggtctgggttaagctgtgaagctcctgcagcctcttgctcctgcagttttgcgtcaagtgtctagcaactctagcatatgtagtgctgcgtaagatgtcggcacctcagatagacagaggtgccatatttcttgctcatgtaatgttatttgttgtatgctcgtttgtatgtactacatgaagcattgtaaaattgagcaacagcaaccagagctcgagaatcttaggcgcaaccaaccaaccccgtatcgatgaattgacaataaagctgaatattttaggtgtttagaaagtattttctcttagatttttggggagattaggatacaaactctctgattc

SEQ ID NO: 30298 - DNA, 426 bp, Zea mays
  Clone ID: LIB3059-027-Q1-K1-F2
gcgaagcgcactagcaacgacctaacaccaatggctaccaagatattagccctccttgcgcttcttgcccttttagtgagcgcaacaaatgcgttcattattccacagtgctcacttgctcctagtgccattattccacagttcctcccaccagttacttcaatgggcttcgaacatccagccgtgcaagcctacaggctacaactagcgcttgcggcgagcgccttacaacaaccaattgcccaattgcaacaacaatccttggcacatctaaccctacaaaccattgcaacgcatcaacaacaacaacagtttctgccatcactgagccacctagccgtggtgaaccctgtcacctacttgcaacagcagctgcttgcatccaacccacttgctctggcgaacgtagctgcataccagcaacaa

SEQ ID NO: 30299 - DNA, 400 bp, Zea mays
  Clone ID: LIB3059-027-Q1-K1-F3
agcatccctttctttgagatggttgaagtgtacaactctttgagcgaggaaggcaaaggggagttcaacaaggcttatagcgcatcgttttacccatgcatggatatactctacgaatgctatgaagatgtggcctctggaagtgaaatccggagcgtggtgttggctgggcggaggttttatgagaaagagggcctcccagcttttccgatgggcaacatcgaccaaactcgcatgtggaaggttggtgaaaaggtgcgctcaacccgtccggaaggtgatcttggcccgctccatgccttcactgctggagtgtacattgccctgatgatggctcagattgagatcctgaggaagaaagggcactcctactctgagatcatcaacgagagcgtgattg

SEQ ID NO: 30300 - DNA, 424 bp, Zea mays
  Clone ID: LIB3059-027-Q1-K1-D8
cggacgcgtgggtcaccgagtccaagtccaagaatgatgccaggacctcctgcttctggatatgaccggtcacctctattttacggaggaggtggtggcgccccacctccaattccgcttggaactggtagctatggtgctccatatccacaccttgggatgcgatatggctatggtccaccagtaggacctcctggttcatatggtcttttctcttcatatggtccacctgggccaatgagtggtatgggatatggcccaggacctgagctaggccgatatagctatgggtttagaggttctccaatgccggtttctagcccatggtctcgtggagcattagctgaaaacaatgacaacattgcttcacgaaagcgccgtggaggccctgatggactttctgagggtgactggacctgtccca

SEQ ID NO: 30301 - DNA, 387 bp, Zea mays
  Clone ID: LIB3059-027-Q1-K1-C11
caactagcaacatagaaagcacaatagtgtaccaacaatggcagccaaaatattttgcgttccttatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttc

SEQ ID NO: 30302 - DNA, 402 bp, Zea mays
  unsure at all n locations
  Clone ID: LIB3059-027-Q1-K1-C12
gccatcttcttcgtcgacaagcaggggagttaggtctcacatgcatgcttcatcacagtgttgactgcataacgaaacacatcgtcgtcggatcggagatgatgagttccgtcgtcgtggatgctgctgctaccagcagcagcgagaagaagacgtcgtggccggaggtggtgggcatgtccatcaaggaggcgacggagactattctcaaggacatgcccaacgcgtacatccaggtgctgcctgttgggtcgcccgtgacgctggaccttcgccccgaccgcgtccgtatcttcgttgacaccgtcgccatgactccgacagttgggtgatacataccaaatgcaataaacaaaccctactttntattntatgtttccagttaataataaaccaggcctt

SEQ ID NO: 30303 - DNA, 366 bp, Zea mays
  Clone ID: LIB3059-027-Q1-K1-C3
gttgaaccaagccttccgttccaaccccaacttccaaaggccgcatattcagccccgcccccatttcctattaaccggattgcccctgccaaataagggacccgttaattccccaactttaaaactcgtcatctccgcgaatgttgaacctgtaaaactaccttttttaaaaagcatctcactggagagtttgaaaattaatatggaccaaccattggtattgaaattcatccgttagatttcaacactaacctttgtaaaatcaaggtctacttcttggataccctacggcaagaaaaatttggtggccttaaggattgataccatattcattgccaatgttccatcattatgcttgatgtaacc

SEQ ID NO: 30304 - DNA, 404 bp, Zea mays
  Clone ID: LIB3059-027-Q1-K1-C4
cggacgcgtgggctgtttcagtagaagagaaacagttgtgccaaggacccaagatggggggctacctaacctctcagcaactgtggctgctgtgaagaatcctaaccctaaggtggtttatgatgagtacaaccatgaaagatatcctcctggagatcccagcaagcgtgcctttgcatactttgacctgagtggtgggaggttcatatatgctgcactgctgcatcttctcgtactgaagtgtgcactgagcatgtcagcacgcaaggatgtgcttgcccttgcttcactagaggtggacctgtccagtatcgagccaaggaccacagtgaccgtgaaatggcttggaaagccagtctctatcatgcgtcggacagaggatgacatcaagcttgtcaacagtg

SEQ ID NO: 30305 - DNA, 322 bp, Zea mays
  Clone ID: LIB3059-027-Q1-K1-C5
accaagcgtataccgacaactacggccttacatatgttactcccaagatataatacggggaagcacgcttgtctttctaaatgatctgaacttacgagcacattacatcacagctatcaatttctcctagctacaatatttcgctgtacccaccaactatctctaacatgggacgatgaaatcccacagtctaaatctaactgttacaacctaggcatcgatccaagaatgttacactttctataatgttgaatcgcaataactccatgtcgtctcatacataacctacagtcacattgcatcgagatcaaccacaacatca

SEQ ID NO: 30306 - DNA, 354 bp, Zea mays
  Clone ID: LIB3059-027-Q1-K1-C6
cccacgcgtacgaccacgcgtccgtccactcgtacgctgatctgcaaccataatgctgtgaatagtatttctcagcgacatatctctgcacttcctgacacaattcatggctgcaatccatatgaaaaaaatattacagaaagatgtatacagcaatcatgcaaaacattgcaagttgtaatctcagagtggatatcaaaatttgacaacatggaaattgatcgttcaaggttgcaattgaataatgtggatgcaattacttccaggacatatatctgcaaccattgctacagcaagttggctgatttcctgctctactgattccgtgtatcattgtcccaaaatctttttcca

SEQ ID NO: 30307 - DNA, 429 bp, Zea mays
  Clone ID: LIB3059-027-Q1-K1-C8
agaccaacaagcaacatagaaagtggaatccagtagcaacaacagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcaacccttgttgtttcaacaatcgccagccctatctttgggtccagtaattggtccaacccaatcaggcaccaacacctgcaaccacctcgtcctacctgtgatcaaccaagtagctctggcaaacctttctccctactctcagcaacaacaatttcttccattcaacc

SEQ ID NO: 30308 - DNA, 336 bp, Zea mays
  Clone ID: LIB3059-027-Q1-K1-D1
atgggagcgaatcgagatggcggcgtcggatgttgcgtcccgctgctaccatcacggcgtgggctggggcaccgacgaccacatggctcacgacgtcttcaacaattaccgcgaggaccgtcagtacaagatcgttctcgatcggttgactcagacgtctctcggcttgggcttcatgacgggcccacagtggaggcgatgcttaacggcatacatggcatgaacgccaacgcgcttgactgtcgcaacatgaccgggcacgatgaccagtcccgcggcggtcttagaggccgcagcggtaggttcggtggtggtcacggactcggctgctacggt

SEQ ID NO: 30309 - DNA, 416 bp, Zea mays
  Clone ID: LIB3059-027-Q1-K1-D10
cccacgcgtccggagagaaaggacgctgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgctgaagagattagggaggcacccaagcgcgactcgagtgaggggcagtaaagccggctttatgtgcctagaaactagtagctagtgtttgctgctgtcgaatg

SEQ ID NO: 30310 - DNA, 409 bp, Zea mays
  Clone ID: LIB3059-027-Q1-K1-D12
cggacgcgtgggctagccttcacttctcagcacggcagccttcgacccccgactgcagccgccagccgcgccatggagcaagccgccatgccgcaggttccccgcgtcaagctcggcatccaggggcttgaggtgtcgaagctggggttcgggtgcatggggctcacgggcacctacaacgcgccgctcggcgacgaggccgtggccgccgtcgtcgcgcacgccttccgccgcgggatcaccttcttcgacacctccgatgcctacgggccccgcaccaacgagaccctcctggggaaggcgctcaagcagctgccgagggagcaggtgcaggtggccaccaagttcgggataggtcagggcgccgctggcatgaccgtgtgcggcacgcccgagtacgtacgcgcct

SEQ ID NO: 30311 - DNA, 163 bp, Zea mays
  Clone ID: LIB3059-027-Q1-K1-D2
catacacataatcaaaaacaccatacttttaacatcctcaccaacgtaccatctctcgtggctctcaaaaatcatagctcctctaattcatgctgaatcttatcaccttcatacacacaacatctatctacatctttcccacatactactacctatcatctat

SEQ ID NO: 30312 - DNA, 416 bp, Zea mays
  Clone ID: LIB3059-027-Q1-K1-D4
cgactgcagattggagaactcgacaccatgaacgtgctgatcgttgcccttgctctcggggcgctcgctgcgagcgccgcctccagtacaagcggcggctgtggctgccatacaccaccgtttcatctaccgcctccgttctatatgccgcctccgttctatctgccgccgcatcagcagccgcagccatggcaataccccactcaaccaccgcagctaagcccgtgccagcagttcggatcctgcggcgtccgcagcgtcggcagcccgttcctgggccagtgcgtcgagttcctgaggcaccagtgcagcccggcggcgacgccctacggctcgccacagtgccaggcgctgcagcagcagtgctgccaccagatcaggcaggttgagccgatgcaccggtaccaggcgacata

SEQ ID NO: 30313 - DNA, 330 bp, Zea mays
  Clone ID: LIB3059-027-Q1-K1-D5
cggacgcgtgggcggacgcgtggggagctgcatctccgatcggttctcctgctcgaggacttccaggaagacggggtcgacggtgatgtggctgtcgatgcggacggagaaggggcgggaccagagcagcaccgtggcctcgccggcgatctcgacggccgcgtccagctccatgtggcggcgcgcgacgtcagagaggagggcgcgggcgcggtgcgcgagctcgacaccgtcgaggcgcgccgggaggtggagcacgcggcaggaggtggcgggctgctcgccggcgtcgaggcgggcggtgccgacgtgcgcgccgtcgtaaaggat

SEQ ID NO: 30314 - DNA, 424 bp, Zea mays
  Clone ID: LIB3059-027-Q1-K1-D6
cgtccgcctcagcccgccgcaaggagaggtaagttcaggagacatcttcgagaagcggaaatggctcctaaagctgctcctgccaagaagggtgatgccaagacccaggccttgaaggttgccaaggctgtgaagtctggggcagccaagaagaagaccaagaagatccgcacgtctgtgacatttcaccgccccacgaccctgaagaaggctagggaccccaagtacccacgaatcagcactaccggaaggaacaagcttgatcagtaccaaattcttaagtaccctcttaccacagaatcagcgatgaaaaaaaatgaagataacaacactctggtcttcattgttgacctcaaggcagacaagaagaagatcaaggctgccgtcaagaagatgtatgacatccaggcaaagaaggtcaaca

SEQ ID NO: 30315 - DNA, 382 bp, Zea mays
  Clone ID: LIB3059-027-Q1-K1-C10
atcgagtacagccggctaggtaatctggtacgacgacccacgacgacatggcggcgggcgacgaccaccagcagcagcaagaagtcgtcgtcgccgtcgtcctcgagctcggcgcagcgggcagcagctgccgccctgctcgtggcggtgtccgtcctggtggtgggcgcggcggcggtgtgcgacatgagcaacgagcagttcatgtcgtgccagcccgcggcggccaagacgacggacccgccggccgcgccgtcgcaggcgtgctgcgacgcgctggcggtggcggacctcaagtgcctgtgcggctacaagaactcgccgtggatgggcgtctacaacatcgaccccaagcgcgccatggagctgccggccaagtgcg

SEQ ID NO: 30316 - DNA, 403 bp, Zea mays
  Clone ID: LIB3059-027-Q1-K1-A5
cgcgaacaaggcggtcgatgcggcggtgaaggccggcaggacgatcatcgactgggggggcatggccaagttgctcgtcaccgacgaggcgcgcaaggagttcgccgtcctgcgacgcgctttccatgacgtcaaccaccagctccagaccaagttctcccaggaaccccagccgattgattgggagtactacagaaaaggaattggatcaaaagcggtggatatgtacaaagaggcttttgaaagcatcgagatcccgaagtacgtcgacacagttactacccagtacaagccaaagtttgatgctgcgattgctgaattaaaggaggctgaaaaagagcatcataaggagtcagaaaggatagagaaagaacttgctgaaatggaagaaatgaggaaaaag

SEQ ID NO: 30317 - DNA, 290 bp, Zea mays
  Clone ID: LIB3059-027-Q1-K1-A6
agaccaactagcaacatagaaagcacaatagtgtaccaacaatggcagccaaaatagggtgcttccttatgctccttggtctttctgcaagtgttgctaccgcaaccattttcccacaatgctcacaagctcctatagcttcccttcttcccccatacctctcaccagcggtgtcttcagtgtgtgaaaacccaattgttcaaccctacaggatccaacaggcaatcgcaacaggcatcttaccattatcacccttgttcctccaacaaccgtcagccctattacaagag

SEQ ID NO: 30318 - DNA, 374 bp, Zea mays
  Clone ID: LIB3059-027-Q1-K1-A7
accaagcgaagcgcactagcaacgacctaacaccaatggctaccaagatattagcccggcttgcgcttattgcccttttagtgagcgcaacagatgcgttcattattccacagtgctcacttgctcctagtgccagtattccacagttcctcccaccagttacttcaatgggcttcgaacatccagccgtgcaagcctacaggctacaactagcgcttgcggcgagcgccttacaacaaccaattgcccaattgcaacaacaatccttggcacatctaaccctacaaaccattgcaacgcaacaacaacaacaacagtttctgccatcactgagccacctagccgtggtgaaccctgtcacctacttgcaacag

SEQ ID NO: 30319 - DNA, 361 bp, Zea mays
  Clone ID: LIB3059-027-Q1-K1-A8
cggacgcgtgggctgattcagtggaagagaaacagttgtcccaaggaaccaagaggggggcctagctgacctcccagcaactgtggctgctgtgaagaatcctaaccctaaggtggtttatgatgagtacaaccatgaaagatatcctcctggaaatcccagcaagcgtgcctttgcatactttgtcctgagtggtgtgaggttcatatatgcttcactgctgcatcttctcgtactgaatgatgtcctgagcatgtcagcaagcaaggatgtgcttgcccttgcttcacttgaggtggacctttccagtatccagccagtgaccacagtgaccgtgaaatggcgtgtaaagccagtcttt

SEQ ID NO: 30320 - DNA, 396 bp, Zea mays
  unsure at all n locations
  Clone ID: LIB3059-027-Q1-K1-A9
cccacgcgtccgccctcgttcctgtcgcgcagccacgacctccacttccacatcttcgccggcggcggcgcggtcagttgaaccatggcggactccaaggccacctcggcggtcaccctccgcacccgcaagttcatgaccaaccgcctcctggcccgcaagcaattcgtgcttgaggtgatccaccccggccgcgccaacgtctccaaggcggagttgaaggagaggcttgccaaggcgtacgaggtgaaggaccccaacaccatctttgtcttcaagttccgcacccacttcggaggaggaaagtccactggtttcggcctcatctacgacaacctcgaggctgccaagaagttcgagccgaaataccgnctcatcaggaatggtcttgctact

SEQ ID NO: 30321 - DNA, 369 bp, Zea mays
  Clone ID: LIB3059-027-Q1-K1-B1
accacgcgtccgttaactggatgaacacaggtatcgttgagagtgatctggttctaacagtgggtccacattatgttaaggaactcacttatggcccagataaacgtgttgagttggatggtgtccttcgcacaaagccttttgaaattggcattgtaaatggcatggatgtttatgaatgggatccttcaacagataagtacaccagcgtgaaatatgatgcaacaacggtaactgaagcaaaggctctcaataaagagaggttgcaagctgaagttggattgcctgtggactcgagcatacctgatatagtcactgtcgggcgtcttgaagtacagaaagggtctgacatactcattgcatccattc

SEQ ID NO: 30322 - DNA, 395 bp, Zea mays
  Clone ID: LIB3059-027-Q1-K1-B10
cccacgcgtccgcccacgcgtccgcgctcagggtctggctcgctatgccatcatctgggaggagaatggtctggtgccaattgttgagcctgagatccttgttgatggccctcatgacattgatcgctgcgcttacgtcactgagaccgtccttgctgcctgctacaaggcgctcaacgagcaccatgtcctcctggagggtaccctcctgaagcccaacatggtgactccaggctccgactccaagaaggtgacccctgaggtgattgctgagtacaccgtccgtaccctccagaggaccgtccctgctgctgtgcctgctgttgtcttcctctctggtggacagagcgaggaggaggccacccgcaacctcaatgccatgaacaagctcagca

SEQ ID NO: 30323 - DNA, 238 bp, Zea mays
  unsure at all n locations
  Clone ID: LIB3059-027-Q1-K1-B11
cccacgcgtncggctccaccagttgttaagaacaactgatgcttgcgtgcttacgaacgagagcgaaccatgcatgaccccccaaccaagttcatttcatcctttcatgcatgtactatgtatgtagctctacatatatatatattgctactactatcaagcatgtatgtcgccgttgtggagacacatctattgatctatacatgagcttgtggaagcagataggtctgcattaatt

SEQ ID NO: 30324 - DNA, 183 bp, Zea mays
  Clone ID: LIB3059-027-Q1-K1-B12
cccacgcgtccgcagggatcggattcggatcaccatgccgtccaccgtgaactccgcgtgcggtcgaccagaaccttgagctcgccaagcaatgctcgcgagagggccgcctcgcagggttcaaggcagcagctgtcgcgaccgtcgcctctgcagttcccaccctggttagcgtcaggatgc

SEQ ID NO: 30325 - DNA, 424 bp, Zea mays
  unsure at all n locations
  Clone ID: LIB3059-027-Q1-K1-B2
agcaaagctccatcaccttggcaggcttgtgtcacttgagatggggaaaattcttcctgagagggatcggtgaggttcaggaaatcatcgacatgtgtgattatgctgtggggctaagtcgccaactaaatggatccattataccatctgaacgaccaaaccatatgatgatggaggtgtggaatccccttggagttgtgggtgttataacggcatttaatttcccttgtgctgtgcttggttggaatgcttgcattgctttggtctgtggaaattgtgtcgtctggaaaggtgctccaacaactccactgatcactattgcaatgacaaaaatagtggctagtgtattggagaagaacaacttgccaggcgcaatttttacatctttttgtggnggcactgaaattggtcaagcaattgccct

SEQ ID NO: 30326 - DNA, 401 bp, Zea mays
  Clone ID: LIB3059-027-Q1-K1-B6
ggcaaagacagcagcgcatcacctgcaagtaggagccctagtcgctcccctcctcgcgggacgccaccttctcctaagagatctcctgtcaggcacaatgatgaccggtctccacgctcacggagcccttcaacataagcacaattcacttgcaaagcatcttcaacagctcaggatgaatggacttgctctgatcctatgtgtgtgtggctatgcttgtgctcaatggtgggcacttttcagttaaagctttgtagtgctgtctgtcagttgctgcctcaaacttggaatactacttctggttggcacctgaactgcttatcaaaaactttatgtataccaattacattccacttttaaccttcatattagtattaccatattataactgtcttttcagt

SEQ ID NO: 30327 - DNA, 389 bp, Zea mays
  Clone ID: LIB3059-027-Q1-K1-B7
cccacgcgtccgcccacgcgtccgtcgcaacgcaacagcaacaacaatttctaccaggactaagccaactagctgtggtgaaccctgtcgcctacttgcaacagcagttgcttgcatccaacccacttgctctggcaaacatagttgcataccaacaacaacaacaattgcaacagtttctaccagcgctcagtcaactagccatggtgaaccctgccgcctacctacaacagcaacaactgatttcatctagccctctcgctgtggttaatgcacctacatacctgcaacaacagttgctgcaacagattgtaccagctctgactcagctagctgtggcaaaccctgctgcctacttgcaacagctgcttccattcaaccaactgact

SEQ ID NO: 30328 - DNA, 321 bp, Zea mays
  Clone ID: LIB3059-027-Q1-K1-B8
cttcaaaacgagttgacaatgcgggtttcaggcagtccagcaggttggggccatggcgccgccagatcagatccccctcttcctcactcaaccgcagtgttctcgtcggagcaggcgatgcaaccacccaccattgcaagcgttgtattcccgttgcagcagccactgtcaccatcagcaatgaccaaaccacctcatgctgcaccaccactcgaactgaagctctttccataagtggcatctggcgaaagccatcaaccctgtgaagaccaccaagctcccaaccatgtggcacgaccaccggccaggtacccaacgcaa

SEQ ID NO: 30329 - DNA, 396 bp, Zea mays
  Clone ID: LIB3059-027-Q1-K1-B9
actcgtaccggaattcccgactcgagcgtcgcgtggaagggacttccgctagagatcaatggtcaggtctctgccgtcatcagcatgtcggtggggttcgacaaggccaacgaccaggtgcccgacccggacgtcatcaaggagaccgccaccaagacgttccacgacctctacgactacctactcaagaactagatggagcgacaactggagatggtccagtacagtacagttccagtccattcatcgacgcgtcacagtttactagtgcacgtcgctggtgtggtctggtgcccgtgctggttacttaatttgcttgctagctagctacgtaccgcggtccgagtccttgtctatggctgatgtttgctgcctgcgtccgtagagcatacgact

SEQ ID NO: 30330 - DNA, 368 bp, Zea mays
  Clone ID: LIB3059-027-Q1-K1-A3
ggaccaagccttccgccaacccatccaacagcgctctctaactttgcacacttgaacctcccgattgctgcggggggcaattcaactagaatcccagttgtgatgccactttcagccgcgatggcagcatgctcgcagttgctggtggccaggtatggcgagaagagtgatggtctcgtgacgaggaaagatgctgaggttcctggttcagtggcagtccggccggagcggaagctagaccacgcgtggatggtgtattcgtcgctgaaagaagagtctggggatcaggcggacacgtcgcaggtatgcgaagccctgctgactctacttgtcgaggttgcacaaaagaggacgcatgagatggcaat

SEQ ID NO: 30331 - DNA, 385 bp, Zea mays
  Clone ID: LIB3059-049-Q1-K1-A4
agcagctcaggcaggcggagccgaaggaccggtaccaggcgatcttgggcttggtcctgcagtcgatcctgcagcaggagccgtaaagcggacagatcgcggtgctgatggcggcgcagatcgcgcaccagctgaccgccgattgcggcctgcagcagccgactctatgcccctacgctgctgccggctgtgtcccccactgaagaaactatgtgctgtagtatagccgctgcatagctagctagttgagtcatttagcggcgatgactgagttatcatgtggcacgcatcaccatgggtggcagtgtcagtgcgagctgagaccctaatgaacaatggaactgaaacgcagcaagtcacgacacacaacatagtcgctatgaga

SEQ ID NO: 30332 - DNA, 387 bp, Zea mays
  Clone ID: LIB3059-049-Q1-K1-A6
gtggagccgcagcaccggtaccaggcgatcttcggcttggtcctccagtccatcctgcagcagcagccgcaaagcggccaggtcgcggggctgttggcggcgcagatagcgcagcaactgacggcgatgtgcggcctgcagcagccgactccatgcccctacgctgctgccggcggtgtcccccactgaagaaactatgtgctgtagtatagccgctggctagctagctagttgagtcatttagcggcgatgattgagtaataatgtgtcacgcatcaccatgggtggcagtgtcagtgtgagcaatgacctgaatgaacaattgaaatgaaaagaaaaaagtattgttccaaattaaaaaaaaaaaaaactaaatcaaacaaataa

SEQ ID NO: 30333 - DNA, 373 bp, Zea mays
  Clone ID: LIB3059-049-Q1-K1-A7
aaaattttaggggactaagaaacctgatcagctggtggagcaagaaaagagtgatgttattagtccagctgatgccaaccgtcctgctgctattgtggggcttcatggggaggacagtgagtcaaagcctgcaccagggggggaaaactcagaacccgatacacaagtctcaccagacaggctattgcgagcagcccttttgaggagccgttatgctgatgtgattgtcaaagctcgtggcattcttagtcagggtggagacaaacaggaagagctggaaaagctacagaaggaagagaaagagcgcttgttggctgaaggtactgcagccatggaggcttgtagagccgaagctgaaactgaaaagaagcgt

SEQ ID NO: 30334 - DNA, 439 bp, Zea mays
  Clone ID: LIB3059-049-Q1-K1-A8
accaactagcaacatagaaagcacaatagtgtaccaacaatggcagccaaaatattttgcctccttatgctccttggtctttctgcaagtgctgctaccgcgaccattttcccgcaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgctgcttatttgcaacaac

SEQ ID NO: 30335 - DNA, 326 bp, Zea mays
  Clone ID: LIB3059-049-Q1-K1-A9
tcatcgttctcgtcgtgtgccaggctctgtcagctgccagcgcctctgcaatgcagatgccctgcccctgcgcggggctgcagggcttgtacggcgctggcgccggcctgacgacgatgatgggcgccagcaggctgtacccctacgcagagtacctgaggcaaccgcaatgcatcccgctggcagcggcgccctactacgccgggtgtgggcagccgagcgccatgttccagccgctccggcaacagtgctgccagcagcaaatgaggatgatggacgtgcagtccgtctcgcagcagctgcagatgatgatgcagcttgagcgt

SEQ ID NO: 30336 - DNA, 432 bp, Zea mays
  Clone ID: LIB3059-049-Q1-K1-B10
ctccgttgagtcgaggcggctccaactccggctcgtggcctcgcggaccaacatggccgccccttcgccctcgccggtggaggctaccctaccgcctgaggccgcggctgccgccgaggaagaccagtgggatgctgacggatatgttattcctaatttgcccactcaagataatgatgtggctgagcctagtgtccccaaagaaaaagatcctgagcctctacaggcaagcgatgagaaaatatatctgggacctcatggagctccaccatctcaagcaaagcagcaggagctgaacaccgttggccgcaagcagcggttccggaacaaactgaaggaagcagataggaaattctccggcaatgctcaggagaacaagatggagagcctaagggagctgctgggtgctagaggtggtactggtaccagcct

SEQ ID NO: 30337 - DNA, 382 bp, Zea mays
  Clone ID: LIB3059-049-Q1-K1-B2
aaaaaaaaaaaaaaaaaaaaaaaaaaattaaaaaataaaaataataaaaaaaaaaaaaagaaaaaggtaaaaaggataaaaaagaacataactatgagctatgtggaacatactttaaaggggtggatgtttttaatggattgtttttgcagtccctggtttttcaaggggagtctattatttgtttacctttagtattgttaatggccagtagtttatgacattgggggttcttataagcgtggtctgcctatactatttccattttctggcatttaccatttatcctgtcgggctatttagaatgagctctctgatgttcctgttgtcaaccttttacattggcagatctgcattggggactacccctatgcgatcgttt

SEQ ID NO: 30338 - DNA, 442 bp, Zea mays
  Clone ID: LIB3059-049-Q1-K1-B4
attggcacaaaacatcagggcacaacatctacaacaacttgtgctagcaaaccttgctgcctactctcagcaacagcagtttcttccattcaaccaactagctgcattgaactctgctgcttatttgcaacaacaactaccattcagccagctagctgctgcctacccccaacaatttcttccattcaaccaactggcatcattgaactctcctgcttatttacagcagcaacaactactaccattcagccagctagctggtgtgagccctgctgccttcttgacacaacaacagttattgccgttctacctgcacgctgcgcctaacgctggcaccctcttacaactgcaacaattgctgccattcaaccaacttgctttgacaaacccagcagcgttctaccaacaacccatcattggtggtgccctcttttagatttct

SEQ ID NO: 30339 - DNA, 437 bp, Zea mays
  Clone ID: LIB3059-049-Q1-K1-B6
cccacgcgtccgattgagaccaacaagcaacatagaaagtggaatccagtagcaacaacagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattc

SEQ ID NO: 30340 - DNA, 299 bp, Zea mays
  Clone ID: LIB3059-049-Q1-K1-B7
agcattcactatattgaccataatgcagccgtcgaacggcctaaaccgacggctctgggaagacgtcaggagcgacttatggctacatcgtatgtaagtgcctactgaactatgcacttgaacttgactgctcacaccttacatgcttcatagaggcatgtaccattttgttgtgatgagtattgcttctatcaatgatagcgctaatatgcaagccctcaactctgcatccatatatgctcttactggctattgtggttagctgcatactgagatgactatagatggcataacagtca

SEQ ID NO: 30341 - DNA, 359 bp, Zea mays
  Clone ID: LIB3059-049-Q1-K1-B8
cgcaaattgcaccaagaaaaccatggagaggccgacgacaggggaattaatggcgtcggggactatcagcagccaccgccgcctcattctcgcagtcgcggtcctgctctccgtgctcgcggatgccagcgccagcgccgggaccttctgcgagccgtggtgggccatcccgcacaacccgctcccgagctgccactggtacgtgaccagccggacctgcggcatcgggccgcgccttccgcggccggagctgaagaggagatgctgccgggagctggcggacatcccggcgtactgccggtgcacggcgctgagcatgctcatggacggcgcgatcccggcggacccggacgcgcagc

SEQ ID NO: 30342 - DNA, 230 bp, Zea mays
  unsure at all n locations
  Clone ID: LIB3059-049-Q1-K1-A3
gctcaagcgtgaggcccggttgaggggtgggttctatgtaaccccagaggccaagcttctgttggtggttcgcatccgtggtatcaatgccatgcaccccaagacccgcaagatcttgcagctcctgcgattgaggcagatcttcaacgggtgtatttcctcaaagttaacaaggcaaccattaacatgctgcgcanggtggagccatatgttgcgtacggataccccaa

SEQ ID NO: 30343 - DNA, 390 bp, Zea mays
  Clone ID: LIB3059-048-Q1-K1-G8
cccacgcgtccgcggacgcgtgggattcctttgcctgagttcatgttcatcgcaggtcagacagcccattctcttcctttctggattgcaagatgaactagtcccccctccacacatgaagatgttatatgacaaagcttctgatcataacagaaattgcagatttgttgattttcctagtggtatgcatatggatacctggatgtctggaggggaccgctactggaggacaatccaattgttcttggatcaatacgctcctggagtgcagaatcatgatgccagcttcaaaagtgaaattgccgaagatgatgaagctgctgattgactggaaaatctggatcggactttttccaaatttctggttcctgatgttgctgcaatttggca

SEQ ID NO: 30344 - DNA, 424 bp, Zea mays
  Clone ID: LIB3059-048-Q1-K1-G9
cccacgcgtccgcccacgcgtccggaatctatgggattgattttggatactagtgagagtgaagaagaccatgtgcagggacacaagaaacgaaaggctacttctgcacatctccaaaagcttcaacaggagttgagtgatctcttgcaatgcccattgcagcctaagactttctctcgccgctatttggctggggctggtgtctcacccttacttcagaagcaactagaagagttggccaagagaaatgcaagcaacaatagcagcaagagtaagaataaaggatctgggtttgttgttattggtcaggatcgtgtcgagcccttgcaagcacttcaaaattctgggcaagaggtctgtgtgaacatagacaaagaaagggaaaagcgaagagtcgctgagaactggaggcggaagaagcatg

SEQ ID NO: 30345 - DNA, 452 bp, Zea mays
  Clone ID: LIB3059-048-Q1-K1-H10
atggccggggggtacccacgcgtccgcccacgcgtccgcagaatacagcaagggcaatgcatatgctcaggttgccattggcaccaatgatgtgtacaagagcgccgaggcggttgatctggcgaccaaagaactaggtggcaagattttgcggcagccagggcctctacctgggatcaacactaagatcgcctcttttgttgatccagatggctggaaagtggttctggttgacaacaccgacttcctcaaggaactccactgaaggctcgggatacccaggtgctgtgctaggatgtagtaatgcttgtctgtggtgtaataagatgtgggtggtttgtttctgccctgatgaacttataatactgaatgttgctacagaggttgtgcttctgccagtgaggtttgggatttgctatgtaactgtgcctgcgggctccgattctggcgct

SEQ ID NO: 30346 - DNA, 430 bp, Zea mays
  unsure at all n locations
  Clone ID: LIB3059-048-Q1-K1-H12
ggggtcaccaagggctaccgctacaagatgaggttcgtctacgcccacttccccatgagcgcctccatcaccaacagcaacaccgccatcgagatcagaaacttcctcggcgagaagaaggtcaggaaggtggacatgcttgatggcgtgaccatcctccggtccgagaaggtcaaggatgagctcatccttgacggaaacgacgtcgagctcgtatctcgctccgccgccctcatcaaccagaaatgccatgtgaagaagaaggatatccgaaagtttttggacggtatctatgtgagcgacaagggcgtcatcgaagaggagcagtgagcgacagagtagccgaaatgccaggagatgaatatggatgtcgtttgagttgcaattttgtgagactgaatgtgaaccctntntctcattccttaaatag

SEQ ID NO: 30347 - DNA, 275 bp, Zea mays
  Clone ID: LIB3059-048-Q1-K1-H4
actgacgcgtgggaaaaaaaaaaacaaaaaaatataattaaaaaaaaaaaacaaaacactaaaaaagaagcgctcattatataacgtgaccatgaatacatccaccttctaccgaatcaacatctctaccatattctacctctaactcaattgcatcgcctacgctttcttacgcaacacactggaaaaacaacgtgcttacccactttaactagcctttctgactattccacttttccaacatcgccttatacctacaattccttgacgcatat

SEQ ID NO: 30348 - DNA, 216 bp, Zea mays
  Clone ID: LIB3059-048-Q1-K1-H6
acgttgccttcgcgtacacctactccatgcttctcatagaaatccaggacactgtgaaggcagggccatcagagaacgtgacgatgaagagggccagcttctacggcatcagcgtgacgaccatcttctacgtctcgctcgggtgcatcggctacgcggccttcggcaacgccgcgccggggaacgtgcttaccggcttcgacgaagccgtctggc

SEQ ID NO: 30349 - DNA, 377 bp, Zea mays
  Clone ID: LIB3059-048-Q1-K1-H7
cccacgcgtccttattttgattctgcactgctcccgtgtacaaacgtgggtctcaataaggcaggcaggaatgcatctgccagtggaacagagcaacctgcacattatttatgtatgcctgttcattggagggcttgttcattacatgttcgtctatactagaaaaaacagaatattagcattaatctatagttaattaaagtatgtaaatgcgcctgttttttgttgtgtactgtaatcatctgagttggttttgtgaaattttcgtaaaaagaatgaatgtaaaatccagaaaatgtaatgccgtgtaatatccttatggaacaatgtataatcttttttctcaccaccaccagtttcttccattcaaccaactg

SEQ ID NO: 30350 - DNA, 447 bp, Zea mays
  Clone ID: LIB3059-048-Q1-K1-H8
agaccaactagcaacatagaaagcacaatagtgtaccaacaatggcagccaaaatatttggcctgcttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaagatccaacaagcaatcacagcttgcattttaactttatcacccttggtccttcaacaatcattaaccctattacattaattacctttggtgcatttattggcacaaaacattaaggcacaacaacttccacaacttgtgctaacaaaccttgctggctactcttaacaacagcagtttctttcattcaaccaactatctgtattgaactctgcttcttatttgcaacaacaacaac

SEQ ID NO: 30351 - DNA, 376 bp, Zea mays
  Clone ID: LIB3059-048-Q1-K1-H9
aaacgttacaaggcagagcgagcaaaatattcggcatttcttgcttcccaggcgacagcctcctgatctggtgatgattagcacggatttgcaccagaaaattctgaacgtttatatgaagctgatggccactattggtactgcacatagtggagactggagagtaagcaacactgcagcgtcacttgttctaatgctcacggaagtggttaggatgtccaggtgatgtcaggccgagagctatagtcgaaatctctaccaattgagcagttcttgtaacccagattttgttcctagatacctcatacgtactcacattgaagtttttttttttttaaaaaaatatatatttagaaaggacagacattaagattcc

SEQ ID NO: 30352 - DNA, 352 bp, Zea mays
  Clone ID: LIB3059-049-Q1-K1-A1
gtgtttcttgtgaggttttatatattttcctgtttctctctgctgatgaggagtcaacaagcttgcttagtgtatgcaaaggcattctgaaccaaagtcccgtcgttatcttggtgtttgtttccactctagtaggctgggcagtgaagcaagccaccaacgtcatccagatgaaaactgctgcggacgcatgcgtggtgtatgatctgaagcgcaccagatgaagcatgaaagcagcttcacggcttagtatcgacatatccaagggaaaactctgcgagggggcgggctacatcttgcgtgccttgacatctttctgatgatgcggtcatatgttggaccaggggattac

SEQ ID NO: 30353 - DNA, 423 bp, Zea mays
  Clone ID: LIB3059-049-Q1-K1-A10
cttggccctcactgagcagccttccaagtttgatttttacgatccaaaaacacctttcgtcactgcaccccgatgcttgcctacgacgcaattggacaagtgcacgatgaaatatgcatttatctcacatggttgcttactgagagaatgcaacatcgagcattctgagattggagtctgctcacgtgtcagctctggatgtgaactcaaggactccgtgatgatgggagcggacacctatgaaactgaagaagaagcttcaaagctactgttagctgggaaggtcccagttggaataagaaggaacacaaagataaggaactgtatcattgacatgaatgctaagattgggaagaacgtggtgatcacaaacagtaagggcatccaagaggctgatcacccggaagaagggtactacataag

SEQ ID NO: 30354 - DNA, 386 bp, Zea mays
  Clone ID: LIB3059-049-Q1-K1-A11
cccacgcgtccgcccacgcgtccgcaccaacgcatattgcaccaagaaatccatcgagaggccgtcgacaggggaattaatggcgtcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgc

SEQ ID NO: 30355 - DNA, 345 bp, Zea mays
  Clone ID: LIB3059-049-Q1-K1-A12
ggtgggttggcttctcctccccttccgttccggtttcggttccgtgaggttctccggggttcggtttcgtgggtgaacgtatcgagatggcgtcgtcggatgttgagtaccgctgcttcgtcagcggcctcgcctgtgccacggacgaccactccctccacaacgccttcagcacctacggcgaggtcctcgagtccaagatcatcctcgatcgggagacgcagatgtcccgcggcttcggcttcgtcaccttctccacggaggatgcgatgcggaacgccatcgagggcatgaacggcaaggatctggacggtcgcaacatcaccgtcaacgaggcccagtccc

SEQ ID NO: 30356 - DNA, 424 bp, Zea mays
  Clone ID: LIB3059-049-Q1-K1-A2
gcctattattcatggtatctgccggttgcatgtgccctgctgctctctggcgagaatttggacggttatggggatgtagagaacatccttgttgaaatgggaacatactttcaagtccaggatgactatctggattgttatggtgatcctgaatttatcggcaagattggaacggacattgaagattacaagtgctcatggctagttgtgcaagcccttgagcgtgctgatgagagccaaaagcgcattctatttgaaaattatggcaagaaagatccagcctgtgtggctaaagtgaagaacctctacgaagaacttgacctagaggcggtatatcaggagtactagaatgagagctacaagaagctgattgcagacattgaagcccagccaagcattgcggatcagaaagtgctgaaatcct

SEQ ID NO: 30357 - DNA, 404 bp, Zea mays
  Clone ID: LIB3059-048-Q1-K1-F11
gtggagctctgtggaggctcttctgtcgtgatgttccatggggacctcccttactgggcaaaagacatcctcaagaagctagagactatagatgaagaaaatatcattggagcaggaggcttcggaactgtttataaacttgcaatggatgatggcaatgtctttgctttgaaaaggatagtgaaaacaaatgaagggctagatcggttctttgatagagaacttgagatattgggaagtgttaaacatcgctatttggtcaatctccgtggttattgcaactccccttcatcaaaacttttgatatatgattatcttcaaggtggaagtctggatgaagtgcttcatgaaaatcttgacagttggattggatgcaacgtattaacattatacttggagctgca

SEQ ID NO: 30358 - DNA, 428 bp, Zea mays
  unsure at all n locations
  Clone ID: LIB3059-048-Q1-K1-F12
ctgtgcatctcccaccgccggtccacctgccgccgccggtccacctgccaccgcctgtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcggcgttggcagcaccccgatcctgggccagtgcgtcgagttcctgaggcatcagtgcagcccgacggcgacgccctactgctcgcctcagtgccagtcgtgccgcagcagtgttgccagcagctcaggcaggtggagccgcagcaccggtaccaggcgatcttcggcttggtcctccagtccatcctgcagcagcagccgcanagcggccaggtcgcggngctgttgg

SEQ ID NO: 30359 - DNA, 217 bp, Zea mays
  Clone ID: LIB3059-048-Q1-K1-F3
cacacgcgtggggttgtctccctgtcgctttccgtgcctagatgtagaaccggacccgcagaggcgagggccgcctatattctactcctattagaacgcccgtgaccgggattacgtggagcaagcgcggatgtcaacgctgcactcagagtctaccgtcgaatcccccatcaaggcggccgaatacaaggacaccgtaaaggccgatcaccagctg

SEQ ID NO: 30360 - DNA, 370 bp, Zea mays
  Clone ID: LIB3059-048-Q1-K1-F4
ggaagatgagccactaaatccttagacgtcgacagaaccatacgtgcaaatcagatacgaaggggggagacacagagcaattcatttccacccgtgcaataagatggaagtcagaaccatgtagttgttttcgtttgtaattttctttctatagtgtaagatttgacaaggctgttagtttgcacctcggatctgcttatatccacagggcaatcgatagttcagcaagtattgagctatacctatgtcccgagaagattagatgagttggcgtcttggcgatcgatgtgggcttttcccgttgttgttccttgcaatttattttcgaaaaaaaaagaaacatgttcgctttaagctttaccattccggt

SEQ ID NO: 30361 - DNA, 412 bp, Zea mays
  Clone ID: LIB3059-048-Q1-K1-G10
gctctcggtcgccatggccgggggatacacatgcgtaacgctcgtcatgctaacatgatgaagtaccttaaaataatgaccgagagacatgtagaggggctattaaggcatgatccacacgaatatcatctgccatcaaaagctgcatggtgcagacatacacagcaagctgcaaaccctttgctaggctactctactgtggaactcactggctaattacctggatcggctcttactagccagctcacatccatccgtatgcactctgataattgacaactgccatcataccctactatcatatgaaccacacgcatcatttgcacacgtcgttcccattctagaaccagcagttctagatgtatgagcttatcctggacaacctgcatcgtctgatccatcagcactatct

SEQ ID NO: 30362 - DNA, 316 bp, Zea mays
  Clone ID: LIB3059-048-Q1-K1-G11
ctcatcgtctcatcctcttcctcctcccgtccaaacgcagccgaagaggaaaggagaggcggcgaggatggggcggaagcggaaggagttgctgtcgtcggctccatggaggacgggggaggcggcggaggacgaggacgcggcaaggatgagccgagaggggaaggtcagcgtcaccagcaaccccggggagacgcccaccatgagcgtgccccggagcaagcgccaggacctcgacctcaccgtcgacgacttcgaggaggacgagatcgaccccgagctgcgctactccttccagcggaacagcaggtttctg

SEQ ID NO: 30363 - DNA, 427 bp, Zea mays
  Clone ID: LIB3059-048-Q1-K1-G12
gtcgccgtgaacgaccccttcatcagcaccgactacatgacctacatgttcaagtgcgacactgtacacggacagtggaagcaccatgaagtcaaggtgaaggactccaaaacccttctctttggtgagaaggaggttgctgtgtttggctgcaggaaccctgaggagatcccgtggggttcggttggtgctgaatatgttgttgagtctactggtgttttcactgaccaggagaaggctgcagctcacttgaagggtggtgccaagaaggttgtcatctctgctcctagcaaggatgcccccatgtttgtcgttggtgtcaacgagaaggagtacaagtctgacattaacattgtctccaatgctagctgcacaaccaactgccttgctcctcttgctaaggtcatcaatgacaagttcggtatcg

SEQ ID NO: 30364 - DNA, 154 bp, Zea mays
  Clone ID: LIB3059-048-Q1-K1-G2
cttcacgtcacgcgagtcgtcatgcccttgttcggttctaagattctggcccttaaaataaactggccggccatttatcacacctggtcggtcgactcaagcaagccggtctttaggtcactggctgctgacttcaaccattacgctgacagct

SEQ ID NO: 30365 - DNA, 466 bp, Zea mays
  Clone ID: LIB3059-048-Q1-K1-G5
cccacgcgtccggggcacaacaactacaacaacttgtgctagcaaaccttgctgcctacgtgtcagcaacagcagtttcttccattcaaccaactagctgcattgaactctgctgcttatttgcaacaacaactaccattcagccagctagctgctgcctacccccaacaatttcttccattcaaccaactggcatcattgaactctcctgcttatttacagcagcaacaactactaccattcagccagctagctggtgtgagccctgctgccttcttgacacaacaacagttattgccgttctacctgaacgctgcgcctaacgctggcaccttctaacaactgcaacaattgctgccattcaaccaacttgctttgacaaaccaagcagcgttttaccaacaaccaataattggtggtgccctctttaagatttctaatgagttatagttcaatattaaagttt

SEQ ID NO: 30366 - DNA, 425 bp, Zea mays
  unsure at all n locations
  Clone ID: LIB3059-048-Q1-K1-F10
ggtcaccttccgtggtgcctgtggctgtgtacgcggtcgtctccatccgacccatgggtcatccaaaaactaaaccaaatcttccccatcgatcccaacttccagtcgatctcctcgctcggctgttgcctcccaaagccgcgccttacaacgagattcctcccctcctctctccaataaccctagcctcctccgccgccggcgacgaatccggcgttttgagtttctgttgccagcgtagccatgtccatgttcaataggatcttcgggaagcccaaggagcaggccaactccaatggcctggccactctggacaagttaaatgagactcttgatatgctggagaagaaagaaaaggtgctggagaaaaaagcagccgctgagctggagagagccaaggagttctcanaagctaagaataaaag

SEQ ID NO: 30367 - DNA, 311 bp, Zea mays
  Clone ID: LIB3059-026-Q1-K1-G6
ggacatgataacctcattggggaaattatccgtcttgagggcgattcagctacaatcgaagtttatgaggaaacagctggactgatggttaatgaccctgtattgagaacaagaaagcctctttcagttgaattgggacctggaattcttggaaacatttttgacggtatccagcgacctctaaaaaccatcgctattaagtcaggagatgtgtatattcctcgtggtgtttcagttcctgcccttgacaaagatgtattgtgggaatttcagccaacgaagctaggtgttggagatgtcatcacatgtgg

SEQ ID NO: 30368 - DNA, 342 bp, Zea mays
  Clone ID: LIB3059-026-Q1-K1-G7
cccacgcgtccgcccacgcgtccgcccacgcgtccgcccacgcgtccgcggacgcgtgggcagtgatgtttcgtgcccaatgcagccttgttgttgactgtggcttctctttcacccatgcatcccctgtacttcagaactttactcttaattatggtgttcggcgtatggaccttggcggcaaggcccttacaaactatctcaaggagctcgtctcataccgttcccttaatgttatggatgaaactctcctcattgatgatgcaaaggaaaagctatgttttgtctcgcttgatgtccctggtggtctacacgttgccaggttatcatttaaggataacc

SEQ ID NO: 30369 - DNA, 303 bp, Zea mays
  Clone ID: LIB3059-026-Q1-K1-G8
gggtgactgttggtgtgcgctactaggcaagacaacaaccacatgagcacggaggagggggaagaggacgtatctgacgggagcgatgcccggagggagatgaaggatgtggccttggctggagaggattgcgtccgcttgctgggacctggtccggaagtacccacttacaaggaagggtgaggactacgccgacaccgacaccgacttcgacgccgtcacggacgagctgttgtggtcgcgggactcttacccctgacgcgggcggccacttgtccttcaccatcctgcagggcaacgacg

SEQ ID NO: 30370 - DNA, 299 bp, Zea mays
  Clone ID: LIB3059-026-Q1-K1-H1
catacgatggggtgaagtgtgtttctctgaccctgcacctgcagccatccaggtaatgagacttgatacaaaggcccttcctccacatctttaggcccttctgttcaagacctgaagcttttctcccttttctaagcgaatcccccgaggttgttgaccatgaacttgttggaaatgctaacggttgacacaatggagtgacaaatgcggaaatgcctaaagcatcaagggctgcaccatgtaaatgctagccaggcaggttgcaacaaaaaaaaaaaacaccaggaagttctgtgggc

SEQ ID NO: 30371 - DNA, 404 bp, Zea mays
  Clone ID: LIB3059-026-Q1-K1-H10
cgcacgcgtccgcccacgcgttcgcatgatccaccccttgttgcactgagggggctgttccagcgggctaattgtgatgaactgcgagcactacgcagtttgctgatgagcaatagaattctgggcgacaattctaggcagcaggcttgccaaatccttgatgaggagattgcgaagcaatggcactgaccagcgtaaatacaggatgttgtactaaccaattgtttggcatgattttgttttgacgggataaatcagttttaaggcttgcttcttccgttgcccttgtgcccattcttttcattcttgtgaccatacccaattctttattgcaagtggtgtcaacaagcatgaggctacagctgcatcacctgcaaggaagtcaaaagtaagaggcacatgca

SEQ ID NO: 30372 - DNA, 304 bp, Zea mays
  Clone ID: LIB3059-026-Q1-K1-H11
ctacttacgcttattgccatcactacaaaagcatccattattgcacaacgctcacttgctgctacttccattattccacagtttctaccaccaattacttcaatagccttctaacacccatctacgcaagcctacttgctacaacaagcaattgcggcaaccatgttacaacaaccaattgcccaatagcaacaacaatccttggcacatctaacaatacaaaccatcgcaacgcaacatcaacaacagctcctaccagcactgagccacctcaccatggtgaaccctgtcggctacttgcaac

SEQ ID NO: 30373 - DNA, 301 bp, Zea mays
  Clone ID: LIB3059-026-Q1-K1-H2
gggcgacaccccgttctgcagcgaggactgccgctacgagcagatgcaccaggacgcggcggcggcgacggactacgcgcggcagcaggccagcagccggcggaggcagcagcggagcaggggcggctctgtgtccgccaacgaggcggacgtgtacgtggccagctagtttaagagcaggcgcaagcgcggcgaggccgaggatggtgaaggccgtgcgctgcctggttcaagctagagaatcccgtcggtggaggcgcaggcgctcacggttggctgcccgcctctgcgccgcacgagc

SEQ ID NO: 30374 - DNA, 330 bp, Zea mays
  Clone ID: LIB3059-026-Q1-K1-H5
cccagttcggagagcttgaggtatgctgatgcttaaatggtccatatcctggagcgggacacaaactgctgcctgtatggactcgtgcgattcagggtgaaccatcagattgtctagtgtcttctttgtaataaatttatctgttcttggtactttgtctatggttgaatcggaacccattttccgtttgcctagattcttaatttctggtgctgtatccagctgaaactagtagatctatgatcttgtggctgcagcatgttcttgtcacttttatctggtctccgttggttcggttcacaggttgtgtgctgtaaaaggctgtgctta

SEQ ID NO: 30375 - DNA, 303 bp, Zea mays
  Clone ID: LIB3059-026-Q1-K1-H7
cccacgcgtccgggaaaacaacaaacctcatgcccctgctagaaaacctgttcagagggcagtcgtgaaagctccatcacaggcgtctgcgaccacaaaggctgaagcaagacccgtggtcacaaggccaaagatctcaaactcgaaacctaaggcttcaagggcaaaggttgcgcgagcgcaagaaaccccagctgaagcccctccttcagaacctgctgctccagaagatttcacggttgaacatggcgttggagacgccacaggtcctgatctgaccgcgcaattggttgcttcgaacga

SEQ ID NO: 30376 - DNA, 331 bp, Zea mays
  Clone ID: LIB3059-026-Q1-K1-H8
gcaaagcggcagtgcgtagagaggatcgtcgaacagaacagcatgaagatggtcatggttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagacgagcgccatgtaccagccgctccggcaacagtgctgccagcagcagatgagggttatggacg

SEQ ID NO: 30377 - DNA, 325 bp, Zea mays
  Clone ID: LIB3059-026-Q1-K1-H9
tcccacgcgtccacccacccattttcattatgcatcaacctaaccacaattggtggcagaatattatccctgcttgcgctacttgcgctttttgcgaacacaacatatgcgttcattattacacaatgctcacttacttctagttccattattccacagttcctcccaccagttacttcaatgaccttctaacacccaactgtgcaagcctataatctacaacaagcgattgcgacgaacgtcttacaacaaccaattgtccaatttcaacaacaatccttatcacatctaacaatacaaaccatcacaactcaacatcaacaac

SEQ ID NO: 30378 - DNA, 414 bp, Zea mays
  Clone ID: LIB3059-027-Q1-K1-A10
cggacgcgtgggcggacgcgtgggcaagaaccgctttgagccggcattcgtgaggaacccgctgcaggcgatgaagaaggacaccctagaacgcgcccgggagcccaacttggatctgaaggcgtacctggccaactcgtacctgcacccggtgttcaagggggacgaaggcgacgacaggtactcggtgatggacgacgatgggtggatggaggaggaggtgatcgtgccgacgaagcggcattcgaggaggacgacgcccgcgcagagcaagcatgaagggtcggactcgctctctgtgctcgagagttctctacagcggtagtcacagtaggagcttagcctgtacagaatggatgaaaatgatcacggccctgctccattgcttttgctttggttgttggttggtcatgt

SEQ ID NO: 30379 - DNA, 433 bp, Zea mays
  Clone ID: LIB3059-027-Q1-K1-A11
accggaccggaaggctcggaccacgcgtgcgcggacgcgtgggcggacgcgtggggacgggcaaaatcctccgccggcgggtgagggcggagaggagccgcagctctcgaagaatgcgaagaagagagaggagaagaggaagaagctggaagaggagcggaggctcaaggaggaagagaagaagaacaaggctgcggctgccagtggaaaacctcagaaggcatctgctgctgacgatgatgacatggatcccactcaatactatgagaataggctcaaggctcttgattcactgaaggccacaggtgtaaacccctatccccataagttcccggttggcatttctgtacccgaatacattgagaagtacaggaccttgagcgagggggagaagcttacagatgtggcagagtgtttagctgggaggatcatg

SEQ ID NO: 30380 - DNA, 353 bp, Zea mays
  unsure at all n locations
  Clone ID: LIB3059-027-Q1-K1-A12
gacccgcggtgggtgctcaagaaatctttcnntggagaaccgtcnnattcgtgacnngccgtcacctacccaccgagcacgcnnccgccgcaaggaaccgtnncaccgccatnnggatgtnnngtctacgcgctttcaaacgacaagggggccgcacccttctttacggctnntcggcgggctaaggggtcgcttccttcaatcnntggtggcnganacctgggcatgtnngttgtcngcnncggtnnggttgggtgttgtggtggccctttaatttnaagtctaagtcccccgttctctcttaattcgtcgcttgtngnnttctggtggtgggtcttgggtagtcccaattt

SEQ ID NO: 30381 - DNA, 302 bp, Zea mays
  Clone ID: LIB3059-027-Q1-K1-A2
ggcaagtcacaaattttcctattctttctacccttgctcgtgatgtgttgtctatgcaagtgtctactgttgcttcagagtctgcatttagttcgggtggacgcattgttgatgcattccgttcaagactcaaaccagaatttattgaggcattggtttgttgtaaagattggaagattgcttcggagaaagatttggagattgaaattaaaaccttaagtgaacctatgaatgacgttgacttggaggatgctgctgcaattggaacttgagaagttaaagttcaagttaccatggatgat

SEQ ID NO: 30382 - DNA, 318 bp, Zea mays
  Clone ID: LIB3059-026-Q1-K1-G5
cgcgtttagaacctctaaaatttcccccactcgccagtcgcagcagcacctgtagccgtggacgccagcggagccgatagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacaataag

SEQ ID NO: 30383 - DNA, 331 bp, Zea mays
  Clone ID: LIB3059-026-Q1-K1-E7
cagcatagaaagtggaatccagtagcatcaacagagcaacaatggcgaccaagatatgttccgtccttatgctcctagctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagaacacagtaactgcagca

SEQ ID NO: 30384 - DNA, 284 bp, Zea mays
  Clone ID: LIB3059-026-Q1-K1-E9
ggaattacgagctacgacgtacgcgtacccggacgcctacaggatccaattttacttccccttccattctacttcataggggacctgttgtatcacctacatgcaattcactgacacggatccttataacggcgttacttgtaaaacacctatgcttcccaactaaattggcttgcagcacataccaatacttcctccaagcctaatacacaaatacccgaacacatcaactttaacaacattctcgcatcctaaatggcgaattccacgcgctatgtcttctt

SEQ ID NO: 30385 - DNA, 440 bp, Zea mays
  Clone ID: LIB3059-026-Q1-K1-F11
cggacgcgtgggtcctaccactaccacagcaccagcgacggaccgggcaggcggagaggaagcagaccagacgagacctctcgcgttccgtcctcctccctgcccctgctgccgttccccttcttcctcagttctcccgcccgctgctgccctccgtccgcgtccagatcccgccaccaaccgatccggcgccctccagcatggcgggggcgggggcgaaggcggcgggagccctggctctggcgctcgtgctcgcgctcgcgggggccaactcggagggcgacgcgctctcggcgctgcgccggagcctcagggaccccggcggcgttctgcagagctgggaccccacgctcgtcaacccctgcacctggttccacgtcacctgcgaccgcgacaaccgcgtcacccgcctagatcttggtaatttgaacttatctggt

SEQ ID NO: 30386 - DNA, 300 bp, Zea mays
  Clone ID: LIB3059-026-Q1-K1-F2
atttggaatggaatatctccatgggaagaatatagtgcattttgacttgaagagtggcgaatctgcttgtctacctaagggatcctcaacggcctatatgcaaggttggtgatttgggattatcaaaggtcaaatgccagacactaatctctggcggagtaagaggaacacttccttggatggcccctgagttgttgaatggcagcagcagccttgtctcggaaaaggttgacgtcttctcgtttggcattgtgatgtgggagctacttacaggtgaagagccttacgccgagctgcact

SEQ ID NO: 30387 - DNA, 297 bp, Zea mays
  Clone ID: LIB3059-026-Q1-K1-F4
cgagatcggacacatggcggcggcggctgtgacgtccaacggcggcgcagtggccgggaacggtccggcgcccggcaggctggcctccgtgtacagcgaggtgcagacgagccggctcctgcacacgctgcccctcccctccgtcctccgctccaacttctcggtcgtcgacggccccgccagctccgccgcgggtaaccccgatgagatcgccaagctcttccccaacctgttcggccagccctcggcgtcgctggtgccgtcggccgagcccgcggcgaccaggccgctaaaggt

SEQ ID NO: 30388 - DNA, 304 bp, Zea mays
  Clone ID: LIB3059-026-Q1-K1-F5
cccacgcgtccgcaacaagcaacatagaaagtggaatccagtagcaacaacagagcagcaatggcgaccaagatatgttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctt

SEQ ID NO: 30389 - DNA, 302 bp, Zea mays
  Clone ID: LIB3059-026-Q1-K1-F7
cccacgcgtccgtgaagatgtactattgcctattttttacagattcatttgcgtattggtccgagtcttctctttgctgcgagttgggtattaattaggatgtgatattgcttaatttcccccctgtttctactcattttttggcccttgataatgtccacgagtatgtaatagggactaatgaatcaaacgttgttaaataaacatttcattccgttttgctaaaaaaaaaaaaaaaaaagatcactgcaagaatgaacattttacctacgtacatagcatgtagaccgatcaccaggatc

SEQ ID NO: 30390 - DNA, 303 bp, Zea mays
  Clone ID: LIB3059-026-Q1-K1-F8
cccacgcgtgcgcggacgcgtgggtcctccgagacctgcagccgactgaggctgagggtctggcgctgaccgatgaccgcacaacagtcgcaggaagcaccggcaacactgcccctgctgcaggccaacaggggtcaggatcatcagccatggccgtggacgatgagccacagccgccacaaccctttgagtacacctcgtgagcgaccgagcgtcaccttttcttattcgttctttttttttgactttttgagtatgtagtgtgcggaaatttgttgttggctggaagaccttttgtagaaa

SEQ ID NO: 30391 - DNA, 401 bp, Zea mays
  Clone ID: LIB3059-026-Q1-K1-F9
ccaggtcctcctcgtcctccatgccgcggatctggtgggtcgccgacctaatgcgggggatgtcgcgcgcgaagcgtcgatcggccaggaggcagcacgccgccacgtctgccgcggggccccggctggaggccgccgcggacccggaggagcgagagcggaaggcggcgttcgagcggctggacgatctgggacggtgcatcgcggacgtggagagcagcggcgagaaggtgttcagagccctcgtcaacaccagagtctccctcctcaacattctcagcccagtcttctgattcccgaacagctctgggatcaccagaacccagcaaactcgactgcattttgcgaccttggataaaagatgtagatagaaatgtgtgcgcgaatgcaatatagcaatg

SEQ ID NO: 30392 - DNA, 381 bp, Zea mays
  Clone ID: LIB3059-026-Q1-K1-G11
acccgcgcgtacgcgggcctggagatcgggttccacgtggttgagttctcgaaccccgtctacttcgcgtgacttgtggaatactaggactgcgacggcgacgtggtgcaggtggacctgatggagtccaagacggcgcgcggcccgccgacggggcggtggacgccgatgcgcgagtcctggggctccgtctggcgcatggacaccaaccaccgcatgcaggcgcccttctccatccgcatccgcaacgagtccggcaagacgctcgtcgtcaacaacgtcatcccggccaactggcgccccaacaccttctaccgctccttcgtccagtacagctagctgatcgggatgcctgccctgccctgccctgcccgcaattgg

SEQ ID NO: 30393 - DNA, 284 bp, Zea mays
  Clone ID: LIB3059-026-Q1-K1-E6
cccacgcgtccgagcgctaactgcaaccatgataacatgcgctcctgacctataatagttgagagtcaaatattagagggcatgagcgctaactgcaaccatgatatttgactctcaaataatttctgtactgctgctcggcagcgtgcatgcaaactgagcattttcgagtcagcctctgcgtgtgtgcgggctaattcaactatgaaattcattcgaatttctttccactttcactttggtatcttcagtgaatatgtaaatctttgatgttcttctgcttt

SEQ ID NO: 30394 - DNA, 232 bp, Zea mays
  Clone ID: LIB3059-026-Q1-K1-G3
cggacgcgtgggcgcatattgcaccaagaaatccatcgcgaggccatcaacgggggggttaatggcgtccttgtgtatctgcaagcaccgagcgctcatgctctgagcaggcggtctgctctcgaagctctcgactgccagcgccagcgccgggacctactgcctgccaggacgggccatgccgtacatcccgattgcgcgctgcccgctgtgcgtgaccagtcggacctgc

SEQ ID NO: 30395 - DNA, 300 bp, Zea mays
  Clone ID: LIB3059-026-Q1-K1-G4
gatgatataaaggagactggctacacttacattatgccaaagaacatattggggaaaggcatatgcatagcgtatctgcggacacaaattgctggatttttgtatgggctgagtccacaggacaatcctcaagtcaaagagattaggtgtatagccatccctccacagcatggaacacaccagatggtgactcttccagcaaatcttcctgagcacgagttccttaatgatctagaacccttgggatggatgcatacacagccaaatgaagctccacagctatcgccacaagacctgaca

SEQ ID NO: 30396 - DNA, 302 bp, Zea mays
  Clone ID: LIB3059-026-Q1-K1-C8
gttctctgaatattgtgagactaaatttgaagtggaacctgttgaagtgatacatcgtgatggaaggaaaacagtttaccctgatctttcatgttacaaaatggatgttttgttatctgacattcttgggcctattggcatctcccaggacgagaaacaggttgtctgtcttttgaataaaatgcaactgcaagctgaaagtcactccttgaaaggggaggctcgcatttcagtgtctgttcctccaacaagaagtgatattctgcatgcccgtgatttgtcagaggacgttgctattgctt

SEQ ID NO: 30397 - DNA, 447 bp, Zea mays
  Clone ID: LIB3059-026-Q1-K1-C9
ttgcgagccggacccacgcgtacgagcaactagcaacatagaaagcacaattttgtaccaacaatggcagccaaaagattgggcctccttatgctccttggtctttctgcaagtgctgctaccgcgaccatcataccgcaatgctcacaagctactatagcttcccttcttcccccgtacctcttaccagtgatggcttcagtatgcgaaaacccaattcttcaaccctacaagatccaacatgcaattgcatcatgcatcttacctttatcacccttgatcctgcaacaatcatcacccctattacaacagttacctttggtgcatttattggcacacaacatcatggcacaacaactcgagctagcacaccttgctgcctactcttagcaacaacagttacctttggtgcatttgatcgcacaaaacattaaggcacaacaacta

SEQ ID NO: 30398 - DNA, 304 bp, Zea mays
  Clone ID: LIB3059-026-Q1-K1-D1
acccacgcgtgcggaaggagcaggctgctggcctctaggaatatatgaacattgatctgcgtctggtgggggtatctgcttctgtgacgatgctcttaagtgatatcagagtagatctgacccattggaaagcgaagcctcccactgaagcaaaacctgccattcttgatgagtttgctcatcctttccctgagaatcactgctatactaacagagctttcgtggattgtacaccagatacaagcgtcgcctctcactattatgattgactaactaaagccatacatgtcattactgcaaacca

SEQ ID NO: 30399 - DNA, 424 bp, Zea mays
  Clone ID: LIB3059-026-Q1-K1-D12
cacgacttccgtccgagtctgagctcatctccacgcgccgccgccgccgctggacgggcaccgcgcagccatggcggaacagactgagaaggctttcctcaagcagcctaaggtgttcctcagctcaaagaaatctggcaagggtaagaagccaggcaagggtggcaatcgattttggaagagcattggccttggtttcaagactcccagggaagcaattgaagggacctacattgacaagaaatgtccattcactggaaccgtttctatcagaggcagaattattgctggaacatgccacagtgctaagatgaacagaaccatcattgttcgcaggaactatctccactttgttaagaaataccagaggtatgaaaagaggcactccaacattccagctcacatctccccatgcttccgtgtg

SEQ ID NO: 30400 - DNA, 300 bp, Zea mays
  Clone ID: LIB3059-026-Q1-K1-D3
cccacgcgtccggagaaaagcagagggggccagatgaggagggacctcgcagggtccgtcgctaccgccgcgtggtgttgctcggcagccgacgcgctccggggctggtgggatgacgtcaacgagtcgccccagtggcaggacgcggccttcttctccctcgccgacggctacgccctcgtctcacgccgtcgcactgattcagctcgtcaggatccagcgccgggtgcccgagttcggatggaccacgcagaaggtcttacacctcatgaacttacttgtcaacggggtccgtgctct

SEQ ID NO: 30401 - DNA, 337 bp, Zea mays
  Clone ID: LIB3059-026-Q1-K1-D5
agtcgatggaagccgtattattgttgaatttgctaaaggagttcctcgtggttctgggggttgacgtgagtacatgggaagaggacctccaccaggaacaggtcgttgttttaactgtggaatggatggtcactgggcaagggactgcaaggctggtgactggaagaacaaatgctaccgctgtggtgaatcgggccatatagagagaaattgccagaacagtccaaggaatctcaggcgtgataaaagctattcacggtctccatccccacgtggtggacgtggccgcagccggagctacagcagaagccggatctatagccgttccagatcccca

SEQ ID NO: 30402 - DNA, 302 bp, Zea mays
  Clone ID: LIB3059-026-Q1-K1-D6
cccacgcgtccgcgcaacagcaacaacaatttctaccagcactgagccaactagctggggtgaaccctgtcgcctgcttgcaacagcagttgcttgcatccaacccacttgctctggcaaacatagttgcataccaacaacaacaacaattgcaacagtttctaccagcgctcagtcaactagccatggtgaaccctgccgcctacctacaacagcaacaactgatttcatctagccctctcgctgtggttaatgcacctacatacctgcaacaacagttgctgcaacagattgtaccagct

SEQ ID NO: 30403 - DNA, 307 bp, Zea mays
  Clone ID: LIB3059-026-Q1-K1-D7
gcaaaagctgtggcccgagcacagaaggaagctgagaagaagctgaagaaagaggaggggaaagccaagaagaaatctggtgcagctgacactgatgagccctcagaatcggatgccaagtctgacgaagccatggaagccccagcggaacaagaagtggccccagcttccaccacggtaaagaaagaacagaaggagagtgcccggtacaggaatgtggtgagccggagcaaggccccgctacccaaggcgatcctgaagaggaagaaggcgcagtcctactggtcatgggctggcccagctgcca

SEQ ID NO: 30404 - DNA, 302 bp, Zea mays
  Clone ID: LIB3059-026-Q1-K1-D8
ctgccagttggttgaatggaagcattgaactctcctgcttatttacagcagcaacaagtactaccattcagccagttagctggtgtgagccctgctaccttcttgatacaaccacagttgttgccgttctaccagcacgctgcgcctaacgctggcaccctcttacaactgcaacaattgctgccattcaaccaacttgctttgacaaacccagcagcgttctaccaacaacccatcattggtggtgccctcttttagatttcttatgagttatagttcaataataaagttttttgtctgat

SEQ ID NO: 30405 - DNA, 314 bp, Zea mays
  Clone ID: LIB3059-026-Q1-K1-E1
gacccacgcgtgcgcgcgcaggccagtgccgcacccataccttatctccgccacatatcagtcgtgggtccggctaactgcactggacgggactgcacccaatggccaccacggcgaccgaggccgacaaggctccaccgcctcatgaccagcacgccaccggcaacggccacggctagcagaacacgcgccactgcgcggtcggccacaacagcctgctcaagagcgacgacctgtaccaggtaaacaagctgagcgcaatgagtggatgaatctgacccgcatctcagcctctgaccgccgggcaagaatga

SEQ ID NO: 30406 - DNA, 435 bp, Zea mays
  unsure at all n locations
  Clone ID: LIB3059-026-Q1-K1-E10
gcaagctgcgctgcactctcgatggtcatggcggatatgttaacgccgtcggcgtgggccccgatggatcgctctgcgcctccggcgggaaggacggtgttactctgctgtgggatttggctgaggggaagaggctgtactcgctggatgcgggctccatcatccactccctctgcttctcgcccaaccgctactggctctgcgctgcgacccaggactctgttaagatctgggaccttgagtcgaagcacgtcgtgcaggacctcaagcctgacatccagatctccaagaaccagatcctgtactgcacaagcttgagctggagcgccgatggaagcaccctctacactggctacaccgatgggtctatcagggtctggaagatctctggatatggctacgcangctagatgtcgaaatccagtccagggtcta

SEQ ID NO: 30407 - DNA, 295 bp, Zea mays
  Clone ID: LIB3059-026-Q1-K1-E2
gacaaattgtgcagcaagccgcatgcttccggctcgctgtttggtggagccggtggagagcacgccgtgatgccgctgtgtgttcgctgtttttgcacagccccgaacatcgacgtcgttcacccctgagagaaccccgtgttttgcgagaagaagggaagccgctcgacgctcgtcgatgttcgtagcgatgcacaaatcggaatctccatcgtcctcacaaacatcgattgggtttgtttatggaccgataggtgacgatcgtgcaagcgatgtggtgccaaccacaagatgc

SEQ ID NO: 30408 - DNA, 390 bp, Zea mays
  Clone ID: LIB3059-026-Q1-K1-C7
cacgtggttcaggtggctcacgtgaatatatggggagaggccctccaccaggtacaggtcggtgtttcaactgtggagttgatggtcactgggcaagagactgtaaagctggtgactggaaaaacaaatgctaccgttgtggagaaaggggccatatagaaagaaattgccagaacagtcctaggagtctcaggcgagagagaagttactcacggtccccatctccccgccgtggacggggccgcagtcgaagctatagcaggagcaggagccggagtcggagctatagtcgatcaagatccctgtgtagatcttctattggaggtcgtcgtgaccgttactgttggtagatcaaggagtcctagctatagctggaagccctatgcgatc

SEQ ID NO: 30409 - DNA, 341 bp, Zea mays
  Clone ID: LIB3059-026-Q1-K1-E5
ctagcaacatagaaagcacaatagtgtaccaacaatggcagccaaaatattttgcttgcttatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatgaaggcacaacaactacaacaacttg

SEQ ID NO: 30410 - DNA, 315 bp, Zea mays
  Clone ID: LIB3059-048-Q1-K1-D2
gtgagctgtcttctaagcctgatgatgaaccagatatcaatacagaacattcttagacaccttgggaggcaaatgaatcgtagtaaacttgtggaacaagcgatgctgatgatggcacaaaggaaatcatgcaagataactggcttgtgctacttttcagggagcttgaaaagcaaggcatcactttgcctgataggtacactgatgatgagttacacagattttatgttgctgcaaatggtgactttgaaagtctactttattctggtaagaagacaattcattgtaaggaaacatatcacatacttacatagc

SEQ ID NO: 30411 - DNA, 322 bp, Zea mays
  Clone ID: LIB3059-048-Q1-K1-D3
aaaaaaaaaaagaaaaaacaaaaaaaacaaaatttattttaaaaaaaaaaaaaaaaaaaaaaaaagaacaagaaaaaaaaaaaaaaaaaaaggccaacccatctaaaaaatccaacctttcttacacatccatccttacgtcatagttcttccatactcatacctaatttcaattcactccccattttattacactgcctcaactttaaaaaccttggcattaccaaacttattccttttccaaactatacccctttccacaacttccccatttcccaaaatgccctaacagataaaatttcccaacagtttcccattctaa

SEQ ID NO: 30412 - DNA, 441 bp, Zea mays
  unsure at all n locations
  Clone ID: LIB3059-048-Q1-K1-D5
cgcagggatgcacaagatgccattcgcgatttggatggtaagaatggttggagggttgagctggcaaccaaagatggtggtggccgtggccgagaccgtaatggttctgatatgaagtgctatgagtgtggtgaagttggccactttgcacgtgaatgtcgcttacggattggttcgggagggctgggtagtggaaggcgtcgcagccgaagtcctagatatcgcagccggagccgaagtcgcagccggagcccaagacatcgaaggagcccaagctatggcagaaggagctacagcccacgagatcgttctcctaggaggcgaagttacagcatgtcgccgncactgccaccaccgnctcctagaaataacagcatgtcaccacggngagcccgagaaatgagcagatcgtcaccaccacctcccataaataacagcagt

SEQ ID NO: 30413 - DNA, 271 bp, Zea mays
  Clone ID: LIB3059-048-Q1-K1-D6
caacaagcaacatagaaagtggaatccagtagcaacaatagagcaacaatggcgaccaagatagtttccctccttatgctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgtttc

SEQ ID NO: 30414 - DNA, 222 bp, Zea mays
  Clone ID: LIB3059-048-Q1-K1-D9
cattgagagtgctaataaggagattgccctgtggttccccgagggccctgctgatgggcagagcagccagcacccctggatctacgagaagtaaacatggaaagtttcacatcaaaccttgagagccagaggaagcatgtcaccatttgtgctttagcaatgttttcgaaaagattatgatctgtatcttggaaccttatttcaatggaccaaatttctttc

SEQ ID NO: 30415 - DNA, 414 bp, Zea mays
  Clone ID: LIB3059-048-Q1-K1-E10
caactctgacggcagcgagccagagcttcactattcatactggtgctgggaagatcgtgtcctgaaatacaaagtgatgggcaggtaaaggttgatatgggagagcccatcctttctggagcagacatccccacaaaactggtagctaccaagaacaaagctgttatccaagctgagttggcagttgagggcttaacatggcatgtcacatgtgttagcatgggcaacccccactgtgtcacatttggggcaaacgagttaaagaccttgcagatcgacgatttaaaactcagcgaaattgggcctaaatttgagcatcatgaaatgtttcctgctcgcacaaacacagagtttgtacaggttttgtctcgctcacacctcaaaatgcgagtctgggaacgtggtgctggagca

SEQ ID NO: 30416 - DNA, 424 bp, Zea mays
  Clone ID: LIB3059-048-Q1-K1-E11
cggacgcgtgggcgtgtcgcgagcaagacacatcactattaatttcactcctggagtgaaagattttttcatgggtccagccaacagcaagtacatcttccccctgaacgttttcagtggtccagaaggctcctctacacatgtcagaactcttcatctgggctatgtctgtctggacacaacctcgtctgatttcatgatctttgcaaatcttaagaagctcactctgcacaaaatttcctttttgggagacctccagtgcctgatgctgccagaatgcaattctcttgagtgtctgagcatcagcttctgttccttgcctggtttaagcacatgccaaccgctgcaacgtctgcaatgtgttcgtttgcactactgctatctaaaaaggattgagctggaagctccaaatctaacatcgttt

SEQ ID NO: 30417 - DNA, 427 bp, Zea mays
  unsure at all n locations
  Clone ID: LIB3059-048-Q1-K1-E12
caccagccgccgtcatgtcgaagcgaggtaggggaggttcggctgggaacaagttcggcatgtcactgggtctaccggtggcggccacggtgaactgcgcggacaacacgggcgccaagaacctctacatcatctccgtcaagggcatcaagggccgcctcaaccgcctcccgtccgcctgtgtcggcgacatggtcatggccaccgtaaagaagggaaagcccgacctcaggaagaaagtgatgcccgccgtcatcgtccgccagcgcaagccgtggcgtcgcaaggacggtgtctacatgtacttcgaagataatgctggagtgattgtgaatcccaagggtgagatgaaaggttctgcaatcactggacctatcggcaaggagtgtgctgacctttggcctangatcgccagtgcagcaaatgc

SEQ ID NO: 30418 - DNA, 366 bp, Zea mays
  unsure at all n locations
  Clone ID: LIB3059-048-Q1-K1-E2
caagatgatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggctacggtggcggcggcggctacggtggtggtggcggcggctaccgcggtggcaaccgtggcggcggctacggcaactncgacgggaactggaagaactgagcggtggg

SEQ ID NO: 30419 - DNA, 366 bp, Zea mays
  Clone ID: LIB3059-048-Q1-K1-E5
cactcatcacgccgccactgatctgctctgttgctggtgactaggagcagtagcgagagggatgctggatggccaagtcgaagaaccacacggcgcataaccagtcgttcaaggcgcacaagaacggcatcaagaagcccaagcgccaccgccagacctccaccaaggggatggacccgaagtttctgaggaacttgaggtactcaaggaagggcaacaagaagagtggcgaggctgagtccgaggagtaagatgatggtgattgagtttgtggcgacaaatgcatctcttgtatcgctaagagtcttagctgtgaacttagttctcacttctgtgtgactgtgatcaaaggacttgtgtatgatc

SEQ ID NO: 30420 - DNA, 292 bp, Zea mays
  Clone ID: LIB3059-048-Q1-K1-E6
cggacgcgtgggggtgggttggcttctccttcccctccggttcgggttcgggttcgtggggttgtccgacgttcgggttcgtgggtgagcggatcgagatggcggcgtccgatgttgagtaccgctgcttcgtcggcggcctcgcctgggccactgacgaccactccctccacaacgccttcagcacctacggcgaggtcctcgagtccaagatcatcctcgatcgggagacgcacatgtcccgcggcttcggcttcgtcaccttctccacggaggatgctatgcggaacgc

SEQ ID NO: 30421 - DNA, 354 bp, Zea mays
  Clone ID: LIB3059-048-Q1-K1-E7
attgttgtagacgacaacgacaagaatcatatgatggagaatggaagtggtgcggttgtgcctgctaattcttcagataggtccgacaggtctgataaacctttggaccaaaagacaatgcgacggcttgcccaaaatcgtgaggcagcaagaaaaagtcggctgaagaaaaaggcatatgtgcagcagctggagagcagtaagctgaaacttgcacaactggaacaggaactccaaaaagctcgccagcaggaaatcttcatttttagttttgaaaaccaaaccaatccaataattgaaaatgaacctttgacttttgccttaaattttgctaaatggttagaggaccaaatt

SEQ ID NO: 30422 - DNA, 400 bp, Zea mays
  Clone ID: LIB3059-048-Q1-K1-E8
accgagtcgacaaagacggtaaccaatggaaggaacggggcacgggcgctgtcaagcttctcagtcacaagcagaccggcaaggtccgcctagtcatgcgccaggctaaaacgcttaagatctgcgcgaaccacctcgtggcctccaccacgaagatgcaggagcatgcgggcagcgacaagtcgtgtgtttggcacgctgctgactttgccgatggcgaacttaaagaggagatgtttgccatcaagtttggttcggtagaaaactggaagaagttcaaggaattggttgaagaaatagctgaatcccttacaaagaaccaaggccagggaagttaaaattgtggttccaacgcttgattggttgccaaacttaattgtaaccaaggccaattttaagg

SEQ ID NO: 30423 - DNA, 426 bp, Zea mays
  Clone ID: LIB3059-048-Q1-K1-E9
cgtcttcggcccggcggcggtggaccccaagctggccgctggtggcgcgccggacgcgcggcgcggatgctgcaggaggcacggtgctggaccagaaggtgtggttccgcccgctcgaggacgtcgagaagccgccccccgccgcgtgagccgcgcggcgctgctaggccagcccacactgctgctcgctcataaaaagggcggcgggagagcctggcagtggcaggcactctgctcgtgctcggccgggctgggctccctgcttatatcactgcattattatactactagtagtggtgctggatagcagtgtgtggctgtgctaataccagtataatactggttctactataatacagtcgtatcaggcatggcgtgcatcaggactggttgtgatagtagcaacgtgatgctcgtgcctgtaat

SEQ ID NO: 30424 - DNA, 425 bp, Zea mays
  Clone ID: LIB3059-048-Q1-K1-D12
gcatgaagttcttcatcatgtgctcattttaggataagtaacacataaaatcttctggaaaaaagataatagtgcgtgtttttttttcataaaataaattttagcttgcagttagcttcttgttcaacattcatctggttaaattacaatggttaatttgaaatttgttgagagcgcagcttcgtgagtccaagggcatgacaacaatcaaacttcgtccacactgtggggaggctggtgatatcgatcaccttgctgcagcatttcttacttcacataacattgctcatggggtgaacctaaagaaatcccctgtacttcagtacctgtattatcttgctcagattggtctagcaatgtctcccttaagtaacaactcactgtttatcgactatcatcggaaccctttcccaacatttttctta

SEQ ID NO: 30425 - DNA, 402 bp, Zea mays
  unsure at all n locations
  Clone ID: LIB3059-048-Q1-K1-B5
cccacgcgtccgcccacgcgtccgggggcgcagaggcgcagcagggctctggaggagggaggaggagggagccgctgcggcgcggggccgtcagcgcgcgcctcccggtgccggaccacatacgccggccgccctacgtcggcacggccgccgtcccggaggtgtgccccgaccggcaggtgcacgacggcgagagcatcatgcggatgctggacgcctgcgagctcgccgctcgggtgctgcaccatgccggggcgatggtcaagccctcggtgacgacggacgagatcgacagggctgtgcaccagatgatcgttgacgccggcgcctacccctnccctctcggatacggcgggttccccaagagcgtgtgcacgtncgtgaacgagtgcacctgccacg

SEQ ID NO: 30426 - DNA, 231 bp, Zea mays
  Clone ID: LIB3059-048-Q1-K1-B6
taaaagtgacgcccaattactgccctcaatgttttgttagacttaatggctcactacgctaacggtcggtgtaattatatacatacatctacaataacatctgtttaagttacacaagctcaaaacaaatggcctcctagctccatcgttttgttgtcgcgtgttcatgatattccatcggcgaacattgacaactctgccacgcacatgactatttgtgttcaaccttta

SEQ ID NO: 30427 - DNA, 462 bp, Zea mays
  unsure at all n locations
  Clone ID: LIB3059-048-Q1-K1-B7
cccacgcgtccgcagaaacacaccaagcgaagcacattagcaacaacctaacaacaatggctagcaagatattatccctccttgcgcttcttgcgctttttgcgagcgcaacaaatgcgttcattattccacaatgctcacttgctccaagttccattattacacagttcctcccaccagttacttcaatgggcttcgaacacccagctgtgcaagcctataggctacaacaagcaattgcggcgagcgttttacaacaaccaatttcccaattgcaacaacaatccttggcacatctaacaatacaaaccatcgcaacgcaacagcaacaacaatttctaccagcactgagccacctagccatggtgaaccctgccgnctacttgcaacagcagttgcttgcatcaaacccacttgctctggcaaacgtaattgcaaaccagccacaacaacagctgcaac

SEQ ID NO: 30428 - DNA, 148 bp, Zea mays
  Clone ID: LIB3059-048-Q1-K1-C1
tgtgttgatccacagctactggtagcaagagcttctatccctgctgatggaagtgtgcgcaatgccaatgttgacattatcgtgggtgatgctattatgttgtggtgtattattggatatgtttgctgtttaatacacattgttgtag

SEQ ID NO: 30429 - DNA, 428 bp, Zea mays
  Clone ID: LIB3059-048-Q1-K1-C10
cccacgcgtccgcccacgcgtccgcggacgcgtgggagttgttgatgttgctaagcgagatcgagagaccgtctatctgggggatctaatcaagcatttcgaccacactatcaggctagatgactgttatatgtacagaacttacagctgtagagtagagataagcacgagagcgaggaattgctgggggatgccgagccgcctgatctgattgtagttcagtgcccttgtcttgtgctaattgctagaaaatgaatactcccagcaaaaaaatatgtaaatgcagctgaagtgtacgattactaacttctacttaattaaatcattctcagatacaggctttttcctgctcgtaagtttgaatatatatttaaaaaaaaaaaaaataaataaaaaaaaaaaaaaaaaaaataaaaaaaaaaataaaa

SEQ ID NO: 30430 - DNA, 412 bp, Zea mays
  Clone ID: LIB3059-048-Q1-K1-C12
ctgcttccgaaggtgacaggagcacgccgccgtggtcgtcctctgccacctcgggcagcgtgtcgcagccttcgctcagggacatacaacagatgcagcagaagaggcaccatggcggcgtctcccacagcccaaaaacccagacatcgggcttctctataccgccccacagcggagcgccagaggccgctgtggggcggtatagagaagccccacagcggagcgccagaggccgctggcggtcgcggcgtgaaggacaacgtgcccaaccggtggttcaggccggagaccgacgccccgtcctccatccgctccatccagatcgaggagcaggctatgaaggacttcaggcgcttctacagcagcgtgaggatcgtcaagccgcatgtctagtagcactggatgcggcggc

SEQ ID NO: 30431 - DNA, 157 bp, Zea mays
  Clone ID: LIB3059-048-Q1-K1-C2
cctcaattcccttatccacccacgcgtccactcactcaacacaccactctaccaccaactcttttattattcaccacaacttacctctctatagactggatttctaacaaaaccttttccctcctcatcctccatccttccaattcatatcatctta

SEQ ID NO: 30432 - DNA, 388 bp, Zea mays
  unsure at all n locations
  Clone ID: LIB3059-048-Q1-K1-C3
cccacgcgtccgctggagggagaggctcacctatgctgggctaactcaagtgtggttcgacccggatgaggttgacacgctaaaagaccagttgatccatgtgacatccttatctggctctgggttcaacatcctagtgtgtgatggcagccttgcactagcgtggcataatcgcccgttatatgtggcaacagcttggtgtgtgacaggaagaaatgctgccagttccatggttggcaacatctgtaaaggtacaaatgataatagaagaaaggaaaaccgtaatggacccatggagtaacaggaaagataaccatgtcatgaacaaatcgatcaagttattaaatgcactgttgacttccaaaaaaaaaaaannttatttttttac

SEQ ID NO: 30433 - DNA, 426 bp, Zea mays
  Clone ID: LIB3059-048-Q1-K1-C4
ctcgccgtcgcggtgccgtgcgccggtgctgtccagtctagggtttcggccctcgcccgccgagccgtgccccccgccggccatgtcgaagcaaggagggaaggccaagccgctgaaggcgcccaaggtcgacaagaaggagtacgacgagagtgatcttgcttatttgcagaagaaaaaagatgaggaaaaggcgctgaaggagctgaaggccaaggcacagaagggcgcaattggaggctcgggtctcaagaaaagtggaaagaaatgagcattgcccacccacccatctccaaaacacctaagagaacgaatagacaactgcttatctgggttgggcctcactatatgatatatggggcttggaaaacatggtgcctcttggattcccgggttcgcggtggtccaattggtttgcttggatcc

SEQ ID NO: 30434 - DNA, 198 bp, Zea mays
  Clone ID: LIB3059-048-Q1-K1-C8
acgcgtccggaaaaaaataactcttaatttatacgagactcctaaaattccaaactgggagggatttcatagcatattgcggaggaccatcaaaaagcacatcaaatgtcacatgccccttgcaagatcgaatccatgattaaactactcttctagcacattctactatccgtaatatgactctatctaacttatatc

SEQ ID NO: 30435 - DNA, 439 bp, Zea mays
  Clone ID: LIB3059-048-Q1-K1-D1
cccacgcgtccgcgatgatgacgaagatgatcttgacgaggaatcttattacatgaacaggtcgccaggcatccgtattggtaacaggagatggggtgacaatgggtacatcaggggaggcaggaaagaggcgaggccagtgaatactgatgtggctgctggtccatccaggactccgaagaagaaagagaaagccgcatcctcttcggcgtcggtgtcagtgtctggttcggggtcaggatcggggtctgtatccaaggatgtcgctggaaagcgggcgaagagggcgcagaagcgagaagctgcagacaaggcaactgcagagaagcacctgaagcacctgcagagggttgggctgagaaaatcgccagagcctgtagtgcccgacgaggttgggccacaggtgaatgagtgacttaagccggcgcctaatgctata

SEQ ID NO: 30436 - DNA, 427 bp, Zea mays
  unsure at all n locations
  Clone ID: LIB3059-048-Q1-K1-D10
ccagaatgcaccccaacaaacccttgtattccaaaaggggaatgcaattcctagcaggaaagctcttaccatctttaaatccagcacatttgaagttgatgttttgtatgtcgacccagataactcacaaattccacaaaaaataagcacttacacaattggccctttccaaacctccaacggagagaaggccaaactgaaagtgaaagtgcgtctcaacatccatgggaccgttacagttgattcggtgataatgctggaggaggatgtggaagttccagtctcatctgcaaatgaagctccaaacgatactatgaagatggacacagatgatgtgccaagtgatcctgctgctggatctgatgtgactatgcaggagcagcctnctgcagctggaaatggagcacaagataatgaggaaaagtct

SEQ ID NO: 30437 - DNA, 274 bp, Zea mays
  Clone ID: LIB3059-048-Q1-K1-D11
cccacgcgtccgcggacgacgacgcccggcggataagagcgggagcgggagcgagagcgacgacgatgactgggtcgagaaccagatgctggctttgctcgacgtggcggtgccgtaccggaagaagagcaggaggctgccggtctttgaggagatctcgcgagcagaatagcagatggctgatatagattagcagcagcatcatcatctttcgatcgagctccatgcatatatcgtttgagcgagcgcggatcctctggacctaactgcagtc

SEQ ID NO: 30438 - DNA, 440 bp, Zea mays
  Clone ID: LIB3059-048-Q1-K1-B4
cttacttaagacaccagggaaggagcaagtctaatgtcaagcaccaaaacctatcttgctagacgctggtgaaatgaaggaaccatatgattgggcgcctgcaattcttccaattcagatcataagaatcggccagctggctatcttgtgtgtccctggagaattcacaacaatggctggcaggaggctacgtgatgccgtcaaagctgtacttacaagtgacaacagtggtgaatttaatacaatcatggtggtcttgcggggcctaccaatacatattcgcaggatattacaacttttgaagaattttaaatccaaagattccaaggaacatcgaccttgtattgcccccaaaccttgaacgcctaccttcaagaattccagaaacttggtacaaccattgtggcaaacaaagaagttccgaccaattttcaagcccc

SEQ ID NO: 30439 - DNA, 206 bp, Zea mays
  Clone ID: LIB3059-048-Q1-K1-A1
cttttagattacatatgagatggcacctccttctattgaacgctgcacggcaagcatcatcagggacaagtttatatatcactgcgatccttcctactgcatcacgcatgcatccaccaacttcttatccactgtgcatggattaatcaactgctgtcgatacttgtatatacacatcaaattttcactcaacacattctacttaa

SEQ ID NO: 30440 - DNA, 426 bp, Zea mays
  Clone ID: LIB3059-048-Q1-K1-A12
ctgggtgggggtattctatctactatctttactactataacacactacttttaatagttccagtcgtggtttttgtgcgtcgcgcccccacccgctcgctcgttttccacgctgtgctatccaggagcgtccgtccgctctctgacatccacaaacactatcctttgagcattacatatctttttgaactgatttagttgtgcattaccattttattcaaaattttgtatgccgtcgcaacgcacgggcacttacctagtaccttgataagaccaggaagaggttcctttgggcaagaggagaaaatccaacgagagggaaatgcaaagtcgtccaataaacctcgtgcggcttaggaatgcttgattcagaaagatttgctagagcgttgtgattacgttggatgtggctgcaatgggctaaacc

SEQ ID NO: 30441 - DNA, 260 bp, Zea mays
  Clone ID: LIB3059-048-Q1-K1-A2
gaacgccatcgagggcatgaacggcaaggagtttgactgccgcaacatcaccgtcaactaggcggagtggtttttaggtcgtggaggcagcggtggttggtactgtggtggtcatttatgcgtttgatacatgtgtggctgacgccgtgatggcttcatgctacatactgctgtggcatatgctacagtgtctgctgctgctactgtggtggtggcagaagctactgcattggcaaccgtttctactgctactgtaacta

SEQ ID NO: 30442 - DNA, 457 bp, Zea mays
  unsure at all n locations
  Clone ID: LIB3059-048-Q1-K1-A3
gttgaaggcctgcagcagggttattgtgtcatttctagcgataaaaggttcttggttctgtatgctttgctaagaaagaagcggaataagaagataatggtgttcttctcatcatgtaattcagtaaagttccacgctgaacttctgaatttccttgggatagagtgttctgatatccatggaaaacagaagcaacagaagcgaactactacattctttagcttttgcaaggcagaaaagggcatcttattgtgcactaatgtggctgcccgtggacttgatattcctgacgtggattatatcttgcaatatgaccctccagatgaaccaaaggattacattcacagagttggtcgtaccgcacgtggtgagaaaagcaaagggaagtgcatntgctgtcttactaccagaagaactgaagtttctatttaacctgaaagcggccaaggttaccctg

SEQ ID NO: 30443 - DNA, 422 bp, Zea mays
  Clone ID: LIB3059-048-Q1-K1-A5
tccaggtacacctacgcgtacgcgtcggagctcttgtcccctattactttgattaaaaaactgggtggggtttggagatcggtcgtcttaataaacaactcgaagatgctcggtcaaaaggcattgatgttatggccttggtggttatcaatccaggaaatccgactgggcaggttcttgctgaagacaaccaatatgatatagtgaaattctgtaaaaatgagggccttgttcttctagctgatgaggtatatcaagagaacatctatgttgacaacaagaaatttaactctttcaagaagattgcaagatccatgggatacggcgaggatgatctccctctagtatcatttcagtctgtctccataggatactatggacagtgtggtaaaagaagacgttacatggagaatactggcttc

SEQ ID NO: 30444 - DNA, 212 bp, Zea mays
  Clone ID: LIB3059-048-Q1-K1-A6
ggggtctctttgtcgattcagcccatatataaagtgtgaaataaaagccgcaggtggaggcaggagacctgctgattgagggaacagttttgcctgtgtttggttacatgaattatctgtttcacagatgtgtagagcatggtgtaaatgcttcatgtgctgttcgtttcgacaaattgattatgctgtagcccttcaggtttcatcttgac

SEQ ID NO: 30445 - DNA, 174 bp, Zea mays
  Clone ID: LIB3059-048-Q1-K1-A7
cccacgcgtccgggagaattagttgagttacctgagtacaggcgagaataaatagatcgggttgtctcagagaaatgttgtaatcattcctaattgtagagctagagaaactctcttttttttcgatacccatttcgacggagttactgatccaaagactggtcttatgcgttc

SEQ ID NO: 30446 - DNA, 436 bp, Zea mays
  Clone ID: LIB3059-048-Q1-K1-B1
gaccaacaagcaacatagaaagtggaatccagtagcaacaacagagcaacaatggcgaccaagagattgtccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacac

SEQ ID NO: 30447 - DNA, 275 bp, Zea mays
  Clone ID: LIB3059-048-Q1-K1-B10
gttggcacatcacctttgggatgtcataacctccatttctttccataagataaatgtgaccgtccattatattttttatctggttattaggttcatgttgaaagttgacatagtgactctagcgtggaggatgcggctagttaagatttggtagctaggttgttcgtccatttgcctatttattatctcagatcagacttggtgccgttccagttgtgcattgtagcctctttttaccatgaaagttagttcagaagattcttttatgttgttgc

SEQ ID NO: 30448 - DNA, 321 bp, Zea mays
  Clone ID: LIB3059-048-Q1-K1-B11
acccacgcatccgcccactcgtccgcccacgcgtcctttttatgagtacttgacaaagtgcggaatgctgcatctgattatgaatgaggccagtggcacatgatttcgaacagcgcaaaggatcttatatgaaaaatcctatgcctttgtcaatcgaaaaaattaaagcccactttaattttaaagcttcctggaatatgaaaatataaaggctacaccattaaatcttgatcccacatgtcttttttgtacccataaattattttccattaattaattcaagaaatttgctctaccagttattgcttaacattttttata

SEQ ID NO: 30449 - DNA, 427 bp, Zea mays
  Clone ID: LIB3059-048-Q1-K1-B12
cggacgcgtgggcagaagcatccggtcaatctgctgctgctcggcctcttcaccgtggccatcagctttgccgtcggcatgacatgcgctttcactagcggaaaaatcattttggaggctgccattcttacagcagtggtggtgatcagcttaactgcgtacactttctgggctgcaaagaggggtcatgatttcaacttcctcggtcccttcctatttgctgctatcatggtgctcatggtgttttcactaatccagatctttttcccgctgggtaagatatctgtgatgatatacggtgggttggcatcgcttatcttctgtggatacatcatctatgacacggacaatgtcatcaagcgctacacctacgatgaatacatatgggctgctgtttcactctaccttgacgtcatcaacctgttcc

SEQ ID NO: 30450 - DNA, 413 bp, Zea mays
  Clone ID: LIB3059-048-Q1-K1-B2
agaaaatggcacccaattactgccctcgaggtgttgttagacttaatgggtcactacgcgaacggtcagtgtagttctatgcatgcatctacaataacagctgtttaagttgcacaggcgcgagacaaatggggtcgtagcgccatcgttttgttgtcgcgtggtcatgatattccatcggcgaacatcgacaactctgccacgcacatgagtatttgtgttcaacctttaatggtggatctgtttttttagaaatgtgtcaagagaagttgaaaatgatgatactggtcaccaaaactggattggggtataatttgaataccggttattccttgaccaaatgttaacaaccaaagtttttaagaaacttaaattatttattccattagcttgaatcggtcaatggtgggtta

SEQ ID NO: 30451 - DNA, 407 bp, Zea mays
  Clone ID: LIB3059-047-Q1-K1-H9
agagcctcattcatctccattcgaaacaccctcgcacccacactctcccttcggcccgagcctaaatccccgcaacgatggctcgcacgaagcagacggcgcgcaagtccacgggcggcaaggccccgaggaagcagctggcgaccaaggcggcgcgcaagtcggcccctgcgaccggcggcgtgaagaagccgcaccgcttccgcccgggcaccgtggcgctgcgcgagatccgcaagtaccagaagagcacggagcttctcatccgcaagctgcccttccagcgcctggtccgcgagatcgcgcaggacttcaagaccgacctccgcttccagtcctccgccgtcgccgcgctgcatgaggccgtcgaggcctacctcgtcggcctgttcgaggacaccaacctc

SEQ ID NO: 30452 - DNA, 304 bp, Zea mays
  Clone ID: LIB3059-026-Q1-K1-A7
cagaagcagaagccaccgatcggcgtgccgcgtgcgtgaggcgatcggagcatcccggcccgaggaggaagacaaccggcgacgcggggggaacatggggaagacgccggtgcggatgaaggcggtcgtgtacgcgctgtcgcccttccagcagaaagtaatgccggggctgtggaaggacatcaccaccaagatccaacacaaggtcaccgagaactggatcttcggcacgcttcttcttaaccccgtcgtcggcacctaccaataccccatgtggtacaaggagccagaaaagcttttccac

SEQ ID NO: 30453 - DNA, 303 bp, Zea mays
  Clone ID: LIB3059-026-Q1-K1-A8
ctctccgacacatgagaacggtgaacacagcatcgcgaagaagaatggttgagctgagctgagctgctttgattgctcaaactgagggagctgacgaatggagttggtcaacataacagttatatctagcttgaacgattgtcaggaccgatggcgatgacagattccaagctggttagatcaccttgtcgggtctaggcggaatgtatatttgctgctcatgatattatagtatgtaagaccataaacggtgagttggtgatgcgctatatatcttggaataaagctcaacttcttccaaaa

SEQ ID NO: 30454 - DNA, 362 bp, Zea mays
  Clone ID: LIB3059-026-Q1-K1-A9
gagctacgacctacgcgtccgcccacgcgttcgtgataagattgcctttgttcccatttctggttttgagggggacagcatgattgaaaggtacaccaaccttgactggtacaaaggcccaaccctgcttgaggctctagaccagatcaccgagcataataggcctttacacaaacctctgcttctgccacttcagcatgcacacatgattgatgccattagaacagtaccaacatgacccagaggagactcataacatgaatcctggtatggaactcacctaacgtgcaactgagctctatacttacgaggattatgcctatatgcaccaaagagcacttcaggaaagcttttaccatgac

SEQ ID NO: 30455 - DNA, 403 bp, Zea mays
  Clone ID: LIB3059-026-Q1-K1-B12
gttacacattcggatcgccatgtcagactcggatgagcaccacttcgaattggatgggcgcgccggatcgtccaagacctacccagcacatgctggcaccgtccgtatgaactgcttcatcgtcatcaagaaccgaccctgcacggctgtggaggtttctaccttaaagactgataagcatggtcatgccaaatgctactttgtagccatagatatatccaacggtaaaaagttcgaatatattggtccttcatgacacatactgcatattacagctgtgaaccgtactgagtatcacatgattgatatatcagactatggattagcgagctttcttacttcagatggtaacactaatgatgatcttaaactcccaactgattatactcttgtagcccagatc

SEQ ID NO: 30456 - DNA, 297 bp, Zea mays
  Clone ID: LIB3059-026-Q1-K1-B2
cggcgcgtgggatgggttttaggcaggtcgatctcaacaaggaaatcctcaggcagaacaattacaatctagagcagtctgtcgatgacctatgtggcgtcaatgaatgggatcctctccttgcagagctggaagagatgggatttgatgacacagagatgaacaaggagctgcttgcgaagaatgagggaagcatcaagcgagctgtgatggagctcattgccagggagaagaaggacaagtgaagatcgtgtgctatctaagtatatattcgtaaataatgagacggctgtgcca

SEQ ID NO: 30457 - DNA, 304 bp, Zea mays
  Clone ID: LIB3059-026-Q1-K1-B6
cggacgcgtgggcggacgcgtgggcgcgcctctacatttcttctctctctgctcctgcgcctgcgcctgatccatgcaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaa

SEQ ID NO: 30458 - DNA, 305 bp, Zea mays
  Clone ID: LIB3059-026-Q1-K1-B7
cccacgcgtccgacctggagaagtaccgcaaggatgctgagatctgcgtcaacgcgggtgaggaatccgtacgtgcatctcttggaaagaggaagaccgcccctaagccgccctctggcgcagacgctaagaagcttaagatttggttgggaaagaacaaagtagaagaagatgaaagtgatagcgatagtgacagtgacatggatgatgaggacagtgaagatcaggagagcgcagatgcaaaatctctcgtagttgatgaaggcaattgctcaaatggatccataaaaaatgagaaacttgat

SEQ ID NO: 30459 - DNA, 427 bp, Zea mays
  Clone ID: LIB3059-026-Q1-K1-B9
acccacgcgtgcgcccacgcgtaccagcacacctgcgcaactagcaacatagaaagcacattcgggtgccgacaattgtatccgaaagatttggctaccttacgctccttggtctatgtgcacatgctgctaccgcaaccatttttccacaatgcttacaagctactatagcttcccttcttgcaacatacatctcaccagccctatatgcaactgcagacaacccaattaggcaacattcctggatcacaacttgcagtctcaacaagcatcttacctatatcaccctcagtcatcgcaacacacgcaagacgtatcacaagatgtacctactgtcgctacctgggaacaacccattaggtctcaccaactactataactagtgttagcaacacttgctgcatactttcaaccaacatgagtacac

SEQ ID NO: 30460 - DNA, 297 bp, Zea mays
  Clone ID: LIB3059-026-Q1-K1-C1
gcaaattgcaccaagaaatccatcgagaggccgtcgacaggggaattaatggggtcggggtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgc

SEQ ID NO: 30461 - DNA, 167 bp, Zea mays
  Clone ID: LIB3059-026-Q1-K1-C10
cttccttttaccttttcaccaacaaaacttatattccatctcattctcaattcattataccattctccacattcttcaaatcttaaacacccactttcaaccttatctacaacacaattcactacttttacacaccaattccattcaacaacatctttctacattac

SEQ ID NO: 30462 - DNA, 369 bp, Zea mays
  Clone ID: LIB3059-026-Q1-K1-C11
cccaattggacccacgcgtcacgctacactggaactccggctaatcttaaataccatggcgacacattcaaatctcctgcgtgtgcggtaacttccacgattagtgatcaacatcattctacacaaaccctggatcaatccctatatggacccctaccatacacccttctacaatatacctgaacggcaacgctaatcagttgctgcaagagaaggcttaaagcttacttcttgactacttgtacaggactccagtacgcattcacatcaaacactctgtatcagatgcaaagcccatcacgcttaccattaagaaccatgactacatatgtgacattaacatactgaaagagtaccttggcaaagata

SEQ ID NO: 30463 - DNA, 302 bp, Zea mays
  Clone ID: LIB3059-026-Q1-K1-A6
cccacgcgtccgcaacagcgggggtgcatgggacaacgccaagaagtacatcgaggccggcttgtcggaggaggcgaggtcgctggggcccaagggatcggaggcgcacaaagcggcggtgatcggggacaccatcggcgacccgctcaaggacacctccggaccgtccctcaacatcctcatcaagcttatggccgtggagtcgctcgtcttcgcgcccttcttcgccgcgcacggtggcatcatcttcgaccacctctgatcaatgcatgctgctgacgttccatggcaaaggcgccggc

SEQ ID NO: 30464 - DNA, 298 bp, Zea mays
  Clone ID: LIB3059-026-Q1-K1-C5
cccacgcgtgcgctaccattcagccagctagctgctgtgagccctgctgccttcttgacacaggaacagttgttgccgttctacctgcacgctgcgcctaacgttggcaccctcttacaactgcaacaattgctgccattcaaccaacatgctttgacaaacccaacagcgttctaccaacaacccatcattggtggtgccctcttttagattgcttatgagttatagttcaataataaagtttttttgctgatgtttgtggcttcccaaaaataagaaagtgcatttctagtttctt

SEQ ID NO: 30465 - DNA, 304 bp, Zea mays
  Clone ID: LIB3059-026-Q1-K1-C6
caactcctgagcactttctcctcgtcccagacaagccaatcgaagccgagatacgacgatgggctccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaat

SEQ ID NO: 30466 - DNA, 437 bp, Zea mays
  Clone ID: LIB3059-025-Q1-K1-H1
cctatcgagtcgatcgaagacccatttgatcaggacgactggagcacttatgccaaacgcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagctccttgccggtctgagcgcctggccaaatacaaccagctgctcaggatcgaggaagagctcggtgatgccgcggtctacgccggagcaaagttcagggcacc

SEQ ID NO: 30467 - DNA, 379 bp, Zea mays
  Clone ID: LIB3059-025-Q1-K1-H12
cccacgcgtccgcccacgcgtccgcccacgcgtccgcccacgcgtccgcgccgccggggaaggacggaaggagaagagggtacggccgtctcctcgcccccatggcccacgagaagaagctgtccaacccgatgcgggagatcaaggtgcagaagctcgtcctcaatatctccgtcggcgagagcggcgaccgtctcacccgcgccgcaaaggtgctcgagcagctcagcggccagacccccgtcttctccaaggcgaggtacacggtgcggtcgttcggcatccggcgtaacgagaagatcgcctgctacgtcacggcgaggggcgagaaggccatgcagctgcttgagagcggcctcaaggtcaaggagtacgagct

SEQ ID NO: 30468 - DNA, 434 bp, Zea mays
  Clone ID: LIB3059-025-Q1-K1-H2
cgaaggagggtgcactggctgaagagaacatgcgcgggatttgcttcgaggtctgtgatgtcgttcttcatgccgatgctatccacaggggtggtggccaggtcattccaactgccaggagggtcatttatgcttctcagctcacagccaagccgaggctgctggaaccagtttacctggtggagatccaggccccagaaaatgcacttggtggcatatacggtgttctgaaccagaagagaggacatgtattcgaggagatgcaaaggcctggtaccccgctctacaacatcaaggctttcctccctgtcatcgagtcctttgggttctcaagccagctgagggctgcaacctctggtcaggcgttcccccagtgtgtgtttgaccactgggacatgatgggctcggatcctttggaggctggctcccaggct

SEQ ID NO: 30469 - DNA, 400 bp, Zea mays
  Clone ID: LIB3059-025-Q1-K1-H3
cccacgcgggcgcacaggctgaagagcacacgctcgggatctccttcgaggtctgctaggatcgacttaatgccctggctataaatatggttcttattcacagcatcacatctgatcaaagggtcaatcatgcttctacagctcacaactcaattgcagctgctggatccagttcacctagctctagatccatatcctacagaaactgcaactactaccatatcacgcgtttctaccgaaaccatacatgcatcttgacacacaccaggcgctgtacctctactctacaagctctacgttacgctggctgtcttttactactgcgacaattgctgccatttaaccaacttgatctgacataacgcgtagtgttatagcgacaacgaataatgggacatga

SEQ ID NO: 30470 - DNA, 435 bp, Zea mays
  Clone ID: LIB3059-025-Q1-K1-H4
caaccaatgagacgctgcttaatgggcattacaacatagtgtttgtagtgttttttgggcgaagctaattgcggtccgtctcttcattggaactcatagcagtaccacacaaccagtgagaccataccactaattttattataccactagaaccagcttctcactagcttctcaccaggggtttgactttgtaacataggagatacagtgtgctcttctggaacttcatccccaacatcatcctcactgatcttgtgcagtacttggcacttcagtgacggcttcaaatacaacattatctcctggattgtgactctgttttggggtcgtggctatatcagtttgcatattatctggagccttctgaagcaactcttttattatagcatcagaatgtaaggtttctatctctatgggtagatcactgactgacgc

SEQ ID NO: 30471 - DNA, 435 bp, Zea mays
  Clone ID: LIB3059-025-Q1-K1-H5
cctttatcacccttgttgtttcaacaatcgccagccctatctttggtgcagtcaggggggcaaaccatcagggcacagcagctgcagcaactcgtgctacctgtgatcaaccaagtagctctggcaaacctttctccctactctcagcaacaacaatttcttccattcaaccaactgtctacactgaaccctgctgcttatttgcagcaacaactattaccattcagccagctagctactgcctactctcagcaacaacaacttcttccatttaaccaattggccgcactgaaccccgctgcttatttgcagcagcaaatactactaccatttagccagctagctgcagcaaaccgtgcttgcttcttgacacagcaacagttgctgcctttctaccagcagtttgcggctaaccccgcaaccctcttacaacta

SEQ ID NO: 30472 - DNA, 366 bp, Zea mays
  Clone ID: LIB3059-025-Q1-K1-H8
cccaaccaatgagactctgcttaatggtcattacatcatagtgctggtaacgtcacttgcgcaatggaattgcaggccgtctattaatttgaactcatagcagtaccacacaaccagtgagaccataccactaattttattataccactacaaccaacttctcactagcttctcaccacaggtttgactttgtaacatatgagatacagtgtgctcttctggaacttcatccccaacatcatcctcactgatcttgttcaatacttggcacttcactgacagattcaaatacaacattatctactggattgtgactctgttatagaggtcgtggctatatcaagttgcatattaatctgagccttt

SEQ ID NO: 30473 - DNA, 190 bp, Zea mays
  unsure at all n locations
  Clone ID: LIB3059-026-Q1-K1-A1
gaggggggagccacgcgnncgggagaagacgcggggggaccngagagcagacgcaccaggcaccagaagggngaacggggggaacngcgaggcggcgagaacacaaaaagccgaacaaagcggaggcgcacgaaacaagcancagcagnggcgacgcaaacgacccggacaggaagacccaccgcagaag

SEQ ID NO: 30474 - DNA, 123 bp, Zea mays
  Clone ID: LIB3059-026-Q1-K1-A10
cgcacaagtaaggtgtatcgctctccccgcccgcaagccagtggcgtccgagccgcgtcgctcgtgctccctacgaccctctacaactcagcggatccgccgactcgcctatcgatggcgtca

SEQ ID NO: 30475 - DNA, 386 bp, Zea mays
  Clone ID: LIB3059-026-Q1-K1-A11
tccgaattcccgactggagccacgcgtacgcgtgctgccagcgtgtacacgaggaggtttccttttcacatccgaacactccttagtgtgctgggctcctcttctgcggggccacagcaatccgcagatattagctgactcgtgaccgactgctatagctacccttcttccgccatgcctgctatcaaatgtagttatagtccgacgaagcacaccatgtaagacgctataaggttcaacaccattgtccgacgggcaactttcacacattacccatttctggtacaaagaagtccgaacgaatcatgctgcactagattgtacaaaccaagagctcacaccatgttgtacaactactactaacgtagagccatctactttgacca

SEQ ID NO: 30476 - DNA, 437 bp, Zea mays
  Clone ID: LIB3059-026-Q1-K1-A12
caagtcgcatcgcacgtacggtctcaggcgcatcggcctcgccgctgcacagcgccggagacgatacgacggcggctacgggatgacggtcttccacttcctcaactgcgccttcctcaccttcgggcctcacgtcgtctactactccgccacgcccctgtcagagtatgatacaatcggcacttctataaaagcagctgctgtttatcttggaactgcgcttgtaaagcttgtttgcttggcaacattgctcaaagtacctgagaatgatagctttgacccctatcaggagttaatgaaagtttttattggattcatagatgtagctggactgtattttgctttgacccagctgacccacagaaacatctctcagaatcataagttccaggctgttggtcttggttgggcttttgctgattcagttttgcaccgac

SEQ ID NO: 30477 - DNA, 296 bp, Zea mays
  Clone ID: LIB3059-026-Q1-K1-A2
gcgtgcagaataacaccagaccttatgccagaggtcgaaaacctgttcataggggacgtctgaaagctgcataacacgcctctgccaccacctaggatgcagcaagatcctctgccacatggccaatgatatcaaaatcgaaacctactgcttcaaggccaaatgttgcacgagcgccagacacctcacctgatgccgctgcttcataacctgctggtcctgaagattccacggctgcacatggtgttcgaaactccacaggtcctgatctcaccagccaattgacagcttcgaac

SEQ ID NO: 30478 - DNA, 301 bp, Zea mays
  Clone ID: LIB3059-026-Q1-K1-A4
cccacgcgtccgcccacgcgtccgaccaggcgagccaacaagcaagcaaaagtaaacggggcgaggagctgtagagacgccggcgacgcgaagcaaccgcccgatcggagccgcggctgagcaggagggagccggagatggtgggtctcgtcggcggcagcacggcgcgggcggagcacgtcgtcgccaacgccggaggggaggcagagtacgtgcgccgcatgcaccgccacgcgccgaccgagcaccagtgcacctccaccctcgtcaagcacatcaaggcgcccgtccacctcgtgtg

SEQ ID NO: 30479 - DNA, 307 bp, Zea mays
  Clone ID: LIB3059-026-Q1-K1-A5
ggagagttcgttgggggatctgatatcatactcaccatgcaccagaagggtgaactgagggaactgcttggcgatatagcacaaaaagccgaacaaagtggttcttcatgaaacaagcatcagtatttgcgatgcaaacttcccggactggatgttccttctcagaagattttaggtgatcttgcattgttgccctgtggcttcggatttgaatacgttctctgttttgttctgttctgttcttgccagttgtgatggaagatccactcaaggccgaattgcacgagtaaccaaagttatagttctc

SEQ ID NO: 30480 - DNA, 396 bp, Zea mays
  Clone ID: LIB3059-025-Q1-K1-G9
gacccacgcgtacgatgaaatcttcaaagatctcgctgcgctagtccatgatcaaggagcaatgatcgatgagatggattcccatatagagaacgccgttgtagcgacttctcatgctaaaggccagctttcaaaggctgctaaaactcagaagtcgaactcttctctgatatgctcgttgctcgatattttcagagtggtcctgctcatagtgataatagtacttgcagcctaaaagcttggaaggacacctggggttcccaaatctgatcgagagcttattgcgacaaattccttcataagctatttttgctgtgctgctaagaatgattcctggtacccaagcggtgattggcgctctgcttgtggtgtggcagcatatgtcgtgatgatcaa

SEQ ID NO: 30481 - DNA, 310 bp, Zea mays
  Clone ID: LIB3059-025-Q1-K1-F5
gccacagcttgcagatggaatggcagaagctgttgcaaacattgctgctttcttgagagaacaacatttgttgccattttacccacaggttgtgggaaacattaatgccttcttgcaacagcaacaattgctaccattctacccacagaatgcggcaaacattgttgccttcttacaacaacaacaattgctgccatttagccaacatgctttgacgaatcctaccaccttattgcaaccgcccaccatcggtggtgccatcttctagattttttatgatttatactgtaataataaagttctcatgctg

SEQ ID NO: 30482 - DNA, 429 bp, Zea mays
  Clone ID: LIB3059-025-Q1-K1-F6
gtgaaaacccaattcttcaaccctataggatccaacaggcaatcgcagctggcatcttgcctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgctgcttatttgcaacaacaactaccattcagccagctagctgctgcctacccccaacaatttcttccattcaaccaactggcatcattgaactctcctgcttatttacagcagcaacaactactaccattcagccagctagctggtgtgagccctgctgccttcttgacacatcaacagttattgccgt

SEQ ID NO: 30483 - DNA, 436 bp, Zea mays
  Clone ID: LIB3059-025-Q1-K1-F7
cccacgcgtccggcaacatagaaagcacaatagtgtaccaacaatggcagccaagatagggtgcctccttatgctccttggtctttctgcaagtgctgctaccgcgaccattttcccgcaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgctgcttatttg

SEQ ID NO: 30484 - DNA, 431 bp, Zea mays
  Clone ID: LIB3059-025-Q1-K1-F8
cccgcgtcacgggcgcgtttggctttgtcagctccctcatagcttgctaccagcgtgggccaagcccaccagcaaagcagatcaagtgaggacttcgactccaagcactgtttaccaggaaaataatccctcctgataggttcgatttggttgccacatacccttgtatggcagactagactaatatatgtaatcatcatcataataattgataaaccatcccactatggataggttaggtcactccaagcactgtttaactgtattcatcctccaaaagcatgctaatgcccgtttagttcgatggactaaacattaatgtctctattttagtctctaaattgtcaaacgatgagactaaaataaagactaaactgtttaggatatagtcactcaaaaggactaaaaatgactaaaccatattaattcta

SEQ ID NO: 30485 - DNA, 290 bp, Zea mays
  Clone ID: LIB3059-025-Q1-K1-F9
cactcgtagccgccggcaaggcgactgacctctttcctgctgccgagcgccatcgtcgcctcggaccatctcaacctaaaactggtgggaacggcggccaacccgtctagggcttggccctggcggtttctgagcctagaacatctttgcattttggagagtcttcacttggagctattggacaggcttcattcctttcaacgagatggcacgttagtctggtctctcgcttgtgagggatcgagccaagaccggagcgctgaaacgtctgactctgagttcatcgaaaa

SEQ ID NO: 30486 - DNA, 402 bp, Zea mays
  Clone ID: LIB3059-025-Q1-K1-G1
catttatgcagaagctgcatgctgttcgccagatgggagtgaatttgcagttcttgctgttcgtagttgtcctgatggagaagcatcaacacaacaagatggagtaattcttctttttgatgcagaaagctcaaaccccattgcctcctggtcggtaaagaaggcatcgggtggcagcatttcttttgtaaaaggtgacgtccctttggatgcaaatgctgatagttcgagagacaaagagccaatgttgcttgattatgtaaatggttctcatgaatacgccatctttgatccccgggagagtgaggaggtggtcattagcaagaacaagcacaagaagattcaagctgaggaacctgcaccaatcggctacgcttctatttacggagagcttacaaaact

SEQ ID NO: 30487 - DNA, 404 bp, Zea mays
  Clone ID: LIB3059-025-Q1-K1-G10
ggatgacttcgccttctatgagagtcgccagaagctgatgcaggataagaggtcgaggcagcagcaggtccaaaagcaggtctgggacagtaggacccccatttctgtcactggaagcgagcaacagcaggaagctgccaatgggaagcccaatccgtctgtaccaaacggtgtccctgcagaggtgaaggcggcgaaggcttctgcagagaacggcaccgccactccagctatttcctacgcggcaaaggtggcccaagcagcaacagagaaacctgtgctcgccaacggagtcgctaagaccggttagctggaccgcccaaccgatgctccatagctagccgcgagcgacggtcgacgtccccaagagctcgaccgaatcactgtacaagggaaactggtga

SEQ ID NO: 30488 - DNA, 398 bp, Zea mays
  Clone ID: LIB3059-025-Q1-K1-G11
cgggcctgaagatcgggttccacgtggtggagtactcgaaccccgtctacttcgcggggctgggggagtacgaggacggcgacggcgacgtggtgcaggtggacctgatggagtccaagacggcgcgcggcccgccgacggggcggtggacgccgatgcgcgagtcctggggctccgtctggcgcatggacaccaaccaccgcatgcaggcgcccttctgcatccgcatacgcaacgagtccggcaagacgctcgtcgacaacaacgtcatcccggacaactggcgccccaacaccttgtaccgctccttcgtccagtaccgctagctgatcgggatgcctgccctgccctgccctgaccgcaattggagcttgctgacgctggggctctacttggct

SEQ ID NO: 30489 - DNA, 372 bp, Zea mays
  Clone ID: LIB3059-025-Q1-K1-G12
gggttggcttctcctccccctccggttcgggttcgggttcgtgaggttctccgggggtcggggtcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttcttcacggaggaggcgatgcggaacgccatcgagggcatgaacggcaaggagctggacggtcgcaacatcaccgtcaacgaggcccagtcccgctgcggtcgtggaggcggcggcagtgggt

SEQ ID NO: 30490 - DNA, 362 bp, Zea mays
  Clone ID: LIB3059-025-Q1-K1-G2
gaaacctggctgcctagtctgagcagcagcagctcgttacatgcaaccaactgtctggagtgaactctgatgcttatgcgcaacatcaactaccattcagtcagctagctgctgcctacacgcagcaatatcttccatacaaccaactggcaccattgaactctgatgctgatttacaacagcaacaactaccaccattcagccagctagctgatgtgagccctattgcctacttgacacagcaacatttgttgccggtctacctgcacgctgcgcctaacgctggcaccatcttacaactgctacaattgctgccattcaaccaacttgctatgacaaacccaacagcgttctaccaacaa

SEQ ID NO: 30491 - DNA, 377 bp, Zea mays
  Clone ID: LIB3059-025-Q1-K1-G3
cccacgcgtccgcccacgcgtccgcccacgcgttcgcccacgcgtccggttggcttctggtggcccttcggttcgggttcgggttcgtgaggttctccggggttcgggttcgtgggtgagcggatcgagatggcggcgtcggatgttgagtaccgctgcttcgtcggcggcctcgcctgggccacggacgaccactccctacacaacgccttcagcacctacggggaggtcctcgagtccaagatcatcctctatcgggagacgcataggttcctgcgcttcggcttcgtcaccttgttcacggtggaagcgatgcggaacgccatcgacggcatgaactgcaaggagctggacggccggaacatcaccgtcaacga

SEQ ID NO: 30492 - DNA, 436 bp, Zea mays
  Clone ID: LIB3059-025-Q1-K1-G4
cccacgcgtccgggcatcttacctttatcacccttgttcctccaacaatcatcagcccgattgcagcagttacctttggtgcatttattggcacaaaacatcagggcacaacaactacaacaactcgtgctagcaaaccttgctgcctactctcagcaacagcagttacctttggtgcatttgttggcacaaaacatcagggcacaacaactacaacaactcgtgctagcaaaccttgctgcctactctcagcaacaacagtttctgccattcaaccaactagctgcattgaactctgctgcttatttgcagcaacaacaactactaccattcagccagctagctgctgcctacccccggcaatttcttccattcaaccaactggcagcattgaactctcatgcttatgtacaacaacaacaactactaccattca

SEQ ID NO: 30493 - DNA, 434 bp, Zea mays
  Clone ID: LIB3059-025-Q1-K1-G6
gaaaatttgaaaaggggccttttgagatcttctctgttggtaataacgattcagaggggcatgtcataaagttcagcagtgatggcaggcggattctgttaaccactaaagctggacgtgtccatgtgctagattcattccatggcaatagcattgcgtcgtgcaatgtgaagccagtggtaaccaactcaacactggaggcgtcgttcagccctgatggaaaccatatcatatctggctccggtgacggtagtgtttatgcttggaatgttaggagtggaaaggtcgcgcgctggggaagcacagacgacgaaccgtcgctggtaaggtgggctccaggatccttgatgttcgtgacaggatcatcagaactgtcatgctgggttccggacctgtctaagctgggatcctttaccattagcaagtaggtgaaa

SEQ ID NO: 30494 - DNA, 428 bp, Zea mays
  Clone ID: LIB3059-025-Q1-K1-G7
gtgatgaccagaaccgtgaattgattctttcccgtatcaaggtccacttgaatgcactgaaaagatacacctatgggaagcatatcgtggcacgtgttgagaagcttattgctgcaggagaacggcgcattggtgccccatcctcttgctgagatggcaataaagctatatacaggtcgcagaataacacctgtacagacagacagggatagcgaggcctagctttttaccattaccagtagtcggtaatattgagcgacggagaggttaaaaaaggctcccaaatcctttgatgtaaataaaggatagccgctggaaataaataaaaagaatgagaaaagatgaagagattttgcttgtccttgagggaagagttgtatatttgtgtggtttattttcccctcttgaagcagatggataaatgtttt

SEQ ID NO: 30495 - DNA, 436 bp, Zea mays
  Clone ID: LIB3059-025-Q1-K1-F4
cccacgcgtccggggtacggtccacttcgctcgcaaccttccccagccatggcgaccgcgacgcggaggctgctccccgcgctcctcaggaccctagctccagccggcgcgcgcggcctctccaccgagaaggctgttggcgcagccgccgtcgtcggcagccacaccgctaagtggatgcaggacacgagcaagaagtcgccaatggaactgatcaacgaggtacctccaatcaaggttgatggtcgcattgccgtctgtgaaggggcttctgaaggtgttggacttggccacccaatcgagtacatctgccttgatctggaggcacctaatgtgtgcaagtactgtggtctccgttatgttcaagttcaccatcactaaattgagaagataatgctgtctaccgctgcagaagctgagttgaggagtttatgtg

SEQ ID NO: 30496 - DNA, 288 bp, Zea mays
  Clone ID: LIB3059-047-Q1-K1-G2
ctcactagctcacatatcttcccttgttcagccatacctgtcaccagtggtgtcttcaatgtgcgaaaacacagtcgtttaaccctacaggatccaacacgcaatcgcaacaggcatcttaccatcatcacacttgatcctcaaacaaccgtcagccctattacaagaataacctttaggtccatttgacagccacaaaacatcactgcacatcaactacaacaacttgagctagcaaaccttgcttgatactctcaccaacatcactgtctcccaatgaaccaactg

SEQ ID NO: 30497 - DNA, 417 bp, Zea mays
  Clone ID: LIB3059-047-Q1-K1-G4
caaaaagacattggagatcaacccatagaaccctatcatggatgagctccgcaagcgtgccgaggctgacaagaatgacaagtcagtcaaggatctcgtgatgctgctgttcgagactgctctcctgacctccggcttcagcctggatgaccccaacaccttcggcaaccggatccaccgcatgctcaaactcggtctgagcatcgatgaggacgagcctgttgaggcagaagccgagatgcctcagcttgaggacgacgctggtgaaagcaagatggaggaggtcgactaagtgtcgcatcgcatgcttgccgtttatcttatccctagctaagctacctgtgatagcttaattttcactattgttcgaggtttttggcacgttatcggttgtcctgctggccaggctataagtct

SEQ ID NO: 30498 - DNA, 416 bp, Zea mays
  Clone ID: LIB3059-047-Q1-K1-G5
caagcggatgctagagatgatcaagatattgatggagagtgatctcaaccaaaaagggaaaaaaaacacaagaggacactaaagacaaacaggcaagagtaccataacgccaaccgagctctctacagcatgctgaagaaggagcagcaccagctgacaccaccgaagccatcaaacaaatgtgaaaaaatcatcatgcacgacgaactcataaacaaccaattgctacgacgcgaaccccgatggatcataagaacaaggacgaacaacaacaatgaagaccaacccgctgcagcacaacgatgacaagatcaagactcaatgacaaaagctgccgaactacaaggactcagcggctagaagcgcacctgtactgcaaacacatcgacaggtgcactctgagcaagatgcggaga

SEQ ID NO: 30499 - DNA, 416 bp, Zea mays
  Clone ID: LIB3059-047-Q1-K1-G7
gtatgtggaaccatttggatcctggaagcgtttgtcacatgtttacacggcaccaggggagtcggatgactacgactccatcgtgacaggggcgcagttacatgtgagcagccatgggttgacgaaggtcctcttccttcgcctccaattcgccagagtcagcaatgctgcgctcgtcaagaatcccgagtgggaagggtcaccgaatttggggcagaaatctggcctcatctcgacgcttatcagcacgcatttctccatggcagctcagaagcctgtccctcgacctgctgatgtgaacatcaactcggctgtgtaccctggcggtccgtcaacgccagtgcaggcaccaaagctactcaagtatgtggacacggcagagatggtgcgcggaccacaggacacgccgggatact

SEQ ID NO: 30500 - DNA, 386 bp, Zea mays
  unsure at all n locations
  Clone ID: LIB3059-047-Q1-K1-G8
caggatggtaaaaaggatatacatttactcttacgaggaggccaagtctttgactcgcaaggcgaagccgccggttgttggtgacaccatcaagccagacccaaacaaattgccaccggaatctgacgtgccacatgactcanacaacaatgctcccgttgctgctgattatcaggactgatggatgctaactgggctcctacctnttctttcccctctgggatgtcggtcatggaaggcaatgcacgctccttgggactngtaagagttatctgttttgttgcttcgcgggcccaaaggacgcttccctgcaccatctgcctttgtttggaacggcttgaaccgccgtggtcctttaacctgcagcagggaaaggaatggctgga

SEQ ID NO: 30501 - DNA, 416 bp, Zea mays
  unsure at all n locations
  Clone ID: LIB3059-047-Q1-K1-G9
gncgcaactagcaacatagaaagcacaatagtgtaccaacaatggcagccaaaagattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcacaacaactacaacaacttgtgctagcaaaccttgctgcctactctcagcaacagcagtttcttccattcaaccaactagctgcattg

SEQ ID NO: 30502 - DNA, 423 bp, Zea mays
  unsure at all n locations
  Clone ID: LIB3059-047-Q1-K1-H1
agcgcctncacgatctcgacgagaggatgcccaatcgcgaaaccgccgccctattgcaatggcgcccaaggccgagaagaagcccgccgtcgagaagcctgcggaggaggagccggcggcggagaaggccacggctgggaagaagcccaaggctgagaagcggctccccgccggcaagtacgcaggcaaggagggtggctagaagaaggggaagaagaaggcaaacaagtcggtggagacgtacaagatctacatcttgcaggtgctgaatcaagtgcacccagacattggcatctcgtccaaggccatgtccatcatgaactccttcatcaacgacatcttcgagaagctggcggcggaggcggccaatctggcacggtacaacaagaagcctaccattacgtccagcgagatccagacctg

SEQ ID NO: 30503 - DNA, 388 bp, Zea mays
  Clone ID: LIB3059-047-Q1-K1-H10
agtacctttactttctgaagttttcaatggtaataagagtcgtgaacacaaacatgaggtataattgagttcttgtctgatcttttgagttgcacttgatcttttgagttcttgtcttggttcgttcttgattcttggacgaggtgggatttggagagccaagggcggcgcggcagcagcgggtttctcggtcggactagattgtttccatcgagatggtgggcggcggagggcattcgtcgatggaccaccctggcgccaaggacctcgagcgcggcgagctgcgccgtggcgcgcctgagtttgcggacggcgacgatggagacggggaagaaagccagtacttctcggacgcggaggaccggtcgtggccgtcgcactcgcgcca

SEQ ID NO: 30504 - DNA, 419 bp, Zea mays
  Clone ID: LIB3059-047-Q1-K1-H11
ataatgtttgggctagcacagccagcggaaacaggaagctggattctgcttaccgtgcggccagagagaaagaagagcattgccctattttcttgtttttctcggttaatggaagtggccaattctgtggcgtggctgagatgattggacctgtcgattttgacagaagtgttaattactggcagcaggataagtggagtggccagttcccagtgaagtggcacataattaaggatgtaccgaacaaccttctgcggcacatcattcttgagaacaatgacaataagcctgtcacaaatagcagggacacccatgaggtgaagctggaacagggcctccagatgctaacgatcttcaagagccatgaggctgagacaacaattgtggaagatttcgacttctatgagcagcgggagaaa

SEQ ID NO: 30505 - DNA, 286 bp, Zea mays
  unsure at all n locations
  Clone ID: LIB3059-047-Q1-K1-H12
ggataacgtgtagaacgctagagcgaccttactcgccaggtgcaaggccaactccgaggctaccctcggcacctacaagggtgatgctgcncnncnacnccnagagccttcacctcaaagactacaagtattgactcgcttctctttgcgaccccgttagtttgaaactcctgcctgctaatatgttgctgagtgttgtttgcttgttagagcttttatattcgaacataaaaaaaacatgcttcctatgtggatgatggttatctttatattcgtatattaacta

SEQ ID NO: 30506 - DNA, 422 bp, Zea mays
  Clone ID: LIB3059-047-Q1-K1-H2
agccatatccgaacttatgtccatcttcctgctcatccgccttcttatggagccggccaagccagggatcgccatgtcggactcggaggagcaccacttcgaatcgaaggccgactccagagcgtccaagacctaccctcagaaggctgtcaccgtccgtaagaacggcttcatcgtcatcaagaaccgcccctgcaaggatgtggaggtttctacctcagatactgttaagcatggtcatgccacatgccactttgttgccatagatatattcaacgggaaaaagctcgaagatatggatccttcgtcacacacctgtgatattccgcatgtgaaccgtactgagtatcatctgattgatatatcatacgatggatttgggagccttcttacatcagatggcaacactaaagatgatctta

SEQ ID NO: 30507 - DNA, 431 bp, Zea mays
  Clone ID: LIB3059-047-Q1-K1-H3
cccacgcgttcgcggacgcgtggtttccaacctattcccaaaggtccccttccttccggagggctaggctggtggtgtcatcaaaaagccaaaccgttcttgcttgtgctccaaggtcaccaaagaaactgagaaggttgtgtgcatggagaaggttgtgtatgttgctgagcagtgtaagaggccatttgagcatggcttccagtgcggaagctacaaggttccagcaaactgatgatatcgcaagagggaagcgcttgacgtagtctttagatttcaattgttgcagccgatcaaccttcttagggttgtataatatgaagtcaatgttgagactaatgtgaggtgggagaggcctattgatgcatcaaaagtattatgagctaataataaagccttctccacataaaaaaaaaaaaaaaaaagaagaa

SEQ ID NO: 30508 - DNA, 286 bp, Zea mays
  Clone ID: LIB3059-047-Q1-K1-H5
gaactatctatattatatcattatcaatgttatgctaaataaaaaaaaacaagaagggaaaaaaaaaccaaaatcaatactatcagaaacaacaatattataacattcaaccaactgtctacactctaccctgctgcttattcgcactaacatctactaccattcagccagttagctactgcactactctcaatatcaacaacttgctgcattcaaccaattgaccgcactgaacccggctgcttatatgcaacagcatatactactaacatctattcagctagct

SEQ ID NO: 30509 - DNA, 417 bp, Zea mays
  Clone ID: LIB3059-047-Q1-K1-H6
aaccatcagggcacagcagctgcagcatctcgtgctacctgtgatcaaccaagtagctctggcaaacctttctccctactctcagcaacaacaatttcttccattcaaccaactgtctacactgaaccctgctgcttatttgcagcaacaactattaccattcagccagctagctactgcctactctcagcaacaacaacttcttccatttaaccaattggccgcactgaaccccgctgcttatttgcagcagcaaatactactaccatttagccagctagctgcagcaaaccgtgcttccttcttgacacagcaacagttgctgcctttctaccagcagtttgcggctaaccccgcaaccctcttacaactacaacaattgttgccctttgtccaacttgctttgacagacccagc

SEQ ID NO: 30510 - DNA, 390 bp, Zea mays
  Clone ID: LIB3059-047-Q1-K1-H8
cgtgaaggcgaagatccaggacaaagtagggcatccccccagaccagcagcgtctgagcttcgccggcaagcagctggaggatggccgcaccctagcagactacaacatccagaaggagagcactctccacctggtgctccgcctccgcggtggtcagtaagccatggttcatttaagctgctgctgtacctgggtatctgcgtcgtctggtgccctctggtgtacctctatatggatgtcgtcgtctaataaacatctgtggctagtgtgtcatgaatcgtggttgtggcttcgttggtttaatggacctgttgtgtcctctgtgttgtccccaaaactcttctgcagcagtatggcttgaatccttatgaagtttgatatttgaactt

SEQ ID NO: 30511 - DNA, 313 bp, Zea mays
  Clone ID: LIB3059-047-Q1-K1-G12
gatcatgtcaaggcttgcctcgagaacggcctgctcacggtcaccgtgcccaaggcggaggacaagaagccctgagtgaacgctattgagatatctggttgagcatgcaatccaatatggacgtggaaggaaggtggactgcttgcggtccgtggctagtgctgtcttgcgtgaagtttactgtgtcttctacgatatataacgtacttccgtttgtttcgcttcgtatgtacaatcttccggttatatgaataataacatataaaatcgggttctcacggtcaaaccgttcagccaacaggcctgaaccctt

SEQ ID NO: 30512 - DNA, 233 bp, Zea mays
  Clone ID: LIB3059-047-Q1-K1-E8
aaaaaaaaaaaacaaacactaaaaattaaaaaaaaaaaaaaaaaaataaaaggatagggaaacaaaaacaaaaaaaaaaaacactaaaacaaaaaaaaaaaaaaaaaaaaaaggggtcctccttttaaatgatccaaacttacctaccgattctttccaatctttaacccttttattggctcacctaaattaaattcctgcccccctttttaaaaagtcacaactttgaaaac

SEQ ID NO: 30513 - DNA, 293 bp, Zea mays
  Clone ID: LIB3059-047-Q1-K1-F10
aggccacatatccaaaatacaaatccttgtctccttcccatagactgcgatctaaggggtctccgacaatggatctatctgtagtgaacactgcactgtgcgacatgtcatagtcaaacataacctcgctgtgcgacgaacgtctgatgaagaccgcgtgccaagcatccaccaccaacgaatggccgtactgtatcaacgtgctagtgcacctttacatctatgacctgaacagtgcgcgatgcttcaggaagacattatcataggaggtcatagacactggttggaaacta

SEQ ID NO: 30514 - DNA, 412 bp, Zea mays
  Clone ID: LIB3059-047-Q1-K1-F11
ggaagatgtcgtcggtgttcagcggcgatgagaccgcccccttcttcggcttgcttggcgccgccgccgctctcgttttctcatgcatgggggcggcgtacgggacggccaagagtggcgtcggcgtggcgtccatgggtgtcatgcgcccagagctcgtcatgaagtccatcgtgcccgtggtcatggctggtgtgctcggtatctacggcctcatcatcgccgtcatcatcagcactgggatcaaccccaaggccaagccatactacctctttgacggctatgcccacctgtcgtccggccttgcctgtggtcttgctgggcttgctgcaggcatggccattggcatcgttggtgatgctggtgtcagggcgaacgctcagcagccaaagctgtttgtgggcatgatcct

SEQ ID NO: 30515 - DNA, 422 bp, Zea mays
  Clone ID: LIB3059-047-Q1-K1-F12
caagaagtgacgttgcatctgcctcaactagcaatcctgcttcatatggttcggccaggtcacagaaacagttgtctcttccagcaaaagctggacaaacttcctcagcgggtactatgaatgaagcagatggaactagaaatgcatacaacgcaaatggaaaccagtcagcaagatatgcagccaacactcagagcattcctgcaaacgtcggcatgcaatacgacgggagtgcagtgtcgcctgaaatccagtttagtggttcatcccttcagagtcagtcttcaagagggtccaacatgctagcattgggccctccgcatcaacatcaaagtttcgaattcccagcgctcggccagcccgttcagccaacaggcctgaaccctttcgaagagtggccgcagcagcaggagaaccgtggc

SEQ ID NO: 30516 - DNA, 433 bp, Zea mays
  unsure at all n locations
  Clone ID: LIB3059-047-Q1-K1-F2
ccggattccggtcgaccagcgtcgtgctccaggtcaatattcacatntcttcacaagtcctaagggctggacaccactgtcaggctataggctcaacagcgatgcggcgagcgtgttacaacaaccaattgcccaattgcaacaacaatccttggcacatctaacaattcaaaccatcgcaacggaacagcaacaacaggttctaacacggcttagcccactataccatggagaaccctgtcgctaactggaaacagaatctgcttgcatccaacccacttgctatagcaaacgtagttgcaaaccagcaacaacaacaactgcaacagtttctgccagcgcttagtcaactagccatggtgaaccctgccgtctacctacaacagcaacaactgctttcatctagcccgctcgctgtggccaatgcacctac

SEQ ID NO: 30517 - DNA, 246 bp, Zea mays
  Clone ID: LIB3059-047-Q1-K1-F3
aaatctgcataatacgtgctgatacagcagctagaagcagattcgttccaacacagggagcggtacactatgcaatcgtcatagattggatacgggatggcaattatcagaaagcagcttgctatttgcgaaatgctgcatcgaagcgatccgcatatatcaatacagacgatataagcggataccaaaagcatgttaatacattcactgatccagctagctatgattaacatcatctaccactta

SEQ ID NO: 30518 - DNA, 423 bp, Zea mays
  Clone ID: LIB3059-047-Q1-K1-F5
gaaacggatggacaagtatatttggagtttgatgtggtgtttccggatcgtgtgtgggtctcagatgcaggtgggcgctgtgggcgggaggcaggtgtaccagaacgtcctccacgctatctactgcatcctcaagaaggagggcgccggcggcctgtaccgaggtctcggccctagctgcatcaagctcatgcccgccgccggcatcgccttcatgtgctacgaggcgtgcaagaagatcctcgtcgacaaggaggatgaggaggaggaggacgaagccggcggcggagaggatgacaagaaaaaggttgaatgatcaaagttcttggccaagaaggtagcaatgtcgtgaagcgtacgtgaactggaaacggatggacaagtatatttggagtttgatgtggtgtttccggatcgtgtgtt

SEQ ID NO: 30519 - DNA, 416 bp, Zea mays
  unsure at all n locations
  Clone ID: LIB3059-047-Q1-K1-F6
caccggccttgtctgcctggagctttacaaagtccttgctggtgggcacaaggttgaagactaccggaacacatttgcgaacctggcgatccccctcttctccatggcggagcctgtgccacccaagaccatcaagcaccaagacatgtcctggaccgtgtgggaccgctggacggtaactggcaacatgacgctgagggagctcctggagtggctgaaggagaagggcttgaatgcgtacagcatatcatgcgggacctcgatgctgtacaactccatgttcccgagacacaaggagcggctggacaagaaagtggttgatgtggccagggaagtggccaaattggaggtgccttactaccgncgncatctggacgttgttgtggcctgtgaggacgacgacgacaatgacgtcg

SEQ ID NO: 30520 - DNA, 421 bp, Zea mays
  Clone ID: LIB3059-047-Q1-K1-F7
gtggctgttaatgttgccctgtcactgagatatgagatcaacaggggctttgctacgttaagggagattgggcatggccgtgatctgaagaaattcctaattgttattgcaggtctctggcttctttcagttctcgggagctgctgcaacttcctgacactgttctatattgtctttgtggcactgtacactgtaccagttctgtatgagaaatatgaggacaaggttgatgcttttggcgagaaggctatgactgaactgaagaagtattatgccattttcgatgagaagtgcctatcgaagattccaaagggcccccttaaggataagaagcactagattggtagtaaggtatttgctatgaatcaacatctacattatgtcactagctgtcacctctttctctgaaggatggtgcttg

SEQ ID NO: 30521 - DNA, 416 bp, Zea mays
  Clone ID: LIB3059-047-Q1-K1-F8
cacaatggcaccagaaacgatgctcttcggcgtctgtgccgtgctgatggtggtcggcgtcacgaacgcggcggagggccaggtggcgtcagtcgtcttgggcctggcgaggtgcgccgactgcacgaggaagaacatgaaggctgaggccggtttcaagggtcttcaggtggcgatcaagtgcaagaacagcaacggcgagtacgagacaaaggccgtgagtgagatccaaagctccggagccttcagcgtcccactcgccgtcgacctccacggcgccgactgccacgcgcagctccacagcgccgccaataacgcgccttgccctgggcaggagccgtacaggatcgcgcccatgtcatgcggcaccttcgtcgccgtgcctggcaagatgcactacccgtccgcggagtgcg

SEQ ID NO: 30522 - DNA, 411 bp, Zea mays
  Clone ID: LIB3059-047-Q1-K1-F9
aggacgcgtgggcgatcaaactctactagcgagaaagcccggagccgagaggccagggggccatggcgctgcatgccctgcacaacgagatccggagcatgaaggtccgcgacgtgccggattacctgaagccgcgcttgacctgagacaacgtcaacaagagcgcctaccaggccgtcgaccgctacatggagaagtacatcgacacgagctcgccggaccctctataccacgtctgcatcaaaaggatgatcttctcctacttagtcaatctgccctgggagcgcgcccacctagcccacctcgaggagatggagacgaccggtgggaagctctagatccgttgacccgttcctagccggcagcgcaatacgacggttgactctcatggagtccattcatgctgatggc

SEQ ID NO: 30523 - DNA, 427 bp, Zea mays
  Clone ID: LIB3059-047-Q1-K1-G1
caactagcaacatagaaagcacaatagtgtaccatcaatggccgccaaaatattttgcttccttatgctccttggtctttctgcaagtgttgctaccgcaaccattttcccacaatgctcacaagctcctatagcttcccttcttcccccatacctctcaccagcggtgtcttcagtgtgtgaaaacccaattgttcaaccctacaggatccaacaggcaatcgcaacaggcatcttaccattatcacccttgttcctccaacaaccgtcagccctattacaagagttacctttggtccatttggtggcacaaaacatcacggcacatcaactacaacaacttgtgctagcaaaccttgctgcatactctcagcaacatcagtttcttccattcaaccaactggctgcattgaactctgctgcttat

SEQ ID NO: 30524 - DNA, 367 bp, Zea mays
  Clone ID: LIB3059-047-Q1-K1-G11
cacctttttccactgcttgccagaaatgatagcgtttgcggttcagagggttctccagcacagcggttgttatcatgcagcttttgctctgggcccttgattctgcctgcgagttggtgaaatcgccctgatacttccgtgctcttatatacatttcgataatagttttggttttctgacatctactgtaaggtgacctgttgctgggttgttggttatctgaatattaattgtaagaggccacttagtctgttatagctggtggatcgcctttttcaaatatatatttttttgttttgcactgaaaaaaaaaaaacaaacaaaaaaaaaaaaaaccacaaaaaaacaaggaataatcacaaaaaca

SEQ ID NO: 30525 - DNA, 416 bp, Zea mays
  Clone ID: LIB3059-047-Q1-K1-D11
gcattcagaaacacaccacgcgaagctcattatcaacaacctaacatcaatggctaccagagtatattatccctccttgcgctatttgcgctttttgcgagcgcaacaaatgcgttcattattccacattgctcacttgctccaagttccattattacacagtatgctacatcaggtacttcaatgggcttcgaacacccagctgtgcaagcctataggctacaacaagcaattgcggcgagcgtcttacatcatccaatttcccagttgcaacaacaatccttggcacatctaacaatacatactatcgaaacgcaacagctacaacaatttctaccagctctgagccacctagccatggtgaacactggcgactacttgcaacagcagatgcttgcatcatacccacttgctct

SEQ ID NO: 30526 - DNA, 422 bp, Zea mays
  Clone ID: LIB3059-047-Q1-K1-D12
cggacgcgtggggagttgatgtcgaagctaccatggtcattggcgaagacgagattgagggtgccaaatggacaatggataatgtcaaattttctgtcaaagaaccaatcgaggcggttgcaacaaaagaagaactagagcaccttgtgatgctttgcagatctgaggctgatgcaatggggaggatcactgctggaattcttcgtctccttaaacttgacaaatctcttgggcaaggaactatagaacaactacgtaacctaggaagtggaggcatggacaatatcttttcacccaggaggctcagcaggcagaacagttttggtagcataggcactcctcggactccaactatgcaagccattgcagacgtcatgggttcgaaaaccacactggaagcaactatttcctcattacaaggc

SEQ ID NO: 30527 - DNA, 419 bp, Zea mays
  Clone ID: LIB3059-047-Q1-K1-D2
attgataccaaactgcctccttaaaaggcccattgtgtcccacattgcacttaggtatgtgcctcctatcctcctggccttctgcagtgctgctacagcgaccatgtttccacattgctcacaagctcctatagcttcccttcttacaccgtacctctcaccaacggtgtcttcggtatgtgaaaacccaattcttcaaccctacatgatccaacaggcaatcgcagctggcatcttacctttatcacccttgttcctccaacaatcatcagccctattacagcagttaccttaggtgcatttattggcacaaaacatcagggcacaacaactacaacaacttgtgctagcaaaccttgctgtctactctcagcaacagcagtttcttccattcaaccaactagctgcattgaactctg

SEQ ID NO: 30528 - DNA, 409 bp, Zea mays
  Clone ID: LIB3059-047-Q1-K1-D4
cgacggccccgccggttccgccggggttaaccccaataagatcgccaagctcttcgggaagctgttcggccagccctcggcgtcgctggggccgtcggccgaccccgcggagaccaggccgctaaaggtcggtgtcgagctctctggtggacaagcgcccggtgggcacaatgtcatctgcggcatctttgattacctacaggagcgtgcaaaaggtagcaccttgcttggactcaagggacgccctgctgggatcatgaagtgcaaatacgtggagctcacttcagactttgcgtatccctacagaaaccagggcggattcgatatgatctgcagtggaagggacacgattgatacaccggagcagttcaagcaagctgaagacacagccaacaagcttgattcggat

SEQ ID NO: 30529 - DNA, 423 bp, Zea mays
  Clone ID: LIB3059-047-Q1-K1-D5
cccacgcgtccggaaggggcgaggcagccaaacgaatcccagcacctgcctctcctttgcttgcgcagatctagcgatggcggcgggcggtgagttggcgtggggggaggagcccgtggcgcggcgccggcctaagaccaagatcgtctgcacgctcggcccggcgtcgcgatccgtcgagatgatctcgcgcctgctgcgcgccgggatgtgcgtcgcgcgcttcaacttctcccatggctcccacgagtaccaccaggagacgctcgacaacctgcacgccgccatggagctcaccgggatcctctgcgccgttatgctcgacaccaagggtccagagattagaactggatttttgaaagatgggaagcctattcaattgataaaaggccaagaaatcacaatttctacagactatagcat

SEQ ID NO: 30530 - DNA, 423 bp, Zea mays
  Clone ID: LIB3059-047-Q1-K1-D6
ctcgtagagagaaggaaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgtccccggtgtgctctccatggccaacgccgggcccaacaccaacggctcccagttcttcatctgcaccgtcgcg

SEQ ID NO: 30531 - DNA, 384 bp, Zea mays
  Clone ID: LIB3059-047-Q1-K1-D9
ccgactcgtacggagcggattatcctaccactacggttcgggttcggattcgggagggtcatcctcgttcggcttcgtgggtgagcggatcgagatggcatgcgtccgatgttgagtaccgctgctacatctgcggtctctcctgggccactgacgaccactgcgtccacaacgccttcagcacctacggcgaggtcctagagtacaagatcatcctcgatcggtagactcagacgtccagcagcttcggctttgtcaccttcttcacggatgaggcgatgcggaacgccatcgcaggcatgaacggaaaggatctggacggacgaaccatcaccgctaacgatgcccaatcccgctgcggactctgaggcagaacaggtgggt

SEQ ID NO: 30532 - DNA, 424 bp, Zea mays
  Clone ID: LIB3059-047-Q1-K1-E10
gcaacagttcactaagagcagcgataggagagagaccggattcaatctcgcagatgaggtccgtagcgtccagcccagagctagaaaacagtgcagaagttgtggaggatacggtgacagctatccttaatctctctatccacgagagcaacaagaagatcattggagacgacccactggcagtcccgttcctgatcaaggccttacagtcaggaagcatggaggcccggagcaacgccgccgccgccatcttcagcctatccgcgctggacggcaacaaggcgaggatcggcgagctcggcgcgatgaggccgctggtggagctcctcgagcacggcagcacggcagcgaggaaagacgcggcctcggccatcttcaacctgtgcacgctgcacgagaacaagtcgcgggccaccaagagcgg

SEQ ID NO: 30533 - DNA, 424 bp, Zea mays
  Clone ID: LIB3059-047-Q1-K1-E12
aagggcaccagccggtgttggtttcagcttgtattcccactctgtcgcacagcgtcggccgtcgccgctgagatcctaggaagaaatggagctctctcgcaagctcttcacggccgtcctcctcgtcatgctgctgctgctgtccgcagaggtcgggccggtggcggtggcggaggcgcggacgtgccagtcgcagagccacaggttccggggcccctgcctccgccggtccaactgcgccaacgtctgcaggaccgaggggttccccggcggcaggtgccgcggcttccgccgccgctgcttctgcaccacgcactgccactgattcgctcgcccagcggccggctggcgtcgccgtcgatcgcgtcgcgaccagtccatggctccatgcatgaataacaagggtgtgcgcggtttgtgttgt

SEQ ID NO: 30534 - DNA, 352 bp, Zea mays
  Clone ID: LIB3059-047-Q1-K1-E4
ctgggttcctcgcgggaccaacgggccaaccccctcctcccttccttaactccttgggggggctcctcgccggcggtccccgccgccgcccgtcgccacgtcttctccgctgacgtgggctcaccaggttcaaggcaatatctgtgttaatcttggggaccttcagtagattgctgagagttctccttgatacaggggaataaagatccaaataagtttttgacattgatctgtagccagtactgcaatggctacgaagcttgtggttctcggtatcccctgggatgttgacactgaagggttactagagtacatggccaagtttggacccctagacgattgtgtcgtcatg

SEQ ID NO: 30535 - DNA, 422 bp, Zea mays
  Clone ID: LIB3059-047-Q1-K1-E5
cggacgcgtgcgtacaacctgctgacgatgcccagccggggacggcatgggccgcgcaagttcctcggaggtagcggggatcgccactcaactgcctcgttggggtcaggctctgattcggaccccgcgaagcggttccacgttgcgcttaccgctacggacgcactgtacagtcagtggcagtcgcggataatgcactactgctataaggagatgagggaccgacctgtttccgacatgggtggattcactaggatccttgactctggcaagcctgatggattgatggatgagatacccaccatggtgggtgatccccttcctgaacgcaaggatcaaggatatattgtcttaaataggccttgggcttttgtccagtggatccagagcgcaaagatcgcagaagagtctatatttatggc

SEQ ID NO: 30536 - DNA, 482 bp, Zea mays
  unsure at all n locations
  Clone ID: LIB3059-047-Q1-K1-E6
aattcccgggntcgactccacgtcgtctcgtcccacgtcgtctcgcgtgacgtcgtgagggctatgagtctcgtaccggcagttgtctaagggacgtgagagacggctaaccgtacaaagtcttcgatctgtccctcgcttatttcggcaaaccatgttcgtctgcccgagggagtatctctcgtcgcctaggtttctgagcgtaagttcgcgtggatggatgccatctgaatgtttctctgaatggtagaaaatcatcaagaagcccagtggtctacaagttcccatgcataccttcaatggatctcacataagggaccagtcaacttaaaggatgcctgtgccgtcattgcacggaactaggaagtctcnttccgtattattgaatggaaccccaactgctnnngcatcgcttggcccctatggtnnttcgagtaagacaaaataactggaaacgatattctaagtgtttagactttggg

SEQ ID NO: 30537 - DNA, 378 bp, Zea mays
  unsure at all n locations
  Clone ID: LIB3059-025-Q1-K1-D9
ctacatggcaactgtggctaatctgaaagaccctgttgacaaatggagatgtgctgcggctcgtttaactgcgatgatgagtgtgaagaggcatttacgtggccctggagcaatccctatagggaggccttccattcacccttctccaattgacctgaaagggaaggcttatgagttgctgcgagagaaggcttcaagcttcctccttgacgacttctacaggactccaggaggcattcagttcgaagggcctggttcagatgcaaagcccatcacgctgaccattgagaaccaggactacatgggtgacattgagatactgaaagagtaccttggcaaggttaggaccatggtgaagccagngtgctcccgggagat

SEQ ID NO: 30538 - DNA, 407 bp, Zea mays
  Clone ID: LIB3059-025-Q1-K1-E1
aactctgctgcttatttgcaacaacaactaccattcagccagctagctgctgcctaccgccagcaatttcttccattcaaccaactagcagcattgaactctgctgcttatttacagcagcaacaactactaccattcagccagctagctgatgtgagccctgctgccttcttgacacaacaacagttgttgccgttctacctacacgctatgcctaacgctggcaccctcttacaactgcaacaattgctgccattcaaccaacttgctttgacaaacccagcagtgttctaccaacaacccatcattggtggtgccctcttttagattgcttatgagttatagttcaataatgaagttttttggatgatgtttgtggcttcccagaaataagaaagtacatttct

SEQ ID NO: 30539 - DNA, 411 bp, Zea mays
  Clone ID: LIB3059-025-Q1-K1-E12
cccacgcgtccgcggacgcgtgggtccagatcagcaaagcggcagtgcgtagagaggatcggggaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagacgagcgccatgtaccagccgctccggcaacagtgctgccagcagcagatgaggatgatggacgtgcagtccgtcgcgcagcagctgcagatgatgatgcagcttgagcgt

SEQ ID NO: 30540 - DNA, 191 bp, Zea mays
  Clone ID: LIB3059-025-Q1-K1-E2
cctcccactcgtcctcccacgcgtccgccctttctttcaaccacacttactattacttatcgacagtttcataaacaagttcgtctactaacacctatacactctcttaattatatacacctaataacatctactaccattcattcatattaatttatatgatatatttttacttataataacaacaacat

SEQ ID NO: 30541 - DNA, 436 bp, Zea mays
  Clone ID: LIB3059-025-Q1-K1-E3
gcgaaaataactacagaaaggacacccccagtatccataggtgatgctaagacagtcagggtgcatacacttcctggagctacttgtggagttaacttgcagtgcatggttgaagcagagaacattcaacaagagaaatacaaagaaaccaatgggagattgattgctgaaaatactatttcagagcagaagtgtgaagatagatctaattccagtcgttcaaattcatgtgctactccggtgactgtggatcaatgttctcatttatctaatgagattgggaaaggtgacaactgtttatctagtgaagtttctgttggagctgctcccataacaggcaaaactgaatctagtttgacatctgttcattgcgctaaccaagaggatgagaaagcttacgcagcccctgtggacactaaaatacctttagtcatta

SEQ ID NO: 30542 - DNA, 396 bp, Zea mays
  Clone ID: LIB3059-025-Q1-K1-E9
cggacgcgtgggcgagcgagagagagaggtttgccaccttcgcaactgtgccaatggggacctgctgcagcatctccctgccgtcgtcgccatggctcctcctgctggcggtcctcatcatcggcgacgccgcggctgtgatggcggtgccccccaccaggccgctgctgcgcatcgccgagccgccaaccgcgccgggcacggcagcggggcccgccggcgcgtcgcggcccgggggcggccgaggcgggaggccgcctgaccggtcggtggccggcgccgaggtgatcctcgccgggttcgctgccgcggtgatgatcatcgtcttctgctatatcagggtcaccaggagaaacagcggcggcggcggcggcgtatgagcgggagggaagcagc

SEQ ID NO: 30543 - DNA, 420 bp, Zea mays
  Clone ID: LIB3059-025-Q1-K1-F10
ccagcagggtgtcccggccctctctagtttctaccccggcccccaacattggcctggggctggtgccatgtagcccagcgctcccccctcggcttcaccggcggcggcggcaacgacggtgaaaactacatcgggtgctagctccgacggtggtgcgtgccctgttgacgatagggcacgcggggcgcgggcagcttgtaagcgttcgatcggccatgtagggcaactatacatctttggcaggtctccaactctccatcatcctccgtgggagagaagatggtaatggagtgcgtgtgtatgtatgtgtatgcccaaggcgcgcgcgcgcggctctgggcgagtcacagtagagatgcaatatcatgtatccagtatctttcttacaacacaaacagtgagaaattatttagagaaaaa

SEQ ID NO: 30544 - DNA, 380 bp, Zea mays
  Clone ID: LIB3059-025-Q1-K1-F11
caatgacctgaaggaacaatacttttttcttttcatttcaattgttcattcatctcagtgctgacacttacactgacaagcattgtcatgcatcacacattatttctcaatgattgccgttaaattactcatctattttgcctcccactggttatattactacacatacagatccctacaccaactgatccagcaccctccaacattgccagttctggagctaatgctgcagaagctctggctctggctctcgtgctcacactctctgtggctcaacttttatagccacgcactctcggggctgaaccggatccttatgaacccaagcgagtttatgcaaatctggtaccctacgcttgttaacccattcaactggttcc

SEQ ID NO: 30545 - DNA, 435 bp, Zea mays
  unsure at all n locations
  Clone ID: LIB3059-025-Q1-K1-F12
gatcagcaaagcggcagtgcgtagagaggatcgtcgaacagaacagcatgaagatgggcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatgttccagccgctccggcaacagtgctgccagcagcagatgaggatgatggacgtgcagtccgtcgcgcagcagctgcagatgatgatgcagcttgagcgtgccgctgccgncagcagcagcctgtacgagccaactctgatgcagcaacagc

SEQ ID NO: 30546 - DNA, 434 bp, Zea mays
  Clone ID: LIB3059-025-Q1-K1-F2
gaagacacacatatgtacagatggaactacaatactctccaagaggtacagcttcatggatcagcatttaggaccttcttggacatagctggtgacaacttaagtggcaagattttcaccgaggcatttgatgcggtctgcttcccccttacactcttctcaagtttatttgaacctggatggtcttctgggagttcagcagtctccattaagggccttttatcatcgctggtggaaggaggcgctgacaatgtaaatcagtgttttcttgaagcagcgcgctttggaagtactgaacttgtacgcattctgctgaaggtcgcatatcagaatagcttggctgtggacaccgatctggctctagtgtatgcctctcattactgcaagttcaaaacaatggaatgcctagttgatgaagggaacgtgagttcttt

SEQ ID NO: 30547 - DNA, 386 bp, Zea mays
  Clone ID: LIB3059-025-Q1-K1-F3
cccacgcgtccgcccacgcgtccgctttttgccctgttttctaatgtaccgtggttgtgaaccggtcaatgtgatctgaaataaaacattgcgtgccaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaataaaaaaaattaagatccaacatgttaaacaaaactggaatctgacaaaatattagtcttaaactctaaaaaatatcaggcctatatccgcatttaaacaagtggaatattttaaaaaacgtcattaaagaacattaattacaacagcttgtaattccaaatagctaatgggtactttt

SEQ ID NO: 30548 - DNA, 341 bp, Zea mays
  Clone ID: LIB3059-025-Q1-K1-C5
gcaaattgcaccaagaaatccattgagaggccgccgacaggggaattaatggcggcggggtctagcagcagccaccgccgcctcatactcgcagccgacgtcctgctctccgtgctcgcggctgccagcgccagcgccgggacctcctgcatgccctggtgggccatcccgcacaacccgctcacgagctgccgctggtacatgaccagccagacctgcagcataggaccgcgcctcccgaggccgcagctgaacaggagatgctgccgatagctggcggacatcacggcgtactgccggtgcacggcgctgagcatcctcatggacagcacggacccatc

SEQ ID NO: 30549 - DNA, 436 bp, Zea mays
  Clone ID: LIB3059-025-Q1-K1-C6
cggacgcgtgggtagcaacatagaaagcacaatagtgtaccaacaatggcagccggaagattttgcttccttatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggctgcattgaactctgctgcttatt

SEQ ID NO: 30550 - DNA, 266 bp, Zea mays
  Clone ID: LIB3059-025-Q1-K1-C8
caccgtcgtcacctactttatctcactactcaattgaaacggcgccataagtatgtagagccttgctctctgactcctggacgtctactcaaacagccaagcacgctcccagacctaccgatcattacactacctcatattccacttcgactattccccaaaagcaacgatcatcaataaccataaccaatgaataagctgacaccatgataatcctcagccatcacatagactatcgtactgaacattctgagacctgatgcacc

SEQ ID NO: 30551 - DNA, 428 bp, Zea mays
  Clone ID: LIB3059-025-Q1-K1-C9
cccacgcgtccgcggacgcgtgggactggtcgtaaactttcaagatttgggcttttgaggagttgagagtgaccaatggttttggtggtgttgttctcagccctgttggaacacagtgtgtatccaaggaagatcatcctattgtgcaaagaaaaggattggctgtggttgattgttcctgggcacgtttaagtgatgtcccctttgtgaaactatgttgcggtgctcctcgtctcttaccatggttggtagcagcaaatcctgtgaactatggccgcccatgtgaactgtcatgtgtggaagctttatcagcagccctcataatatgtggggaggaagatacagcacatttgctgcttgggaaatttaaatggggtcacgcattcttgtctctaaacagagatctcctgaaagcatacttccaatgt

SEQ ID NO: 30552 - DNA, 434 bp, Zea mays
  unsure at all n locations
  Clone ID: LIB3059-025-Q1-K1-D2
ccactggaactgctcgctcaagcgcaagctcgccgccgcgtccgccccggcgggttccggcgacgtcgaggcgcgcccgaccaagcgcgtcagcctctcgcccgacagcccgtcggggtcggggtcggggtcagggtcagggtccgggtccgggtccgggtccgaccgtagcgacctgagccacggcgccggccaggtttaccgcccagtggcgcggtccggcgggttcgagccggcggactgcgcgatgagccgtccgctggaggaagaggaggaggaaaaggaggacccgctcacctccctcagcctctcgcttccaggcacggaccagcggttccaccacgaccgcgcccacagccagttccaggagctcccggcgtcngccgcctcgcccttcccgcctccgccgccggttctctcggcgtacccgttca

SEQ ID NO: 30553 - DNA, 278 bp, Zea mays
  Clone ID: LIB3059-025-Q1-K1-D3
gccgggctgcccgcgggaggtgcagaggggattcgccgccaccctcgtcacggaggccgagtgcaacctggccaccatcagcggcgtcgccgaatgcccctggattctcggcggcggaacgatgccctccaagtaactgcgaagagcatagtgcatgaggaatgagcttgtagctagctcatatgtctgaataataagcacagcacgaagatgaatgcatttctcggatcgttcatccggaacaataattaaaggggatccggatttgttcttgtgat

SEQ ID NO: 30554 - DNA, 385 bp, Zea mays
  Clone ID: LIB3059-025-Q1-K1-D4
aaaaaaaaaaaaaaaaaaaaaaaaaaaatttaattaaaaaaataaaaaaaaaaaaaaaaaagaaatgtataaaaaaaagagtaaaaaaaaatataaataaacacatataaactatcttataaaataaaataaatataaataaactgtactcaattttacaatttcatctcttgtaaaaccttgtctttactcaattttattaccttttagatcatccttttttcatcatatggcgtatttttcaagaagtgtaatcctatacaattttccaaaatttttattaccttaatggaccattcaacattccacttttgctacatattaatcctgctagcttattctgcttatccacagattaatccttatacttgcaatttccattata

SEQ ID NO: 30555 - DNA, 386 bp, Zea mays
  unsure at all n locations
  Clone ID: LIB3059-025-Q1-K1-D5
cgttcctcctgctcgccggcgtgctgctggtcgtagcagccacggccggngcggaggagggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccgggaggggcgagtgccggcgccagtgcctgcgccgtcacgagggccagccgtgggagacccaggagtgcatgaagcggtgccgtcgtcgtggactggccgtcgacatggagcaagagtacggtcgcggcagcgagagcgcgggcaag

SEQ ID NO: 30556 - DNA, 426 bp, Zea mays
  unsure at all n locations
  Clone ID: LIB3059-025-Q1-K1-D7
atcctggcgcggttccggcccatcgcgcccaagcccacaccggcggcgacaggggaggggagggacgtccccgtggagcgcgacctgctgcggaagctgctggagcccagggtcatatcgccccgggcggtgcgccccgtgtggtctgccatccacgtcgggtgcatccaccgcaccgacgacgcggcctgcaccgacgccggcgtctcgaagacggcggttcaggtggaggcggagctggaggtcgacgcgctcccggcggtggtctccgactccggcaaccgcgtncggctcgtgaacgacgcgtacaaggagatggtggggcagcccgagtgcccgtggctcgacgccgtggctgccacgtcgaggaggatcagcggggaggtggcgctggtggtagcggaccggtcctctctgccggactcg

SEQ ID NO: 30557 - DNA, 434 bp, Zea mays
  Clone ID: LIB3059-025-Q1-K1-C2
cggacgcgtgggtgcggcgtcggcagcgtcggcagcccgttcctgggccagtgcgtcgagttcctgaggcaccagtgcagcccggcggcgacgccctacggctcgccacagtgccaggcgctgcagcagcagtgctgccaccagatcaggcaggtggagccgctgcaccggtaccaggcgacatacggtgtggtcctgcagtccttcctgcagcagcagccgcagggcgagctcgcggcgctgatggcggcccaggtagcgcagcagctgacggcgatgtgcggtctgcagctgcagcagccaggtccctgcccttgcaacgcagctgccggcggtgtctactactgaggaaactatgtactgtagtaataatgtaatggagccgctgactagctacctatagctagttcactcgtttagcggcgatgagtaac

SEQ ID NO: 30558 - DNA, 432 bp, Zea mays
  Clone ID: LIB3059-025-Q1-K1-A6
gtgcaagaacgacacagccctacaagaaaccttgcccaggcccagcatccagttcgtgctggcggtcatggcggcttcctcagcaatccatacccgagtttctttggagaggctacctcaaccgcgggaccattgcaactctacatgccaaacatggtggcgtcaggtggcacgacatcgacgccctctctcgccttctctctgtctgcgcctggacagcctattacgagcacagctcttggcggctcctttggctcaaacactcgcactgcatggggcaattcagatatggctgctgcgtcgtactctcagcctgaccgcatgggcatggatcaacaagcaggaaccggttctgccatgaatctgacaattgggctgtatcccaatgcccagcagccaccaccaaaatatgtcaaaatctgggagggtgac

SEQ ID NO: 30559 - DNA, 369 bp, Zea mays
  Clone ID: LIB3059-025-Q1-K1-A9
atatcaaggaaaaagaagttgctgaagtagcaggctgaaggaaagaaaaggatgaagggaataggaagggttgatgtccctcaagaagcattcatggccgtgttgagactggaaaaggaggtgctatgaaagtgctcatgaacctttgtgtctccgtaaattaaagacctcttcctgtgcgccactcacaagtatagtcagacgagagctttgagacaacaggcattcactatggttcaacctgtccgctctggaccataggaaccagtcaagcacagatcactcccagaacaaaagcaggtaaatctggcattcgttcgctattttttgcttttttatgggtcaagctatgatggtaaaacaatcatg

SEQ ID NO: 30560 - DNA, 421 bp, Zea mays
  Clone ID: LIB3059-025-Q1-K1-B10
gtttttagggccatgatcttttgaagcaggagtgtgatcgatcaaaaggcacttccagcacagctgattctggtgctcaatcaggggctataacgaacgaggaaaataccggggaagtagcagtacccatggtgagtacctcacaggatgtatctggtgcgaggagcctcattcctccttttcaagatccccagcagagaacaggaagagattcttccatcgggtccacttcacaagaactgtggggttcactaacgtcacacatgagatcaagccaacttggtccagtactagcagtggcgctggtggctatcattgtcctattgcaggtaaccatcatagttctgctaactaggtccccccaggtccagatggctcctcacgggatctcgacgggcagtttcgggtacagcaaagaaag

SEQ ID NO: 30561 - DNA, 169 bp, Zea mays
  Clone ID: LIB3059-025-Q1-K1-B11
caatcgcttatctccatctttacaacaatccaactatatattcaactcttctactttctaacatatatcatctccctaatattataactactaaaaatcatcctcaatgccaacctattcatccttatactatacattatcatctttatcacttctatcataacatcta

SEQ ID NO: 30562 - DNA, 369 bp, Zea mays
  Clone ID: LIB3059-025-Q1-K1-B12
cgtacgcagtttagggccatgatcttttgaagtttgattgtgatcgatcaaaatgcacttccggcacggctcattctaatgctcaatcaagggctataacgaacgattaaaataccggagaagtagcagtacccatggtgagtacctcacaggatgtatctgatgcaaagagcctcattcctccttttcaagatccccaacatagaacatgaagagattcttacatcgggttcacttcacaagaactgtggggttcactaacgtcacacatgatatcaagccaacttaatccagtactagcagtgacgctagtggctatcattgtcctattgcaggtaaccatcatagttctgctaactaggtcctccc

SEQ ID NO: 30563 - DNA, 434 bp, Zea mays
  Clone ID: LIB3059-025-Q1-K1-B2
ccctacttgaggctctggacttgatcaatgagccaaagaggccttcagacaagcccctgcgtctcccccttcaggatgtgtacaagattggtggtattggaactgtccctgttggacgtgttgagactggtgtcattaagcctggtatggttgttacttttgggcctactggtcttactactgaggttaagtccgttgagatgcaccatgaggctctccaggaggcccttcccggtgacaatgttggcttcaacgtgaagaatgttgctgtgaaggatctgaagcgtgggtatgtggcctccaactccaaggatgaccctgccaaggaggctgctagctttacctcccaggtcatcatcatgaaccaccctggccagattggcaatggctatgccccagttctggactgccacacctcacacattgctgtcaag

SEQ ID NO: 30564 - DNA, 431 bp, Zea mays
  Clone ID: LIB3059-025-Q1-K1-B3
cccacgcgtccgtcattacatacacatatatatggggcctcagcaagacgggcggtcgtccggggcgaacggcggcacggcggcgaggcgcaaggaggccgccgcgaagccggtggtgcggtaccgcgagtgccagcgcaaccacgcggcgtccgtctgcgggcacgccgtggacgggtgccgcgagttcatggcgtccagcgcggagggcacggcggcggcgctcacgtgcgccgcctgcgggtgccaccgcagcttacacaggcgctaggttgcgacggcgacggagacggtcgccgactgccgtgaccgcgcctacaccacctgcgggtgaactcgacgaagagtcgtgatgtgcattggtggaatggttgtttacagtggttgttcttggatgatttttgagtggatttttattgcgtgtgctatat

SEQ ID NO: 30565 - DNA, 409 bp, Zea mays
  Clone ID: LIB3059-025-Q1-K1-B5
gcagtcgcagcccacaggatcaggtgatgagcccaccacctaacgataacggcgaccggaatgattcacaccgcggcgacagcccccaagggaggcaagacagcaccagccgtaccctaaccccattcccaggtaaccgacgccctgcacctaatgggcctcgccctagccccatacgtgaccgtcatcccagccacatcgctgaccacagccccagccctaacgtccatggtctcaacgatcgtcctgatgatgatcctgcccgaggttgctaccgcacaggaaacaagtgaccattaacgctacaccgcctcaactatcaagtgcttaactatgcaaagagcaaacatacccattacttgatagctggatcactgccctatctgatacatgaacttatatagcttgc

SEQ ID NO: 30566 - DNA, 429 bp, Zea mays
  Clone ID: LIB3059-025-Q1-K1-B7
ctcgttaccaagattgataggcgatccggcaaggagctggagaaggagcccaaatttgtgaagaacggtgatgctggtatggtgaagatggttcccactaagcccatggtggtggagaccttttctcagtatcctcctcttggtcgatttgctgtccgtgacatgaggcaaacggtggctgtcggagtcatcaagagtgtggagaagaaggacccaactggagccaaggtgacgaaggctgctgccaagaagaaatgatctatctggctggtgacgaaggctgctgccaagaagaaatgatctatctggctggtgctgtgcttgcttgttggttacctcgtggaagcttaaaatatctcgtcttgttgacatccttgcagttgtcgcgtgaacaagtaatctatgatggcaatgtttgcctggtcatga

SEQ ID NO: 30567 - DNA, 426 bp, Zea mays
  Clone ID: LIB3059-025-Q1-K1-B8
gcactacggcatccgcatcgagttcatgttcccggacgcgagcgaggtgcaggaggttgggcgcaccaagggcctggtctgcttctacgaggacggccaccaggagtgctgccgggtgcgcaaggtgcggcccctgcgcagggcgctcaaggggcttagggcatggatcaccggccagaggaaagaccagtcccccggcaccagggccagcatccccattgtccaagttgatccttccttcgaaggcctgaatggcggagccggtagcttggtcaagtggaaccccgtggccaacgtcgacggcaaggacatctggactttcctgcggaccatggacgtacctgtcaacaccctgcatgctcagggctacgtgtccatcgggtgcgagccgtgcaccaggcccgtccttgccgggcaacacgagcg

SEQ ID NO: 30568 - DNA, 430 bp, Zea mays
  Clone ID: LIB3059-025-Q1-K1-B9
gtggaatccagtagcaacaacagagcaacaatggcgaccaagatattttccctccttgggctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacactgaaccctgctgctt

SEQ ID NO: 30569 - DNA, 391 bp, Zea mays
  Clone ID: LIB3059-025-Q1-K1-C1
cccatcttccccgctccccctctccctctcgtggccacgactgccgccgctgccgggctggccaggtgtccaggtcatctccggcccattcgccggcgacgagcaccccactagatcgaccgagctatggacggcctgtggcatctgggggacgagctccgcgggcagcccaaggtggtggaggaccgccagtggtcgctcatgacatccaagctggcagagatcaccaggtccaggggcgagaggacgaacgacctcgactacgccaggatgaacgccggccccgacgccaagcagtggggcaaggcggcgtcctaccagcaccacgacgagggcacgatggaccaccacgtcggtctcagcctgaagacgaacgatctcaagatgaacg

SEQ ID NO: 30570 - DNA, 412 bp, Zea mays
  Clone ID: LIB3059-025-Q1-K1-C10
attttgagcattcagaaacacaccaagcgaagcacattagcaacaacctaacaacaagggctgccaagatattatccctccttgcgcttcttgcgctttttgcgagcgcaacaaatgcgttcattattccacaatgctcacttgctccaagttccattattacacagttcctcccaccagttacttcaatgggcttcgaacacccagctgtgcaagcctataggctacaacaagcaattgcggctagcgtcttacaacaaccaatttcccagttgcaacaacaatccttggcacatctaacaatacaaaccatcgcaacgcaacagcaacaacaattcctaccagcactgagccacctagccatggtgaaccctgccgcctacttgcaacagcagttgcttgcatcaaaccc

SEQ ID NO: 30571 - DNA, 318 bp, Zea mays
  unsure at all n locations
  Clone ID: LIB3059-025-Q1-K1-A5
gacagcaagcggatgcgtgaggacgcgacaacactgaagatggcatgtctgcggtgcctggctctgcactgcacgcttgaatgcaacctgcccctgccgggctgaggctgacggctgcccgctgacacatatgcccgcgctgtccctccgagcctgagagcgatgacccgtgcgcgcccctataccggtgggcaccacccagtcaacgttcgcacagtgctgcagcagcgatgaggatgatggacgtgcagtccgtggcgcaccagctgcagatgatgatgcagcttgagcgtgccgctgccgncagcagcagcctgt

SEQ ID NO: 30572 - DNA, 421 bp, Zea mays
  Clone ID: LIB3059-047-Q1-K1-B5
gcaacatagaaagcacaatattgtaccaacaatggcagccaaaatattttgcctccttatgctccttggtatttctgcaagtgctgctactgcgaccattttcccgcaatgctcacaagctcctatagcttcccttcttcccccgtacctgtcaccagcggagtcttaggtatgtgaaaacccaattcttcaaccctacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgcttcttat

SEQ ID NO: 30573 - DNA, 424 bp, Zea mays
  Clone ID: LIB3059-047-Q1-K1-B6
cccactcgtccgcccaaacaagtatacatctaagatgctcctggctgcaattgatgagcttcacagaggaacttatgactttttctacctgccaattgatttcaagaacaaatgcaatgttggatacgcgttcattaacatgatatcgccggtgcatattatatccttctaccaggcttttaatggtaagaaatgggaaaagttcaacagcgagaaggtagcctcgttggcttatgctagaattcaaggacggtctgcactgatatcacattttcaaaattcaagtttgatgaatgaggataagaggtgccgccccattctttttaatcccaatggtcaggagtctgtgcaccaggaagcatttccaatcaatggcatatgcatccacatgcttccggaagatgattaccttgacaatgaagat

SEQ ID NO: 30574 - DNA, 424 bp, Zea mays
  Clone ID: LIB3059-047-Q1-K1-B7
ctctcaccaacagcagttccttccattcaaccaactggctgcattgaactctgctgcgcatttgcaacaacatctaccattcagtcagctagctgctgcctacccgcagcaatttcttgcattcaaccaactggcagcattgaactctgctgcttatttacaacagcaacagctaccaccattcagccagctagctgatgtgagccctgttgccttcttgacacaacaacagttgttgccgttctacctgcacgctgcgcctaacgctggcaccctcttacaactgcaacaattgctgccattcaaccaacttgctttgacaaacccaacaacgttctaccaacaacccatcattggcggtgccctcttttagattgcttatgagttatagctcaataatgaagatttccggatgatgtatgag

SEQ ID NO: 30575 - DNA, 411 bp, Zea mays
  Clone ID: LIB3059-047-Q1-K1-B9
agatgagcttgtttttgttctagcagcaacaaatctaccatgggaattggatgcagcagtgctgcgtcggctggagaagcgtattcttgttccattgccagagccggatgctagacatgctatgtttgaagagctcctgccatatacacctggcacaatggagatgccctatgatgttcttgtggagaaaactgaagggtattctggctctgatattcgcctggtatgcaaggaagcatcaatgcagcccctaagacgggtaatggcagttcttgaaggcaggaaagaagaggtccctgagggtgagttgcctgaagttggcccagtaactacagaagatattgaacttgctttgaggaatacaagaccgtttgcacatcttcatgcacatagatacgaaaagttcaacca

SEQ ID NO: 30576 - DNA, 425 bp, Zea mays
  Clone ID: LIB3059-047-Q1-K1-C1
ggattcgaaatatttgcggcgacacacatagtggtcagctagaagctggccattatgtgacatatctgaggctaaacaatcattggtacaaatgtgatgatgcctgggtaaccagagttgatgagcataccgtcaggacttctgacgcatacatgctcttctacgtgcagaagacgttctactacaaagcttgcgaaagagcagccacagtctgatctgaagcagacattgatgacacaacttcagaccaccataaatttatttgtcaccgaatcagatacacatgtagtaagtagttcgtcaatcaagaaggaaaacgggcgccgtattcacagcagcataagcatggcctgttaaatattttcgttgtacactgacctatagttccaatcagagagaagctttttcggcggattttgtcttta

SEQ ID NO: 30577 - DNA, 420 bp, Zea mays
  unsure at all n locations
  Clone ID: LIB3059-047-Q1-K1-C10
ggagctctgggcagcgtgcgcacgtggtgtacctagctcgctctgctagcctaccatggctgatcaccaccggtgcgcgacgggaggtggcggtggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccggtgctggntgcggccgccatcgcgctggcgctcatggcggccgggttcgtcacctccggcggcctcggcgtcgctgcgctgtccgtgttctcctggatgtacaagtacctgacgggcaagcaccc

SEQ ID NO: 30578 - DNA, 412 bp, Zea mays
  unsure at all n locations
  Clone ID: LIB3059-047-Q1-K1-C11
ccgcgtccagtgtgtccgctactccgctccccctcagtcctcagttcctcacgtagcggtagcgtgcgcgcgggagacgtagatggcggcttcggaggcggcagcggcggcggcaacaccggtgacgccgacagaggggacggtgatcgcgatccacagcctggaggagtggagcatccagatcgaggaggccaacagcgccaagaagctggtggtgattgacttcactgcaacatggtgtcctccgtgccgcgccatggctccaatttttgctgatatggccaagaagtccccaaatgttgttttcctgaaagttgatgtggatgaaatgaagaccattgctgagcaattcagcgtagaggccatgccaacattcctgttcatganggagggcgacgtcaaggacagggtc

SEQ ID NO: 30579 - DNA, 420 bp, Zea mays
  Clone ID: LIB3059-047-Q1-K1-C12
aggcatctcactggagagtttgagaagaaatatgaaccaaccattggtgtggaagttgatccgttggatttcaccactaactgtggtaagatcaggttctactgctgggataccgcagggcaagagaagtttggtggcctcagggatggatactatatccatggccagtgtgcgatcatcatgtttgatgtaacctcaaggcttacttacaagaatgttcctacgtggcatagggacctgtgcagggtctgtgaaaacatccccattgtcctctgcggtaataaggttgatgtgaagaacaggcaggtcaaagccaagcaggttactttccacaggaagaagaatctgcagtactatgaaatttctgccaagagcaactacaactttgagaaacctttcctgtacctcgcaaggaagctg

SEQ ID NO: 30580 - DNA, 264 bp, Zea mays
  unsure at all n locations
  Clone ID: LIB3059-047-Q1-K1-C3
ctctgcagcgatggcgatcaagcggactaaggccggaaaaaagaatggttccaccagaaactgttcaaccctgctcgattagtccacaaagtggctaatngcctggccgacaacgtcggttccaaacagcttcaggacattcgccggggcctcaagggcgactcggtggtgctcatggggaagaacacgctcattaggcgttggatcaaagtgtacgccgagaagaccggtaaccacacctttgacccgctcatggaccttctg

SEQ ID NO: 30581 - DNA, 251 bp, Zea mays
  Clone ID: LIB3059-047-Q1-K1-C5
cggacgcgtgggggcggagcgctggtaccggcgtaactccgggcccatcggtcgggaggtcagtcaaccgcgctccccggcccccagtggctcgtagaacattcgagaacccctcgcctcctcccccaacgataaaatcctcaccgcgccgcaacgcatgttcgccccacaaaccctcgtctcgtgccactttctcagtcccctctagccggcgcctaccgctcgcgctctcctcgcgttcgggaaggtcg

SEQ ID NO: 30582 - DNA, 417 bp, Zea mays
  Clone ID: LIB3059-047-Q1-K1-C6
cccacgcgtccgcgtaactcagactgacacagctcaagataaagttggactccatattaattgttacttacatattatcatcttctttttccccaaaaaattcttactagaatactaagaccatttctacacagcaatcacataaagttggatccatcatcaacaatgattttacaaactctcttgaatcacctgcaaaggttcttattatacatctgcaattgaattatctaaaattaaaacatagaattcaattatgttcgttgtttacaggttgaaacaacaacttttgaagactggccatgaatatctagatagtactacaccatctacataatttgtaatcaatataatttgcatattattcatcggacacctttataaccatagcacatcatgacagtagctcacaggctc

SEQ ID NO: 30583 - DNA, 424 bp, Zea mays
  Clone ID: LIB3059-047-Q1-K1-C7
ggataaaagacccgctcctgtcccgcaggcaactgagcgccggcccgcccgcccgggcaccagccgccgccgcaccgtcaccgcgcgacctcccttcttcgccgcaaaccgctctgggcgcttgaagatggcggtgccgctgttgactcagaagatcgtgaagaagcgggtcaagcagttcaagaggccccacctcgaccgctacaagtgcctcaagccaagctggcgcaggcccaagggtatcgactcccgtgtcaggcggaagttcaagggatgcaccttgatgcctaacattggatatggctctgacaagaagaccaagcactacctccccaacaaggttaagaagtttgtcgtgcacaatgtttctgagctggagttgcttatgatgcacaacaggacatactgcgctgaaatcgcacac

SEQ ID NO: 30584 - DNA, 423 bp, Zea mays
  Clone ID: LIB3059-047-Q1-K1-C8
atctgatgtactttggctatacatcatgcccagatgtgggtccagctgaagttcagaagatagctgatgttgttaaactgttagagtcaaagtacgatatcaatattacaccactctttgtcacaattgatccacaacgtgattcacctgctcagcttaaggcataccttactgagtttgacccaagaatagtaggactaacaggtcccatcagtgcagtaagacagatagctcaggagtaccgtgttttctttaaaagagtagaggaagttggtcaggactatcttatagaaagctctcacaatatgtacttgctagatccatgcttggagacagtaaggtgctttggaagtgagtacgaggcatcagaccttgctgaggctataacaacagaggttcagaaagcatctgcctcatcaacaa

SEQ ID NO: 30585 - DNA, 427 bp, Zea mays
  Clone ID: LIB3059-047-Q1-K1-B3
atgattttgcaaggacaggaagtactgctatcgatacggttggacttaaggaaggcctttgggacagttcacacatgaaatgggacccatttctacgcaagcaaggacttccagttcgcttgaacaaaggtgttgtagagttggttgcagaccatgtagtttgtgaggaaggaaagcccctttcgccagaagcagcgcagactctgcggctgcttgggatacaaatggcgacattccgtctataccttgtgtgtcgctggtcgggcgatgactttgaagtttacaaagaaagcttgatgcacctaagaactgatgaatcctcttaagcttttgtttcctgtatacacaaaaggctcacttgctgtctttgctgggacagcttttggtaactgtgcgtgtggccatgtacccaggagtattggaagtt

SEQ ID NO: 30586 - DNA, 434 bp, Zea mays
  Clone ID: LIB3059-047-Q1-K1-A1
cccacgcgtccgcccacgcgtccggggagttgttcagtttggtactgtggacatagaatctgatggcttaagtgatcaccttagtgttcttgctgattcattaaataaagcaaggattcatatctgtccaccagtgaaaaagccatctaaactcggtgaaagtctcattagtttggctgcaatagtggagaatgaacataagaggctgcttgcaaggaagtccatcattgaaaaacgtaaagaagagcttgagcgtcaaatattggagaaggaaaaagaagaagaaaaaaagagaatgagcagtcaaaagaaaactgcggatgaagaaagggtgaagcttctcaatgaacagaggcagagggagcaggaccggattcgtagagagatagaggaaaaaaataaagcagaagcaaaaaagttgctagaagatttga

SEQ ID NO: 30587 - DNA, 418 bp, Zea mays
  Clone ID: LIB3059-047-Q1-K1-A10
attatttagaccaactagcaacatagatagcacaatagtgtaccaacaatggcagccggaatattttgcctccttatgctccttggtatttctgcaagtgctgctacggcgaccattttcccgcaatgctcacaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctg

SEQ ID NO: 30588 - DNA, 181 bp, Zea mays
  Clone ID: LIB3059-047-Q1-K1-A11
ctcttacaactacaacaattgttgccctttgtccaacttgctttgacagacccagcgggctcctaccaacaacacatcattggtggtgccctcttttagattgcttattagttgtaattcaataataaagttttttggatgatgtatgtggccaaccagaaataagaagttacatttccag

SEQ ID NO: 30589 - DNA, 417 bp, Zea mays
  Clone ID: LIB3059-047-Q1-K1-A12
caacaagcaacatagaaagtggaatccagtagcaacaatagagcaacaatggcgaccaagatattttccctccttatgctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgtttcaacaatcgccagccctatctttggtgcagtcattggtacaaaccatcagggcacaacagctgcagcaactcgtgctacctctgatcaaccaagtagctctggcaaacctttctccctactctcagcaacaacaatttcttccattc

SEQ ID NO: 30590 - DNA, 225 bp, Zea mays
  Clone ID: LIB3059-047-Q1-K1-A3
ggagattaaggagttccaaaagttcaatggaccggttattccctttgggcctttggttcgggttgtgaaggaggtaaccaatttcgttacaaacgggaaagtatagcgctataccgcaaaagcccttcttgcgcttcaagaagcaacagaattccacttgatagaactggttgaaatggcgaatctgggtgccattcatgccagcgtgtcacaattatgcaaaag

SEQ ID NO: 30591 - DNA, 411 bp, Zea mays
  Clone ID: LIB3059-047-Q1-K1-A4
cgtttcgcgttcgcctcagcccgccgcaaggagaggtaagttcaggagacatcttcgagaagctgaaatggctcctaaagctgctcctgccaagaagggtgatgccaagacccatgccttgaaggttgccaaggctgtgaagtctggggcagccaagaagaagaccaagaagatccgcacgtctgtgacatttcaccgccccacgaccctgaagaaggctagggaccccaagtacccacgaatcagcactaccggaaggaacaagcttgatcagtaccaaattctcaagtacccccttaccacagaatcagcgatgaagaagattgaagatcacaacactctggtcttcattgttgacctcaaggcagacaagaagaagatcaaggctgccgtcaagaagatgtatgacat

SEQ ID NO: 30592 - DNA, 425 bp, Zea mays
  Clone ID: LIB3059-047-Q1-K1-A5
atgggcttccgtggtgagcgtgacccaagggaccgtgtgaaatatgagtggtctgccactgatgactacgttcagagggagcgcccatatgatggttatcttgacaggagtcggcgtcgctcaggatctcctcgtggtaactggggaaatgatctgcgtgacagaagccgctctcctgcacggaacaggcctatgaagagttccttcaccggaagaggtcgacctgacgactatgctgctgatccatatggcagccgagggagacccaatggtatggaggccggccgtgggcgtgggcatgcttacagagcaagcagtggtccgtaccctggtgagactcgaggtgaccaacgcgctgctccacgcgctaggaacgaggatggctattagatcttcatgaagctgagtgacgtcattttgtcttt

SEQ ID NO: 30593 - DNA, 406 bp, Zea mays
  Clone ID: LIB3059-047-Q1-K1-A6
cggacgcgtggggtttttcaggttgtgctaactcccacacatttggccatagttatggaatatgctgctggtggtgagctatttgaaaggatctgtaatgctggaagatttagtgaggatgaggcgagatttttcttccaacaactgatttcaggagttagttattgccactcaatgcaaatatgccatagagatttgaaactagaaaacactctcctggatgatagtatagcacctcggctaaagatatgtgattttggttactccaagtcctctgtgctgcactctcaaccaaaatcaactgtcgggacaccagcttacattgctcctgaggtccttgctagaaaggaatatgatggaaaggtcgccgatgtttggtcatgtggagttactctgtatgtgatgc

SEQ ID NO: 30594 - DNA, 426 bp, Zea mays
  Clone ID: LIB3059-047-Q1-K1-A7
cggacgcgtgggcagggccctgttctctcatctctcactccctcgctccgtgtacggggtaccaccacgtgcctcctcgtcgacgatctcgtagcggcggcgcacatggcgagcgacggcgcggcggctacgccagcgaaggttaccccaaagaaggccaatctcctcgacccgcactccatcaagcaccttctcgacgagaccatctccgaagtcgtgaagagtaagggctacaccgaggacacgcggctgggcaactggaagctggggatcggagcctgcgtgattgctgtcgccctcctcgctcagttttaccccaagaagttgccgcagaaccgcgatttcctccttggctgcatcgccctgtatgtggtgctgaatgtggtgctgctgatccttagctacaccaaggagaaggatgccatc

SEQ ID NO: 30595 - DNA, 431 bp, Zea mays
  unsure at all n locations
  Clone ID: LIB3059-047-Q1-K1-B1
gcaattagctcatcgaactccagaatgggagaacctcgccacccttgaaggtccgaatggtggccttggttttctggcccctggttgcaacccccgcttcagtacaagcggcgctgtggctgccagacaccancgtttcatctaccgtctncgttctatatgccgcctacgttctatctgccgccgcagcagcagccgcagccatggcaataccccactcaaccaccgcagctaagcccgtgccagcagttcggatcctgcggcgtcggcagcgtcggcagcccgttcctgggccagtgcgtcgagttcctgaggcaccagtgcagcccggcggcgacgccctacggctcgccacagtgccaggcgctgcaacagcagtgctgccaccagatcaagcaagtggagccgctgcaccggtaccaggcgacata

SEQ ID NO: 30596 - DNA, 397 bp, Zea mays
  Clone ID: LIB3059-047-Q1-K1-B10
atgtaaacgtccttgaaaccgtttaaggtggcccaaccctttcatgaacccattaaagggccttggtattaagcctctttttggaccatctgtcattaaaggcctaattggactttcaaggatctgaactagtcaggaagatggaccattgcttatgcttatgctttgcatgatgaatcttgccgacttcaagctatcatcgagcatgtactcatactgtacaaaatcgtacatgatactctttgtaatcataataagcaccatctggtgcaatctacactagctgtagctctgaataaagaattcctttgcatgttaaatatgacagaatcagaaccaatagcaagcacatgtgtatgccaatccaatataacagtcgtgcttctcttatgcccta

SEQ ID NO: 30597 - DNA, 416 bp, Zea mays
  Clone ID: LIB3059-047-Q1-K1-B11
atttaaccaattcgccgcactgaacccctctgcttatttgcagcagcaaatactactaggatttggccagctagctacaacaagccccgcttccttcttgacacatcatcaattgcttccgttctaccagcagtttgtggctaaccccgcaacccttttacaactgcaacagttgctgccctttgtccaacttgctttgacaaacccagcagccttctaccaacaacacatcattggcggtgccctcttttagattgcttattagttgtcattcaataatgaagttttttggctgatgtatgtggcctcctagaaataagaagttatatttccaaaaaaaaaaaaaaaaaaaaaaaaaaaaaaaaaaaaaaaaataaaaaaataaagatcatagctaagatgaagttgaacaaaaa

SEQ ID NO: 30598 - DNA, 422 bp, Zea mays
  Clone ID: LIB3059-047-Q1-K1-B12
cggacgcgtgggcgaggccaactcactaccacatcctgcatgatgagataggcttcaggcctgatgatctgcaggagctggtgcattcgctctcttatgtgtaccaaaggagcacaacagccatatcagtcgttgctcccatctgctacgcacatctggcagctgctcaggttggccagttcataaagttcgatgagatgtcggagacgtcctccagtcatggcgggcatacttcggcgggcagcgttccggtccaggagctgccgcgcctgcatgagaaagtgaggagctcgatgttcttttgctgagccgtggttttacttttttggtggatggtgaacccctctagttatgtcggtagacgcttttggatgacgctctagttgtggtccaggaaggctcgagctggtacgatgttaaat

SEQ ID NO: 30599 - DNA, 428 bp, Zea mays
  Clone ID: LIB3059-047-Q1-K1-B2
gagaaagtcagatccgtgttccgtgttcgcgttcaatgtgttcgctactccgctccggctgagtcctcagttcctcacctagcggtagcgtgcgcgcgggagacgtagatggcggcttcggaggcggcagcggcggcggcaacaccggtgacgccgacagaggggacggtgatcgcgatccacagcctggaggagtggagcatccagatcgaggaggccaacagcgccaagaagctggtggtgattgacttcactgcaacatggtgtcctccgtgccgcgccatggctccaatttttgctgatatggccaagaagtccccaaatgttgttttcctgaaagttgatgtcgatgaaatgaagaccattgctgagcaattcagcgtagaggccatgccaacattcctgttcatgagggagggcgacgtcaa

SEQ ID NO: 30600 - DNA, 315 bp, Zea mays
  Clone ID: LIB3059-046-Q1-K1-G12
aactagcaacatagaaagcacaatagtgtaccaacaatggcagccaaaatattttgcttccttatgctccttggtctttctgcaagtgttgctaccgcaaccattttcccacaatgctcacaagctcctatagcttcccttcttcccccatacctctcaccagcggtgtcttcaatgtgtgaaaacccaattgttcaaccctacaggatccaacaggcaatcgcaacaggcatcttaccattatcacccttgttcctccaacaaccgtcagccctattacagcagttacctttggtccatttggtggcacaaaac

SEQ ID NO: 30601 - DNA, 424 bp, Zea mays
  Clone ID: LIB3059-046-Q1-K1-G2
gaagaagggaggaaggaaagggggataatctaaggtggtgggcttccgggtcgtaggtgggatttgcccgaacttccggtaaaggtacttgatacatgttgggaatgaggggagtagcagcacgtccactttcactctcacaataacgctgcccaggcgcagccatgatttaattagaaacttattgtcaaaggaagtttgtttatttttttatatggtcgtgcgcactggttaattcagttcaggtcgtatgtttatctttccttgctagccgagtaataatacttagtatgttttagtcatgatatatgtttatactctgttgctccctcttttatgcaatcttgcaaaggggatgctgccgaaattttatatatggacgtcggaagtgtagtacagtagcaaaaaataaaaatagggaaaa

SEQ ID NO: 30602 - DNA, 397 bp, Zea mays
  unsure at all n locations
  Clone ID: LIB3059-046-Q1-K1-G3
cgcacgcgtccgcggacgcgtgggcttacgcgtgggttccttcgtaagatggtgtgcgctaattgatatagagagctcattgatttattatccaaacacaaaaacgacctggaaggattcatgatacatgtatatggaaatggcgaggactctgaagctgtccagaacgctgctaggaaatttgatttgaacatcaattttttcaagggaaaggaccatgcagatgattcactccatgggtacaaggttttcgtcaatccaagtgttagtgatgtgctatgcacagcaacagctgaggcccttgcaatggggaaatttgtagtctgtgcagatcatccatcanacgatttttttaagtcattccctaactgcttaacatatagaacttcataggaat

SEQ ID NO: 30603 - DNA, 422 bp, Zea mays
  Clone ID: LIB3059-046-Q1-K1-G6
cggtccggattcccccacgcgtgcgcgtctttcgaggttcatggaacaatttatgcattgtattgtctcagtgaagcatcgattgtgcttgttgacctatgatgtagttagcagaacatgtgagctccgggtatctattgcctttgttttgttaagccattgagtcaagctgcaattcttaatgaccattttacttcaatcccgttttcttcagttctgtgtttgttctgactaacgatttgtattcaatgtttttttctgtctttcctaaagctcttaaaggcaagaaaaaattgcacaacgaaaagcacaagtctcgatctgaaaggcctcaccgccaatctaatatcaccgaactggataaaggcaaaaaacgacctgcacaatcctccaaatccgatctgcctaataaaagatctaag

SEQ ID NO: 30604 - DNA, 354 bp, Zea mays
  Clone ID: LIB3059-046-Q1-K1-G7
aggcgacgcgggggctgttggcttgaacctttatttgaccaaagggcaggcaatctttgttgaggtctctggagccgtttgtcaaatggctcgaggaggctgaggaggaagaataagcatttgatttggagaacggccgaatgctggcctaagtgttactttatatgtctgaagttagaagtttgaggaggaattattgctgctgcctcttactgcctagaactttatgttatgatgtttaaccacatggatcccggctgcacagtgctataatatgttgctgttaaaactatgtgtcgagcattttttgaaaactttgttatcaatactgaaaggagttataatgggacgtta

SEQ ID NO: 30605 - DNA, 416 bp, Zea mays
  Clone ID: LIB3059-046-Q1-K1-G9
gtgggttggcttctcctccccctccggttcgggttcgggttcgtgaggttctccgggggtcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggc

SEQ ID NO: 30606 - DNA, 417 bp, Zea mays
  Clone ID: LIB3059-046-Q1-K1-H12
ggccaccctgaatctcaatgccatgaacaagctcagcaccaagaagccatgggccctgtccttctccttcggccgtgccctccaggcgagtaccctcaaagcctgggctggcaaggtggagaacgtggagaaggctagagcggccttcctcgccaggtgcaaggccaactccgaggctaccctcggcacctacaagggtgatgctgccgtcgacaccgagagccttcacgtcaaggactacaagtattgagttgcttctctttgcgatcccgttgttttgaaactcctgcctgcgagtaggttgctgagtgttgtttgcttgttagagcttttatattcgaacataaaaaaaacatgcttcctatgtggatgatggttatctttatattcgtatattaactactagtctctggtgtt

SEQ ID NO: 30607 - DNA, 407 bp, Zea mays
  Clone ID: LIB3059-046-Q1-K1-H2
cttttgtccaaaaggcttaagaaaggagaagaccagggagaatcaggatttattcgtgatggttttccccgtacagtaaaacaagcggaatattaacttaatttgcgggaaattcttgatggcgttacagacattgatatggtggttaatctgaaactaagagaagatgttatagtagagaagtgccttggcagaaggatttgcggccaatgtggaaagaacttcaatttggcctgcattgatgttaagggtgaaaatggactcccaccaatctacatggcaccactgttgcccccaaacaactgcatgtcgaagcttattacccgagctgatgataccgaagaggtggtcagaaatcggcttcagatatataatgacatgagtaaacctgtggaaggtttctaccg

SEQ ID NO: 30608 - DNA, 440 bp, Zea mays
  Clone ID: LIB3059-046-Q1-K1-H4
ggaattcgacgcctcgactccaggcgtccggtcaggcgacgcatgggctcaatgcctggcttcaaaaaaattccgtcagcagttgaagttatacccatggcaaaactactcttgggtttgctccttgcccttgctattctagggacaacatcggctgctggttgtgtacaagacgcggaagacatgaaacgagagtgcaagcagtttgagctattcccagcgaacccaaagttgccaccgtcggcagcatgttgtgctgtgtggaagacggcagatgttccatgcctatgcaaatatgttaacaaggaagtagagaaagtatggtgcatggaaaaagttgtgtacgtcgccaactattgtaagaggccgtttcaacctgactacaaatgcgggagttatacagttcctcttagtatgtaaaaagactggttgggacatgt

SEQ ID NO: 30609 - DNA, 395 bp, Zea mays
  Clone ID: LIB3059-046-Q1-K1-H6
cccacgcgtccgcggacgcgtgggctcagtgcctggcttcaacttgagcccaggtgtttttaactttgttgtgcctcagtttatgcagtatgacattggttatgtgcaatctcctggcatgtccacaaaccagcatactatgtactttggccagcctgatctaacaatagggtcttctggagctgctgtttatcgacattggccaaccccaacaatgatgtatccccattgctatgataatgttagtccaatgatgtctcaggttcctctgtaccagtctttcaaccatgattaggagattctgcttgctggaaagttgggaacaattctctgttgaacttgctatgttgtgttgtcctatgttaagtggagttcctttagattcgagccgtttt

SEQ ID NO: 30610 - DNA, 209 bp, Zea mays
  Clone ID: LIB3059-046-Q1-K1-H8
cccatggcaaaactactcttgggtttgctccttgcccttgctattctaaggacaacatcagctgctggttgtgtacaagacgcttaatacatgaaacgagagtgcaagccagttgagctattcccagctaacccaaagttgccaccgtcggcagcatgttgtgctgtgtagaataggtcataagttccatgcctatgcaaatatgttaa

SEQ ID NO: 30611 - DNA, 412 bp, Zea mays
  Clone ID: LIB3059-046-Q1-K1-G11
gtgaagggtctcatccagatctcaagatctattggagatgtatatctaaagaaaccagagtacagcagagaaccacttcacagcaagtttcggcttcgagaaaccttccagaggccgatccttagttctgaacctcaaattactgaacatcgaatacagccgaacgatcaatttgttatatttgcttctgatggtctatgggagcacctcagcaataaggaagcagttgaccttgtccaaagtagtccccgaaatggaatcgctcggaggctagtgaaagccgcgatgcaagaagctgccaagaagagggagatgagatactcagacctcaagaagatcgaccgtagtgtgagaaggcatttccacgacgatataactgtcgtcgtggtattactcgattcggatgccatga

SEQ ID NO: 30612 - DNA, 427 bp, Zea mays
  unsure at all n locations
  Clone ID: LIB3059-024-Q1-K1-H1
ccgagtccatcagctacccggctcaggtgttggcaaaatcttctaagatgattcctgtaatgttgatgggaactcttctctatggtgtgaagtacacacttccagagtatttatgcacctttcttgttgccggcggtgtgtcctcctttgcgttgttgaagacaagctccaagacaattaagaagcttgccaaccctaatgcacctcttggttacacattgtgcttcctcaacttagcttttgatggatatactaactcgacccaagatttaataaagtcaaggtacccaaaaacaaacccatgggatataatgcttggcatgaacctctgggggaccatatataatgctgtaattatgtttgttgcgccattactattcagtaactggccatatgcanatggttttgaggcattgagattttgcca

SEQ ID NO: 30613 - DNA, 407 bp, Zea mays
  unsure at all n locations
  Clone ID: LIB3059-024-Q1-K1-H10
gccctacatgcttagcaaaaattttggggatctatcaggttactagtaagcatgtaaagggtggcaaggagtcaaagatggatttgcttgtgatggaaaatcttttgtttggacggaatattaccaggctctatgatctaaagggatcttcaaggtcaaggtataatgcagattcaaatggtagcaacaaggttcttcttgaccagaacttaattgaagcaatgccaacttcaccgatttttgttgggaacaaggcaaagcggctactggaaagagctgtttggaacgatacatctttcctagctggaatcgatgtgatggactattccttgcttgtgggagtcgacgaggagaaacatgaactggtcttaggaattattgattntatgaggcagtatacatgggac

SEQ ID NO: 30614 - DNA, 429 bp, Zea mays
  Clone ID: LIB3059-024-Q1-K1-H2
ccgacgcgtccgattttgagcattcataaacacacctagcgaagcgcactagcaacgacctaacaacaatggcttccaagacattatccctccttgcgcttcttgccctttttgtgagtgcaacaaatgcgttcattattccacaatgctcacttgctccgagtgccattattccacagttcctccctccagttacttcaatgggcttcgaacacccagctgtgcaagcctataggctacaacaagcgcttgcggcgagcgtcttagaacaaccaattgcccaattacaacaacaatccttggcacatctaaccatacaaaccatcgcaacgcagcagcaacaagcactgagccacctagccgtggtgaaccctatcgcctacttgcaacaacagctgcttgcatccaacccacttgctttggcaaacg

SEQ ID NO: 30615 - DNA, 425 bp, Zea mays
  Clone ID: LIB3059-024-Q1-K1-H3
gctcttcagccctataggctccaacatgcaatcgcagcatgcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacactgaaccctgctgcttatttgcagcaacaactattaccattcagccagctagctactgcctactctcagcaacaacaacttcttccatttaaccaattggccgcactgaaccccgctgcttatttgcagcagcaaatactactaccatttagccagctagctgcagcaaaccgtgcttccttcttgacacagca

SEQ ID NO: 30616 - DNA, 421 bp, Zea mays
  unsure at all n locations
  Clone ID: LIB3059-024-Q1-K1-H6
cccacgcgtccgcccacgcgtccgcggacgcgtgggcggcgcggccgtggagaagaccatcctgaagcgcctcccgcccacggatctggcgtctctggtcagccctctccctctccctccccgcgccagtgccggtgcctcgcccgggccgctcgtgctctacgacgactacgaggcgcggctgcgggagctgcagcggcagcgcgactggtacttgatgagcaccgcgggtgcgggtccgggtctggaccccgcctacttgcacttgtcggtggcggcggggcatccggataacgaggacccacagcagtggtccccgaggcgacgaccgtccccgtgccccgagtgcgaggcggcggcggcggccatgcggcagccggcgttccactggtgcgtgcgcgnacgcgtggtctccgcggga

SEQ ID NO: 30617 - DNA, 424 bp, Zea mays
  unsure at all n locations
  Clone ID: LIB3059-024-Q1-K1-H8
ctttggagtcagagagcacggaatgggcgccatttgcaacggcattgctctgcacagcccagggtttgttccgtactgtgctacattctttgtcttcactgattacatgagaggtgccatgaggatctcggccctgtctgaagccggagtcatctatgtcatgacccacgactctattggtctcggagaagatggcccgacccatcagcccatcgagcacctggtgagcttccgtgcgatgccgaacatactgatgctccgccctgctgatggcaacgagactgccggagcatacaaagtcgcggtcgtcaacaggaagaggccgtccatcctcgctctctccaggcaaaagctccctcacctgcctggcacctcgatcgagggcgtggagaagggcgggtacaccatctncgacaactcgact

SEQ ID NO: 30618 - DNA, 293 bp, Zea mays
  Clone ID: LIB3059-025-Q1-K1-A1
agagaagatccttcacgagcaagagcagcttcgggagattgaactcagcaagcaacaggatgccagcgacttgcaagagaaaaatagactttcacgggtgttggaacacaagaatgctttacaggagagaatcatccaagaacgtgcagctgaatttggccgtctgaagaaagagagagatgaacggatgaatcggttgatatcttcaagaaagcattaaagggagacagtaaggaagttgatggtttatctgaacctggaggaacagcggattgaaatgcttcgtgagggaa

SEQ ID NO: 30619 - DNA, 394 bp, Zea mays
  Clone ID: LIB3059-025-Q1-K1-A10
atgtcttctttctactttcttgtaacctaagacgaactcggtgaactctttctcctggcgcagcaccggagcacaatcaaggattccagtccagtcctgccaatggagtgcgttttgggcttggttggccgcgacttcgcggtggtggcggtcgacaccttcgccgtgcagagtatcctcgtacacaagactgacgaggacaaagtaatggtcctcgactcgcacaagctgttgggcgcttcaggggagcctggtgaccgggtgcagtttacggagttcatacagaagaacctccacctgtaccagttccgcaacaccatcccgctgtcaaccgccgctgccgacaacttcacacgcggcgagctcgccacagcccttcgtaagaatccataca

SEQ ID NO: 30620 - DNA, 412 bp, Zea mays
  Clone ID: LIB3059-025-Q1-K1-A11
ctgcctcctctcctctcctctaggctctagtcctctcgcatccgcagcttccccagggggctagggtttgcagatgacgacagcggcgcgccccacctgggcgccggccaagggcggcaacgagcaggggggcacccgcatcttcggcccctcccagaagttctcctcccgcgacctcgccgcgcacacctccctcaagccaagaaaagacggtcaacagacccaagaggagttacagaagaggaatctcagggaggaacttgaggaacgtgagcgcaagcactactcttccaaggataagtcctatgccgaagaaagagaccggcggaaaagctctagccatctactcttagaaggttcaaagagagaagcagaggataagatagttccacgaggaatcgatgctgatgac

SEQ ID NO: 30621 - DNA, 436 bp, Zea mays
  Clone ID: LIB3059-025-Q1-K1-A12
caactagcaacatagaaagcacaatagtgtaccaacaatggcagccaaaatattttgcgctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaaca

SEQ ID NO: 30622 - DNA, 423 bp, Zea mays
  Clone ID: LIB3059-025-Q1-K1-A2
cggactcgtggtcggacgcgtgggaaataaaaataagaaaaaaaaataaaaaacaaaaagggtagataaaaaaaaccagtatatcacaaaaaacacaaaatttaaagacctaaaagagatatgatgatgaaagaacaccttacaagcggccacaaatgaaaaaaccttcatcgaataactctggaatggaatccaaacatgatgatcttgatgctgacttttcacaacccacgtctgggcaaagtagttcaaggcagcacgcttctaagccggaagcctcacctttggactttgtcattcgtccacagtccaaaattgaccctgagcagatacgggctcgtgctaagcaagctgtccaagaccagcgtccgctgaagatgaacaagaaattgcaacaactgaaagcgcccaagaagaaaaacc

SEQ ID NO: 30623 - DNA, 289 bp, Zea mays
  Clone ID: LIB3059-025-Q1-K1-A3
aatatttcgcacgacaaaaaaaaaaaataaattaaaaaaaaaaaaaaaaaaaaaaaaaagaaaggaaaaaaaaaaaaaaagaaaaaaaaaaaaaaaaaaaaaaaaaaaaaaaaaaaaaaaaaaaaaaaaaaaaaaaaaaaaaaaaaaaaaaaaataaacataaaaaaagaaaatgaatggtaaaactaaaaaacaaaatttacatatacaaattttaataatatcctaaaatttaaaacatggacaaaaaattaaaaaatcatgaacgtgtaaaattaactagaatatt

SEQ ID NO: 30624 - DNA, 439 bp, Zea mays
  Clone ID: LIB3059-025-Q1-K1-A4
agaagatctcagcgacaaaacaatgaagatcactttatgggcagattaggcgataatggtcaagcttcatgacgtgtacgatgcaaatacaaataaaccgattcttgtgctattcgtcgggtgcttaccaaaatttttcaaaggtgtctacctaagtggtggtcctgcctgtagatggtacttcaatccaacaattccagaggcagaaccttatcttaccagccagtctacaaaaagaattgtgttacagcttccccaaaatttacaacatcctccagcgatggaaacgaagccaattgtcgaacataaatccctctatgaacttcttacagttaacccatatgatttcccggaaacaggatttgaatgtactatcacaatagcagaaataccagctgaacacaaatggtggtttccatcttgcacaaaatgcaataaa

SEQ ID NO: 30625 - DNA, 412 bp, Zea mays
  Clone ID: LIB3059-024-Q1-K1-G9
acgctgcaggggacctgccgcgtatgcagcacccttttcctgggccagtgcgtcaagtttgtgaggcatcagtgcagcccgacggcgacgccctactgctcgcctcagtgccagtcgttgcggcagcattgttgccagcagctcacgcaagtggagccgcatcaccgttaccaggcgatcttcggcttgatcctacagtccatcctgcagcagcagccgcaaagcggtcatgtcacggtgctgttgacagcgcagatagcgcagcaactgacggcgatgtgcggcctgcatcagccgactccatgcccatacgctgctgccggcggtgtctcccactgaagaaactatgtgctgtactatagccgctggctagctagctagtcgagtcatttagcggcgatgattgagtaat

SEQ ID NO: 30626 - DNA, 412 bp, Zea mays
  unsure at all n locations
  Clone ID: LIB3059-024-Q1-K1-F3
ggatgccccccatggaaggaggcctcattaagccttggccggcaccagttttccaggccctgcaacaatcctatcctatctggcaaaagttgggtttgcactagctgtaaaaatttccatctatgtgacaagtgtcatgcagaggagcagaatacagcacagaaggacaggcattcggccaccacaaaacagaagcatgcattcgaaagaatggaggtacaacctcttccagagactgatgatggagatccgacaaatgaaaagtagtattttgacagcangatcgatttcttgaagcactgccaagacatcaatttccagtttgataccattccggcggccaaagcactctacaatgatgattctgtattacctacacaattcaacctgctctgcttgccatcgtgccgtg

SEQ ID NO: 30627 - DNA, 402 bp, Zea mays
  unsure at all n locations
  Clone ID: LIB3059-024-Q1-K1-F4
aagaaaagaagaaggaggaagattggttctgatttaaatcttggtagaactgaccatacaacatgtctatgaatcaatcaatttgttttgcaggcgtacatggtcggcgagcacggcgacagctcggtggcggtgtggtcgagcgtgagcgtggcggggatgccggtgctcaagtcgctgcaggagagccaccgctgcttcgacgaggaggcgctggagggcatccgccgcgccgtcgtcgacagcgcctacgaggtcatcagcctcaagggctacacctcctgggccatcggctactccgtcgccagcctcgccgcgtcgctgctccgggaccagcgccgcatccaaccggtctccgtnctcgccagggggttccacggcatccccgacgggaacgacgtc

SEQ ID NO: 30628 - DNA, 417 bp, Zea mays
  unsure at all n locations
  Clone ID: LIB3059-024-Q1-K1-F5
gagccatgcttcttcaagacgtacttttcttgggataacacaaaatctttggttcatggaaattccttccagaagaaactctcgctgctttttggattgcgttctgagggtgcacctaggagctctggtaatggtgggccaactcagagggcatctgcattagcagctctatcatccgcattcaatccatcatctcaacaaaggctgtctaatgagaggcctaaaagcacaggcgatggacccacgcaacgtgcctcagcactggctgccttatctaatgcattcaacccatccttaanacccaaaacatcaccttcatctcgctcaggtcgaggttctcaaagagcagctgctgtagctgctctatcctctgtgctgactgctgagcaatctggatcttcagaatttctacgatcc

SEQ ID NO: 30629 - DNA, 365 bp, Zea mays
  Clone ID: LIB3059-024-Q1-K1-F7
caccgggtgtcggtgaactcggcgagggagaggttctccatgccctacttcttcaacccggcgacctacaccatggtggagccggtggaggagctggtgagcaaggacgatccgcccaggtacgacgcctacaactggggcgacttcttcagcaccaggaagaacagcaacttcaagaagctcaacgtggagaacattcagatcgcgcatttcaagaagagcctcgtcctcgcctaactactgctactgctaggatccatgccattgccatgtcgtcttcagattcagagcacgccatgtcgtcgctagcttcgtggtagaacaaataatgatgtgcgtgctgtgtgtaagcatggatatggatg

SEQ ID NO: 30630 - DNA, 414 bp, Zea mays
  Clone ID: LIB3059-024-Q1-K1-F8
accaggtgatctcaagtaattaacagaaaatatattccatcattgaaaatgagttccgttgttttgggtgctactggtagggagaataagacatcatggcctgaggtggtgggcatgtccatcaaggaggcaagagagatcattcttaaagacatgcccaacgctaacattcaagttctaccggttggctcgcttgtgacccaagactttcgccctgatcgtgttcgcatcttcgttgatattgttgcctagactccaacagttggctgacaaggatatgccttatctataggccaaataaacaaagcctacttttatgtatcatggctaataaatcctacatttcttggttaaaaaaaaagaaaaaaatataaaataaaaaaagaaaaaaaaaatataaaaaaaataaaaata

SEQ ID NO: 30631 - DNA, 413 bp, Zea mays
  Clone ID: LIB3059-024-Q1-K1-F9
gtagcaacaatagagcaacaatggcgaccaagatattttccctccttatgctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgtttcaacaatcgccagccctatctttggtgcagtcattggtacaaaccatcagggcacaacagctgcagcaactcgtgctacctctgatcaaccaagtagctctggcaaacctttctccctactctcagcaacaacaatttcttccattcaaccaactgtctacactgaaccct

SEQ ID NO: 30632 - DNA, 424 bp, Zea mays
  Clone ID: LIB3059-024-Q1-K1-G1
agcacgccttccgggccgccaggtcttttggcccggacctgaaaaggatggcgttggtcggtctagcgtccacacgttaagaccctgaaaagagacctacgatgcttcaagtcgtgccgttgctgaaaggccagtctaaagaaacgctcgttaagcttgacaggcaggagttgttgttcagcccagactcgacgacggtgagttcgcagggaacaccgaccctagatgggagcacggactctgcgccgtcctagatagatcaagaactgattggggcgtgagttgcgatatatagctgctctaggcgattgtctagggcgtatccgtggtattgatgattggtctgcgcggattgacgtgaatgcgaattgtataggcattgactggccatctacgtatggtttctgtcgcatttgagggagta

SEQ ID NO: 30633 - DNA, 406 bp, Zea mays
  unsure at all n locations
  Clone ID: LIB3059-024-Q1-K1-G10
ctcgaagcttgcgttcttgtagtagaggtcggcagcaagcggtggtagagcgagaggtcgagaagatgaagagcagcactctgttggcgatcctagttctccaggcccttctggtctctgcggccgtggccaaaggacctgcagggccgacgacgaagaagcagtgctggtgcggcgagtgcaccagctggtcgggcgtgtggacctgcgacgacctcctcaccaagtgcgccgccacctgcaagaactgcgtccccgtgtccacggacaagggggccatcaagtacaggtgccgcgacttcctccccgaaaactgcggctgcaagatccactagagactcatccaattccaccatggccgngcgccacagcggcacagccgatggatccttccatgttcctccgt

SEQ ID NO: 30634 - DNA, 408 bp, Zea mays
  unsure at all n locations
  Clone ID: LIB3059-024-Q1-K1-G12
cggacgcgtgggggaaactgcagtgaagtcgccggcgccgccgcgacaggaggaaggagcagcagcggcagcggaggcccggcgatctcgtctgctgcgtgcggcgagggagtaaccggagccgcgacaggatgcactcctttgggcaccgcgccaacgcggtggcaacgttcgcggtcaccatactggccgcgatttgcttcgccgcctccttctccgacaacttcaacaccccgacacccactgcctccgttaagatcttgaatctaaactggttccagaaggaggccaacggcaacgacgaggttagcatgacgctgaacatttcggccgacctttcgtctcttttcacgtggaacacanaacaggtgtttgtttttgtggcagcagagtatgagactccacaga

SEQ ID NO: 30635 - DNA, 429 bp, Zea mays
  Clone ID: LIB3059-024-Q1-K1-G2
cagcatagaaagcacattagtggtacctccattggccggctaaaatatttggcctcctgatgctccttggtctttctgcaagtgctgctacggcgaccattttcccacaatgctcacaagctcctatagcttcccttcttcccccgtacctctcaccaacggtgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaaacatcaaggcacaacaactacaacaacttgtgctagcaaaccttgctgcctactctcagcaacagcaagttcttccattcaaccaactagctgcattgaactctgcttcttatttgcaac

SEQ ID NO: 30636 - DNA, 173 bp, Zea mays
  Clone ID: LIB3059-024-Q1-K1-G3
acccactcgtccgccgactcttcctacccgacaaattctttgtacctcacctgaaaaatattgccttggtgagtctatcgtacacacatttataacctcaaaacacacccactatactttaaatccacccgtttcttaaacgccagtctaaacaaactctcgttaatcttgaa

SEQ ID NO: 30637 - DNA, 420 bp, Zea mays
  unsure at all n locations
  Clone ID: LIB3059-024-Q1-K1-G4
cccacgcgtccggaggaaggcggaatttgcaggcctctttgcaaagttaacccagaagtggcccctgatcggacctctgctcttctttctgggcatgaagaactccatcccgaagcggcagggcggcaggaagaaggcccccaaggcgaagacgaactanggctgcttagatagctgcacgcctcaggtggngtgtatcaggagacaggtctatttcgaagcaggctcagcgcgatgcagcgaatgccatcgagctgcgcttttacatgtttatcatcagattccattttgcggcccgaacaaaggtgtgaccggngtgggttaggcgactagattgcacgattatgtacttgagatttgtttgttgaactgggttgccgacggttaatcttctccatttgattttatcttgttagcagc

SEQ ID NO: 30638 - DNA, 413 bp, Zea mays
  unsure at all n locations
  Clone ID: LIB3059-024-Q1-K1-G5
gcagaggcaacaagggggattcaccaagggaaatgatgatgcaccagaccttagttttgaaggagaagaaggatttaaacaatctaagaaaaggagacctggtgtttctcctggtgacaggtctggtggtcttgctaagcgaggtaaagaaggaaagaacaggagggcaaaggattccatgtttgggcacggtggtcgtaaagggctgaagaagcaaaacaccgctgagaccactaatgatttcagaagctttaaccaggggggtcagtctcaaaacaagaagagaaagaggttttgaacttttgatggatatattaagaatttgggtgagtctcaaaaccagaagaggaagaagttntgaacttttgtgttattactattcccccctgcggcattattntgttatggtgtgt

SEQ ID NO: 30639 - DNA, 397 bp, Zea mays
  Clone ID: LIB3059-024-Q1-K1-G6
gcattcagaaacacacctagcgaagcgcactagcaacgacctaacaacaatggctaccaagatattatccctctttgcgcttcttgccctttttgtgagcgcaacaaatgcgttcattattccccaatgctcacttgctcctagtgccattattccacagttcctccctccagttacttcaatgggcttcgaacacccagctgtgcaagcctacaggctacaacaagcgcttgcggcgagcgtcttacaacaaccaattgcccaattacaacaacaatccttggcacatctaaccatacaaaccatcgcaacgcaacagcaacaacaatttctaccagcactaagccaactagctgtggtgaaccctgtcgcctacttgcaacagcagttgcttgca

SEQ ID NO: 30640 - DNA, 418 bp, Zea mays
  Clone ID: LIB3059-024-Q1-K1-G8
cccacgcgtccggagatcgtgcagagaagcaagccaatgtcaccacaccacgccgaccttctacttctgaaagactccccatcaaaagagagactgcagcaaagcataatgatatttccgctgtacgtcgaccctctacaggagagagacgtgcttttactagagatggtgttctgagaactgatgtgaagacacctagtaaggcaagagcaactgtggctcatccgatgagtgaaatgactacagtgggcaatacgagaaaggctatcactccaaatgcagctagaagtagcaagctggaaacaaaaagcaataactacagactgaagggaccttcagcattggatagccactctactaggtcaaacagaatggacttgcaagtgtctggcaagcagaaatcgagttctgttaacct

SEQ ID NO: 30641 - DNA, 408 bp, Zea mays
  Clone ID: LIB3059-024-Q1-K1-F2
aaaaaaaaaaaaaaaaaaaaaaaaaatttaatttaaaaaaaaaaaaaaaaaaaaaaaagaaaaggaaaaaaaaataaaaaaaaaaaaaaaaaaaaaaaaaaaaaaaaaaaaaaaaaaaaaaaaaaaaaaaaaaaaaaaaaaaaaataaaaaaaaaaaaaaataaaaaaggcctacttttttaaaattttcaatttttattaaagttacataacaaaaattaactttcttttttttaaaactaaattaaatttaaaaaaccctgttttaaaaaattttaattggaaaaaacttatgttaaccaaaataaattgctttaaaaaaaaaaaccttttttccaattgggtttataaccaaaaggcccctttaaatgcccattttaaaaaatttttaaaccttaatttaaaaag

SEQ ID NO: 30642 - DNA, 422 bp, Zea mays
  Clone ID: LIB3059-024-Q1-K1-D4
cggacccctggggggttggcttttcttccccttccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggc

SEQ ID NO: 30643 - DNA, 425 bp, Zea mays
  Clone ID: LIB3059-024-Q1-K1-D8
cccacgcgtccggacccactatcccaaaaccgtagcgccctcgcctgctcgccgccggcgtcgttgcgagctccccatcttcctccgtcaaccatggcgacccagatcagcaagaagaagaagttcgtcagcgacggcgtgttctacgccgagctcaatgagatgctgacgcgggagctcgcggaggacggctactccggcgtggaggtgcgcgtcacaccgatgcgcacggagatcatcatccgcgccacgcgcacgcagaacgtgctcggcgagaagggccgcaggatcagggagctcacgtctgtcgtccagaagaggttcaacttccccgagaacggcgtcgagctctacgccgagaaggtcgtcaaccgcggcctctgcgccatcgcgcaggctgagtccctccgctacaagctcctcgg

SEQ ID NO: 30644 - DNA, 386 bp, Zea mays
  Clone ID: LIB3059-024-Q1-K1-E11
cccacgcgtccgcccacgcgtccggatcagcatgttttacaagagattgttaaaattgtccagaagaggcatgatatgcaagtgagggataaggctttgttacttctggattcatggcaagaggcatttggtggacctggtggcaaatatccacagtactactggtcatacattgaactaaagagggcaggagtaatgttcccacaacgtcctgtagatgctcctccaatatttactcctactgcaacacatcaggcatatggttcacctagatatccttctggaagtctaaatgagagaatcacatctgatgctggaacgttgagctttgagggcttgaataatattagaaatgcaacggaactgctgtatgatatggtgaatgc

SEQ ID NO: 30645 - DNA, 408 bp, Zea mays
  Clone ID: LIB3059-024-Q1-K1-E12
aggcaatcacagcaggcatcttacctttatcacccttgttcctacaacaatcatcaggcctattacatcaattacctttggtgcatttattggcacaaaacatcagggcacaacaactacaacaactcgtgctagcaaaccttgctgcctacgctcagcaacagcagttacctttggtgcaattgttggcacaaaacatcagggcacaacaactacaacaactcgtgctagcaaaccttgctgcctactctcagcaacagcagtttctgccattcaaccaactagctgcattgaactctgctgcttatttgcaacaacaacaactactaccattcagccagctagctgctgcctaccaccagcaatttcttccattcaaccaactggcagcattgaactctcctgctt

SEQ ID NO: 30646 - DNA, 407 bp, Zea mays
  Clone ID: LIB3059-024-Q1-K1-E2
cctcgatcgggagacgcagaggtcccgcggcttcggcttcgtaaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctaccgtgatgtttaccctagtc

SEQ ID NO: 30647 - DNA, 307 bp, Zea mays
  Clone ID: LIB3059-024-Q1-K1-E6
atccacacatccacagaatccattattttttcttctatataatatatacaaacaacaggtatcacttctcctatctaagcattaacatcttaacatgaatacctccataccataaccacaaaaaagcccaataacgctccaaacgctaagactaactatgactgtacacatacttacatacatgacgctgctactatcattacacatgcctatatatcagcacgctcaacgctatacaccaaatctaatacagctacgcttgtacatgtttatcatcatatagcattttacgaacctaacaaacatt

SEQ ID NO: 30648 - DNA, 419 bp, Zea mays
  Clone ID: LIB3059-024-Q1-K1-E7
ccgaggtcgaaataagctgctgcgggcagaccgtgaaccctgggcaacctgtgcgcaacttggtggagcggtggctgagggttggcccggcgcgcccgctgcacacggtgatcggctcctccgggggagattatgtgatggtgataagctatgggcggcccaagtccgcgtcctgttaaaaccatatcaccatcgacggcctggcgaggtcgattcctagttcgaacaagggttggtgccgccgccgctgccgccgccggggaagaggccgtcgacagataaactcaagcagcggtagcgggctgctctgccgcagcagctcgtcctctcaccggcgtgttctttaaagatctgttcgttcgttcgttgttgtcatacatgcacatgtgatggaagtcgctataatttggtagtacttg

SEQ ID NO: 30649 - DNA, 401 bp, Zea mays
  Clone ID: LIB3059-024-Q1-K1-E9
cccacgcgtccgcgaacgaagatgttgtcggtgttcagcgggcaggtggtggaggtgccggcggagctggtggcggcgggcagccggacgccgtcgcccaagacgaaggcgtcgcagctggtggggcgcttcctggccgcctccgagccggccgtgtccgtgcagctcggcgaccacggccacctcgcctactcccacaccaaccaggcgctcctccgccccaggtcgttcgcggccaaggacgaggtgttctgcctgttcgagggggtgctggacaacctgggtcgtctgagccagcagcacgggctgtcaagcaagggcgccaacgaggtgctcctcgtcatcgaggcctacaagacgctgcgcgaccgcgcgccctacccggccagctttatgctcgc

SEQ ID NO: 30650 - DNA, 382 bp, Zea mays
  Clone ID: LIB3059-024-Q1-K1-F10
cggacgcgtgggcaactagcaacatataaagcacaatagtgtaccaacaatggcagccaaaatattttgcttccttatgctccttggtctttctgcaagtgttgctaccgcaaccattttcccacaatgctcacaagctcctatagcttcccttcttcccccatacctctcaccagcggtgtcttcaatgtgtgaaaacccaattgttcaaccctacaggatccaacaggcaatcgcaacaggcatcttaccattatcacccttgttcctccaacaaccgtcagccctattacagcagttacctttggtccatttggtggcacataacatcagggcacaacaactacaacaacttgtgctagcaaaccttgctgcatactct

SEQ ID NO: 30651 - DNA, 409 bp, Zea mays
  Clone ID: LIB3059-024-Q1-K1-F11
cccacgcgtccgcccacgcgtccggcggcgcccttttttttttttttttttttttttgactatggcggtgatctggttcatcgcagaaacagaagtacagaagccagtggctttgtcgtccacctgtgaagagctgaatacgttttgtctcagtgacgcagtagagtagcttaacactacatactgtaaacatcatcatttatcagcacgggatcctattctccaaaaggaaaaagacaatatttttttttgatcaactatgcctccctcatagctagagatagtaagcagggtctgcctgccggatgggctgttgatgaggctagaagatcgttgggcctcggaacggcaagcagacaaccctcaggttcctaggctgcgggacctcctccaaccatgccagccgaca

SEQ ID NO: 30652 - DNA, 405 bp, Zea mays
  Clone ID: LIB3059-024-Q1-K1-F12
acggactcatctactgagcagcgcggtgggcatccgagcgagagggcgagcgcgggaggatcggaattccgaaggttgggcatggaggcgagcggcgagaaggctgcggtggtgcgacggctgatggaggcgaaggaggtgtccgggaagaccttctcgggaatcgccgccgagacgggtctcaccaacgtctacgtggcgcagctgctgcggcgccaggcgcagctcaaggccgacacggtgcccgcgctgagggcggccctgcccacgctcacggacgacctcatcgaactcatgatgcagccgcccttccggtcctaccaccccaacatcgtccacgagcccgccatttacagattgaatgaagctgttatgcattttggagagagcatcaaggaaatcatc

SEQ ID NO: 30653 - DNA, 355 bp, Zea mays
  Clone ID: LIB3059-046-Q1-K1-E6
gggtactctttgggcagtttatggtgtcatacgtacgttggatgcttcggtaggaacttagacagactggaatgacgtcatcgcgattgtactgagaagagcttcctagcgtgcccgagctaagtgcaggcacatctgttcgtccacgcagtgatagccttgccctccaatctatatacactctatcacgtggtcaaaagagcagtgctgattcgctaaactaatctgacgactctgcccatcatgatacttgacgtgactcctaaccgtctcgagacgtacactgttgaggcgctaatcgcgagctgacaggtcgctcagagagggttgctgatcgtcaggtacgatgagcata

SEQ ID NO: 30654 - DNA, 395 bp, Zea mays
  Clone ID: LIB3059-046-Q1-K1-E7
cccacgcgtccggaaaacacatgttattcattgggtgaggacagactgctatcgttgtgttgatgaagcatatgaagatggaagaaatcggcttgaagctttgttatcaagattacattgcctcaatgtcccaacactttcttctggttctataaaactcaatgttgaaaactttggcccagtaatgcaaaaatcaacgatgtcaagcgaagaatataaaaatatcgttgtccaagctaaagaacacatcttggccggtgacattttccaagttgttttaagccagcgttttgagagacggacattcgccgacccctttgaaatctatcgtgcattgcgcatcgtaaatcctagtccatatatggcctatctacaggcacgaggttgtattctcg

SEQ ID NO: 30655 - DNA, 84 bp, Zea mays
  Clone ID: LIB3059-046-Q1-K1-E8
cgcacgcgtgcgtgaacgcgatcgttcacacattcggacgaccgactgttgtagtggtctagtttaagtatactatattacaca

SEQ ID NO: 30656 - DNA, 383 bp, Zea mays
  Clone ID: LIB3059-046-Q1-K1-F1
cagtcatccacactaacgaacgaactcttgctccgatcacgagctagctgaggtcgacgatggcggctgtgctgaacagcaggaagacgccgcaggtggtggccgtgctggtggtggtggcgctgctggcttcgtccgcgtcggcggcgatcacctgcgggcaggtggggtcgtcgctggcgccgtgcatcccgtacgcgacggggagggccagcgcgctccccgcgtcgtgctgcagcggcgtcaagagcctcaacagcgcggcgcggaccagcgcggaccgccaggcggcgtgccgctgcctcaagagcctcgccaacagcgtcaagagcgtcaacatgggcaccgtcgccaccatccccggcaagtgcggcgtctccgtc

SEQ ID NO: 30657 - DNA, 420 bp, Zea mays
  Clone ID: LIB3059-046-Q1-K1-F11
cggacgcgtgggcaacacaacactctcgggctttggccaggagaatatggaaaaagtagactctgacactgccactacctctaatgaccaatccaaggcggaagattccagtgtcacaaagaagcgcgctgcaagcttttggtttgatgaggatgggttgtttaacaacgatgatgaagggagggcggaaaggcagcagtgtgctattgcagcctccaatataatccgcaatttctcttttatgccagaaaatgagattatcatggttcaacataggcattgcttggaaactatatttcattgcttagaaaaccagaatagaggtaaatattgaaatattgtcctgcgtctttgtttttttagtttatagattaacttggtgatggtcaaatgaggctatgtgaatgtgtttggcacttc

SEQ ID NO: 30658 - DNA, 405 bp, Zea mays
  Clone ID: LIB3059-046-Q1-K1-F12
cccacgcgtccggctctttctgcatgtgttgctaacgcgacaattttccctgaatggggacaagctcctatagcttcccttcttgccccataccttccatcaatgatagcttcaatatgtgaaaacccagctcttcagccctataggctccaacaagcaatcgcaacaagcatcatacctttatcacccttgttgttgcaacaatcgtacagccctatctatggtgcagacattgagtacataccatcaaggcacaggacctgcaatacctcgtgctacctgtgatcaaccaagtagctctggcacacgcttgtgcctactctgagctacatcaatgcattgcattcaacctactgtctacactgaaccctactgctaacgcgcagcaacaactattaccattca

SEQ ID NO: 30659 - DNA, 391 bp, Zea mays
  Clone ID: LIB3059-046-Q1-K1-F2
cccacgcgtccgcgtagttgcaaaccagcaacaacaacaactgcaacaggttctggcagcgcttagtcaactagccatggtgaaccctgccgcctacctacaacagcaacaactgctttcatctagcccgctcgctgtggccaatgcacctacatacctgcaacaagaattgttgcaacagattgtaccagctctaactcagctagctgtggcaaaccctgttgcctacttgcaacagctgcttccattcaaccaactaactatgtcgaactctgttgcgtacctacaacagcgacaacagttacttaatccattggcagtggctaacccattggtcgctgccttcctacagcagcaacaattgctgccatacaaccgggttctcttgatg

SEQ ID NO: 30660 - DNA, 391 bp, Zea mays
  Clone ID: LIB3059-046-Q1-K1-F3
cgttcttctgccccagcatcttcagctttctgcgcaagtggaggcgctacgacgacgacatggccgactgggacggcgggtacgcgcgcaaggtgcgctccagcgacgaggactacggcggctggtgggtcagcgagcccgacgtcgaccgcaaggcctccgacttcatcaacaacttccaccagaagaattgaagggtcgcgttctctgctagctgcgactgctaccgcttccccacgccagcatagcatgcaatatgcatatatatggtcgacgacgacgatggcacacggccggcagcaccaccgcccgccgccgcgccggtccacgctatgcatgcatgcagctacgtttcatttattaccaggttctttgatatttctatatatat

SEQ ID NO: 30661 - DNA, 392 bp, Zea mays
  Clone ID: LIB3059-046-Q1-K1-F4
ctgtaaataagcaggagagttcaatgctgcgcctaacgctggcaccctcttacagctgcaacaattgctgccattcaaccaacttgctttgacaaacccagcagcgttctaccaacaacccatcattggtggtgccctcttttagatttcttatgagttatagttcaataataaagttttttgtctgatgtttgtggcttcccagaaataagaaagtacatttctagattctaaaaaaaacaaaataacatgcaatatgcatatatatagacaacaacaacaatggcacaacggacgacaacaccaccgaccgacgacgagccggtccacgctatgcatgcatgcaactacgtaacatatattaccaggttctaagatattcttatatatat

SEQ ID NO: 30662 - DNA, 394 bp, Zea mays
  Clone ID: LIB3059-046-Q1-K1-F5
cggacgcgtgggtcttggaacatgctgagcctcttctaaaagttacaattgttccgcgtgggacagctgctttaggctttgcacaatacgtcccaaatgaaaatcttttgatgacaaaagagcagctttttgatatgacatgcatgacattaggtggccgtgctgcagaggaggttttgattggcaaaatctcaactggtgctcagaatgacctggagaaagttaccaaaatgacatatgcacaggtcgccgtgtatggttttagtgaaaaggttgggcttctgtccttcccccagaaagatggtggtttcgaattgagcaagccttacagtaatcagacagcatccatcatcgacgatgaggtccgggaatggtttggcaaggcctacaagaa

SEQ ID NO: 30663 - DNA, 433 bp, Zea mays
  Clone ID: LIB3059-046-Q1-K1-F6
cggacgcgtgggcgagcaaaccctatcgagcgagagagcccggagccgagagaccggccagccatggcgctgcgtgccctgtacaacgagatccggagcatgaaggtccgcgacgtgccggcttacctgaagccgcgcttgacctgagacaacgtcaagaagagcgccgaccaggccgtcgaccgctacatcgagaagtacatcgacacgagctcgccggaccctctctaccacgtctgcatcggagggatgatcttctcctacttcgtcaatctgccctgggagcgcgcccacctcgcccacctcgaggagatggagaggaccggtgggaagcactagatccgctgacccgtccctcgccggcagcgcggtaggacgggtgactctcatggggtccattcaagctgatggcttctggtatcttctgctggtg

SEQ ID NO: 30664 - DNA, 315 bp, Zea mays
  Clone ID: LIB3059-046-Q1-K1-F7
ttttattttttagcaaccagacttcctctctaggtcatggtgatttatacgagtatcgatgaattcgagctcaagatatgctatcattattacatattcttaatttgctaatactttcattttgttatataaaattcattgacgaacactttaacccattaatccataagtttttcatgtttaccgactactataaacattattggttaccatctaacaatcaccttttggcccattacatttacaaagctgttttaatccaaccttacgaaagacggtcattcaacgacccctctgaaatctatcactcatttt

SEQ ID NO: 30665 - DNA, 411 bp, Zea mays
  Clone ID: LIB3059-046-Q1-K1-F8
gaacaagtgatgaaggtcctggacccaaggctctcgaccgtcccgctgcacgaggtgacgcgcgtcttctacgtcgcgttgctgtgcaccgaggagcaaagcgtgcagcgcccgacgatgagggaggtggtgcagatcctgagcgagcttccaaaaccgccatctaccaagcagggagaggagaattctaccaagcaaggagaggaggttccgaattccggcgacggctctgcgcccagccctctacactcagcaccagttgggaccaacgaagcaccagccgtcgaagcgagagaccaccagcagcagacaagctctccgtcgtcgccaccgcctccagatctcatcagcatctgagtaaccggaatcgaaaacgttaccgttcctcgcaaaaatccccgcttcagtgta

SEQ ID NO: 30666 - DNA, 363 bp, Zea mays
  Clone ID: LIB3059-046-Q1-K1-E5
gattgagtcggtggactcgctgaacccgttcatgcacgcccgtggggtcgccttcagggtggacaactgctccacaacggctcgcctgggatccaggaagtgggcgcctcgcttcgactacatcctgacgcagcaggccttcgtggcggtggacaaggacgccccgatcaaccaggacctcatcagcaacttcttgtcggaccctgtccatggtgccattgaggtctgcgccgagctgaagcccaccgtcgacatctctgtgcctgccaacgccgactttgtgcgcccggagctccggcagtcttcctagattgaggcagtgagcggagagggagagggagagagaaagagaggatttcgtgt

SEQ ID NO: 30667 - DNA, 375 bp, Zea mays
  Clone ID: LIB3059-046-Q1-K1-G1
ctcggaactggacaccctgagcgaggagtcctacaaggacagcactttgatcatgcagctccttcgtgataacttgaccctatggacctctgacatctcggaggaccctgctgaagagattagggaggcgcccaagcgggactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtccgtaaaatttgggggctccccgtaagggatgctgcctggcaaggcctcggtgtcccaccctgtctgtggcgttgggcgcttgaaccccggtc

SEQ ID NO: 30668 - DNA, 418 bp, Zea mays
  Clone ID: LIB3059-046-Q1-K1-D12
ctgtaaccgacgacggaacgggtagctcatctgcggcgagctatgagcgatcggccgagtcaggtgatgcttcacaggacgctgacactgaacacacactctccaagcttcagactacttcagtggatgacctgccatatactgtacaatagggaacaagatcaaacgatgatcgcgtaacaggtctactagacgagaaacttcacaatgaggtaagattctatgaccacatgcagcgtcaaatttacaagcgcaggctcaagttattacatactattcatgttgaatccagtgatttcgatcttgagattcactatgcctttcatgatgaacctcatatactactagcttagatagtcatgacgatagctaggactattatagtgaaggcctgcaatcacactgatcattgctagat

SEQ ID NO: 30669 - DNA, 221 bp, Zea mays
  Clone ID: LIB3059-046-Q1-K1-D2
cccacgcgtccgttcagcaggctcatgcagtgcagaagattcaccttaaagtaacgatgccttggttttgccataccattgacgtcaacggctacaggtaatggagaagacctggagtggtagagggaggtgtgtttcaggcgggtgaaaattcaagttgtacagttgaactcaccaggattggaaaatggtcatcaattcaaatttgagttgtttttctt

SEQ ID NO: 30670 - DNA, 373 bp, Zea mays
  Clone ID: LIB3059-046-Q1-K1-D3
cggacgcgtgggcggacgcgtgggctcgtgagtttgtgacagtggttttctctgtgccgccttttgcaggggaagggggtctgggttgcgtacaggcgaaaggcacgcgccgccgctgccgcgcgagcctctccgtccccatcgccgcgcagatggatccgtcgtcggagcccctgtacgcgcaggtcgagccgtacgactccgggttcctcaaggtctccgatgtccacaccatctactacgagcagtccgggaacccgcagggccatgcggccgtgtttctccacggcggtcccggagccggcacgtcgcccggcaacaggaggttctttgacccgcagttctacaggatcgttctgtttgaccagagggg

SEQ ID NO: 30671 - DNA, 380 bp, Zea mays
  Clone ID: LIB3059-046-Q1-K1-D4
agcacatcaaacaagtggcgacagactaaagatttgtgagggtgatccgcgctgaggagagatggctaagatcgccgcggcggcggcggcggcgctgtgcttcgcggccctggtggccgtggccgtcatgccaaggcgaggtctagcggcacaggctcatggacctgcagtgctggcaggaggtccaggagagcccgctcgacgcgtgccgccaggtcctcgaccggcagctaaccggcggtggcagcagcggcggcgttggcccgttccggcggggcaccgggctccggatgcggtgctgccagcagctccaggacgtgagccgcgagtgccgctgcgccggcattcggagcatggtcaggggctaccaggaggccatg

SEQ ID NO: 30672 - DNA, 353 bp, Zea mays
  Clone ID: LIB3059-046-Q1-K1-D5
ggcagttgctgtagagcgatgagcactcaggtaactggagaccaggtgcaggagtggagaactaaggatcaggccaggaaggcaggcaatccatggcgatcgacggaggagaattacccaagtgtgagcaggtcgactatggaagtgaagttgaaggctgcgcagatgatgagaaccctggcaagagggctgctttagttactttgggtggaaatgaatactgcggcgacgaggattagagagttcaagtgctcaccattgtcaagaaaggcgagcatgcagatgacattgtcgaccggattaatcctggcacagttgcagggtacagtgaaatgaagggtgctgtaggtgct

SEQ ID NO: 30673 - DNA, 381 bp, Zea mays
  Clone ID: LIB3059-046-Q1-K1-D7
gaaacacacctagcgaagcgcactagcaacgacctaacaacaatggctaccaagatgttatgcctctttgcgcttcttgccctttttgtgagcgcaacaaatgcgttcattattccacaatgctcacttgctcctagtgccattattccacagttcctccctccagttacttcaatgggcttcgaacacccagctgtgcaagcctacaggctacaacaagcgcttgcggcgagcgtcttacaacaaccaattgcccaattacaacaacaatccttggcacatctaaccatacaaaccatcgcaacgcaacagcaacaacaatttctaccagcactgagccaactagctgtggtgaaccctgtcgcctacttgcaacagcag

SEQ ID NO: 30674 - DNA, 433 bp, Zea mays
  Clone ID: LIB3059-046-Q1-K1-D8
ctcaaagcaacctccagtcttccaacaatcctgaaaagccagcagctaaagcagatgctgccgaggcaaccgctaatggtgttccaaatggtactggtcacactcacagttacagtggaactgtaccaagccaacaaagttcagcactgacgcctgatggaacttatagggcgcccttgctaggtggagttccttctgctggttacctagacacgacatattatgggtatgacagcacaggggcacaatttgcatggtatgatggctctgcttatgcaaatggacagcaaagaacaaccacaactaatcgttttccatcctcgtcattcagtggtaatggttcatctgcaatatatcagaacaagagctccaccacgcagcagatgggtatgcagaatagaagacctacaactccatcagcagcttctaccta

SEQ ID NO: 30675 - DNA, 418 bp, Zea mays
  Clone ID: LIB3059-046-Q1-K1-D9
cccacgcgtccgctcttcatctctggcacaaagatgcgcactcttgccaagaaccgagagagtgccccagatggttttatgtgcccgggtggctggaaggtactcgttgaatactatgacagcttggtgccatctgagggcagcagcaagctgcgtgaaccaattgcagcctaaatctggaaaatccttcatataaggaatgctactatatcttagcaagcggttctttgcgacatagaaccgatgctatgtgattgtatactggctgtaagactttaaaacactaggcttgattcggatgttaatgtgtgctttgtacccggtgtaccttctctgctggcagtgttgcacatgcactggagcacatcaaacgtttggtgttaataaggacaggctatgtatcctctgccagattgta

SEQ ID NO: 30676 - DNA, 377 bp, Zea mays
  Clone ID: LIB3059-046-Q1-K1-E1
cccacgcgtccgcggacgcgtgggtcaagctttgcaaggttaggtctgtgcagttgggtcagaagggcatcccctatctgaacacgtatgatggccgcaccatccgctaccctgacccgctcatcaaggccaacgacaccatcaagatcgatctggagaccaacaagattgtggacttcatcaagtttgatgttggcaacgtcgtcatggtgactggcggaaggaacactggccgcgtgggtgttatcaagaacagggagaagcacaagggcagctttgagaccattcacgtggaggactccctgggccaccagttcgccacccgtatgggcaacgtgttcaccatcggcaagggtaataagccgtgggtgaaccct

SEQ ID NO: 30677 - DNA, 417 bp, Zea mays
  Clone ID: LIB3059-046-Q1-K1-E10
cgcgtgcgaaccaagcagaccacaacatgaagaagcgtagtcgtcgccggaaggaaaggcgcggagcaagatgtcgtggcaggcgtacgtcgacgagcacctgatgtgcgagatcgaaggacagcatctcagcgccgccgccatcgtcggtcacgacggcagcgtttgggcgcagtccgagagcttccccgagttaaagcctgaggaggttgctggtatcataaaggactttgatgaacctggtactcttgcaccaactggtcttttcgttggaggtacaaagtacatggtgatccaaggtgaacctggagttgtcatccgaggaaagaagggcactgggggcattactatcaagaaaaccggcatgtccttgattattggtgtctacgacgagccaatgactccagggcaatgcaa

SEQ ID NO: 30678 - DNA, 416 bp, Zea mays
  Clone ID: LIB3059-046-Q1-K1-E12
cccacgcgtccgcggatcgagatcatgatccagcgagcgagcgagccagctcgtcacttccattagcagttagtctcgggctcgttggccgtctttgctggggcagctacctagcagacgcatggcacacgtcgaccggccacggagccgcgccgtgctcgcggtcgccgtcgccgtcgccgccgcggcgctcctcctttttgccgcagcgggcgtcccgcgtgcggccggccagacgacgacgacagcggtggtggatctggacagctgggccgatcgcggcgcggcgtgcacgggcgcggtggaggcgtgcggcggcatcggcgcgacggccaggacggagctgggttccggcgggtacatcagctacgacgccatgagccgcgggcgcgtgccgtgctcgtaccgctgcgcgt

SEQ ID NO: 30679 - DNA, 405 bp, Zea mays
  unsure at all n locations
  Clone ID: LIB3059-046-Q1-K1-E2
gcggcagtgcgtagagaggatcgtcgaacagaacagcatgaagatggtcatcgttgtcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagacgagcgccatgtaccagccgctccggcaacagtgctgccagcagcagatgaggatgatggacgtgcagtccgtcgcgcagcagctgcagatgatgatgcagcttgagcgtgccgctgncgncagcagcagcctgtacgagcc

SEQ ID NO: 30680 - DNA, 357 bp, Zea mays
  Clone ID: LIB3059-046-Q1-K1-E3
cccacgcgtccgcgcgctcagtgtcatttgcagttcccggtagcagccatggcgtgggtgcagctgtctgggccgcgggtggtggcggctgcgaaaccggctgcgttgggcgggctcctcctgacgccgtcccttgcggtgccaaaggggcggagggccaggggcctcgtggtgagggccgccacggtcgtgtcacctaagtatacgtccataaaaccattgggagacagagtacttgtgaagatcaaaacctctgaggctaaatctgatggaggtattttacttccagtatcagttcagacaagaccacaaggaggggagattgttgcggttggagaagggagaagttttggaagt

SEQ ID NO: 30681 - DNA, 383 bp, Zea mays
  Clone ID: LIB3059-046-Q1-K1-E4
acacaatcggtgtatccaaggactctcaacttcgtgccgctaagattatcggggcgatatgtaatggctatgagccggtaccatcctctggtaaaacaagccaactcttccatttcgccaaggaaaaaatggcggctcgctgggctagacttcgtgcagctgtggcagcctcagacatctttactctcccttatgagctatctggctattgtagcttttccaatgagactgtcaccgccaatcctccatttgcatggcttcgctacaacaaggatgatattgaagatctggaggccttcctactcgagaaaaagattatcactcgaggtggcacaaggtttggagtggatgcaagggctgtcagaagtagtatggttgacaca

SEQ ID NO: 30682 - DNA, 416 bp, Zea mays
  Clone ID: LIB3059-046-Q1-K1-D11
cggacgcgtggggtacagcacggcctgaaagagctgagtggagcctgtcccgacgagcacatggtatccgtctacaacggcattccccatctgtgaccaactatctaaactctgcgctctaccgttgggctggtgatgccaatacatttgatggcgacacatgtattgagctcgtctgctccccaaacaaccctgatggtggcctccggaagcctgtcatcaaatccaagtctagcaagcctgtttatgacttcgcctactactggccgcagtacacacccatcaccgaggcagctgcccatgatatcatgctgctcactgtctacaaatgcaccggccatgccggcaccaggctgtggtgggcattggtgaacgatactaaggtggctcagaagatgatcaagcttatagagctc

SEQ ID NO: 30683 - DNA, 397 bp, Zea mays
  Clone ID: LIB3059-046-Q1-K1-B6
cccacgcgtccgagaacccaccccccaccatgacgagctcctcctctccttccagagaggcgctgagcaagatcgcttgcaatcggctgcacaaagagctcgccgagtggcagccaaacccccccgtcgggttcaagcacaaggtctacgataacctccaaaggtgggtaattgaggtcaccggagcggccggcaccctttacgccggcgaggcttaccagttgcaggttgacttccctgagcattatcctatggaggcacctcaggtcattcttctcaatccagcgccaatgcatccacacatttacagcaacgggcacatctgcttagatattctgtatgactcgtggtcgccagcgatgaccgtgagctctgtctgtatcagtatcctgtctat

SEQ ID NO: 30684 - DNA, 397 bp, Zea mays
  Clone ID: LIB3059-046-Q1-K1-B7
agcgactcctctgcgtgaggcctgctttcatcccccgtgggccgtggcgggggccgtggccgtgcgcaaaaaaacaaaccatcctcgattcgaccggaggggaaggagacgcgccgggagaagggggaagagacgcggcgaccatgtctccgatctgggtgttcgggtacggctcgctgatctggaacccaggcttcgcctacgacgaccgcgtcgtcggctttgtcagggactaccgccgcgtcttctaccaagggagcacggaccacaggggcacgccgcagttccccgggaggaccgtcacgctcgagcaccagcccggaacgacttggtggggagttgcttacagaataaaagagggaagataaagggatagctttggagtatcttggagtca

SEQ ID NO: 30685 - DNA, 320 bp, Zea mays
  Clone ID: LIB3059-046-Q1-K1-B8
gcaacatagaaagtggaatccagtagcaacaacagagcaacaatggcgaccaagatgttttcggctccttatgctccttgctctttctgcatgtgttgctaacgcgacaattttccctcaatgctcacaagctactatagcttaccttcttccgccataccttccatcaatgatagcttcagtatgtgaaaacccagctcttcagccctatgggctgcaacaagcaatcgtagcaagcaacatacctttatcacccttgctgtttcaacagtcgccagccctatctttggtgcagtcattggtacacaccatcagggcac

SEQ ID NO: 30686 - DNA, 393 bp, Zea mays
  unsure at all n locations
  Clone ID: LIB3059-046-Q1-K1-C1
gcaaaatctgcacgagagacagacgacgagatggccgatgcggaggacgccgccggggcgcgccgacgggccgccataaccgactaccgcaagaagctgctcaactgcagggagctcgagtcgcgcgtcggcaccgtgagagaaagccttaaaaatgcaaagagggattttaccaagactgaagacgacttgaaatctctgcagagcgtggggcaaataattggagaggttctccgacctcttgataatgaacgctttattgtgaaggccagcagtggtccccgatatgtggtcggttgccgaagtaaagtagacaaggagaagttgacatctggaactcgtggtgtacttgacatgacgaccttgacaataatgcgcactcttncacgggag

SEQ ID NO: 30687 - DNA, 418 bp, Zea mays
  Clone ID: LIB3059-046-Q1-K1-C10
ctcgcgtcgacgactgggctaccggcgcctccaccctccgcctggtgtccttcgccgtcgacgagcgcacaccagggtacagtacgtattgctcgtgatttgtgtaactacggagcaagctgcatacagcacaagatagaagatgggtatccttgagaggatcaaggagattgaggccgagatggctcggactcagaaaaataaagcaacagaatatcatcttggacaactgaaggcaaaactagcaaagttgaggacacaactattagagcctccaaagggttccagcggaggtggagatggttttgaagtcacaaagtttgggcatggtcgtgttgcacttattggatttcccagtgttggaaagtcaactcttttaacgatgttgactgggacacattctgaagctgcatcatat

SEQ ID NO: 30688 - DNA, 413 bp, Zea mays
  Clone ID: LIB3059-046-Q1-K1-C11
ggtatttctgtgttcattgctaccaatatctgtgagaatatcatctggaaggcatttagccccggaaccatcaacagtggtcgtggtgctgaattcgaaggggctgtcattgcactgttccatctgttgattacgagaaccgatacagtgctcgctcttcgtgaggctttctaccgccagaaccttacaaatgtgaccaatttgcttgccactgtcttggtgttcctcatagttatctatttccaaggcttccgtgttgtgcttccagtgagatcaaagaatgctcgtggccagcaaggctcatatccaattaagctgttctacacttcaaacatgcccatcattcttcactctgcgctgattaccaacctctattttatatcccagcttctctacaggaagtacagtggaaa

SEQ ID NO: 30689 - DNA, 419 bp, Zea mays
  Clone ID: LIB3059-046-Q1-K1-C12
cccacgcgtacgaggacgcgtgggcggaacccaaattccagcacgactcctggagccagcggcccaagcatacctagggcccttgagctccctcccgcatggcgttcccgcggagcctgtcggatacggccgacgtaccgcctgtggcgcccgcgcccggctcctttagcgtgtgcgcgtccgtgaccggactcacgcgtgtgccggttctcaccggcaggcggcgcaagtggagcacgctcgtggtctgctcaggacacgactaggagaagattaccaagcggtcagccgtcgatttgaccatcgaatgggagagaccaaagcctgtgacgagacctgatatcttccctaagtacaggccaatgaagacaccattaccgcatgcgtgaccagctgacgatccgatggatgatgatcaa

SEQ ID NO: 30690 - DNA, 399 bp, Zea mays
  Clone ID: LIB3059-046-Q1-K1-C2
cccacgcgtccgcccacgcgtccggtcaacctcgatcatggcgacccgactatgtgcgaggagttctggcgcggcacaggagatagcgcctcgatcttcatccctggttggcaaacaatgagctacttctccgacctcggcggcatctgttggttcctggagcctggattcgagcgcgaggtgcggcgtctccacaggctcgtggggaatgccgttgtagacgggtaccatgtgctcgtcgggacaagctccactcagctctttcaagccgtgctgtacgcgctcttaacttgcagtgacggcacaaccattgacctcgtctcaccggcaccggactactcgtcttacccatctgtgaccaactatctaaactctgcgctctaccgttgggctggtgat

SEQ ID NO: 30691 - DNA, 375 bp, Zea mays
  Clone ID: LIB3059-046-Q1-K1-C3
cctacaacagcaacaactgctttcatctagcccgctcgctgtggccaatgcacctgcatacctgcaacaacaattgttgcaacagattgtaccagctctgactcagctagttgtggcaaaccctgctgcctacttgcaacagctgcttccattcaaccaactgactatgtcgaactctgctgcgtacctacaacagcgacaacagttacttaatccactagcagtggctaacccattggtcgctgccttcctacagcagcaacaattgctgccatacaaccagttctctttgataaaccctgtcttgtcgaggcagcaacccatcgttggaggtgccatcttttagattacatatgagatgtactcgataatggt

SEQ ID NO: 30692 - DNA, 321 bp, Zea mays
  Clone ID: LIB3059-046-Q1-K1-C4
actttctgttgactctggtgctgattccttcaatgagcttttcaatagcgtggaagagactggaattactgttaggcctcaacagttggactccactgtgcaaccaaaccatgtgttcgctagccagggcaatgcaacacggaggctgcggctacaggttgagtgtagggagatcataactaaagatgagagtgaagatgaagtatcatgtgttctaactccagactgtttgaacgattctgttgaggagtccactgcagagaaggatgtggcttctgatggggatgaggctgagtcaacaaggattggtattagaagcca

SEQ ID NO: 30693 - DNA, 330 bp, Zea mays
  Clone ID: LIB3059-046-Q1-K1-C5
cggacgcgtgggcggacgcgtgggcggacgcgtgggacagcagcaacaggtactagcattcagccagctagctggtgtgagccctgctaccttcttgacacaaccacagttgttgccgttctaccagcacgctgcgcctaacgctggcaccctcttacaactgcaacaattgctgccattcaaccaacttgctttgacaaacccagcagcattctaccaacaacccatcattggtggtgccctcttttagatttcttatgagttatagttcaataataaagttttttgtctgatgtttgtggcttcccagaaataagaaagtacatttct

SEQ ID NO: 30694 - DNA, 405 bp, Zea mays
  Clone ID: LIB3059-046-Q1-K1-C8
ggaatgccggtcacaactactcttatgggcctcggcaacttccacagcgacgaccgactgtgtctgcgcatgctaggtatgcatggcacggtgtatgcaaattatgcagtggataatgccgatctgttgcttgcacttggtgtgcgggttgatgatcgtgtgacagggaagattgatgcttttgcaagcagggctaagattgtgcacgttgatattgatccggctgagattggcaagaacaagcagccacatgtgtacatctgagcagatgttaagcttgctttgcatggcatgaatgctcatgttgaaggaagcacatcatagaagagcttggactttggctcatggaacgatgagttggatcagcagaagagggaattccgccttgagtataaaacatgtaat

SEQ ID NO: 30695 - DNA, 415 bp, Zea mays
  Clone ID: LIB3059-046-Q1-K1-C9
cgcccgttcgtcttgtctagcgaccagcgcgcccaggccgcccggccatggagaagaagctgctgctgccgctggcggtggcgcacaagcacgcgcacggaggcggcggggagcggccgtgggcgcggccgtggcggtgggccaagaccgccttcttcgtcgcggcgatgctggcatcgctcctgctcgtctgcgcgccgccgctgctcgtcgtgctcctcgacctcgcgctcccgccggcgctcctcctccgcggcggggatggcggcggcggctcgctcgcgctggcggtcgtggcccaggcgcgggcgttcgacttccgctcctcgctcgtcgacctgcccgccgtctccgcggcgcgcgcgctgctcatcctctgcgcgtacgtggcgtgcggcggaggcggcgcgtacct

SEQ ID NO: 30696 - DNA, 360 bp, Zea mays
  Clone ID: LIB3059-046-Q1-K1-D1
cggacacttggtcagacgcgtcgcctgacgcctgaggcctcaatctcaaggactagcactgactacgatcactactgtaagcccatgtaccgtctggacccaacgacagctgatgacctgataccagcactcttggcgtaacactctcacactgttacaactgcgacatacgctggcattgaactcaacttgcattcacgataccctacaccattctaccaacagctcataattgttgtgaccgtcctttaactatgccctaatacaaccagaacaatattaagaggctatacactatctttgccgatctccagacgtacgaacaggcatctctcaaagcggcagcaggggggaaagaag

SEQ ID NO: 30697 - DNA, 409 bp, Zea mays
  Clone ID: LIB3059-046-Q1-K1-D10
gaagaacccgctcgacaccatgagggtgttgctcgctgcccttgctgtcctgggtctcgctgcaagcgccacctccacgcatacaagcggcggctgcagctgccagcctacggcgccggctgatttaccgacaacagtgcatatgccaactccggataagctgacagctacggagcatctcacaccgccgattcacctgccgacgccggtacacctgcaaccggcagaacatgtgccgacgccggctcatctgacgacgcaactatgccagtaccctactgaaccgagccggcgtgagcatgatccccaagcacacacatgcgcgcgccaacagccggatccaagcgcatgccagatgcatggaacctgcagcgttggcaggacgccgaccctgagacagtgcgaagag

SEQ ID NO: 30698 - DNA, 384 bp, Zea mays
  Clone ID: LIB3059-046-Q1-K1-B4
ggtttaactcgcaaagaagctcaagatgttcacattaagtttgcagagaaagcttgggtgcaacaggcggaagtaattcttgctgatgggaaattaacagaggctaaggctgaccagcttgctaagattcaaaagcaggtcggtttgcctactgaacatgcacagaaaatcattaagggtattacaacgacaaagttatcttctgcaattgaagcctctgttgctcggggtcagatcggtatacagcaggtccgaagattgaaggaagcaaacttccaactagatagcttgattgcggaaccgcagcgagaaagcatttataggaaaactgttgaagagctcttttttcaggtacaggggatttcgatgaagaggaaatgtatg

SEQ ID NO: 30699 - DNA, 418 bp, Zea mays
  Clone ID: LIB3059-024-Q1-K1-B4
cccacgcgtccgggttcacacaaattggagatgaactaccagatgatattactcttagagatgtcatggatactttacctaaagaggtatttgaaatcaatgatgtgaaggcttggacatcagttttgatatcagttacttcttatgcgctgggtttatatttcattgctaagtctccatggtatcttcttcccttggcttgggcttggacaggcacagcagtgactgggttttttgtgataggtcatgattgtgctcacaaatcattttcaaggaataagttggttgaagatgttgttggaaccttggctttcatgccattgatatatccttatgaaccgtggagatttaagcatgaccgacatcatgccaagacaaacatgttgatagaagatactgcatggcaacctgtttggca

SEQ ID NO: 30700 - DNA, 417 bp, Zea mays
  Clone ID: LIB3059-024-Q1-K1-B5
ccattcgcatctgcctccttttccttgtagccgaagaagagggaaaggaagggaggacagccgtcgccgccgccgccgccgccaccgtcaggatgcattccacgaacctcctgctcgaggagcccatccggatggcctccatcctcgagccctccaagcccagctacttcccggcgatgaccaagatcgtcggcactctcggccccaagtcgcgctccgtcgacacgatctccgactgcctcaaggccggcatgtccgtcgcccggttcgatttctcgtggggggacgccgcgtaccaccaggagacgctggagaacctcaagctctccatcaagtccaccaagaagctctgcgctgtcatgctcgacaccgtgggcccggagctgcaggtggtgaacaagagcgagaccccgatct

SEQ ID NO: 30701 - DNA, 414 bp, Zea mays
  Clone ID: LIB3059-024-Q1-K1-B6
cggacgcgtgggattcaatgtctaaggttgcagatattgaagctgctgagaagcagagaatgagagagaaagtccaaaagatcatagcacacgggatcaactgttttgtcaacaggcagttaatctataacttccctgaggaactctttgctgacgctggcatacttgcaattgagcatgctgactttgagggcattgaacggctggctcttgttactggtggtgagatcgcatcaacttttgataatccagagtctgttaagcttggtcactgcaaggtcattgaagagattatgattggggaggacaggctaatccatttctctggggttgcgatggggcaggcttgcaccattgtcctaaggggggctagtgagcatgtgctcgatgaagctgagaggtccttgcatgatg

SEQ ID NO: 30702 - DNA, 419 bp, Zea mays
  unsure at all n locations
  Clone ID: LIB3059-024-Q1-K1-B7
aattttctgaccaggttgtgaagtgggacttctggtacccgaccgagggcatccatagacgctgggacaatggcttccgtattactgcaatggctgccacgatggatcagtctgcgctgatcctaagcaagccaaggcgtcgcccaagagacgagacacangagactctgcggactacacagtttcccagtcaacatgtcaaggacaagtgggccaagaatctctaccttgctgggatatgctatgggcgaaaccgtgcctaacatcgtccgttgctgaccctaggctgtgttgatgtatattttgaagtttttatcaactgctaccaacatgaaccacaaggcaattggcctgtcgtaacccatgaaaattgaaaggggatgaattccgatgtatgtgcccgaacttgattctagggt

SEQ ID NO: 30703 - DNA, 422 bp, Zea mays
  unsure at all n locations
  Clone ID: LIB3059-024-Q1-K1-B8
cggacgcgtgggcggacgcgtgggtgcgtctccgccgtgcaggatctcaggggggcggatcttgtgatcgaggccgtcgtggagaacgaagacgtcaagaagaagctattcgtggagctggataaggtcacgaagccctcggacatcctcgcctgcaacacgagctccatctccgtaacccgcctggcttcagctaccaaacgcccctctcaggtgataggcatgcatttcttcaacccttctncggtaatgaaactgatcgaggttatccgaagagccgatacgtcagatgaagtgtttgcttgtggcagaactttctacgaaaggcttgggaaggcccgtatattgctcgaaggattacccaggattcatcgggaaccgcatcctcatgccgatgatcaacgaggccttctgggctctgt

SEQ ID NO: 30704 - DNA, 218 bp, Zea mays
  Clone ID: LIB3059-024-Q1-K1-B9
cccacgcgtccgcccacgcgtccgcccacgcgtccgagaggtcacacatatcagcatgagaactttattattacagtataaatcataaaaaatctagcagagtatttagtgttagattattgtagaaattacgatttagacttgtttctaaatgaataattgtatatataattagaagatcatgatcggttgagaaaaaaattggtggtattggaact

SEQ ID NO: 30705 - DNA, 389 bp, Zea mays
  unsure at all n locations
  Clone ID: LIB3059-024-Q1-K1-C10
cctcgaaaatcgccccgatggcgccgtccatctccgtcggcgccgcggcgccgtccggtgcatcggccccaaccccgaaaaaaccccaccaaggggagctcctgcgggggcggaacgcggagctggagcgggaagtggcggcgctgcggctggagctgggcgcggcgcggcgccgcgccgagacggcagaagaagccgaggagcggctgtgcgtgcagctcggcgacgccgaggtggaagcgctcgagctcgcgcgcgcctaccaggcccacgtccacgagctcgccagggagctcgncgccgcgcgcgcggccccgcacgcccgacagataggttctcgtgggctggtagtaggctactagtagctatagcgtgcggttcagcgggat

SEQ ID NO: 30706 - DNA, 200 bp, Zea mays
  Clone ID: LIB3059-024-Q1-K1-C11
aaaaaaaaaaaaaaaaaaaaaaaaaaaaaaaaaaaaaaaaaaaaaaaaaaaaaaaaagggaaaaaaaaaaaaaaaaaaaataaaaaaaaaaaaaaaaaaaaaaaaaaaaaaaaaaaggaaaaaatgttatgggatttaaaggtaacttaacttgaattgccgtggtttaacaataatgtggctgaaaaaaacttgagtaa

SEQ ID NO: 30707 - DNA, 401 bp, Zea mays
  Clone ID: LIB3059-024-Q1-K1-C12
gggtttctactgatggtagcagatagatgtgtagattgattgatacatcatcggccgggtggaagaattgataccacaaaaactgctatatatatatgtactgtgagtaaacagttaaaattaaacttgtgagatataccgtacatatgaagagctagctagtagtgagtgataaagtgggaaagtgaagcatatatagtcgtaaaaacaatcacatgaattgctattaggcaccatatatatgcacttaattatattggttgaggagacctaataaatcatttgacctaccatgcatataattgcagtgcgaagcaccatatatatatatgcagtggcagcatgcagaaaccaaaaaagtgtataggtacagtaagtaccagcagctaggctcagggctg

SEQ ID NO: 30708 - DNA, 281 bp, Zea mays
  Clone ID: LIB3059-024-Q1-K1-C3
ggccaaagtggattgaagggttgcttgaccagttgactgatatggtggtgaatgcagttctgtgcattcgcaaaccagatgaaccaattgatctattaatggtggaaataatgcacatgcgcaacaaatttgatgttgacacccgtctggttgagggtctggtcctggaccacgggtctcgtcaccctgacatgaagcgcagggcagagaattgtacatcttgacctgcaatgtctcattagaatatgagaaaagtgaaatcaatgcaggattttttactc

SEQ ID NO: 30709 - DNA, 417 bp, Zea mays
  unsure at all n locations
  Clone ID: LIB3059-024-Q1-K1-C4
atttgacctgggtgatgccgactattttaaggattaagggattccagaagttggttcgggcattgcaccatcttgagcaaaattatgaattcatgacatctgatcaccagtatatttcccggaaacatgaggaggataaggtgattgtgttcgaaaagggagatttggtatttgtgttcaacttccactgcaacaacagctattttgactaccgtattggttgtcgaaagcctggggtgtataaggtggtcttggactccgacgctggactatttggtggatttagcaggatccatcacgcagccgagcacttcaccgncgactgttcgcatgataataggccatattcattctcggtttatacaccaagcagaacatgtgtcgtctatgctccaatggagtgatagccgggtactc

SEQ ID NO: 30710 - DNA, 220 bp, Zea mays
  Clone ID: LIB3059-024-Q1-K1-C5
acataagcgtcagggtcggcttatcacttgactgatattggtgtgaatgggaaggagcaccagccatatgtgcacgtcaacttctaccgcatctatggtgatacgttcaagaaaccaaggcgtgcttatgagacggagcgtcttgatgctgcactgaaactagctactgagtattgcctgaggtgcaaacatgagcttatcaggagacactatgcactga

SEQ ID NO: 30711 - DNA, 345 bp, Zea mays
  Clone ID: LIB3059-024-Q1-K1-C6
gcgacgagcgcgtcacatcagccaattgaggagttacaagaacattcattggggcaggtaaccatacaagagatagcaacgcatcaattacaacaatctagaccagcactgagccaactagctgtgaagaaccatggcgtctactggcaacaggagctgatcgcatgcaaccaactagctctggctaacatagtggcataccagcaacaccaacagtcgcaacagcattctaccagcgctcagccaactagccatggtgaaccctgacgtctacctacgacagctacaactgagttaatgtagcacctataggtgagggtaacgcacctacatacctgcagcaac

SEQ ID NO: 30712 - DNA, 276 bp, Zea mays
  Clone ID: LIB3059-024-Q1-K1-C7
cgcaaattgcaccaagaaatccatcgagaggccgtcgacaggggaattaatggcgtggtcgtctagcaacagccaccgccgcctcatcctcgcagccgccgtcctgctctccgtgctcgcggctgccagcgccagcgccgggaccttctgcgtgccggggtgggccattccgcacaacccgcttccgagctgccgctggtacgtgaccagccggacctgcggcatcgggccgcgccttccgtggccggagctgaagaggagatgctgccgggagct

SEQ ID NO: 30713 - DNA, 251 bp, Zea mays
  Clone ID: LIB3059-024-Q1-K1-C8
aaaaaaaaaaaaaaaaaaataaataaataaaaaaaaaaaaaaaaaaaaaaatgagaaaggaaaaataaaaaaaaaaaaaaaaaaaataaaaataaaaaaaaaaaaaaataaatataaaaactaaaaaataaaaaaaaaaaaaacaaaaacaatactgcatgcctttatgggccataaagtacaacccgctaccgatctaactttggtactttaccaggcggacctgaagtatatttccttgcctcccgttt

SEQ ID NO: 30714 - DNA, 407 bp, Zea mays
  Clone ID: LIB3059-024-Q1-K1-C9
cacgctcaggagcaacgtcgctccgcagaccacgcagttcgtgcccacgcccgcctgcgtatccgcgccgaccgaggctcccgcctccgagcgaaaagcgccggcgccggcggagaaggcttcgaaggaagctcctactcctgcgcctgcgaagaaggaagcccctactcctgcggctgacccgctcgggagcgccagggggaaggtgcaggaggaggtgatgaaggagttcgcggccatcatggccagcggtacgctacgggccagcgaggcggcggcgctggccatgcgccgggtcatggagcgccacagcgacggcgccacgatgcagcagggctagacgaatcaggctgtgaacgcgttccggttccatgggaattggaatttgtcatctgcatgctgatgcc

SEQ ID NO: 30715 - DNA, 168 bp, Zea mays
  unsure at all n locations
  Clone ID: LIB3059-024-Q1-K1-D1
cccactcgttcgaccgcttcaacaggtcataaccttaactcnaattatcnctgcaacttcaaatcaaacgtgatagtcccaaaatatttcaggtctatcaccttcaagctattcaacttcaatccacacttcaatactcaatcacctttcacattcccataacttttc

SEQ ID NO: 30716 - DNA, 245 bp, Zea mays
  Clone ID: LIB3059-024-Q1-K1-D11
cccacgcgttcgtccacgcgttcgcccacgcgttcgcacaagtccaaggagtgccttgctctgatcctcatcatcaggaacaggctcaagtatgctctgaactaccgtgaggtcatttctatcctgatgcaacgccatgtacttgttgatggcaaggtcaggactgacaagacctaccctgctgggttcatggatgtcatttccattcctaagacaatggagaactacaggctgctttatgacac

SEQ ID NO: 30717 - DNA, 117 bp, Zea mays
  Clone ID: LIB3059-024-Q1-K1-D12
ggcaaattatggttcctccctgttcggttgagtggttgcattctggaggtatcttgttctggactcaggctaatgattgtgcgtgcgactgtttcagagtcatttcaaaggttatcc

SEQ ID NO: 30718 - DNA, 406 bp, Zea mays
  Clone ID: LIB3059-024-Q1-K1-B3
cttcgtcaacggggccgtcggcgcgttcgttgccggagcctctgtctgcggctacagaggaaagagtattcagtcagccctcatcggaggctcctgtctggctttcacatctgctgtgctggacattggcggcaatacgaccagagttgacaacggcaaagagtactatgcctacacaactgagaagaagcctgcaaattgattccaagtctgcacttctagcaaacaatcttgcacgccatcaactcagtgaatttgaagctgatgtgcagttttatgtctggtttgctgatgcaattagttcttaagcaaatccatggcaacttgtttatcgctgatgcttgagggatggaaatgacactcagaataatatttgatttgctttcttgtgatcgttgatcaccat

SEQ ID NO: 30719 - DNA, 427 bp, Zea mays
  Clone ID: LIB3059-023-Q1-K1-H8
cttgcatcaccacgagcgtgggctctctcctttctcgacgacgactgggccaccgtcgctgccgcctgccgcctgccgccctgcgccaggtgccaagcagccaggtgttcttggggcccttcgccggcgacgagcaccaccagctgaaagatggcgaggataccgtctctgaagagcctcaatgcgtttccacatgcggaagagcacttgttgaagaagacttactctggcgctgttgtgacaatttttgggctacttataatgattacactgtttgtgcatgagctgcagttttatcttaccacctacacggtgcatcagatgtctgtagatctgaaacgaggagaaactctgccaatccatatcaatatgtcatttccttctttgccatgtgaagtattgagtgtggatgcaattgacatgtctg

SEQ ID NO: 30720 - DNA, 403 bp, Zea mays
  unsure at all n locations
  Clone ID: LIB3059-023-Q1-K1-H9
agccgcgacactcaagagatacacctagaacaaggccttcagatgctcaagatattcaaggagcatgtcagcaagacgtccatcctggatgacttcgccttctatgagagtcgccagaagctgatgcaggataagaggtcgaaacagcagcaggtccaaaagcaggtctgggacagtaggacccccatttctgtcactggaagcgagcaacagcaggaagctgccaatgggaagcccaatccgtctgtaccaaacggtgtccctgcagaggtgaaggcggcgaaggcttctgcagagaacggcaccgncactccagctatttcctacgcggcaaaggtggcccaagcagcaacagagaaacctgtgctcgccaacggagtcgctaagaccggttagctggacc

SEQ ID NO: 30721 - DNA, 417 bp, Zea mays
  Clone ID: LIB3059-024-Q1-K1-A1
cggacgcgtgggcattccttcttcgctccttcgccgccgctatggttaagtactcgcaggagccgggcaaccctaccaaatcggccaaggccatgggaagggacctgagggtccacttcaagaacacaagggagacagcttttgcgcttcgcaagctgcctttgaccaaggctaagcgataccttgaggatgttattgctcacaagcaggcaattcccttccggagatactgtggaggtgttggtcgcaccgcacaagcaaagtctcgccactccaatgggcagggtcgctggcctgttaagtcagccaggttcatattggatttgctgaagaatgctgagagtaacgctgatgtgaaaggcttggacgtggacaacctctatgtttcacacatccaggtgaaccaagcccagaagc

SEQ ID NO: 30722 - DNA, 428 bp, Zea mays
  Clone ID: LIB3059-024-Q1-K1-A2
gaccaactagcaacatagaaagcacattagtgtaccaacaatggcagccaaaatattgggcttccttatgctccttggtctttctgcaagtgttgctaccgcaaccattttcccacaatgctcacaagctcctatagcttcccttcttcccccatacctctcaccagcggtgtcttcaatgtgtgaaaacccaattgttcaaccctacaggatccaacaggcaatcgcaacaggcatcttaccattatcacccttgttcctccaacaaccgtcagccctattacagcagttacctttggtccatttggtggcacaaaacatcagggcacaacaactacaacaacttgtgctagcaaaccttgctgcatactctcagcaacatcagtttcttccattcaaccaactggctgcattgaactctgctgctt

SEQ ID NO: 30723 - DNA, 261 bp, Zea mays
  Clone ID: LIB3059-024-Q1-K1-A3
cccatttcgacccatgcgtacggcgaacatacaaagcacattagtgtactaacattttcagccaaaatattttgcttccgtatggtccttgatctttctgcaagtgctgctaccgcaaccattttaccacaatgctcacaagctcctatagcttcctttctttccccatacctatcaccatcggtgtcttcagtttgtgcaaaccctattctttaaccctacagcatccaacaggctttttgtagcacgcatattaccttt

SEQ ID NO: 30724 - DNA, 424 bp, Zea mays
  Clone ID: LIB3059-024-Q1-K1-A4
aactagcaacatagaaagcacaatagtgtaccaacaatggcagccaaaatattttgcttccttatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggctgcattgaactctgctgctt

SEQ ID NO: 30725 - DNA, 425 bp, Zea mays
  Clone ID: LIB3059-024-Q1-K1-A5
caactagcaacatagaaagcacaatagtgtaccaacaatggcagccaaaatgtgttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcacaacaactacaacaacttgtgctagcaaaccttgctgcctactctcagcaacagcagtttcttccattcaaccaactagctgcattgaactctgcttctt

SEQ ID NO: 30726 - DNA, 415 bp, Zea mays
  Clone ID: LIB3059-024-Q1-K1-A6
cagataccaacatagacagcacaatagtctaccaacaatggcagccaaaatatgttggctccttatgctccttggtctttctgcaagtgctgctacggcgaccattttcccgcaatgctcgcaagctcctatagcttcccttcttcccacgtacctctcaccagcggagtcttaggtatgtgaaaacccaattcttcaaccctacaggatccaacaggcaatcacagctggcatcttacctttatcacccttgttccttcaacaatcatgagccctattacatcagttaccttcggtgcatttattggcacaaaacatcagggcacaacaactacaacaacttgtgctagcaaaccttgctgcctactctcagcaacagcagtttcttgcattcaaccaactaactggattgaac

SEQ ID NO: 30727 - DNA, 394 bp, Zea mays
  Clone ID: LIB3059-024-Q1-K1-A7
gtccctgatgctgcagcaactgttggccttaccgcttcagacgatgccagggatgatgccacagatgatgacgcctaacatgatgtcaccattgatgatgccgagcatgatgtcaccaatggtcttgccgagcatgatgtcgcaaatgatgatgccacaatgtcactgcgacgccgtctcgcagattatgctgcaacagcagttaccattcatgttcaacccaatggccatgacgattccacccatgttcttacagcaaccctttgttggtgctgcattctagatggaataattggggtggtcccaattatggagtgaccttgcattgggtgggaactaattataattaccattaaaccaggtttcttttaaaaaaaaaaaaaagggccggccg

SEQ ID NO: 30728 - DNA, 421 bp, Zea mays
  unsure at all n locations
  Clone ID: LIB3059-024-Q1-K1-A8
cccacgcgtgcggtttcttcctggcagagacgctgaagtacctgtacctacggggctgccctacatcagtcatattcttcgacgagtgggttttcaatactgaagctcacccattgagaattgctccagtaagtgataacaaaggcattggaacaccggtccgacaattcaggagaaaacagggaaagcctgagtaaccttggatatagagcagtggatttttgaatctgccgtctgattatgaccgtcctgacgatgtgctctgacacgagggaactttttgcctgaagcaataaggggtaaaaaattacgggatagattgcttagagcaaanatcataggtagaggatgatgttatatgcggcgcattgacctccgtgaggtcaagagccccatagaagcttctatctttggatttgct

SEQ ID NO: 30729 - DNA, 357 bp, Zea mays
  unsure at all n locations
  Clone ID: LIB3059-024-Q1-K1-A9
cggacgcgtgggcggacgcgtgggcggacgcgtgggctttgttcccatctctggttgcgaaggtgacaacatgattgagaggtccaccaaccttgactggtacaagggcccaaccctacttgaggctttggacttgatcaatgagccgaagaggccttcagacaagcccctgcgtctccccctacaggatgtgtacaagattggtggtattggaactgttcctgttgggcgtgttgagactggtatcatcaagcctggtatggttgttacctttggtcctagtggccttactactgangtgaagtctggttgaaatgcaccatgaggctctccaggaggcccttcttggtgacaatg

SEQ ID NO: 30730 - DNA, 413 bp, Zea mays
  unsure at all n locations
  Clone ID: LIB3059-024-Q1-K1-B11
ggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacngcggtggcgggcgccg

SEQ ID NO: 30731 - DNA, 393 bp, Zea mays
  unsure at all n locations
  Clone ID: LIB3059-024-Q1-K1-B2
cccacccttccgccaacccttcggccaagccttccggccaattggacccagaaattggttcaaaaggccgtcaccgggggaattaatggcgtcctcgtctagcagcagccaccgncgnctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgca

SEQ ID NO: 30732 - DNA, 418 bp, Zea mays
  Clone ID: LIB3059-023-Q1-K1-H7
cccacgcgtccggacacgtggtatgggagccgggcgcaagctcaagacccaccgcaggaaccagcggtgggctgacaaggcatacaagaagagccatttgggcaatgagtggaagaaacccttcgctgggtcatcccatgccaagggcattgtcctggagaagattggtattgaggccaagcagcccaactccgctatccgtaagtgtgctcgtgttcagcttgttaagaatggcaagaagattgctgccttcgtgccaaatgacggttgtttgaactacattgaggaaaatgatgaggtcttgattgctggatttggtcgtaaggggcacgctgtgggagatattcctggtgtccggttcaaggtcgtcaaggtttccggtgtgtctctgcttgcccttttcaaggagaagaaagag

SEQ ID NO: 30733 - DNA, 394 bp, Zea mays
  Clone ID: LIB3059-023-Q1-K1-G3
gcaacatagaaagtggaatccagtagcaacaacagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcaaggcacagcagctgcagcaactcgtgctacctgtgatcaaccaagtagctctggcaaacctttctccctactctcagcaac

SEQ ID NO: 30734 - DNA, 407 bp, Zea mays
  unsure at all n locations
  Clone ID: LIB3059-023-Q1-K1-G4
gccacccgtccgccaacgcgtccgtttttttttagatcaaaatgaggttgcagatgtacatttgaggtcaacagaaaactcttatactacattggtaatatgtgacaagagaaacaaaagttatatttaaaaaggctctgctagctccctattcagctataaacatttcagaggcaatatacattagaccgtggactcaaatccatctgttcactagctatatgtattagcagactgaatcaactcaagggcttgatgagcgtgtgctcttgcttgtcagagacgacctcattgtgacaatggcagattcgtttgcgcccaaccgcaccgncttgttgctcgcctgcagaaagctcgtgatggctcgccgcacgtacgcatcggcctgtttgactgtcatcttcttc

SEQ ID NO: 30735 - DNA, 412 bp, Zea mays
  Clone ID: LIB3059-023-Q1-K1-G5
cccacgcgtccgatggtcggcaacgccatgaccgtcaccggcgtcaccatgaagaagctccgggaggacgtcaagatccagaggaacctggtggagacggcgctggcgctgggcgcgacgccgcggcaggcgacgctgcagcaggtgaagcggtcgctggtcatcgcgctgtccccggtgatcgacagcgccaagacggtggggctcatcgcgctgccgggcgccatgacggggctcatcatgggcggcgcgtcgccgcttgaggccatccagctgcagatcgtcgtcatgaacatgctcatgggcgcctccaccgtcagcagcatcctctccacctacctctgctggccggccttcttcaccaaggccttccagctcgacgacagggtctttgcagactaagatacctgct

SEQ ID NO: 30736 - DNA, 394 bp, Zea mays
  Clone ID: LIB3059-023-Q1-K1-G6
gtccgcttcttgaggagtgtggtttggattgcaactaggatgtcagtgcatcagctgccccaatctgcatatgcttgaagtatattttctggtgtttgtccccatattcagtgtctgtagataagagacatgaaatgtcccaagtttcttttgatccatggtgaacctacttaatatctgagagatatactgggggaaaatggaggctgcggcaatccttgtgcagttgggccgtggaatacagcatatgcaagtgtttgattgtgcagcattctttattacttggtcgcaatatagatgggctgagccgaacagcaaggtattttgattctgcactgctcccgtgtacaaacttggttctcaataaggcaggcaggaatgcatctgccagtgg

SEQ ID NO: 30737 - DNA, 400 bp, Zea mays
  Clone ID: LIB3059-023-Q1-K1-G7
cccacgcgtccgcggacgcgtggggatcatttgcttcacctcttctgggagggctgcaaggctcatcgccaagtacaggcccaccatgcctgttctttctgttgtcattcctcgtctgaagacaaaccaactgagatggagtttcactggtgcttttgaggcaagacagtcgctgatagttagaggcctctttccgatgcttgcagatcctcggcatccagccgaatcaaccagtaatacaaatgagtcagttctgaaggttgctctagaccatggcaaggcatgtggtgtgatcaagtcccatgaccgtgttgtcgtttgccagaaggtgggagattcatcggttgtgaagatcattgagctggacgactagggcatactttgccgattttttttttga

SEQ ID NO: 30738 - DNA, 306 bp, Zea mays
  Clone ID: LIB3059-023-Q1-K1-G8
atgatcttaggcagattgagccacaatacattcaccaagcaatctacaacatggttcaatccataatccaggaggagcaacaacaacaaccatgtgagttatgtggatctcaacaagctactcaaagtgcggtggcaatcttgacagcagcacaatacctaccatcaatgtgcggcttgtaccactcatactaccaaaataatccatgcagcagcaatgacattagtggtgtttgcaattgaagaattgtgtctacctagccgttatactcctataacggtgttaagcaataaagtaccatacatt

SEQ ID NO: 30739 - DNA, 409 bp, Zea mays
  unsure at all n locations
  Clone ID: LIB3059-023-Q1-K1-G9
ctaccaagatattatccctccttgcgcttcttgcgctttttgcgagcgcaacaaatgcgtccattattccacaatgctcacttgctcctagttccattattccacagttcctcccaccagttacttcaatggccttcgaacacccagctgtgcaagcctataggctacaacaagcgattgcggcgagcgtcttacaacaaccaattgcccaattgcaacaacaatccttggcacatctaacaatacaaaccatcgcaacgcaacagcaacaacagttcctaccagcactgagccacctagccatggtgaaccctgtcgcctacttgcaacagcagctgcttgcatccaacccacttgctctagcanacgtagttgcaaaccagcaacaacaacaactgcaacagtttct

SEQ ID NO: 30740 - DNA, 418 bp, Zea mays
  Clone ID: LIB3059-023-Q1-K1-H10
ccaagagtgatggtcatgaggactatggcctccttgttagtgagaaggcaaggaaatacgccataatcaaggagcttgatgagccagttaccttgaaggatgggacagtggtcctgcagtttgaagtgagacttcagaatggccttgaatgcggaggtgcctacattaagtacatccgccctcaggatgctggatgggatgccaaggagtttgataatgagactccatacactattatgtttggtccagataagtgtggatcaaccaacaaggttcatttcatccttaagcacaagaatcctaagactggaaagtatgttgagcatcatctcaaattcccaccatctgtcccatatgacaagctctctcatgtctacacggctatcttgaagccagacaatgaggtcaaaattttggt

SEQ ID NO: 30741 - DNA, 411 bp, Zea mays
  Clone ID: LIB3059-023-Q1-K1-H11
caacaagcaacatagaaagtggaatccagtagctacaatagagcaacaatggcgaccaagatagtttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggggcagtcattggtacaaaccatcagggcacagcaactgcagcaactcgtgctacctgtgatcaaccaagtagctctggcaaacctttctccctactctcagcaacaacaatttcttcca

SEQ ID NO: 30742 - DNA, 362 bp, Zea mays
  Clone ID: LIB3059-023-Q1-K1-H2
cacgagaagagaagtttcacaacttctctccccatggcactcatcatcaagagcacaatcatgcgctgtgttcttggttcttggagccatatcttacacatccgtatattgcatcggtgcaatcggcacggaggacacccctgctcccaagccaaaacctgggatgccgtgcttccacgccggaacctcacagtacccctgcactactgacgggtgccgcaagttatgcgagcaccaacaccacaggagcgacatggcctactgtaaaagtatttcctcaggagaatgctgctgcccaaacgaaatgaggatgtggtcgtgtgtttgatgacgacaattattaaataaaacatgcatgattg

SEQ ID NO: 30743 - DNA, 460 bp, Zea mays
  unsure at all n locations
  Clone ID: LIB3059-023-Q1-K1-H4
taccgatccggagttccaaccaagccgtccgtggaaaacccagttcttaaaccttataggctccaacaggcaatcgcagcaggcaccgtacgttaataaccctggtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacattgaaccgtgctgcttatttgcagcaacaactattaccattcagccagctagctactgcctactctcagcaacaacaacttcttccatttaaccaattggccgcactgaaccccgctgcttatttgcagcagcaaatactactaccatttagccagctagctgcagcaagccgtgcttncttcttgacac

SEQ ID NO: 30744 - DNA, 186 bp, Zea mays
  Clone ID: LIB3059-023-Q1-K1-H5
taatataacaccacctaaatacaattcactctctccttattatacaacgactcacactactaaaaccttgtcattacccaacttaataccattccatcacatcctactttatacagcattcttaataacacaaacacccaaacctaactcccttttcaacatttccccaaccacaatctcaaatat

SEQ ID NO: 30745 - DNA, 335 bp, Zea mays
  Clone ID: LIB3059-023-Q1-K1-H6
attgagaccaactagcaacatagaaagcacaatagtgtaccaacaatggcagccaaaatattttgcttccttatgctccttggtctttctgcaagtgttgctaccgcaaccattttcccacaatgctcacaagctcctatagcttcccttcttcccccatacctctcaccagcggtgtcttcaatgtgtgaaaacccaattgttcaaccctacaagatccaacaggcaatcgcaacaggcatcttaccattatcacccttgttccttcaacaaccgtcagccctattacagcagttacctttggtccatttggtggcacaaaacattaaggcaca

SEQ ID NO: 30746 - DNA, 415 bp, Zea mays
  unsure at all n locations
  Clone ID: LIB3059-023-Q1-K1-G11
gctgcagggaacctgcggcgttggcagcaccccgatcctgggccagtgcgtcgagtggctgaggcatcagtgcagcccgacggcgacgccctactgctcgcctcagtgccagtcgttgcggcagcagtgttgccagcagctcaggcaggtggagccgcagcaccggtaccaggcgatcttcggcttggtcctccagtccatcctgcagcagcagccgcanagcggccaggtcgcggggctgttggcggcgcagatagcgcagcaactgacggcgatgtgcggcctgcagcagccgactccatgcccctacgctgctgccggcggtgtcccccactgaagaaactatgtgctgtagtatagccgctggctagctagctagttgagtcatttagcggcgatgattgagtaataatgt

SEQ ID NO: 30747 - DNA, 418 bp, Zea mays
  Clone ID: LIB3059-045-Q1-K1-H9
catgagggtgttgctcgttgccctcgctctcctggctctcgctgcgagcgccacctgcacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccggcgtcggttcatctgccgccgccaccatgccactaccctactcaaccgtcccggcctcagcctcatccccagccacacccatgcccgtgccaacagccgcatccaagcccgtgccagctgcagggaacctgccgcgttggcagcaccccgatcctgggccagtgcgtcgagtttctgaggcatcagtgcagcccgacg

SEQ ID NO: 30748 - DNA, 318 bp, Zea mays
  Clone ID: LIB3059-046-Q1-K1-A1
cgtccgcgcacgcgtccgcggacgcgtgggcttacgcgtttgctgacgcgtggaaggatttggaaatcgggaatttttaaaagcgtgctgctaatcatgcaaaggagcctaagaatgtaaatcgaatatcactgacgactaataaagtacaacctgatcaatcagcaagccaaccaaaacatgttgccaatgcctaaaagtaccgaggtcttattacatattagctagagagtatttcttacatacatccaaaacaaccgtttaaatattgataggatattgccatcgaatcaacacctggttcactattaaatacac

SEQ ID NO: 30749 - DNA, 233 bp, Zea mays
  Clone ID: LIB3059-046-Q1-K1-A10
aaaaaaaaaacaaaaacacaatttaaaataaaaaaaaaaaaaaaaaaaaaaaaggggaaggaaaaaaaaaataaatacacaaaaatgcaacgatgctattcttcaataaagataccgtaattcaattcactaggctcataactttacaacgtcgtcactgagaaaacatttgttctaccatcagcttaaaaacaattgcacaggtaagactttaaccagatggacttttatca

SEQ ID NO: 30750 - DNA, 414 bp, Zea mays
  Clone ID: LIB3059-046-Q1-K1-A12
cggacgcgtgggcagccaacaacttcgctcgtggtcactacaccattggcaaggagattgttgacctgtgccttgaccgcatcaggaagcttgcagataattgcactggtctccagggcttcctcgtcttcaacgctgttggtggaggaacgggctctgggcttggttctctcctcctggagcgcctgtctgttgactatggcaagaagtccaagctcggtttcaccgtgtacccatccccccaggtgtccacatccgtggttgagccatacaacagtgtcctgtccacccactctctcctcgagcacactgatgttgctgtcctgctcgacaatgaggccatctatgacatctgccgccgctcccttgacattgagcgcccaacctacaccaacctcaacaggcttgtctccc

SEQ ID NO: 30751 - DNA, 94 bp, Zea mays
  Clone ID: LIB3059-046-Q1-K1-A3
agcatgcttgttatgcttattttatcagaggattatcggttgtaataatagtggttaggagtcatggaattgttacaaaacaagcagttcttgt

SEQ ID NO: 30752 - DNA, 356 bp, Zea mays
  Clone ID: LIB3059-046-Q1-K1-A4
gctacgcgtccggctacatgccatattatctggggctttgcaaggctatggactgagctaggcacagatgtttaacttatgaaatggcacgactgccatcatgtcggacattacagttcacatgagattgaatacaagaatgctgtaaatgatgctttgaagaccgctcttgataccttctgactctgtaaccaactatatgactcagatatggatggtgaccaggagtattagatagcgcacttactgtgcactctacacaatgctgcagacaattcaaatgagagcttaagaagggttgctgacagttctagcgatcactgtttgttgcctagtgctaaggatcatgatcaatc

SEQ ID NO: 30753 - DNA, 323 bp, Zea mays
  Clone ID: LIB3059-046-Q1-K1-A7
aggacacctacgaatgtttacatcattagcagcaccctttattcatgagtgacttggtgcattacagagggagaatttattttcagataaacatgtccaaccttaatgtcagatttatattaatacccgaaactgtaactttgtgctctattcagagcacatcatcccagagaaccaataatttctactaccaattgtgcactgagtccattacgcctacctttgcgacccggacatccaatatgcaatttctacaatcgctactgcatgtgcaagatccgaccagattgcacattacatcacccaatgtgaaatgccatgta

SEQ ID NO: 30754 - DNA, 413 bp, Zea mays
  unsure at all n locations
  Clone ID: LIB3059-046-Q1-K1-A8
gattgggacagtggtggcacagaaggaatctgaaccagagaaacaggagactcgccaacgggttgaggaggacaggaaacctcagatcgaagcagccattgtcaggatcatgaaatcacggagggtgttggatcataacagcattgtagctgaggtcaccaagcaattgcaagcccgtttcttgccaaatcctgttgtcataaagaaacgcattgaatctctgattgaacgagagttcttggaaagagacaaagtagatagaaaattatatcgttatcttgcatagaaaactgtcatgagataattcattagcagttggcatccttctgctcttgtaaaacggttttctttatgctcgagttctctnttatcagttgcatttggccgctgggttcatagatgttcaaacattg

SEQ ID NO: 30755 - DNA, 375 bp, Zea mays
  unsure at all n locations
  Clone ID: LIB3059-046-Q1-K1-B1
gggaggacgatctaaatgaaattgtgcagcttgttggtaaagatgcgctggcagaggctgacgggattacactggagacagcaaagctactgagagaagattatttggcacaaaatgcatttaccccatatgataagttctgcccattctacaaatccgtttggatgatgcgcaatattattcacttcaacacattggcaaatcaggctgtggagcgggcagctggtactgatggccaaaagataacatacggtgtcataaaacaccgtttgggcgatctattttatcgcctagtatctcaaaagttcgaggatcctgccgaaggtgaagaagctttggtcggcaaatttaagaaactggatgatgacctnacca

SEQ ID NO: 30756 - DNA, 419 bp, Zea mays
  Clone ID: LIB3059-046-Q1-K1-B10
cccacgcgtccgcccactcgtccgcccacgcgtccgcggacgcgtggggttccagatattcgcagttgaccgggtcctcggagcacgatgaagtttgttgctgcctacttgcttgctgtcctcgctgggaacgccagcccctccgctgaggatttgactgccattctggagtcagttggctgtgaagttgacaatgaaaggatggaactcctgctgtcccaactgagcggtaaggacatcaccgagctcattgccgcgggcagggagaagtttgcttcagtcccatgtggtggcggtggtgtcgctgttgcggcagcttcacctgctgctggcggagctgctcctacagctgatgcaaagaaagaagagaaggtggaagagaaggaagaaagcgatgatgatatgggcttcagcctctt

SEQ ID NO: 30757 - DNA, 243 bp, Zea mays
  Clone ID: LIB3059-046-Q1-K1-B11
tcttcttttggctcaacatcgtcgaggtcacccgccatggcgataatctcgagttctccgtcggcatcgcctccggggacttcgggattgacaacttcctcgagtgcccaacctgtggctgcgggttcgactgcaacgacctgctcatgctccagaaggcggtggcagccaccgccaggctgcgcctgcgagtgccttctaaaattccactcatgcaaatccagatgggatagaagttcagac

SEQ ID NO: 30758 - DNA, 416 bp, Zea mays
  Clone ID: LIB3059-046-Q1-K1-B12
atcaatgccatgaacaagcttagcaccaagaagccatgggccctgtccttctcgttcggccgtgccctagatgcgagcaccctgaaggcctgggctggcaaggcggagaacgtggataacgctagagcggccttcctcgcctggtgcaaggccaactccgaggctaccctaggcacctacaatggtgatgctggcgtcgacaccgagagccttcacgtaaaggactacaagtactgacttgcttctctttgagatcccgtagtattggaactcctgcctgcgagtaggttgctgagtgtaggttgcttgttagagctattatattctgacatgaaaaaaacatgcttcctatgtggatgatggttatctatatattcgtatattaactactagtctctgttgttaatttccgtgta

SEQ ID NO: 30759 - DNA, 416 bp, Zea mays
  Clone ID: LIB3059-046-Q1-K1-B2
agcgactcctctgcgtgaggcctgccgtcatcccccgtgggccgtggccgtggccgtggccgtgcgcaaaaaaacaaaccatcctcgattcgaccggaggggaaggagacgcgccgggagaagggggaagagacgcggcgaccatgtctccgatctgggtgttcgggtacggctcgctgatctggaacccaggcttcgcctacgacgaccgcgtcgtcggctttgtcagggactaccgccgcgtcttctaccaagggagcacggaccacaggggcacgccgcagttccccgggaggaccgtcacgctcgagcaccaacccggaacgacttgctgggaagtggcttacagaataaaggaggaagataaggagatagctttggagtatcttgaggtcagggagaagcaatatgatgag

SEQ ID NO: 30760 - DNA, 415 bp, Zea mays
  Clone ID: LIB3059-046-Q1-K1-B3
cccacgcgtacgtccacgcgtccgcccacgcgttcgagcatctaacatggattacgaccaggagatcaatgctgtgctcaagaaggtggagcctaatgctcacaagatagtggaacatcgcaggaagtatgagaggttgagaaaagagagggaggaaaagagagcgcagcgtgatcggcttcgtcaacgtgcagaggcgcaggctgcttacgacaaggccaagaggaaggagcaatcgtcaagtcgctcatcaggaggtgcatctaccagaggctttccttggaggatgccctgtgggtggttccctagagggatgcccggtggaggtttcccccggggtggcatgcctgggggtttccctgggggtggcatgcctggaggtttccctggtggtgttcccggtaatgttgatatg

SEQ ID NO: 30761 - DNA, 413 bp, Zea mays
  Clone ID: LIB3059-045-Q1-K1-H7
ctccatcgtatctgttcgacgagatcgatgctgctctggatccacaataccgggcagcagttggaaatatgatccgccgtctagctgacatggctgacactcagttcattgcgaccacattccggccagagattgctaaagtggctgataagatatatgccgtgagacacaagaatagggtgagcaacatcgacgtggtgtccaaggaggaggccctggacttcatcgagcgtgatcagacgtacaatgctagctgaggctgctgctgctgtgtattgattgatctgcaggcagatgctaacgcagacaggatagttcttgttgcgttatggatattctggcctattgttgtagctgtgtatatgtgtgatgcagttaggtagctattggaccagcttgtttggcgcatcaac

SEQ ID NO: 30762 - DNA, 318 bp, Zea mays
  Clone ID: LIB3059-045-Q1-K1-G11
ctcagtcgttacactacccgttgtctttcgagatacggttatttaaaatgatgcaggagaacctattggatcttacagctatgtagactaaggactgatatggtctcgaccagtggacactaacattaccatctgctgcatgaacgattgacttatgtatcaagaggatgatataatatatagtatacaatgaacgtcgatgcaatacagtcaaaatggactagataattaccgcacacatagcataattatatatacgattgaccgtcgaggaattgataaggatcaaccagaagttgaaaaatatcacttaatgaa

SEQ ID NO: 30763 - DNA, 377 bp, Zea mays
  Clone ID: LIB3059-045-Q1-K1-G12
cccacgcgtccgcggacgcgtgggatctggtggtacgacgacatggcggccaccaggagcaagtcgtcgtcgtcctcgagctcggcgcagcgggcagctgccgcactgctcgtggccgccgccgtggcggtgtccgtcctggtggtgggcgcggcggcggtgtgcgacatgagcaacgagcagttcatgtcgtgccagcccgcggcggccaagacgacggacccgccggccgagccgtcgcaggcgtgctgcgacgcgctggcgggggcggacctcaagtgcctgtgcggctacaagaactcgccgtggatgggcgtctacaacatcgaccccaagcgcgccatggagcttccggccaagtgcggccttgccacgcc

SEQ ID NO: 30764 - DNA, 422 bp, Zea mays
  unsure at all n locations
  Clone ID: LIB3059-045-Q1-K1-G2
gctcgcgaagtatcggcggcggcaatcgctgcaggctagagcctcgttgctgagggggggagatggcgggtatgggcgatatgccgatgaggccggcgcggccgggcccgccgatgcagcaccgtggtccgcccccgatggcgcgccttcgccccgaaccaatcgaccgcgagaagacctgtcctctgctgctcagggttttcacaagggttgctggtcaccaccaaaatgaagagtttgcagtgagagggaaggaaccaaaggatgaagttcagatttacacatggaaggatgcgaccctncgcgagctcactgatcttgtgaaagaggttgctcttccagcaagaaaaaggaatgcaaggctttcttttgcatttgtatacccagacaagaatggtcgttatgttgtcagacaggtgggg

SEQ ID NO: 30765 - DNA, 409 bp, Zea mays
  Clone ID: LIB3059-045-Q1-K1-G3
ccgacgcgtacgcagaagatggaggttccgtttgccttaccccatccgtgaatcgggtggagcatcggatgacgaggaggaagacatccggaaaatcggggagaacctggtgcagacgcaggcgctcatgaacgcgctcgcgtactcgctgaagaacgttctgcagaaggtgatgccggagctgtggaaggacatcaaccacaagatccaccagaactggatctataactggatcttcctcacgctcctcgtcagcacctacgactacgccttgtaatacaccgtgtatgacaaggtttacgacaagttttacatgagatgttatatgcactgagctttagagactgacattggatttaacatttgcatgatcaagtttagttaaccgcctatatgtatgtatatattc

SEQ ID NO: 30766 - DNA, 417 bp, Zea mays
  Clone ID: LIB3059-045-Q1-K1-G4
cagaggggcctacttaacagggagtcagaggaatctgacgaagaagagaactactgttccattgaattgacgccaagtttgtttacatctgctgtcgataatgcataccagtccatacatgaattttcaaagcctttgatcaacatgatgaaggctgcaggttgggatcttgatggggctgccaatgcgatcgaacctggtgtggtttacacaagaagggctcacaagaagtttgcttttgaatcctatatttgccaaagaatgttcagtgggttccaagaggagagcttttctatcaaggattctaacatcagtgtttccaatgaggctttcttccaccaattccttgcagtgcgagccatggatcctctggatgtcctgagccagaaccctgattcagtattcggaaagttctgt

SEQ ID NO: 30767 - DNA, 412 bp, Zea mays
  unsure at all n locations
  Clone ID: LIB3059-045-Q1-K1-G5
aggattgggatcgtcaaaatccaacacaaattgtaacggagatgtgcggcttcgttgcaatcctttctggaacttttcttcttcacaagacaaaggatatggtggatggtatgtcgtacatttacgccccttttgacctgtaactactcacgttcataatgtcttattggttcgcgtcgtgacaggtctcccaccaaatttaccgattcggcttcctaaacatgcggatgaggacggctacgctgctgaaggaattcctctcagatccgctgctgacggtattccgctcaggtcaccaagggctacagattcatttcgctcgtcatgatgccccgctgagatttgcatgcgcactcaaatcgtgtcacttgaaggctcatacccagcangcgtcagtcctatatatacatgg

SEQ ID NO: 30768 - DNA, 417 bp, Zea mays
  Clone ID: LIB3059-045-Q1-K1-G6
caacaagcaacatagaaagtggaatccagtagcaacaatagagcaacaatggagaccaagatattttccctccttatgctccttgctctttctacatgtgttgctaacgcgacaattttccctcaatgctcacaagctcctatagcttccctttttcccccataccttccatcaattatagcttcagtatgtgaaaacccagctcttcaaccatataggcttcaacaagcaatcgcagcaagcaacatacctttatcgcccttgttgtgtcaacaatcgccagccctatctttggtgcagtcattggtacaaaccatcagggcacaacagctgcagcaactcgtgctacctgtgatcaaccaagtagctctggcaaacctttctccctactctccgcaacaacaatttcttccattc

SEQ ID NO: 30769 - DNA, 238 bp, Zea mays
  Clone ID: LIB3059-045-Q1-K1-G7
cacaacgtccttccacagagaccatctacgtctgatcttcgccggacagcagataggggatggtcttaccctagcagactacaagatccataaagagagcactctacagctggtactacacctccacggtggtcagctagccatgcttcacttatactgctgttgaacctatgtatcagcgtcgtcttgtgccaactggtgtacctatatatagatgtagtcctctaataaacatctg

SEQ ID NO: 30770 - DNA, 424 bp, Zea mays
  Clone ID: LIB3059-045-Q1-K1-G9
cccacacctggcaatacgtggggattctggaaccctagcgcctgatctccgcggcagcggccgaaatggcgaatcctgtagcggggctgcaggaccacctcaagctcgcgcgggactacacgctctagggcctctacgacacctgcatcatcttcttcgacggcgccatcgtgcagatcaacaagcatctaactactttggacgatgctctgattcgcacgaaatggatgaactgcaagaaagcaatctctgaagaagtggaaattgtgaaacaggtggatgctcaattaaagtcccttaaagaagctcctgcgacacggcggtcatcatcacctgctattcgggctaataaatcatttgttttccaaccgttggatgagtatgcaacatcttcaccagcaccctttgatgatcctgatgagtg

SEQ ID NO: 30771 - DNA, 402 bp, Zea mays
  Clone ID: LIB3059-045-Q1-K1-H10
cggacgcgtgggtttctccctactctcagcaacaacaatttcttccattcaaccaactgtctacactgaaccctgctgcttatttgcagcaacaactattaccatttagccagctagctactgcctactctcagcaacaacaacttcttccatttaaccaattggccgcactgaaccccgctgcttatttgcagcagcaaatactactaccatttagccagctagctgcagcataccgtgcttccttcttgacacagcaacagttgctgcctttctaccagcagtttgcggctaaccccgcaaccctgttacaactacaacaattgttgccctttgtccaacttgctttgacagacccagcggactcctaccaacaacacatcattggtggtgccctctttt

SEQ ID NO: 30772 - DNA, 387 bp, Zea mays
  Clone ID: LIB3059-045-Q1-K1-H11
gtgacacctgttggtagaaagaacctttaaagatacggaacgtgtcattcatggtcaaagcggtacctgtgctggataacatgttgcatgagtatcggcgcaacttataacacattgtcaaatgggactatgggagtccaaaacatattacatttaaccaattggacgaactgaaaccacgatgattatttgcagcagaaaatactactaaccatttagccagctagctgcaagcaaaccgagcttaaattgggacaccagttcaaggtgccgaatttatactagcagtgagcggataaccaagcatccctattacgactacaacaatgagtgcacgtacgtgcaacttgcaatgacagacccagcaaacccctaccatcaacacat

SEQ ID NO: 30773 - DNA, 380 bp, Zea mays
  Clone ID: LIB3059-045-Q1-K1-H2
ggatgagcagctacaccaacaaccttaaaattttgatgggcgacggtcgacttctgggctcgaagaggttattatgggatgtagttcgaggaggtccaaaagagcggaagcatctggcccaggtggaaacaaggagagcagaggatggcagtacccatccttctggccatctggcagccaacaggatcatcatgggtagaagagcagcaacacatccctgcctggcactgtatgtgccgcaccacctttgcatgaagccaaccttggagagggcaaccgaaagcagagagacacctgacatcatcattactagctaccatgataagatcatcatataaacctagctacactgtcgtacctaccatatctaggcttacaat

SEQ ID NO: 30774 - DNA, 410 bp, Zea mays
  Clone ID: LIB3059-045-Q1-K1-H3
gaattcccggtcgaccagctccgcgacgctccgacagctgtctcttcatatcacacctgtactccacaagagacttcctaggagctatatcaactctccgagccttgacaagacaggttgagagttgacggacaaaccaagctggatgcacagccagagctgttatccacattgtcccgcaaggtcaacacacactgcaatcatcgacagtgcattggtatgaccaatcagaccttgtgacaaccttggtaccattgcgcggtcaggcacgaaggaattcatggaggcacttgctgctggtgctgatgtgtccatgattggccagtttgctgtcggtttctactctgcctaccttgttgcagatagggttgtcgtgaccactaagcacaatgatgatgagcaatacgtgt

SEQ ID NO: 30775 - DNA, 308 bp, Zea mays
  Clone ID: LIB3059-045-Q1-K1-G10
ctctgtcgatattctgaccaatgacttaggagctgctgttgcttcaaatgatgcaggagaacctattggctctaacatctatgttgctggtggaatgattaaggacacaccgagtggaaactacattctatcagctgcctgatccattgagttatgtcccataagacgatatagtatatgctataaaagccatcgccgtcacacatagggaaaatggaccaactgattaccgcatgtatagcatgattaagtatacagattgaccgtcgtggaatagataggtatcggactgaagttgaaaaatatta

SEQ ID NO: 30776 - DNA, 410 bp, Zea mays
  Clone ID: LIB3059-045-Q1-K1-E5
cccacgcgtccgaaagcaatcacccgagcaaagcagtgcggagcgacgatccagcggcatttcgcattcgacgaacgaagcgccgccatctgatccgacacgcagcgcaatggcggcgggactgaagaggccgtcgttcgggacgcgggcgtggcggctgctgcggctggcggtgctgtgggcgcggaagggcggcgcggcgcacagcctgcgcctgcgcctgctccgcacgctccgccgccacggccacggcctcgccggcctgggcggcgcgcgcggcgaccggctccgctgcggcgagcgcgagtactccatcgacgagacgccggcgttccggttccgcaccccgtccgcgcgcgtgctccgtctcatcccctgcatcgcgccggccgtgccggacacgccgggcc

SEQ ID NO: 30777 - DNA, 416 bp, Zea mays
  Clone ID: LIB3059-045-Q1-K1-E6
cgaggtctatgcatggacaccagtaaagatctcaaatggcaattactttctggtaaaagggctactgaagacggaagcatattgctctctgctgcagtgccaatttttcatcaatcttttgatccaatccgtgaagctctcactggtagagatctgattcctgagatggttaacggttaagataaccgaacaacactttgttttggaggtatgcataaggtcctcatctcatgtaaatgtaccaggaggggacctaaggagggaatgcccgggcaagattacagtggaatgtactgcgcactgttaactgtgggctctaccgaggtgtcagcagcacttctgcgtgtaatgggaggcgatgtggccgagctgccactagttgctacaagccaggatgttcaagggctgggctactt

SEQ ID NO: 30778 - DNA, 179 bp, Zea mays
  Clone ID: LIB3059-045-Q1-K1-E7
ctcaatcattccatcgcgccatccatagcttcataccaattcttgatcgtgcagctgctggtggcagcctgagaccagacacgaggatgctgaccgagttcagcggctatgagttggaggtatccagaggagctagttgtggctgctagacatacgacttctgccaagactaacgctta

SEQ ID NO: 30779 - DNA, 415 bp, Zea mays
  Clone ID: LIB3059-045-Q1-K1-E8
gccacgcatacgttcccctattgtatggcttcatccaaagccactactggggagtgggtttcttgaggtacttccaagtgaagcagctgccgaactttctcttggcctcaccagtgctttctctcgcggtttattctattgtccattacgcaaaactgcttcaccggtgtttccagagaactagcgtccacacgcagattatcactgctctagagaaaaggccagttgtgtcgtatagaagatcagatgacgcgacaattttgagtgaacctcctgctggactcaccaagaaagcacaagggagctctaaggctaaacagagaaaaccagttgctaccgagatagctcctgcgacattgcatgacagtaccacgccagctaaccaaaacatctaagaggatcaggacgcgtgctc

SEQ ID NO: 30780 - DNA, 367 bp, Zea mays
  Clone ID: LIB3059-045-Q1-K1-E9
gagatgctgaagtacgctatctgcatagactcaaaggggcacaagttgcaccagatgctgtcaacactggctataaagctgatgatttcgctgatgacgcactctacaaaaaagagctgaccgaggatccttatgatcagagcatcctatatgaagtggactaagacttcagaatgtatcggtctggcaggactgataggaagaaatgacctgatgacaatgagtctatagaagattacgaatgttatatgggtgaaatgattcagcgaacgaaagctgattgatctccagatgggatgattgactgctaatgtcttacatcgagacatagagcctttcaaagcatgggtggggatggcgaatgata

SEQ ID NO: 30781 - DNA, 413 bp, Zea mays
  Clone ID: LIB3059-045-Q1-K1-F1
cggacgcgtgggctcgggaactggattcctgtgtcaacagatctattgatgacagcctcagggtccttccgcatgtggtggatcagatcaagtccaccctcaaaatcaattagaggcactattacttttagcaaatgaaccagatatagttgagaatgtttcatattcacattcgctgcataactccacattttcagagctcttaccgatattgatagaacatgatcaccctatcgtagttttttggattctgctcttaccacctagtcctggcatgtcaacagcgtcgacattttgaactctactgagaacacagcttaggcattgaaaggctggatgaacttgttgtgctacatgtacaagaatactcttacgtcttgtgattaaaaaaaaaataaataaaataaataaat

SEQ ID NO: 30782 - DNA, 408 bp, Zea mays
  Clone ID: LIB3059-045-Q1-K1-F10
cgcatccaagcccgtgccagctgcatggaacctgcggcgttggcagcaccccgatggtgggccagtgcgtcgagtttctgaggcatcagtgcagcccgacggcgacgccctactgctcgcctcagtgccagtcgttgcggcagcagtgttgccagcagctcaggcaggtggagccgcagcaccggtaccaggcgatcttcggcttggtcctacagtccatcctgcagcagccgactccatgcccctacgctgctgccggcggtgtccgacactgaagaaactatgtgctgtagtatagccgctggctagctagctagttgagtcattcagcggctacgattgagtgataatgtgtcacgcatcaccatgggtggcacagtcagtgtgagcaatgacctgaatgaacaa

SEQ ID NO: 30783 - DNA, 380 bp, Zea mays
  Clone ID: LIB3059-045-Q1-K1-F11
ctcacgcgtccgactacccgttcggtttaatcgctggagtgcataacaatgtgttggaattcgtaatcaaagaaatatgcatgactggtaacatcgctatgagacatgaaatgatgggtgcaacagcccatttctggcgatatcgtgctgcttattacccagacctgattgaagcgttgacgatacatgcaccgacatttgtatataggacaaattacgtcatttctagtcaaacatacaatgcttctactgatgcctatgctgtggaatcatacgatagctatttactgaaccatgtactctatgctcattgcagtgttctggatgaagatgatgcgactgaacatcgatcggatactctttccattcttgtgaatgac

SEQ ID NO: 30784 - DNA, 412 bp, Zea mays
  Clone ID: LIB3059-045-Q1-K1-F2
ggacgacagctcggcaacgactgtttcgaccgtcgctgccgtcctacttgccgggtggtgagatcttcttcggcccgttagccgacgacgagcaccaccagggcaaccagatacttcagtggcttcgcaaggatgtcctggtgcactattgagtctgatcctggtgtgttcactgagctgattcagcaaatgcaagtgaaaggtgtacaggttgaagagctttactctctcgatgtgggctctcttagtcaactgcggccagtatatgggctaattattctcttcaagtggatacccggcgagaacgatgaacggtctgttgtcagagatcctaacccaaaccttttctttgcgcaccaagtcatcactaatgcatgtgctactcaagctattctctcagttctcatgaatc

SEQ ID NO: 30785 - DNA, 412 bp, Zea mays
  Clone ID: LIB3059-045-Q1-K1-F4
agtcagtcagcttcagcaccacgagcacgatggccctcgcgctcgccacgaccccggtcgcgcatctcgcccttgccccgccctcgatcttcggctcccaatcctcgctgctgctgctcccgcgccgcgcgtcgcccgcccccgtctccctctctcaccgccgcatcatcgcggccgtcgcgaccaaggaacccgagctcggcggcggcggatcgggggccggcgacggtgccggagggagcggcggcggcagcgacccgaggggaggagggcaggaaggagacggggaggaagagaagatggggcagggcctgtccatgtcgcagaaactcaccctcgcctacgccgcgctcgtcggagctggtggtgtaatgggatatatgaagagtggaagccagaaatccttggctgc

SEQ ID NO: 30786 - DNA, 415 bp, Zea mays
  Clone ID: LIB3059-045-Q1-K1-F6
cccacgcgtccgcggacgcgtggggtagggagaaaggtttgccagagctactctcagcaacaacaatttcttccattcaaccaactgtctacactgaaccctgctgcttatttgcagcaacaactattaccatttagccagctagctactgcctactctcagcaacaacaacttcttccatttaaccaattggccgtactgaaccccgctgcttatttgcagcagcaaatactactaccatttagccagctagctgcagcaaaccgtgcttccttcttgacacagcaacagttgctgcctttctaccagcagtttgcggctaaccccgcaaccctcttacaactacaacaattgttgccctttgtccaacttgctttgacagacccagcggcctgctaccaacaacacatcattg

SEQ ID NO: 30787 - DNA, 108 bp, Zea mays
  Clone ID: LIB3059-045-Q1-K1-F7
cccacacgtaccatcacaagttgagttttaacaaagatttgccagaattccggtcgggaattacaatcacttaccttgctactaattacataaatgaattattctaca

SEQ ID NO: 30788 - DNA, 267 bp, Zea mays
  Clone ID: LIB3059-045-Q1-K1-F8
cccacgcgtccgagtacgcgttggattaaaaaaaacaaaaacataactgcgggaaggaaaacgtaagggaaaatcttgcaacgaagctgaaaggaccagtacagatcacatgattctacactccactaccatctatagcacgctaggggtgatcttctatcaagtccaagttgaactgatcagtattcacaatggctacgattgatcatggtgtaatttgcatgcaatgtatgacctgttggagaacaactgctgatgaggtagaac

SEQ ID NO: 30789 - DNA, 420 bp, Zea mays
  Clone ID: LIB3059-045-Q1-K1-E2
ggaaccactcctttttcatcctgtggtaagtacggccctggttgagaaccgccaggggtatcttatcaccagcatccagaacaaggcacacgaactggcaaactgtccaatgctcgtgacgttgtgtgaggaagctggagagatcctctcgaacatgaatcatccagcaagtgattgaccatggtgtctatatccgttaatgtgagaggataaggttgactctgaggtgccatctatgaagccgatgtcatgctaccattgctgccacagtgactgcattatgagatggtgggaatggctccaacatggtgacacacacccagaggagcacactactggagctcatactagcattataatgtgaatcatccaagacgattttgtactgtatgccgcacagtgttcgatgagaaggatatt

SEQ ID NO: 30790 - DNA, 407 bp, Zea mays
  Clone ID: LIB3059-023-Q1-K1-E9
attttcagcattcaaaaacacaccaagcgaagcgcactagcaacgacctaacaccaatggctaccaagatattagccctccttgcgcttcttgcccttttagtgagcgcaacaaatgcgttcattattccacagtgctcacttgctcctagtgccattattccacagttcctcccaccagttacttcaatgggcttcgaacatccagccgtgcaagcctacaggctacaactagcgcttgcggcgagcgccttacaacaaccaattgcccaattgcaacaacaatccttggcacatctaaccctacaaaccattgcaacgcaacaacaacaacaacagtttctgccatcactgagccacctagccgtggtgaaccctgtcacctacttgcaacagcagctgcttgca

SEQ ID NO: 30791 - DNA, 399 bp, Zea mays
  Clone ID: LIB3059-023-Q1-K1-F1
ggagaaggagctgaagcaccaagagctgtacaagaacgagcagtaccgcatgaagctgcacaaatcgaacgagcggctgctggcgctcgtcaagtcgagcctggacatcgtggtggccgtggggctcctgcagctggccccgaagaaggtgaccccccgcgtcacgggcgcgtttggcttcgccagctccctcatcgcttgctaccagctgcttccaagcccaccagcaaagcagagcaagtgaagactccgactccaagcacttgttaccaggaaaataatcccgccggataggtttgatttggttgccacatccccttgtatggcagactagactaatatatgtaatcatcatcataataatttgataaccatgccactatggataggtttggtcaa

SEQ ID NO: 30792 - DNA, 398 bp, Zea mays
  Clone ID: LIB3059-023-Q1-K1-F10
ggaggttgaggatcttgaggctgctggtattcatgtgatccagattgatgaggcaggtctaagggagggtctgccactgcgcaagtcagagcatgcattctacctggactgggctgtccactctttcagaatcaccaactgcggagtccaggacaccacccagatccacacccatatgtgctactccaacttcaacgacatcatccactccatcatcgacatggacgcagatgtgatcaccatcgagaactcccggtccgacgagaagctactgtccgtgttccgcgagggtgtgaagtacggagctggaatcggtccaggtgtctacgacatccactcgcccaggatcccctccaccgaggagatcgcggaccgcgtcaacaagatgctcgccgtgc

SEQ ID NO: 30793 - DNA, 407 bp, Zea mays
  unsure at all n locations
  Clone ID: LIB3059-023-Q1-K1-F12
agccgttccagtccaatccgcctcagtccaaatctaatcgccgggtttaggcagaaggggcgggacgcggcgaggtttaggcggggtttgttttgtcccttccgtgcgattctgctctccgcgcgggaggcaagtactgacggaagcgaaggcgaaggcggaggagggggtccccggcggtggaagtggaacgcgccgatgcgcaagtttcaggactccatcaaggccctccaggccgacatcgatcacgccaatgcgatggcgtcggaattcctgagggactacgacggctcggtcatccagatgcgggtggcgtacagcgccgtcgcgcatttncttctgcagtggaccgactgcaagctcgccggcgcgctcggcctcctcaaggttatgctatacaaggtgtg

SEQ ID NO: 30794 - DNA, 289 bp, Zea mays
  Clone ID: LIB3059-023-Q1-K1-F2
aaaaaaaaaaaaaaaacaaaaaaaattataataaaaaaaaacaaaaaaaaaaaaaaagtgaggtttaaaaaaaaacaaaaaataaaaaaaaaaaaaataaaaaataaaaataaaaaaaaaaaaaaaaaaaaaataaaaaaaggcaaaaattttttaaaattcaaaaatttagggcgccttctttttaaggaaaaaacttttttttagggtaccttaaattaattaacttttcatttttttaaaaaaattttaattttaaaaacccttttttaaaaacaattttatttgg

SEQ ID NO: 30795 - DNA, 391 bp, Zea mays
  Clone ID: LIB3059-023-Q1-K1-F3
atattattgttcttagtcatcgcacaagactcttgtcaacaagaccaacaacaggatgaggactaccgtgcatgctgcgctttgcattgtgcttgtgataatgtcttcaacactgtcatcttgcgaggacgatgagaaggtatctatcgcatgtgacacaggatgcaatgccgcgatctcccgcctcaaatgcttcctgatggcctattctgaagggaaagtgttggtcagcagcaactgcgaaacgccgaccaggtgcggctgcgtgtttcgtcacaaacaagatgcagcccttatcgccggcgacgttggcaacaaaaagggatactgatggcaaacgtgtactttttggttgaataatactgctagaattaatatgggcaccaacgaa

SEQ ID NO: 30796 - DNA, 428 bp, Zea mays
  Clone ID: LIB3059-023-Q1-K1-F4
cccacgcgtccggcaacatagaaagcacaatagtgtaccaacaatggcagccaaaatattttgcttccttatgctccttggtctttctgcaagtgttgctaccgcaaccattttcccacaatgctcacaagctcctatagcttcccttcttcccccatacctctcaccagcggtgtcttcaatgtgtgaaaacccaattgttcaaccctacaggatccaacaggcaatcgcaacaggcatcttaccattatcacccttgttccttcaacaaccgtcagccctattacagcagttacctttggtccatttggtggcacaaaacatcaaggcacaacaactacaacaacttgtgctagcaaaccttgctgcatactctcagcaacatcagtttctttcattcaaccaactggctgcattgaactctgctg

SEQ ID NO: 30797 - DNA, 402 bp, Zea mays
  Clone ID: LIB3059-023-Q1-K1-F5
agaacatgcaaaactaccagaacagagatgggcctcctgcccaaggtttcaatggccccccacctccacctggccagaaccagatgccatcccaccatagtcagggcaacatgtctccgcaaccaccacatgctggtggtggccaaccaaactatcagccccaaatgcaaaacccacagacgggctacaaccctggcggtgctcctcactaccagcaaggtgctgctcctggctaccaaggtggacctccggggtatcaaggtggttaccaagggaacccaggccctgcctaccaaggtggtaacactggttatcaaggtggcaacccaccaccttcctaccaaggaagcaacccaccaccttcttaccagggaagcagcccaccaaggccaccaccttcct

SEQ ID NO: 30798 - DNA, 424 bp, Zea mays
  Clone ID: LIB3059-023-Q1-K1-F6
cccacgcgtccgcggacgcgtgggccaagggtggcgccttattagctgcatctggctccatgctggcctaatccatttggttgtgaacatgctaagtttgctgtttattggaatccgccttgagcagcaatttggatttgttcgcattggtgccatatacctactgtctggttttggtggcagcgtgttgtctgcactcttcctacggaacagctacatctccgttggtgcttctggagctctatttggcctgctgggatccatgctttctgaactactcatgaactggactatatactccaacaaggcagcagctataataacactgttgtttattattgcactcaatttggctattgggatactacctcacgttgacaactttgctcacattggtggattcgcgacgggtttcctcttgggt

SEQ ID NO: 30799 - DNA, 377 bp, Zea mays
  Clone ID: LIB3059-023-Q1-K1-F7
attgctgccatttagccaacttgctttgacgaatcctaccaccttattgcagcagcccaccattggtggtgccatcttctagattttttatgctttatactgtaataataaagttctcatactgatatgtgcaacttctcagtaataaaagattagagatctatattttaagttcaaaaaaaaaaaaaaaaataaaaaaaaatcaaagtaaaaaaaaaaaacaataaaaaaaataacaaaaaaaaactaaaaaaaataaaaaaaaattactttaggaaaaaaaaaaaaggggtgcccttttaagaggaccaagttttataacccgggctttgcaacgtaaagattttttttagggccccctaaattcaaatcacggg

SEQ ID NO: 30800 - DNA, 417 bp, Zea mays
  unsure at all n locations
  Clone ID: LIB3059-023-Q1-K1-F8
cgcgaggaggcgtgtgaggccagcggctttgcgatgacagcaccagcggacaaggggaagaaggccaagactgatgccgacggcggcgaggagaacgaacagatcgacggcgtcctcgtcctctccatcgagaagctccaggagatacaggacgagctcgagaaggtaaatgaggaagcaagtgacaaggttatggaggtggagcagaaatacagtgagatccgcagacctgtctatctcaagaggggtgacattatcaagaccatcccggacttttggctcacagcgtttatgagccatcctctattaagtgagcttctgactgaagaggaccagaagatattcaagtacttagactccattgatgtggatgattctgatgttaaggcaagatactccattcatnctaacttctct

SEQ ID NO: 30801 - DNA, 415 bp, Zea mays
  unsure at all n locations
  Clone ID: LIB3059-023-Q1-K1-F9
ctttgcccgggctcattcccaagccctactgggcaacaagccacagtcgaagtcaggatgagggaagggcatgcagtcaatatccacatgttctgtgcgcgtaggccaggcatcctgctgtcgacaatgacggccctcgacagcctaggcctcgacatcgagcaagcggtcatcagctgcttcaatggctttgcgatggacgtgttccgagctgagcagtgcgcggatggtcctggaatggtgcctgaagaaattaaggccgtgctgatgcacaccgncggccttcacaacgcaatgtagccggtccgaanacgggccaccgncaggatgacgacgatcctnctnctttctactaagggcttcggttcggaagcggcataagattaagctgtggtggtcattggttttctgggga

SEQ ID NO: 30802 - DNA, 414 bp, Zea mays
  Clone ID: LIB3059-023-Q1-K1-G10
cccacgcgtccgcagaaacacaccaagcgaagcacattagcaacaacctaacaacagtggctaccaagatattatccctccttgcgcttcttgcgctttttgcgagcgcaacaaatgcgttcattattccacaatgctcacttgctccaagttccattattacacagttcctcccaccagttacttcaatgggcttcgaacacccagctgtgcaagcctataggctacaacaagcaattgcggcgagcgtcttacaacaaccaatttcccagttgcaacaacaattccttggcacatctaacattacaaaccatcgcaacgcaacagcaacaacaattcctaccagcactgagccacctagccatggtgaaccctgccgcctacttgcaacagcagttgcttgcatcaaaccca

SEQ ID NO: 30803 - DNA, 410 bp, Zea mays
  unsure at all n locations
  Clone ID: LIB3059-023-Q1-K1-E8
cccacgcgtccgcggtcatggggcagaaccttgccctcaacattgcagagaaagggttccccatctctgtgtacaacaggacaacctccaaggtggacgagaccgtgcagcgtgccaaggcagaaggaaaccttcccgtctacggcttccatgaccccgcgtcctttgtgaagtccattcagaagccacgggtggtgatcatgctcgtcaaggccggcgcgccagttgaccagaccatcgcgacgctcgcagctcacttggagcagggcgactgcatcatcgatggggggaacgagtggtacgagaacacggagaggagggagaaggccatggaggagcgcggcctnctgtatcttggcatgggtgtctctggaggaaaggagggtgcccgcaacggcccgtccttgatg

SEQ ID NO: 30804 - DNA, 359 bp, Zea mays
  Clone ID: LIB3059-023-Q1-K1-D12
ccacaacagcgaaggagaaagcagaccaacctagccacccagggagaaagaggccaataaggaggggagagtgtcgtcatggcttccattgtcgcttccaggagggccgttcctctagttcgcgctctggagaagctcatcgcagcgtcctacgctcccgggactggctccgccctcatgccggtggcagtcgccgggctgcctgcgcggctacaacaccggcgctccgctccgacgctacgaaggggccgagtcggaagacgatagcgtccgcgagtacgatgggcggcacggcggccgggactacgctgtgcccagcctgttctcagatattttccgtgatccgcttagtgcgccgc

SEQ ID NO: 30805 - DNA, 261 bp, Zea mays
  Clone ID: LIB3059-023-Q1-K1-D3
gcaacgcatccggggacacctgggcgttcacatgtgaaaacaactgcaaaacaaacggagagtgcccagaatgttgcaggtctatcacacgacaatctattaacctggactgcagttttagggactccatgacctttcacattcccatacgagtgccagttgtactatagtgcaagctaaatgcaatgaacttgccgaatgttatcaagcaaccgactgagaaaacactgcagttgcctactttattgcctacgaaggata

SEQ ID NO: 30806 - DNA, 368 bp, Zea mays
  Clone ID: LIB3059-023-Q1-K1-D5
ctccccctacgcagcaaggatcgagaaaaggaggggcacgttgaattgaagaggaagagaggatcaaggagatgttcttccccatctcctcttgaagatttcttggggaaaccctaggtggctacactccagatcatgtctagtacatttcttcttcttcgatgaaggtgcttgttgctcatcaaggggagtgggaagtagcagcacatccaccttcattctcataataatgctgcccagacgcagccatgatttaattagaaacttcttgacaaaggatgtttgtttttaactagtcgtgcgcactgattaattcagttcatgttgttatggttgtcttcccattgctagcagattattaatgtctt

SEQ ID NO: 30807 - DNA, 420 bp, Zea mays
  Clone ID: LIB3059-023-Q1-K1-D6
atatcttttagtaacctttcaataggcgtcccccaagaactagtaaacatggcaaaactgttgagcctgttcttagccctctcctttgtagcagctatgtttgccataggctctcatgctgatggagactgtgagaatgacctccaaagcctgataagtgactgcaagacatacgtgatgttcccagctaatccaaaggtccctccttcggatgcttgctgtggtgtcatcaagaaggcaaacgtttcttgcttgtgctccaaggtcaccaaagaaactgagaaggttgtgtgcatggagaaggttgtgtatgttgctgagcagtgtaagaggccatttgagcatggcttccagtgcggaagctacaaggttccagcaaactgatgatatcgcaagagggaagcgcttgacgtagtcttt

SEQ ID NO: 30808 - DNA, 374 bp, Zea mays
  Clone ID: LIB3059-023-Q1-K1-D7
aaaaaaaaaaaaaaaaaaaaaaaaaataaaaaaaaaaaaaaaaaaaaaaaaaaaaaaaaaagacaaaccatataaaagataccaaacttacatacacatacatgcgacgtcctatcttttggcatcctggctccctaactcatttcactggccgtctgtttacaacttggggcccgtaaatccccttccctgccccaacttaatcaccttcctgcccgtccaacttttgcctgctcccattttaacccactggccccaactgctcgtccttcccaacggtttctcagccttaatgcccattgggaccccccttgcaaccggtcattcagcctgactgctgattgggtcacgccctgtgtggccgcttcacttgc

SEQ ID NO: 30809 - DNA, 425 bp, Zea mays
  unsure at all n locations
  Clone ID: LIB3059-023-Q1-K1-D8
aatgtttttctccctcaaaaataaagcaatgggccatggatgatttggcacagactatgtcatggctggacagccaagaagagaagccagagccaagtgaactgaaggctatagcctctgaaggggtaatcacttgtctgcaagatgccatagaatccctcgagcaaggcaatgatatcaagggagttgcagagcagtggagcttcgtcccccatgttgtcaacgagctgttaaaactagatggaggcggaaaaggtgcggctctgcccaaagagcagctacgtcaactagcaggcaagtgcaagaagatctaccaggccgagtttgctcgcgcggacatgggcgacaagaacaagggtaggcatcaaaatgacccacatgtgaccgagcaccgcaggaagaccaataccanatcagaggatgac

SEQ ID NO: 30810 - DNA, 418 bp, Zea mays
  unsure at all n locations
  Clone ID: LIB3059-023-Q1-K1-D9
gtgatccggcgctgagaagagatggctaagatcgccgcagccgccgcggcggcggcggcgctgtgcttcgcggccctggtggccgtggccgtctgccaaggcgaggtcgagcggcagaggctcagggacctgcagtgctggcaggaggtccaggagagcccgctcgacgcgtgccgccaggtcctcgaccggcagctaaccggcggcggcgtcggcggcccgttccggtggggcaccgggctccggatgcggtgctgccagcagcttcaggacgtgagccgcgagtgccgctgcgccgncatccggagcatggtcaggggctacgaggaggccatgccgnctctggagaaaggcttgtggccatatnggccggcagcagcagccgccgccgcagggaggaggaggaggacaggggggc

SEQ ID NO: 30811 - DNA, 402 bp, Zea mays
  unsure at all n locations
  Clone ID: LIB3059-023-Q1-K1-E12
aataaaaaaagcactgccaaatctcccaccaatgaaagttgctagagatggcacaatcatggagtgggcacaagactttcaggatcctgagattcatcacagacatgtgtctcacttgtttggtctttatcctggacatactatgtcacttgaggaaacacctgacctctgcagagctgttgccaatagtctttataaaagaggtgacgaaggcccaggctggtctacttcatggaaaatggtcctatgggctcgccttcacaacagtgaccatgcatacaaaatgatactgcagctaatcactttggtggatccagaacatgaggtttcaagagaaggaggcctatacagcaatctgttcactgcacatncacctttccaaatngatgcaaattttgggtt

SEQ ID NO: 30812 - DNA, 240 bp, Zea mays
  Clone ID: LIB3059-023-Q1-K1-E2
ccatattctaaggcacttgttaccactactgatgccattgactaccattaactcatctatgcaattctgattgaagcaacaatggttctccaacttgctatctgtgccgaccctaatgctacagcaactattcacctcaccgatttatcccagccatatgctacttattatcccacgatttatgccacatctgacaataattccaattccaaaaattaagccatctataataatacccac

SEQ ID NO: 30813 - DNA, 403 bp, Zea mays
  Clone ID: LIB3059-023-Q1-K1-E3
gaccaacaagcaacatagaaagtggaatacagtagcaacaatagagcaacaatggcggccaagatattttccatccttatgctccttgctctttctgcatgtgttgctaacgcgaccatttttcctcaatactcacaagctcctatagctgcccttcttcccccataccttccatcaatgaccgcttcagtatgtgaaaacccagcccttcaaccctacaggctccaacaagcaatcgcaacaagcaacttacctttattacccctgttctttcaacaatcgccagccctatctttggtgcagtcattggtacaaaccatcagggcacaacagctgcagcaactcgtgctaccagtgatcagccaagtagctctggcaaacctttctccctactctcagcaac

SEQ ID NO: 30814 - DNA, 415 bp, Zea mays
  unsure at all n locations
  Clone ID: LIB3059-023-Q1-K1-E4
gcactacccgtgccatggcacacagggctgttgatgctgtattaggtccccggaccattcagcatgagactgttgcctcagaagctgctgctgctgcccctgcccctccagtgatgaatgctgatgcttgcagcatccattctaaggctttccaagattgtctcaacaactatggcagcgagatcagcaattgccagttctacctagacatgctgaacgagtgccgccgtggtggtgtgtctgcctaaactgcctctgggattattcatggattntcttttcgtgatgttatctcattaaataagataccgtgaaacttttgtctccacagcttgaagctgaacttcctgggattaatacattttgttatcctatgctgttggagcagacttttgtctctggatcatanatattt

SEQ ID NO: 30815 - DNA, 421 bp, Zea mays
  Clone ID: LIB3059-023-Q1-K1-E5
cccacgcgtccgcggacgcgtgggatcctgaatggatagattttccaagaggtccgcaaagacttccaagtggtaagtttattccagggaataacaacagttatgacaaatgtcgtcgaagatttgacctgggtgatgcagactatcttaggtatcatggtatgcaagagtttgatcaggcaatgcaacatcttgagcaaaaatatgaattcatgacatctgatcaccagtatatttcccggaaacatgaggaggataaggtgattgtgttcgaaaagggagatttggtatttgtgttcaacttccactgcaacaacagctattttgactaccgtattggttgtcgaaagcctggggtgtataaggtggtcttggactccgacgctggactatttggtggatttagcaagatccatcacgc

SEQ ID NO: 30816 - DNA, 425 bp, Zea mays
  Clone ID: LIB3059-023-Q1-K1-E6
gtcaactagccatggtgaaccctgccgcctacctacaacagcaacaactgctttcatctagcccgctcgctgtggccaatgcacctacatacctgcaacaagaattgttgcaacagattgtaccagctctaactcagctagctgtggcaaaccctgttgcctacttgcaacagctgcttccattcaaccaactaactatgtcgaactctgttgcgtacctacaacagcgacaacagttacttaatccattggcagtggctaacccattggtcgctgccttcctacagcagcaacaattgctgccatacaaccggttctctttgatgaatcctgtcttgtcgaggcagcaacccatcgttggaagtgccatcttttagattacatatgagatgtactcgataatggtgccctcataccggcatgtg

SEQ ID NO: 30817 - DNA, 289 bp, Zea mays
  Clone ID: LIB3059-023-Q1-K1-B5
catgatttttatagatccatttttcttattcctatcactaaacttctaatgggctctagtacatgtatatacaaatacaaatgttaaaatctgataatacatattaatagttaaatgccgaactttaacacctcacagtgtaactactagtccacctaacctactattcaaatagaaatgcgtgtcttttattcatattattatgccagttgacacaaatcatatattcttaaccggtctattgaatttaactacttttaatataagatagaactgtattatattactt

SEQ ID NO: 30818 - DNA, 412 bp, Zea mays
  Clone ID: LIB3059-023-Q1-K1-B6
caaaagcacactctgttcggcttgccttgtcctttttccttgccatatggctaccaagatggtcctgtgtcgctttgtagccctcgcggctgtcgccttgctcctccggcctggcccggcccgtcaggctcaaccgaaggttttccggttggtccaacaacccggccccgacttggtacggcgcagccaccggcgctggaagcgacggtggtgcatgcgggtaccagaacgccgtcgaccagccgccgttctcgtccatgatcgccgccggcagtccatccatcttccagaacggcaagggctgcggcgcctgctatcaggtgaaatgcaccgggcacgcgtcgtgctccggcagcccggtgaccgtggtcctaaccgacgagtgccccggcggcgcgtgcctggacgagcc

SEQ ID NO: 30819 - DNA, 383 bp, Zea mays
  Clone ID: LIB3059-023-Q1-K1-B7
catctcaagagcgactagagagaggaagagaacaagcgataagctcatctcgcacgcaagatgcgggctccaaggggcggaggcggctgccgcggcggccaggagcatgtggagctgatccctggcatccccgacgacgtggccgtggactgcctggcgcgcgtcccccacgcctcccaccgcgcgatgcgccgggtctgccgcggctggcggagcgccgccgcggcgccggccttcgcgtcggcgcgcgccgcggcgggcgccaacgaggacctcgtgtacctgatgcagttcgggaacccgtccggcgacgacgggcccaaggacggcgacgacgggcccggcagcaccccggcgtacggcgtggcggtgtacaacgtgac

SEQ ID NO: 30820 - DNA, 366 bp, Zea mays
  Clone ID: LIB3059-023-Q1-K1-B9
ccctccgagcatcctagtgactcccatggctccggccatgtcggcgcagttcacaagaataaccttcagcaacctgtttgtccgtcgggctggcccaggcagcacggagctgaccgtggagggaaggccatccgaccagctgggcaggagaaacctcactgacagccccgtatttgacggccgtggccctgacgccagcctcgtggctcgcgtacagggagtcgctacccagatgggcgacgtgcgccagttgtacaccgtcgtgttccaggagaggccgctcaagggctccacgctcgtcaccgaaggcgcgatgacagaagggtcagacgagtgggcgatctacggtggaactggagtgttcgc

SEQ ID NO: 30821 - DNA, 312 bp, Zea mays
  unsure at all n locations
  Clone ID: LIB3059-023-Q1-K1-C10
cgttcccaccgcaggcaaagcttttcaggccgcccaaccgaacaaccgaaaaaagggcgccgcggncgcgaccaaaagccgatggatccgaagatgacagaggtgacccagatgttcgcccgcttcaaggcggcctacacccgcaacgacctcgacgcctgggtcaccctcctctcacaacttaaggtccatcttaccaaattccccaacctttcggcctcatttgagccgacacctaaagccctggaggagcttaaacttgcaagggacatttattagccttcctggtgttttgagtgtgaaacttgagga

SEQ ID NO: 30822 - DNA, 416 bp, Zea mays
  Clone ID: LIB3059-023-Q1-K1-C11
ccttaacaaaggggcaaatgtgtcacaactgacagctgatggcaggagcgcaattggtatttgtcggaggttaacaagagcaaaagactacaatacaaagatggagcagggtcaagaatcaaataaagataggctgtgtatagatattctagagagggagatgatgcggaatcctatggcggtggaagatgccgtcacctcgcctttgttggcagatgatcttcacatgaagcttctctacctggaaaacagagttgcatttgctagattgttctttcctgctgaagccaaggtcgccatgcaaatcgcacaagcagacaccacagaagaattcggcggtatagttgcagttgcagcaagcacttccggtaaactgagggaggtggaccttaatgagacgccagtgacacaaaaca

SEQ ID NO: 30823 - DNA, 334 bp, Zea mays
  unsure at all n locations
  Clone ID: LIB3059-023-Q1-K1-C12
cagagttgatgaagtactcacaatggaaccaaacaaggttgatgatatttcattgaagcgattgccattaacgtttcagtgtttagatactggaggtttgtaccttcttgatgaaggcttcactttcctagtgtggttaggtaagatgctcccgnctgaacttgtgaacaacattctttgagtgagcttggcaaactttcctgacctatcaaagattgtattgagagagtgtgacaatgaattgtcaagaaatttcatgaaattactaagatccctgcgcgagaaggatccttcctatcaccagctatgccgtgtggtgcgacagggtgaacag

SEQ ID NO: 30824 - DNA, 367 bp, Zea mays
  Clone ID: LIB3059-023-Q1-K1-C2
gaggacgagaaggccaaccacgtggtcccttcttcccgcaccaaaaacccgccctcgccgccgcagactggcgaagattccgaggcttccgacgaagaagaggatagggaggcggacgacgagatgccgcagacgaagcccgctccaaatcaagaggtggaggctaagggtgcaaagcggccgagcgcgccgttccagcgcacctggtcgattgacgacgacttccgcatcctggaggccctcgctgcgcaacgcctggagcacggcgcgctgcctcaaacggacgtgctggccgacgccctcgctggcaagctcgacaatagtggctgcagcctctccgatctcaagaggaaggtgaagagtttgc

SEQ ID NO: 30825 - DNA, 157 bp, Zea mays
  Clone ID: LIB3059-023-Q1-K1-C3
gcagctctagtggctgacgagatcgcggagcaggctgaattcttctcctttggaacgaacgacctcacgcagatgacctttggctacagcagggatgatgtggggaagttcatccccatttatctggctcagggcattcttcagcatgaccccttcg

SEQ ID NO: 30826 - DNA, 411 bp, Zea mays
  unsure at all n locations
  Clone ID: LIB3059-023-Q1-K1-C4
aaattttgctctggctcanagttgaaagagatgggtgggagtgggattnttgctgagaagagtgaaaatggtgatgcagaggcttcaaatcctgctaacaagacttccttgaggatgtaccagcaaactgtgactggaataagccagatttcatttagcgctgatggaagtgtttcaccaaagaagccatcgtcgatacctgaggtggctaagcagcgagagcttagtggcaccctggaagatgctgatgctaaaatcaataagcagctttctgaagccaagaccaaggagcttagtgggagtgacatctttggtccgccttctgagattccagcgaggccattggctgctcgtaacatggagctacaaggaaatgtcgatttttcactttcacagcgaagcgtncacaca

SEQ ID NO: 30827 - DNA, 383 bp, Zea mays
  Clone ID: LIB3059-023-Q1-K1-C5
cccacgcgtccgcccacgcgtccgcgcaaattgcaccaagaaatccatcgagaggccgtcgacaggggaattaatggcgtcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagc

SEQ ID NO: 30828 - DNA, 415 bp, Zea mays
  unsure at all n locations
  Clone ID: LIB3059-023-Q1-K1-C6
cagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacattgaaccgtgctgcttatttgcagcaacaactattaccattcagccagctagctactgcctactctcagcaacaacaacttcttccatttaaccaattggccgcactgaaccccgctgcttatttgcagcagcaaatactactaccatttagccagctagctgcagcaagccgtgcttccttcttgacacagcaacagttgctgcctntctaccagcagtt

SEQ ID NO: 30829 - DNA, 367 bp, Zea mays
  Clone ID: LIB3059-023-Q1-K1-C7
cggacgcgtgggtcagcatgttcagtttcgctctccccagagagaaccaaaatttagcaaccatccaccacaagttgggtatggtgcccaattgcctcagtcaggatatcgctttgagctccaacaagaacaggttggatttggaaatcaagtagcacaacctgcacatgtggcttcaagacaaccctcatatgacacccgctggagctcgagagattatggatcaacccaagggcaactgggatatggtggtcctcaagcacagtcatatgaatctcagttaccacatcaccagggaagttttggtatgccacatgtccaaaataacaatggcttctatcgatacaaccctggatattgcccatct

SEQ ID NO: 30830 - DNA, 416 bp, Zea mays
  Clone ID: LIB3059-023-Q1-K1-C9
caactaaccagatgccaattgggatcttacagttcaagagcgagcaatagtaacatgtatttggatgacgttcttttggcaaatacaagatgcctgcaattcgtacagccatatggcatcaaaagtttcttaaagcctgataatttcaaatggtatcagtttgcagtttttccccgtagatacacaggatatatagctgatacggcctcatcgtttctagtttgtacatgctattaagttggggcatgagggatgcaatactagctaggtgaggttacttatatgtggttatggtgttctatagatggatcgatggtatacatgttctgattttgttcccaacacccgacaagattttgaatgtatttgtacagatgtttttgagttacattttgccttttgtaactttgaagatg

SEQ ID NO: 30831 - DNA, 383 bp, Zea mays
  unsure at all n locations
  Clone ID: LIB3059-023-Q1-K1-D1
nccacgcgtccgcctttctccctactttcagcaacaacaatttcttccattcaaccaactgtctacactgaaccctgctgcttatttgcagcaacaactattaccatttagccagctagctactgcctactctcagcaacaacaacttcttccatttaaccaattggccgcactgaaccccgctgcttatttgcagcagcaaatactactaccatttagccagctagctgcagcaaaccgtgcttccttcttgacacagcaacagttgctgcctttctaccagcagtttgcggctaaccccgcaaccctcttacaactacaacaattggtgccctttgtccaacttgctttgacagacccagcggccttctaccaacaacaca

SEQ ID NO: 30832 - DNA, 427 bp, Zea mays
  unsure at all n locations
  Clone ID: LIB3059-023-Q1-K1-B4
aaactgttgagcctgttctaagccctttcctttgtagcagctatgtttgccataggctctcatgctgatggagactgtgagaatgacctccaaagcctgataagtgactgcaagacatacgtgatgttcccagctaatccaaaggtccctccttcggatgcttgctgtggtgtcatcaagaaggcaaacgtttcttgcttgtgctccaaggtcaccaaagaaactgagaagggtgtgtgcatggagaaggttgggtatgttgctgaacaatgtaagaaggcatttgagcatggcttccaatgcggaagctaacaggttccagcanactgatgatatcacangagggaagcgcttgacgtagtctttagatttcaattgttgcagccgatcaaccttcttagggttgtataatatgaagtcaatgttg

SEQ ID NO: 30833 - DNA, 300 bp, Zea mays
  Clone ID: LIB3059-045-Q1-K1-D1
aaatattttggccccctatacccattgagccaattggaaatgcttcttccggctgcaattttcccgcaaagttaccagcctccttatcatacatttttatcgcgtaccttttaccagcgttgactctcaaatgtgaaaacccaattcttcaaccctacacgatccaacattctatggcatcacgcatcttacctttatcacccatgatccttcaacaatcatcaggcctattacagcctatccatttggtgcatttattggcgcaaaacattatggcacaacaactcgtgctagcaaacc

SEQ ID NO: 30834 - DNA, 418 bp, Zea mays
  Clone ID: LIB3059-045-Q1-K1-D10
gccacgcatcagaaaacctactccattgctcttttcttatagccgccgccggaacgggttgctagcgctctgagctctcatactagcgtccgtggaaggtcgtctagacatggtctccgagacggagacgttcgtctaccagacggagatcaaccagctgctatcgctcatcatcaacaccttgtactccaacacggagatctaacttagggagctcatttcaaactactacgatgcatagaataagatcaggttcgatagttagacggacaatagcaagctggatgcccatcctgagcatttaatccacatcgtcactgacaaggccaacaatactctgacaatgattgacagtgtcataggtatgaccaagtcagacctagggaacaaccttggtgccattgcacgatctggcaca

SEQ ID NO: 30835 - DNA, 421 bp, Zea mays
  Clone ID: LIB3059-045-Q1-K1-D11
cgctgaagtccacatgctagacatcgagtgcttctccttcctgaaccgcgcgttgggaaacgacatggcgccgatcttagtaatcgcaacgaaccgagggatcacgtatatccgcgggacaaactaccgctcgccgaatgggatcccgccagacttccttgaccggctactgattatcacgacgcatccctacacggaggatgagatccggaagatcctggatatccggtgcgacgaggaagacgtggagatgtccgctgacgccaaggttctgctcaccaagattggtgtggagacctctctgcggtatgccatcaaccttatcacatctgccgcgctagcctgccagaggcgcaaggggaaggtggtcgagatggaggacattagccgggtgtaccaactgctcctggacgtgaagcgg

SEQ ID NO: 30836 - DNA, 196 bp, Zea mays
  Clone ID: LIB3059-045-Q1-K1-D12
cccacgcgtccgaaaaaaaaaaatatatagaaaatacatagaaaagataacggaacggaaaaaaacaagacatgataacaagctaacctatactacaaataaaacatcatacgatatcatctataatatcttacgcatgttaaaactgagctattcaatcatatacgcttcagcaagcaatctcagcacgcaacat

SEQ ID NO: 30837 - DNA, 386 bp, Zea mays
  Clone ID: LIB3059-045-Q1-K1-D2
cgaacgcgtccgcgttgacaaccgctaaatcgtttccgcgtcccgcgacaggacgggtaagctctggaacaccctcggtgagtgcaagtacaccatcggaggtgacctcggtggcggcgagggccacaacgggtgggtctactgcgtcaggttctccccaaacacatttcagcccaccattgtctccggttcctgggaccgcaccgtcaaggtctggaaccttacgaactgcaagctgcgcttcactctcgatggtcatggcggatatgttaacgccgtcgtcgtgagccccgatggatcgctctgcgcctacggcgggaaggacggtgttactctgctgtgggatttggctgatgggaagaggctgtactcgctggatgcgggct

SEQ ID NO: 30838 - DNA, 407 bp, Zea mays
  Clone ID: LIB3059-045-Q1-K1-D5
ccctgctgcttatttgcagcaacaactattaccattcagccagctagctactgccgactctcagcaacaacaacttcttccatttaaccaattggccgcactgaaccccgctgcttatttgcagcagcaaatactactaccatttagccagctagctgcagcaaaccgtgcttccttcttgacacagcaacagttgctgcctttctaccagcagtttgcggctaaccccgcaaccctcttacaactacaacaattgttgccctttgtccaacttgctttgacagacccagcggcctcctaccaacaacacatcattggtggtgccctcttttagattgcttattagttgtaattcattattaaagttttttggatgatgtatgtggccaaccagaaataagaagtta

SEQ ID NO: 30839 - DNA, 415 bp, Zea mays
  Clone ID: LIB3059-045-Q1-K1-D6
cagaaacacaccaagcgaagcacattagcaacaacctaacaacaatggctaccaagatattatccctccttgcgcttcttgcgctttttgcgagcgcaacaaatgcgttcattattccacaatgctcacttgctccaagttccattattacacagttcctcccaccagttacttcaatgggcttcgaacacccagctgtgcaagcctataggctacaacaagcaattgcggcgagcgtcttacaacaaccaatttcccagttgcaacaacaatccttggcacatctaacaatacaaaccatcgcaacgcaacagcaacaacaattcctaccagcactgagccacctagccatggtgaaccctgccgcctacttgcaacagcagttgcttgcatcaaacccacttgctctggcaaa

SEQ ID NO: 30840 - DNA, 243 bp, Zea mays
  Clone ID: LIB3059-045-Q1-K1-D7
cccacgcgtccgctcacagagttcattgcttaacagcaagcctgactcgccgagatgctgataggatcctgctgctacattcgcccatgttccacgcgtctcaggtcttattagccgcatgccactcatgagcttgaatatgcatactcatagagcatgtcatgagtatataatgacatagacagagaggagccgtaagtgtaaatacaggaaggttatatgctatatatgcgacgatcaaaa

SEQ ID NO: 30841 - DNA, 416 bp, Zea mays
  Clone ID: LIB3059-045-Q1-K1-D9
gaaaaggccctgatcattggtataaaggagaggtcgttgggctggcgactcgcatggatgaatttttactgtgtgcgaggcacttctgggagccggggaccgtccgcgggaaggcatggcacagttggctcttaagctttcctgacttttggttcttctacattgaggctgttgaccatggagcctttttttttgagtagtagaagtatgcaaattgaaccatggaagttctatacgacccacaatccgggtcaacattttgttgtagatatacatgtctggtagttctctgttgtcctcctggtcgacccgaactccttattaagagctgatacttggtacccatggtatgcatgtgaaattctgctccatgtacagagagtagaaaagaaaatgaaagccgtgctagctgttat

SEQ ID NO: 30842 - DNA, 367 bp, Zea mays
  Clone ID: LIB3059-045-Q1-K1-E10
cccacgcgtacgcttacctttatcacccttgttcctccaacaatcatcagcgctatgacagcagttacctttggtgcatttaatggcaccaaacattcgggcaccaccacctacaacaacttgtgctagcaaaccttgctgcctactctcagcaacagcagtttcttccattaaaccaactagctgcattgaactctgctgctaatttgcaacaccaactaccattcagccagctagctgctgcctacccccaacaatttcttccattcaaccaactggcatcattgaactctcctgcttatacacagcaggcacatcttatacaatacacccatatctctggtgagagctgttgtgtttttttcac

SEQ ID NO: 30843 - DNA, 412 bp, Zea mays
  Clone ID: LIB3059-045-Q1-K1-E11
cactgccttacgtgggccaggtctgagtttgagggtctacttgagaagactggcagggaagtaaatgctttcctgtcgaaccctggcggatatgcaaccgcagcaagaactgctggtgatgcacaggctagggatcaacttgagcgagttattgaatgccttgagacagacaagtgtgagacattccaagactgtattacctgagcccggcttaagctagaggattatttctgcaaccgtgtcaagcagctgacattcactttacccgaagatgcaatgactagctcctgtgctccttactgatctgctcctaagcggttcccgcgacctctgcagttctcgtctagcgactcaagtcaccttaacttcttgatggctgcatctgtattaatggcagagacatgtggaatac

SEQ ID NO: 30844 - DNA, 411 bp, Zea mays
  Clone ID: LIB3059-045-Q1-K1-E12
aatatcttggtctccattgttgctctattgttgctacatgtgttgctaacgcgacgattttccttaattgctaacaggctccaatagcttccttttttccccaatactttccatcaataatagcttcagtttgtgaaaaccaagctcttaaaccatataggcttaaacaagcaatcgcagcaagcaacatacctttatcgcccttgttgtgtcaacaatcgccagccctatctttggtgcagtcattggtacaaaccatcagcacacaacatgtagaaactctcgctctacgtgatatcaaccaagcatctggggcaaacctttcttactactctcagcaacaactttttctattatacaaacaacttactatgctgaacgctgcttattatatgcaacaactattaccaa

SEQ ID NO: 30845 - DNA, 401 bp, Zea mays
  Clone ID: LIB3059-045-Q1-K1-C9
cacacgcgtgcgcattgaaccattctaactatgggaacgcagctgcaacaagcactgggcgacgtagccacgttgtactctatcgcttacttggaacaactgctggttgcattcaaccgactcgctttggcaaacgtagctgcataccaacaacaacaacatgttgcaacagttggtgtcagggctcaatcaactagtcatggtgaacatctatcgactacctacaacagcggcagcttgcatcatttagcccgatcactattggcaatgcatgtacatacatgcaataacaggcgttgcaacaactgaagctgtaacaaattgtaccagctcttactgagctagctgactcaaaccctgctgcctacttgccacatctacttgcattcaaccaactgact

SEQ ID NO: 30846 - DNA, 407 bp, Zea mays
  Clone ID: LIB3059-045-Q1-K1-B5
aaggatcccaggcagatatctggccatctacttattcaaaatgcagagtcaactgtttaccagacctcatagtgtttcctaaactaaaactgctcgacacaagcagctagcaattctccacatagagaatgttacgcaacagtacaaatatatagtaacacatcttcaggaaagtattagcaggaagagttgtcacagaaatgttctcaaaacggcctaaaagggtgcaggcatgggcaagcggaacaactttcaatcacaagttcttgaacgcagactcatgaggaagcttctgcggcgttagcctagccaacaatgccttgttcgagaagtggtcagcatcaacaaagtagaagttcccctcagccttaaaggtgacaaagggcctgtttgtttcaggaggcctg

SEQ ID NO: 30847 - DNA, 410 bp, Zea mays
  Clone ID: LIB3059-045-Q1-K1-B7
attctcatccccgacccccgcaccgcagcgtaaaccctagtccccggcggcgaccgggcggcctccgctgcgctctgactggtgcgcgtttagacgaggagctgcggcggccaagaccaatcgaccatggctacccgtatccagtttgagaacaactgtgaaattggtgttttctccaagctgacaaatgcttactgtctggtagcgattggagggtcagagaacttctacagtgcctttgaggctgagcttgcagatgccatccctgtggtcaagacctctattggtggcactagaataataggccgactttgtgttggaaacaagaatggacttctattgccacatactacaaccgaccaagagcttcagcatctgaggaattgcttgcctgatcaagtggtggttca

SEQ ID NO: 30848 - DNA, 416 bp, Zea mays
  Clone ID: LIB3059-045-Q1-K1-B8
cccacgcgtccgatatgatcaaaacgaatacgaagagttgtggagaaaagcgactgaccggaagcctgtgagcagacaaagacacttgcgaagtgcatcaaagcgctatgttacagaggcaatcgggctgtcatatctcgattattaccctgatctagccgtacaaataaagtcatctgatcgtgataagagactgagcctactacgaaggttcttcttctggttggagaacttgtgccatgagggagcctacatgccctggatctccaaacctctagcttgcaaccccatttcaccggatggatgaatatgaaccgacgcccactctcatcctcaagacacacgaagatgagccctaggggtgagcggttagcagagatttgcttgcagcatccctgcatctctgatgctacttg

SEQ ID NO: 30849 - DNA, 305 bp, Zea mays
  Clone ID: LIB3059-045-Q1-K1-B9
cccacgcgtccgcatcccgcctccaaacccgaactccaagtcgccccgcatcgatggcgcccaaggccgagaagaagcccgcggcgaagaagccggcggaggaggagcccgctgccgagaaggcgccggccgggaagaagcccaaggcggagaagcgtgtcccagcaggccaggcccgccgccaggaaggccgccagggaaagaagggcccggagaaaggccaggagaaccttgagaccttccaggaccaccttcttcaagggcctgaaccaggtccacccggccatgggcatttcctttaaggc

SEQ ID NO: 30850 - DNA, 416 bp, Zea mays
  unsure at all n locations
  Clone ID: LIB3059-045-Q1-K1-C1
ccaaaccctagccgccgagtgccgcctaccgcccgcccgccctccgccgcgcgtcggacggtgccgagggaagaggcaccatgaggttggagaagtgctggttctgctcctctaccatctaccccggccatggaatccagttcgtccgcaacgacgccaaggtcttccgcttttgccggtcaaagtgccataaaaacttcaagatgaagaggaaccctcgtaaggttaagtggacaaaagcatacaggcatttgcatggcaaggacatgacccaggatacaacctttgagtttgagaggaagaggaacaggccggagcgctacgaccgcaatttaacggagcagactctgaaggctatcccgcttattacaaagattaggcatgaccgtatgggaaaacacatctcanacagacat

SEQ ID NO: 30851 - DNA, 402 bp, Zea mays
  Clone ID: LIB3059-045-Q1-K1-C11
aacaaatcttgcaagctttgttctacgtttccttttgatcccgagcaaacgtagaggaaagaagagcggtgttaagggcccaggagctccaccatcggagggacgaggcctgcagcttgttgaggcgccgaaagttaactcgtgggacagcgtgtggactgagaatggcatgggaaagtaaagggcccgtttgggcaagagtgaggcagttctgctgaaaggagaggaggacgagtttgcttgtggaagagaaatctgcgaatatctgttcggatgcgttttgcatacgcatagaaggcataatcaaggaaccccttatgcctatttgtatttgtcatgttctttcatggagtacatatagatcagtgtgcaatgagaaatgtgagcggctaatgtaccaac

SEQ ID NO: 30852 - DNA, 420 bp, Zea mays
  Clone ID: LIB3059-045-Q1-K1-C12
agcaacttacctttatcacccctgttctttcaacaatcgccagccctatctttggggcagtcattggtacaaaccatcagggctcaacagctgcagcaactcgtgctaccagtgatcagccaagtagctctggcaaacctttatccctactctcagcaacaacaatttcttgcattcaaccaactgtctacactgaaccctgctgcttatttgcagcaacaacaactactaccattcagccagctagctactgcctactctcagcagcaacaattgcttccatttaaccaattcgccgcactgaacccctgtgcttatttccagcagcaaatactactaccatttgaccagctagctacaacaagccccgctatcttcttgacacaacaacaattgcttacgttctaccagcagtttgtg

SEQ ID NO: 30853 - DNA, 414 bp, Zea mays
  Clone ID: LIB3059-045-Q1-K1-C2
agagcacaatggcgaccaagatattttccctccgtatgctccttgctctttatgggtgtgttgctaacgcgacagctttacctcaatgctcacaagctcctatagctccccttcttcccccataccttccatcattgatagcttcagtatgtgcaaacccagctcttcaaccctataggctccaacaagcaatcgcagcaagcaacatacctctatcacccttgtttcaacaatcgccagccctatctttggtgcagtcattggtacaaaccatcatggcacagcagctgcagcaactcgtgctacctgtgatcaacctagtagctctggcaaacctttctccctactctcagcaacaacaatttcttccattcaaccaactgtctacattgaaccgtgctgcttattcgcagc

SEQ ID NO: 30854 - DNA, 388 bp, Zea mays
  Clone ID: LIB3059-045-Q1-K1-C3
tccggggtggaccaagccttccgtaaccaaacttggggaataatgtattttatgatgggccacaaattgccattgtgcgggcggttctgaaaacaagattgatgtctctccgcgcacttcaatgaacagctgattcttaactaaaataccgtccatcaatgatagctccagtatgtgaaaacccaactcttcaaccctataggctccaacaagcaatcgcagcaagcatcatacctttatcaccctcgtttcaacaatctccagccctatctctggtgcagtcattggtacaaactactgcggcacatcatctgcagcaactcgtgctacctgtgatcaaccaagtagctctggcaaaccgttctacctactctcagcaacagcaatt

SEQ ID NO: 30855 - DNA, 268 bp, Zea mays
  Clone ID: LIB3059-045-Q1-K1-C4
actcgacccactcgtccgaagcacacactctcgtattatatattttattttcgtccacacatttccctttatccgtcagtttttaaaactacaataatcccacaactctcacatccttctacaacttatcctcaactaacataccttccatcaattataactccaatatattcaacacccatctcttcaaccctatattcttcatcactcaatcacatcaagctacatacctttattacatctactttcaacaatctccatccctatc

SEQ ID NO: 30856 - DNA, 385 bp, Zea mays
  Clone ID: LIB3059-045-Q1-K1-C5
gtccattccaggtagtcacagaatactctgaggatcagcttgagttggtcttagaggcctgcgaaaggatgaatgcgcatctgacagctgcagttgtctcaaacgacccgctattcctgcaggatgtacttgggagatccgttaacgggacaacctacgccggaattcgagcgaggaccacgggcgctccacagaaccactggtttggcccggccggtgatccgcgaggcgcatggatcgggactccggaagccatcaaacttgtctggtcctgccacagggaagtcatatatgacgttaggcccgtgcccgagagctgggcgcattctatcgcgagctgattagctagacgacgatagactattccatgtcatcacgaggaata

SEQ ID NO: 30857 - DNA, 403 bp, Zea mays
  Clone ID: LIB3059-045-Q1-K1-C7
cccacgcgtccgcccacgcgtccgctgtcgcgtgggtgtgatttttctgatcatgagatggaccagagttccaatctctgttggtttagatgaagtggcaagtttttgttgtgtgtgtgtctctgataaaaggcacccatatttatgtctgtgacattaatccaaatatgctaaatgttgggaaaaagtgtgttgcagaaagaggtcccgagcatgaacttttctaatagattttgttgcctctgtctcaagtgtgggttatgttgttcaacagttggtttttatttccaggttatagcgaagaacattgtcttagctggatacaaggagatgcataagctctgagttttgaggatggatctatggatggttacactatcgcatttgggatcagaaatgtgac

SEQ ID NO: 30858 - DNA, 414 bp, Zea mays
  Clone ID: LIB3059-045-Q1-K1-C8
atctttgacaaggctaggcagtctgctccatgtgtcctgtattttgatgagctcgagtccattgctactcagagaggacgcagtgttggtgacgccggtggtgctgctgatagggtgttgaaccagctgcttactgagatggatggcatgaatgccaagaagacggtttttattatcggtgcaactaacagaccggacatcattgacccagccttgctgaggcctgtgcgtcttgatcagcttatctatattcctctgcccgatgagcagtccaggcttcagatcttcaaagcctgtctcaggaagtctcctgtggccaaggatgttgacttgaatgctctcgccaaatacacccagggtttcagcggtgcagatatcacagagatctgccagcgcgcgtgcaagtatgccatc

SEQ ID NO: 30859 - DNA, 422 bp, Zea mays
  Clone ID: LIB3059-045-Q1-K1-A10
gattggagtgcgcaatgggaggctgttcgggaaaggtacgtcgtgatgacgaataagagcttgattttaaaggtggaaatgttcatattataacaagcaatgagggctgggaccagaagattgcagaagcaaacagagatgggaaaactgttgttgcaaatttcagcgcttcctggtgtgggccatgccgtgtcattgctcctgtctatgctgaaatgtcaaagacttatcctcaactcatgttcttgacaatagacgttgatgacctgatggacttcagctcttcatgggacatccgtgcaaccccgacattcttcttcctcaagaacgggcagcagatcgacaagctcgtgggcgcgaacaaacctgagctcgagaagaaagtgctagcagccgctgatgccagtacgtactagtgacac

SEQ ID NO: 30860 - DNA, 425 bp, Zea mays
  Clone ID: LIB3059-045-Q1-K1-A12
cccacgcgtccgcccacgcgtccgtctctaggaagcaagggaatcacatcgccatggcagccaagatgtttgcattgtttgcgctcctagctctttgtgcaaccgccactagtgctacccatatcccagggcacttgtcaccactactgatgccattggctaccatgaacccatggatgcagtactgcatgaagcaacagggggttgccaacttgctagcgtggccgaccctgatgctgcagcaactgttggcctcaccgcttcagccgtgccagatgccaatgatgatgccaggtatgatgccaccgatgacaatgatgccgatgccgaatatgatgccatcgatgatggtgccgactatgatgtcaccaataacgatagctagtatgatgccaccgatgatgatgccaaacatggtttcacca

SEQ ID NO: 30861 - DNA, 314 bp, Zea mays
  Clone ID: LIB3059-045-Q1-K1-A3
cttccgaggcacggcaccaggcaggattaacttgcctttcgatcatatcgtcaactggtccggcggtgttcgacaccatgagctccacggattgcggcggcggcggcggcggcgccaagacgtcgtggcctgaggtggtcgcgctgagcgtggaggacgccaagaaggtgatcctcaaggacaagccggacgccgacatcgtggtgctgcccgtcggctccgtggtgaccgcggattatcgccctaaccgtgttcgcatcttcttggacatcgtcgttcagacgccccacatcgtgtgacaatatataagctag

SEQ ID NO: 30862 - DNA, 419 bp, Zea mays
  Clone ID: LIB3059-045-Q1-K1-A4
cccacgcgtccgagcacaatagtgtaccaacaatggcagccaaaatattttgcttcgttatgctccttggtctttctgcaagtgttgctaccgcaaccattttcccacaatgctcacaagctcctatagcttcccttcttcccccatacctctcaccagcggtgtcttcagtgtgtgaaaacccaattgttcaaccctacaggatccaacaggcaatcgcaacaggcatcttaccattatcacccttgttcctccaacaaccgtcagccctattacaagagttacctttggtccatttggtggcacaaaacatcagggcacaacaactacaacaacttgtgctagcaaaccttgctgcatactctcagcaacatcagtttcttccattcaaccaactggctgcattgaactctgctgct

SEQ ID NO: 30863 - DNA, 402 bp, Zea mays
  unsure at all n locations
  Clone ID: LIB3059-045-Q1-K1-A5
cggacgcgtgggaaatcacgttatacataactgcattgagtgtgtccccacggggcatattgcttttgtagtgtctgcttttcagggacaagttactagcctttcaatgcatacatatggctgccgtgtaattcagagaatctcgtatcactgcggtggtaactcacaacgtcagtgcataatatacgagatattacagtgcatgtgcatccttgcgcaggatcagtatggcaactatgttacactgcatgttctagaaagaggtatagctcatgacaggagccttattattactaaattcgcacgtcacgttgatactatgagccaagataaatatgcatcagatgtgatagagaagtgtnttcaacatggagatatagctgagcgggatcttatgatcag

SEQ ID NO: 30864 - DNA, 414 bp, Zea mays
  Clone ID: LIB3059-045-Q1-K1-A6
cggacgcgtggggtgttgctaacgcgacacatgtagaaagagcaaggagcataaggagggaaaatatcttggtcgccattgttgctctattgttgctactggattccactttctatgttgctaacgcgacaattttccctcaatgctcacaagctcctatagcttcccttgttcccccataccttccatcaattatagcttcaatatgtgaaaacccagctcttcaaccatatacgcttcaacacgcaatcgcagcaagcaacatacctttatcgcccttgttgtttcaacaatcgccagccctatctatggtgcagccattggtacaaaccatcatggcacaacagctgcagcaactcgtgctacctctgatcaaccaagtaactctggcaaacctttctccctactctcagc

SEQ ID NO: 30865 - DNA, 413 bp, Zea mays
  Clone ID: LIB3059-045-Q1-K1-A7
cagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagacgagcgccatgtaccagccgctccggcaacagtgctgccagcagcagatgaggatgatggacgtgcagtccgtcgcgcagcagctgcagatgatgatgcagcttgagcgtgccgctgccgccagcagcagcctgtacg

SEQ ID NO: 30866 - DNA, 351 bp, Zea mays
  Clone ID: LIB3059-045-Q1-K1-A8
cccacgcgtacggtgatgaacatgataatgcatattcttgcgctttataagggaaggtgagcatcttatagtaacttataaagcgcaagaatataaattactatgagatgctcatattcctttaaaaaacaccatactacatacctagaacagcactgacatccagcctgacaacaaaaataggcacgacgcctattctacacgatccaagattacctcaggcatcctgcgagcatcacgctgtcgtatagcgccatactactctcaattgtgtgcccactatcttcaaacaccaggcgggccaaaaacattgcttcacacaacttactaggattatagacattcaacctt

SEQ ID NO: 30867 - DNA, 284 bp, Zea mays
  Clone ID: LIB3059-045-Q1-K1-A9
cccacgcgtccggatctagaccgcattctcgatcttcaagttgttcattatttatggtgcccatttcctagtagaatcccgtgcttaagaatctggctgatgatgagcccgttatatagaatgcccctgccgggaagaatcccaatgcagcaaaacgtgtaccaacaggcaagtccatcagcaaggacggcgctgtggaaaagaaggaccgtaagatgcgcacgaatagcgtggagacctacacgatctacatcttcaaagtgctgaagcatgtacaccagtac

SEQ ID NO: 30868 - DNA, 419 bp, Zea mays
  Clone ID: LIB3059-045-Q1-K1-B1
cttcgcccacgcgttcgcgcacaccttcggccacgccttcgaaacatcttcgcttggttgaggatggaattgccccacttcctaattccggtggtttttaatatggccattctgaacctgttgggttataccctaccgctgtatctagtactaaagccccgtttgtttccttccaagattatataatccagctcgtggattatataagcacctattgacctgcttatagattatcataatctagatatccggattatataattcacctaataatctatattgcttgtttaactctcaatttatttaagctagattatataatatagatggtaaacaaacaacgactaaaacatattttctgcaacataaaatttctgagttcacaagttcaacacagagtacagaatattatatagatt

SEQ ID NO: 30869 - DNA, 352 bp, Zea mays
  Clone ID: LIB3059-045-Q1-K1-B10
aacagatctcgctatggacattctatttatactctacttcaagatcaatcagtaagggtgcatgcacgtaggttcattccaaatatctgtactcagcaattgactaatccgattagtcgaaatgctgcgtattgagcaacacacggctcttgaagcatcatatattgccatgcaaacctgtaaacttagcgtggttcatattgtgtacagtcagatgacctgcaactatgacaacttaactcacgtagtactgtcgagctaactaaactacatatgctagtaaagcactaattcatatgatactataggatgagcatatgcctatttgaactgctgatgctattggatcttg

SEQ ID NO: 30870 - DNA, 426 bp, Zea mays
  Clone ID: LIB3059-045-Q1-K1-B11
cccacgcgtccgcccacgcgtccgaactagcaacatagaaagcacaatagtgtaccgacaatggcagccaaaatattttgcctccttatgctccttggtctttctgcaagtgctgctaccgcgaccattttcccgcaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaacta

SEQ ID NO: 30871 - DNA, 376 bp, Zea mays
  Clone ID: LIB3059-045-Q1-K1-B2
ggaatacagtagcaacaatagagcaacaatggcggccaagatattgtccatccttgtgctccttgctctttctgcatgtgttgctaacgcgaccatttttcctcaatactcacaagctcctatagctgcccttcttcccccataccttccatcaatgaccgcttcagtatgtgaaaacccagcccttcaaccctacaggctccaacaagcaatcgcaacaagcaacttacctttatcacccctgttctttcaacaatcgccagccctatctttggtgcagtcattggtacaaaccatcagggcacaacagctgcagcaactcgtgctaccagtgatcagccaagtagctctggcaaacctttctccctactctcag

SEQ ID NO: 30872 - DNA, 179 bp, Zea mays
  Clone ID: LIB3059-045-Q1-K1-B3
ccgggttgaaccaagccttccaaatatatattcctgaacaatccaaaactggttaaggggggtggcctaactgcataatgccggatttaaatagagagggatggatagacgacacacattatcatgtgtggtatgaccaataatatatgcatgatcataataaagttttggttttaatg

SEQ ID NO: 30873 - DNA, 442 bp, Zea mays
  unsure at all n locations
  Clone ID: LIB3059-045-Q1-K1-A1
ttttgggccatcctnntgccctccttgctnnctttcagncaagccgttgctaccnnngcgactannntattccacaatgcntnncacaacaatnnacctctctttccggtgaccagcnncgcgaagatnnttgaataccccannactatacaatnncctacaggctnnnacaaagaggccanntcgcagcaagggcattcttaaacggtcgtnntagcatnntgaccgnntccaacaaccccatatgnnncctattgcaacccaaccanntccttaatgggaatctanntatctcnncaaagaatcnnngcagcacaacanacctacccaacaaccagtnntgctntccannataatcananntcaagtagttnnngcagcgaacncttnnngctgcttacnctnncnnagcaacaaccannatttcttcccattttcaatc

SEQ ID NO: 30874 - DNA, 323 bp, Zea mays
  Clone ID: LIB3059-022-Q1-K1-H1
gtggaaacccctttagtcttgagggaaaaaaaataaagggagaagctctcctgagaagcatatagcaccagcggaacacggtaacggcggaagcaaacaactagaaattccccagaccagttctttgcgtgcggttgatctcgtcagatgcccggacatggttactcaatccgccatcgaattcgatggcagacaacgccgggaataatatccgcaacgccaagctgaatcttcttggagatgtgagcgctggcaaatctagcttggatcttcggtttgttaaaggacagtttgttgaattccaggaatcaacaattggagca

SEQ ID NO: 30875 - DNA, 415 bp, Zea mays
  Clone ID: LIB3059-022-Q1-K1-H12
ggaaccaggactcgaagcagaatttgctacgtttgacttgaagagtttctgtcacattggcattgactcttcgggcaacaggttcttcagctatggaccttcgaaatatgcaaacatacagtaagcaaatggtgctaccttcttggctatctgaggaagatgtcagttaccttgcaagtgtgtactcaaaaactggatttgctggtggagtaaattactatcgctgcttggacctgaactgggaactgatggcgccatggacaggagcaaaggtgcaagttccaaccaagttcatcgttggggacggtgacctggcgtaccatcaccctggagtgaagaggtacatccacaagggcgggttcaagagggacgtgcccatgcttgaggaagtggtggtcatcaagggcgctgggca

SEQ ID NO: 30876 - DNA, 323 bp, Zea mays
  Clone ID: LIB3059-022-Q1-K1-H3
atcgaagatgccgttgacggcgccatcagctggctggacagttaccagctggctgaggtggaggagttctatgacaagatgaaggagcttgaggggatctgcaaccccatcatcgctaatatgtaccagggcgagggcgcggtcatggagcgctgatattgatatatgatttgttgctccagatggtagtagcagttctggttccaatatcgaggaggaggattaagtaggttagtgttcgaggtttggtttagggaggtgtgaagagcctaaactctgatggttgtttgtgaggtgtggtcgcaatagctgcggcctgtggt

SEQ ID NO: 30877 - DNA, 334 bp, Zea mays
  Clone ID: LIB3059-022-Q1-K1-H5
acacaaaaggtggggtatggataagattatagatggatggtgacacggcacagcagggcacatggctagcctgctagcgtgcggcacccacacaacacaacacactgctcgccagaagcgccccaggaggccagtggaggacacggcgccgacatgagccatcatcatcatctcagactcagagcatgccatggcacgcaactgactgactgactcggaacacacacagcgacgccgctatactttattaagctttataattagctagcttcctgcggccggcctgcagggtggagcacctagctcacttgccgcaagtgcaggggtcgcactg

SEQ ID NO: 30878 - DNA, 230 bp, Zea mays
  Clone ID: LIB3059-022-Q1-K1-H9
cgttcgctcatgctcccattccacgtcagattcagtatcatcactttctcgggggtggggaccaatatgtgagcccttcttatagctccttgctcttatgtgtatgtacttgctaattcgacagttgtctctcattgctcacagactaccaactggtccacaacttctcatatacctaccatcaatgatctccattacaatatgataacccatctgtacacgcatatatg

SEQ ID NO: 30879 - DNA, 365 bp, Zea mays
  Clone ID: LIB3059-023-Q1-K1-A1
caacactattatttcaaaaggatccttggctggtgctggctgggatgtattccgcaggcaggatcttccaaagcttaatgaatatctagctgttcatcgggaagattgtgcagctagatgtcaagcagtgtcttctgttaagtatcctatttatgatcaaactgtgtaccttaacgattatcataagaaggtgttgaaggatcaatatggaattgaacccttcacattccaccaacatattggtgaggctgttttcattccagctgggtgtcctttccaattgaaaaaccttcagtccacggttcaattggctctcaattttttgtcacctgagagtttgccagagtcagtccggctgtcccaag

SEQ ID NO: 30880 - DNA, 441 bp, Zea mays
  unsure at all n locations
  Clone ID: LIB3059-023-Q1-K1-A11
taccggtctcggaggttcgacccacgcgtacgcgcccgtggtagctcggcccaaattccgttcttcgctgctttgatggcgagaatgcaggaccttgtgcgaaggactgcaagctggctaatcttgtctgcttggaggaagttggatgctatcgaggagaaggatggagtgcttgatgagtaagacgggtttctggtgtcgatttgcttctgagtttttttctttntatatcgttgcgatctcgtggttgtcgtttggttagcaggcaagccaggctattagtccgaagaatgtcgtctataaacatgtgttcctacgttgccacatgctgagtcaatctgtatacagctagctctaggtggtcagctgcgtctaccacaatgagcatacatgtatggataaatcttctgtgaaagcattcgatgaataagggttgttttc

SEQ ID NO: 30881 - DNA, 266 bp, Zea mays
  Clone ID: LIB3059-023-Q1-K1-A12
ggatcacgtatgaatggccagctcccacatctgaactagtctctatcatcatgcaatgcacatcagcaaagcggcagagcgtacagaggatcgtagaacagaacagcatgaagacggtcatcgctctcctcacgtgcctagctctgtcagctgccagctcctctgcaatgcagatgccctgcccctgcacggggctgcaaggcttggacggcgctggcgctcggctgaccacgatgatgggcgcctgctggctgtacccctacgcg

SEQ ID NO: 30882 - DNA, 366 bp, Zea mays
  unsure at all n locations
  Clone ID: LIB3059-023-Q1-K1-A3
cgaagtcccgcagggcgtaaccgtggttcgctgagatcactgtctccgagcctaggaagcacgcggagcccgcgactggagccgtgggcgtcattcccggctcggccagctacgtctcctacctcatcgccactcgggtgcccgacggcggcgagttccgcgtgcgtcggcgattccgtgacgtcgtggcgctcgccgaccgcctctcggagacccaccgcggcctctttgtaccggcgcggcccgacaagagcatcgtcgagggccaggtcatgcagcggcacgacttcgtgaaccagcggtgcgtcacgctccagcgctacctccgccgnctcgccgcgcatcccgtcgtcggccacaacccca

SEQ ID NO: 30883 - DNA, 426 bp, Zea mays
  Clone ID: LIB3059-023-Q1-K1-A8
cccacgcgtccgcccacgcgtccgcccacgcgtccgggcaagccaagcgtagtcatgttcgttggtctgcaaggttctggtaaaactactacttgtacaaaatatgcttattatcatcagaagaaaggattcaaaccagcactggtttgtgctgatacatttagggctggtgcttttgatcagttaaagcaaaatgcaacgaaggccaagattcccttttatggaagctacatggaatctgatccagtgaaaattgctgttgaaggtgtggagaggttcaagaaagaaaactgtgatctcatcattgtggacacaagtggaaggcacaaacaagaagcagcactctttgaagaaatgcggcaagtttcggaagcaacaaaaccagacctggtgatttttgtgatggacagtagtattggtcaggct

SEQ ID NO: 30884 - DNA, 344 bp, Zea mays
  unsure at all n locations
  Clone ID: LIB3059-023-Q1-K1-A9
cccacgcgtcccggcgaatcggaccggaaggaaaccaggaaggccctgaggcaagcgggggaccaaagaagaagatgaaggtccgtgcggcggtgaagcgcctgtgccggttctgcaaggtggtgaatcgccggggaatcgtcttcgtccaatgcacggacaacgccaagcacaagcagcgccagagcttctacaccatcgccgaaacagccgtcgactcgtgcgttcacctgccttcgacgncggccgctagcggtttccgccttcgccgcagcgttcgcagaggctttcaaagtggcgagacatgagatgtctatgaagttcaattggcggctgggtttaac

SEQ ID NO: 30885 - DNA, 397 bp, Zea mays
  Clone ID: LIB3059-023-Q1-K1-B10
cggacgcgtgggcggacgcgtgggcttgacaatgacacttcatggatgatgcttgctagctctggaattggtgtttgcattgagttttggaagatcggaaaggcgatgcatattgaagtcgatagaagtggaaaaattcccatgttgaggttccgagatcgtgaatcatatgcacagaataagaccaaagagtccgatgctattgcaatgaagtacctcacctatggcctctttcctcctggggatccggttcttctatctattcactaaaggtttgaaagcacaagaacttggacttatggatactttcttctaatgacaagttgggggaacatgtttggttccatcatgatgtgcccccaattaattatcaactacaagctgaagtctggtgctc

SEQ ID NO: 30886 - DNA, 318 bp, Zea mays
  Clone ID: LIB3059-023-Q1-K1-B11
cgcagccgtctgatgacctcatatcaaggctggtacccaactccaacctgcaaaatccttgccgaagttgtggtgctttcctgcgcgacgctttcgaaccgtttttattatgtcgccattttctttccctgtgccaccaccctgatgaatgaagaaggcctgagctaggcgaacatctgcaggctgcagcagtatgccaaatcattatcattaccgttaccattaccaattggagattgccgtaaatttccgcgattatgggaactcatttacctgattatctgatacgtttgaaattaaaggtccgccattagaatg

SEQ ID NO: 30887 - DNA, 400 bp, Zea mays
  Clone ID: LIB3059-023-Q1-K1-B3
cggacccgtgggctgtttaaatccacggtgctaaagtttagcactacacttttaataaactttagtacatgtaaatccaaacacgagtgttaaaaggtgctaaaagatgttaaaagtgaagtgccgaagtttagcacctgtcagtgtttggaccagtggacctaaccaactagtgaaatagtgtcgcgtgtcttggatccagatggtgatgcgagttgacacaaatgatttatcctggttcgggctatgaagggccctactttcagcagaggaaggatgtggattatattactcgcaccaaaagtgctcacagtaggggttacaagcacgacgggagagggtaggaccctaagtccctgagagtgattgagtcaagtgccaataccgtatgagagagaat

SEQ ID NO: 30888 - DNA, 307 bp, Zea mays
  Clone ID: LIB3059-022-Q1-K1-G9
cggacacctgagccgaatcctgcacgagacacttgggaaaacaacaaacatgggagacggtcataatatgtggaaccatcaagaaggtggtcacatctaaagtatccatcttgctgctggtgcttatcagagttactcaagaggcctcgtcattgccaaagtcgatcatttggcagcacctgaacccgtacttcaaagggaacaccatgaaccagcacaactgaatggaattgtacctgcatcagctttacctctacagcaactgctacagcatgatgcgccagtatcacgtgcatcagcaagtgct

SEQ ID NO: 30889 - DNA, 345 bp, Zea mays
  Clone ID: LIB3059-022-Q1-K1-E9
ctggctttgacagacccatttgacttctaccaacaacacatcattggtggtgccctggtttagattgcttattagttgtaattcaataataaagttttttagaatctggaactgtaacttcttatatctgtttcaccacatacatcatccaaagattacaagatacatttccaaattctaacaaatttacaaactgggcgctcattatacagtatccaaacttacctacgcttgcatgcaactctataacttttctatagcttaacttatatcaaatacgctggccccgatagtacttcctcatgactgctaaaactttatcgatacccagcttcagcctcttac

SEQ ID NO: 30890 - DNA, 325 bp, Zea mays
  Clone ID: LIB3059-022-Q1-K1-F1
cgcacccgcctgtaggctgccgtcgaacctggcgcttccctctgccatgaccgtcttgtcgctcatcctgctcacctactttgcggtcgtctccggactcgtgtacgacgtcatcgttgagccccctggcatcggcagcgcccaggaccccggcacttgcgccgttcggctggtcgtcttgcttacagggctgcgtaacggccagtgcatcatcgagggactctcctgcgggttcatgttcctgcttggcggcattggcatcatcctgctcgacctcgccgtcaaccgcacgaggccccggagccttcgcgtctcgtttggaagc

SEQ ID NO: 30891 - DNA, 408 bp, Zea mays
  Clone ID: LIB3059-022-Q1-K1-F10
gttgatgttgctgccaggagcagcaacagactacaaggtgcacctataacggctatggcagtagctcaaatctaaaaaattgtcatgaattcctaaggcagcagtgcagccctctggtaatgactattgtccaatcacgttcgatacaaccaagtaactgccacgtattgcagcaacaatgctgtcatgatcttaggcacattgagccacaatacattcaccaagcaatctacaacatggatcaatacataatccacgaggagcaacagcaacaaccatgtgagttatgtggatctcaacaagctactcatagtgctgtggcaatcttgacagcagcacaatacctaccatcaatgtgcggcttgtaccactcatactaccaaaattatccatgcagcagctatgaca

SEQ ID NO: 30892 - DNA, 406 bp, Zea mays
  Clone ID: LIB3059-022-Q1-K1-F11
cccacgcgtccgcccacgcgttcgcccacgcgtccgcccacgcgtccgcggacgcgggcgtttgagcattcagaaacacaccaagcgaagcacattagcaacaacctaacaacaatggctaccaagatattatccctccttgcgcttcttgcgctttttgcgagcgcaacaaatgcgttcattattccacaatgctcacttgctccaagttgcattattacacagttccttccaccagttacttcaatgggcttcgaacacccagctgtgcaagcctataggctacaacaagcaattgctgcgagcgtattacaacaaccaatttcccagttgcaacaacaatccttggcacatctaacaatacaaaccatcgcaacgcatcagcaacaacaatttctaccagcac

SEQ ID NO: 30893 - DNA, 324 bp, Zea mays
  Clone ID: LIB3059-022-Q1-K1-F2
gcaacatagaaagtggaatacagtagctacaatagagcaacaatggctgccaagatagggtccatccttatgctccttgctatatatgcatgtgttgctaacgcgaccatttttcctcaatactcacaagctcctatagctgcccttctttccctatacctatcattaatgaccgcttcaatatgtgaaaacccagcccttcaaccctacaggctccatcatgcatttgcaacaagcaacttacctttatcacccctgttattacaacaatcgccagccctatcgttggtgcagtcattggtacaaaccattagggcacaacag

SEQ ID NO: 30894 - DNA, 323 bp, Zea mays
  Clone ID: LIB3059-022-Q1-K1-F3
gtttgacactcataacaagaaagtcagtatgaaatatgatggatattttagaagcatgaaccatagtagttgttggtacagaaacgatacttttattttagcagcacaagcaactgaggtattttatttgcaagacatcaagaattctggaagctagtagattgatcaaaaatttacacataggcacttgtggtgtgtggctgaaaatgacattgatgaaagacctagtttctcaagactatcataccaagatgatacatgtattggttctgaagtgcaagttaatgaaggagatatggagataactggacatcaggatgctg

SEQ ID NO: 30895 - DNA, 324 bp, Zea mays
  Clone ID: LIB3059-022-Q1-K1-F4
ggtctcgccgctgctggcgggcgtcgggcagctgtacctgaacaacaaccggttcaggggcgaggtcctcgtgcggctggtgcatgagctggtgggctccggcggcctgcaggtgctgtacctgcagcacaacttcctgacgggcatcgcgatatcgtctgaatcgtcagttccctacaacgtgtcgctctagcggaatgacaactgcagggtgcacgcggtgtacacgcagagcccgatcaaggcctggtcgcagaacacgcgtgcggcgtaccagtgcccggagtggaggggctgagcctgatgtcggggtgagcttgatcg

SEQ ID NO: 30896 - DNA, 64 bp, Zea mays
  Clone ID: LIB3059-022-Q1-K1-F7
aaaaaaaaataaaaaaaaaaaaaaaaaaaaaaaaaaaaataaaaaaaaaaaaaaaggggaaaaa

SEQ ID NO: 30897 - DNA, 450 bp, Zea mays
  Clone ID: LIB3059-022-Q1-K1-F9
gtttctttggcagatgtggccaactaaatttcagaataaaacaaatggagtgactcccaggcgttggatccggttttgtaatcctgcattaagtgcattaatttcaaagtggattggttctgatgactgggtgcttaatacagacaaactggcagaactgaagaagtttgctgataatgaagatctgcattcagagtggcgtgctgctaagaaggctaacaaaatgaaggttgtttctcttataagggagaagacaggatatattgtcagtccagatgcaatgtttgatgtgcaggtgaaaaggatacatgaatataagcggcagctgctaaatatccttggaattgtctaccgctacaagaagatgaaagaaatgagcacagaagaaagagcaaagagctttgttccaagggtatgcatattcggtgggaaagcatttgccacatatat

SEQ ID NO: 30898 - DNA, 138 bp, Zea mays
  Clone ID: LIB3059-022-Q1-K1-G10
aaaaaaacaaacactaatctatcatataaaaaacgaacaaacaaaaacaggggatagggacaggacatccggtctagcagttccatgcttacaaacgaagtcatgctacttcatctctcttttatcgtcactcctaaa

SEQ ID NO: 30899 - DNA, 331 bp, Zea mays
  Clone ID: LIB3059-022-Q1-K1-G11
gccgctccagcctttcgctagggtttaaccaccggcggcgcgcgcgacggcggcaagatggtgcagcgtctgacctaccgcaagcggcacagctatgccacgaagtccaaccagacgcgggtcgtcaagacccctggtggcaagctcgtgtaccagtacaccaagaagagagccagcgggcccaagtgtcccgtgaccgggaagaagatccagggcattccccatctgaggccagctgagtacaaaaagtccaggttgtctaggaaccgcataactgtgaaccgtccctatgggggagtactatctggaactgcagttagagaaaggatca

SEQ ID NO: 30900 - DNA, 423 bp, Zea mays
  Clone ID: LIB3059-022-Q1-K1-G12
cccacgcgtccgaccacgcgtacggcaacatagaaagtggaatccagtagcaacaacagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgctgtttcaacaatcgtcagccctatctttggtgcagtcattggtacaaaccatcagggcacagcagctgcagcaactcgtgctacctgtgatcaaccaagtagctctggcaaacctttctccctactctcagcaacaacaa

SEQ ID NO: 30901 - DNA, 321 bp, Zea mays
  Clone ID: LIB3059-022-Q1-K1-G3
acgtggtatgcccgtaggagaagagcaagtggcggcgcctgtcgcgacgcgactaccggaccccgctggtcttccacgacggccagctcgcgtttctgccgacgccactcaacacggtggccatgttcacgtggcttcctctgggcgccgcgctagagatagtgcggctgtccgtagcgctagcgctgtcgtgcaaggtctgcacggagctgctggtgggcactggacagtcagggcgcctccgaggctcactcccgacgcctgggaacagcggcgggtccggacagctgtacgcgtgcaaccaccgtacgctgatcgacc

SEQ ID NO: 30902 - DNA, 323 bp, Zea mays
  Clone ID: LIB3059-022-Q1-K1-E6
cccgaattcccgatctccggccgacgccatggcagcccccttcgcggccgtcataggggtgctcgaactgctcgtcgagaggtcctcgggcgcgcgcctcccaggccgcggcagcaccacccggggagctgctctgccgcgcggttgagcgccggtcactgtggtgttagcgctgtgaagcttattgctatcataggcggagttcggatgcctactcagcgtgatcctgtccttcgtcggctactctggcggctccaagtccaaccgcgagtaccgcaacctagccgaccacgccgagtgcgtcaaggttgagtatgatcccc

SEQ ID NO: 30903 - DNA, 324 bp, Zea mays
  Clone ID: LIB3059-022-Q1-K1-G8
atacgatctgtcgctcatcccacatcagtagtcgaccaagcacaagcagcagagccggccggaatatgtggacgatcatgaaggtggcgacgccgcaggtggccgtcctcctgctggtcctcatcgtcgttgctcaggaggcggcgccgttggcggaggcgcgcgtgtgccgtcgccggagcgcgggctttaagggggtctagatgttcgaccacaactgcgctcatgtgtgcttgcaggagggctacggcggcagcaactgcgactgcatgatgcgccagtgcaagtgcatcagggagtgctagctagctaggctctaggatc

SEQ ID NO: 30904 - DNA, 139 bp, Zea mays
  Clone ID: LIB3059-022-Q1-K1-C7
cccacgcgttcgtccacgcgtgcgcagagttgacaggtgtaggcagctccagttggcggtcaccattcctttgccgttagaagcacctcatctcccacccccagacaacataagcgatgagcggcaggaacgaggcgca

SEQ ID NO: 30905 - DNA, 325 bp, Zea mays
  Clone ID: LIB3059-022-Q1-K1-C8
accacgcgttcgtccacgcgtccgtagtcgggtcttctaatggagacactcattggtgtcacacccaaggatccactctatgtaccttcattaggaccacttgacccatactgcaccaaagaaggtttgattctatgtgacaaagataggatgataggacgtcattgtatttgcttagattcattggtggtaatatgtacccgactaggtagagacatgtaggagattgtcgttagcaaaagctataagttggctgaaaaggtttcatctataatggaagagacacaacctcttcttacacggattgaggatttagctgaagaaa

SEQ ID NO: 30906 - DNA, 444 bp, Zea mays
  Clone ID: LIB3059-022-Q1-K1-C9
cccacgcgtccggaagggataaagtcaaatgcttgatggtcaaggcatgtgcatatgagactatgcagcctgaagacccgtgcaaattttgatgatgctagttccaagtccccttccaaatttcttggcactatacagggaacttgaccttcaaacatcttttgaaggtctgaagatggaaatataatcttctgctgaactgacagaaactttgtgaattgcagagcaacccgaattgaatggtttagcttgtcattcttgatcctgtcacagcaagtggtgacatcattgaggcttgcccatggaattatgacaactgtatctgccatgagctgtgtaattgcagttcttacattttacctgtcttttgtcaatggtaacatctagtgactattgtatgactaacatggaatttcggtacctgcaattgttatgtacgattct

SEQ ID NO: 30907 - DNA, 397 bp, Zea mays
  Clone ID: LIB3059-022-Q1-K1-D10
cccacgcgtccgggttgggtttattgaggcgtggaggatccctggtgttggcccttgcgccctctgccttttcttctgcaagcttgtggcgtatacgttcctgtactggcttcccttctatatcagccacacagctatcggtggagaatacttgtcggactccgcagccggggtactgtcgacgctgttcgacgtgggcggcgtcgtgggcggcatcctcgccggccacatctccgaccacctggacgcccgggcgctgacggccgcgagcttcaccttctcggcgataccggcgctcttcttctaccgcgtctacgggaacgtctcgctggcctggaacatcgccctcatgttcgtcacggggatgctggtgaacggcccctacgcgctgatcacg

SEQ ID NO: 30908 - DNA, 392 bp, Zea mays
  Clone ID: LIB3059-022-Q1-K1-D11
agcaaaacaacaccatgaaaagcttaatacaggatacaacagtgttagggagagtagtggtgttatagttaaagcctggaaatgcaggtttacttgggtgggccatgagttctgttacacaaaagggtaaaccttatgaccatgccccaatatctactgcaaatgccaataattcttaagcatcaacaacctaaactgccactccagacactcaggcttccacactatcatatgcaccatccacattcaccttgcttgatcaagctgcattagcatcagcaaggtcatcagtagattgttggagtgagcttgaagatggtaaaatccatgatgagaatagtagctaataaaattgatggcatgatgtatacccatttgatgacaagccatcc

SEQ ID NO: 30909 - DNA, 321 bp, Zea mays
  Clone ID: LIB3059-022-Q1-K1-D2
agcacgcgtccgagaccgcaccctgtctgcgagctcgctcccgtacccgtccgctgggggccgctcgacgccgccgtcttgcgctcatctagtgtctacactcccggcgacgatggcggaggacttggttttggacacggcgatccgagactgggtgctgatccaggtctacgtggttatggtcctcatcggcgtactccagtactgaagtctgcaagctcatgcgctgggaggcgacctctccgtgtaccgaccccaagctcgtttaggaagggcaggtggtcatcagggcgaggaacctgaggaccaacgcacagttca

SEQ ID NO: 30910 - DNA, 142 bp, Zea mays
  Clone ID: LIB3059-022-Q1-K1-D3
atctccaccaccatcggcgggaagaacggcgagcccaagcggaccatcagttacatgggagaacgtgacgtgggcacaggctcattagggatcgtcttccaggctaagtgtctggaaacaggagagaccttcgccatcaaga

SEQ ID NO: 30911 - DNA, 325 bp, Zea mays
  Clone ID: LIB3059-022-Q1-K1-D4
agcagctgtgcaagcctataggctacttcaagcgattgcgtagagcgtattacaacggcgaattgcccaattgcaacatcaagcagtggcacatctaacaatacaaaccatcgcatcgcaacagcaacaacagtgcctaccagcactgatccaaatgtgcaatggtgcccttgttgactaattgcagcgtgtgctgattggatacaactgacttgctagagcaaacgtagtttcaaaccagcaacaacaacaactgcaacagtttcggacagcgcttagtcaactagccatggtgaaccctgccgtctacctacaacagcaacaa

SEQ ID NO: 30912 - DNA, 327 bp, Zea mays
  Clone ID: LIB3059-022-Q1-K1-D8
cgcaaattgcaccaagaaatccatcgagaggccgtcgacaggggaattaatggcgtcgtcgtctagcagcagccaccggcgcctcatcctcgcagccgccgtcctgctctccgtgctcgcggctgccagcgccagcgccgggacctgctgcatgccgggatggaccatcccgcacaacccgctcccgagctgccgctggtacgtgaccagccggacctgcagcatcgggccgcgcctcccgtggccggagctgaagaggagatgctgccgggagctggcggtcatcccggcgtactgccggtgcacggcgctgagcatcctcatgga

SEQ ID NO: 30913 - DNA, 348 bp, Zea mays
  Clone ID: LIB3059-022-Q1-K1-D9
caaagacatggattgaagtttctggttcatcagcaaaggatgttgctaaggagctcggggaacaacaaatggtgatgccaggccatcgtgagtcaaacttgcagaaggaacttaaccgatacatccccactgccgctgcatttggtggtgtatgcattgtcgcattgaccgtcctggctgatttcatggttgcgattggttcaggaactgctatattgctcgctgtgacaatcatataccaatacttcgaaacctttgagaacgaaagggcgactgagcttggtttctatggtttttgatcattagctgtggaaccttaactagtctatagatgaattttcttgtcag

SEQ ID NO: 30914 - DNA, 315 bp, Zea mays
  unsure at all n locations
  Clone ID: LIB3059-022-Q1-K1-E1
ttgacaaagttatcttgtgcaattgaagcctctggtgctcggtgtcagatcggtatacagcaggtccgaggattgaaggtagtaagcttccaactagatagcttgattgcggagccgtagcgagaaagcatttataggaaaactgttgaagagctattttctttaagtacagtgtattttgatgaatangaattagatttgaagattccagctgatcttataagaagttctgagaatgtcaattcaattgtacaggataatggaagtgttaggttggagaactatcttgtccaggctattgcgttgcttcggcag

SEQ ID NO: 30915 - DNA, 239 bp, Zea mays
  Clone ID: LIB3059-022-Q1-K1-E10
cccacgcgtccgcaatacttcgcttttgaaatcatgctacgcttgcagaagggtcagcgtctggatcctcgtactgtttactgaaaacctaaaagatgcacgcaatgccgaacacgatctttccatatgcatgtccattcacgggtctcagatgattattgaaacgccagatttataagtcaccctagagcgcgcatgcatctagttaggagaccgcaaaggacagggcaccattttat

SEQ ID NO: 30916 - DNA, 325 bp, Zea mays
  Clone ID: LIB3059-022-Q1-K1-E3
cggacgcgtgggctgctgcagcgccttcgccgtcgccgccgcatctaacgcagttccgtgcgccgcagcccgaggcaagagggatctccagaacgacattgatctgctcaacccgccggcagaactcgagaagctcaagcacaagaaagagagactcgtccgagcggccaacttcttcttgatggatgttaagtgccaggggtgcttcggcataaccgctgagttcagccactcccaggactgttggtgtgtgccctggctgccaaactgtcctctgccaacccacaggaggaaaggcaaggctcactgagggctgctctttccg

SEQ ID NO: 30917 - DNA, 327 bp, Zea mays
  Clone ID: LIB3059-022-Q1-K1-E4
gaggaatattccgcatattggattgggccgatattgttaatgcgcatatagtacctggacctggaatcgtagatggcttggagctgaagggtttgcctaaaggaagagggctacttcggctcgctgagatgagctctgccggcaaccttgcccatggtgatgacactgctgctgccgtaaagattgctgagcaacattctgattttgatatgggataaatatcagtaaatactgagtcttggtcagtaaaaccatcaagccctgcatttatccatgccacgcctggagttcagatggtcgcaggaggagatgatcttgggcaacaat

SEQ ID NO: 30918 - DNA, 322 bp, Zea mays
  Clone ID: LIB3059-022-Q1-K1-E5
cagaaacacaccaagcgaagcgcactagcaacaacctatcagcaatggctaccaagagattatccataattgcgcttaatgcactttttgcgagcgcaacaaatgcgtccattatgaccacaatgctcacttgctcctagttccattattacacagttccattcaccagatacttaaatgacctaagaacactcaactgtgcaagccgataggctacaacaagcgagtgaagcgatcgtcttacaacaaccaattgcctaattgcaacaacaatccttggcgcatctaacaatacaaaccatcgcaacgcaacagcaacaac

SEQ ID NO: 30919 - DNA, 323 bp, Zea mays
  Clone ID: LIB3059-022-Q1-K1-C6
ggaccaactagcagcatataatgcacaataatgtaccaacaaaggcagccaaaagaggttgccttcttatgctccttggactatctgcaagtgctgctacggcgaccattttatctcaatgctcacaagctcctatagcttccattattccaacgatcctatcatcaaagaaatattcaatatggtaaaatcccaatttttaactctacatgatatttcaagcattagcatcaagcatcttacctttatcactcctggttcgcttcaacaatcatcagccctattacagcagttacctttggtgcatttattggcacaaaaca

SEQ ID NO: 30920 - DNA, 450 bp, Zea mays
  Clone ID: LIB3059-044-Q1-K1-G5
aggacatcactgcccaaatcatatctgctagtatagcgggtgatatggttcttgcttgggcctactcgcatgagttgccacgatatggtcttgaagttggtctgaccaactatgcagctgcctactgcactggccttctgttggctcgccgtgtgctcaagatccgtggttcggatcaggagtacgagggcaatgttgatgccactggtgaggacttctctgatgagccagctgatgagaggaggcctttccgtgctctcttggatgttggccttatcaggactacaacaggtaaccgtgtctttggtgccctcaagggagcattggatggacgcctggatattcctcacagcgagaagaggtttgctggattcaagaaagacgacaagcaattggatgctgatacccaccgcaggtacatctatggtggccatgttgctgactacatga

SEQ ID NO: 30921 - DNA, 445 bp, Zea mays
  Clone ID: LIB3059-044-Q1-K1-G6
cccgcgtccgctagccctagccgccgtccgccgacttcatcgtcgccgtcgtctagacgtcttcacgcactggaaaggttaaagtccgacatcaatggcgaagcatcatcctgatctcatcatgtgccggaagcagcctggcatcgcgattggccgcctttgcgagaaatgtgatggcaagtgtgttgtctgcgactcgtacgtgcgcccatgtacgcttgtccgggtctgcgacgagtgcaattatggttcgttccagggaaggtgtgtgatctgtggaggagtcggcatctcagacgcttactactgcaaggagtgcacccagcaagagaaggaccgggacggttgccccaagatcgtgaatctcggaagcgccaagacggatctcttctatgagcgcaagaagtatggttttaagaagagatgaccgagaagatggagctgt

SEQ ID NO: 30922 - DNA, 231 bp, Zea mays
  Clone ID: LIB3059-044-Q1-K1-G7
cccacgcgtgcgcgatgcagctgtctgtcttcaaatatatagctcactcgccggttggtgcggtacggattgatgtgtgcgtacgtgattgaagacggaggcccataagtgcgctgtcagcactggccatgtgcctggctcgatacgactccaacgtcctgctgaccgatgtgaccgcactctcggcggctgtcactttcgtcgcggcgcatgacctctactcgcggtgcc

SEQ ID NO: 30923 - DNA, 366 bp, Zea mays
  Clone ID: LIB3059-044-Q1-K1-G8
gaaagtggaatccagtagcaacaatagatcaacaatggagaccaagatatttggcctcgttatgctccttgctctttctacatgtgttgctaacgcgacaattttccctcaatgctcacaagctcctatagcttccctttttcccccataccttccatcaattatagcttcagtatgtgaaaacccagctcttcaaccatataggcttcaacaagcaatcgcagcaagcaacatacctttatcgcccttgttgtgtcaacaatcgccagccctatctttggtgcagtcattggtacaaaccatcagggcacaacagctgcagcaactcgtgctacctgtgatcaaccaagtagctctggcaaacct

SEQ ID NO: 30924 - DNA, 417 bp, Zea mays
  Clone ID: LIB3059-044-Q1-K1-G9
ggcttctcctccccctccggttcgggttcgggttcgtgaggttctccggagttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgat

SEQ ID NO: 30925 - DNA, 406 bp, Zea mays
  Clone ID: LIB3059-044-Q1-K1-H1
cggacgcgtggggtggaatccagtagcatcaacagagcaacaatggcgaccaagatatgttcgctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtccaaaccatcagggcccagcagctgcagcaactcgggctacctgggatcaaccaagtacttttggcaaaccttcttcctaattttaagaaccaccatttctttc

SEQ ID NO: 30926 - DNA, 422 bp, Zea mays
  unsure at all n locations
  Clone ID: LIB3059-044-Q1-K1-H10
caaccatataggcttcaacaagcaatcgcagctagcaacatacctttatcgcccttgttgttgcaacaatcgccagccctatctttggtgcagtcattggtacaaaccatcagggcacaacagctgcagcaactcgtgctacctctgatcaaccaagtagctctggcaaacctttctccctactctcagcaacaacaatttcttccattcaaccaactgtctacactgaaccctgctgcttatttgcagcaacaactattaccatttagccagctagctactgcctactctcagcaacaacaacttcttccatttaaccaattggccgcactgaaccccgctgcttatttgcagcagcaaatactactaccatttagccagctagctgcagcaaaccgtgcttncttcttgacacagcaaca

SEQ ID NO: 30927 - DNA, 221 bp, Zea mays
  Clone ID: LIB3059-044-Q1-K1-H11
tggtgtttgttgccagcaagcctgttggcaacttctttgcttttgatatgccactgttgtttgtgcatggtgagaagttcaatcagcccatatttcactgcaacaacatctctggattcgttgaaccagtcgttccagacaatcagaacagggccctgtactcaactcacaccttcaagatcttgttcaaggaaggcggctgtggtactttcgttcctctc

SEQ ID NO: 30928 - DNA, 129 bp, Zea mays
  Clone ID: LIB3059-044-Q1-K1-H12
cgggctcaaggcaccacaacttgatttacttgtgctaactgggatcaacggaattggttttggcaaacttttttccttattttcggaacaaccatttttttcatttaaaccaattgtttaaattgaacc

SEQ ID NO: 30929 - DNA, 448 bp, Zea mays
  unsure at all n locations
  Clone ID: LIB3059-044-Q1-K1-H2
cggacgcgtgggcggacgcgtggggagccgtgctcgcatgtgtgttaagcccagccaagacaagtcaagtcggagcccgcaggtgtcgacaccgcgcgccgggagccggaagaagggtggaccatgagcgcgaccgggcgagccccgtgcggcctgccgcgcatcggcctgggcacggcggtgcagggcccgcggccggaccccgtccgcgccgcggtgctgcgcgccatccagctcggctaccgccacttcgacacggccgcgcactacgccaccgaggcgcccatcggggaggccgccgccgaggccgtgcgcacggngctcgtcgcctcccgcgaggacctcttcgtcacgtccaaggtctggtgcgccgacgcgcaccgggacagggtgctcccggccctccgccggacgctcagcaatctccagatggaatacgtggacctgt

SEQ ID NO: 30930 - DNA, 448 bp, Zea mays
  Clone ID: LIB3059-044-Q1-K1-H3
cggacgcgtggggaaccacaccaagctaagcgcactagcaacaacctaacaacaatgggtacggagatattatccctccttgcgcttcttgcgctttttgcaagcgcaacaaatgcgtccattattccacaatgctaacttgctcctagttccattattccacagttcctcccaccagttacttcaatggccttcgaacacccagctgtgcaagcctataggctacaacaagcgattgcggcgagcgtcttacaacaaccaattgcccaattgcaacaacaatccttggcacatctaacaatacaaaccatcgcaacgcaacagcaacaacagttcctaccagcactgagccacctagccatggtgaaccctgtcgcctacttgcaacagcagctgcttgcatccaacccacttgctctagcaaacgtagttgcaaaccagcaacaac

SEQ ID NO: 30931 - DNA, 396 bp, Zea mays
  Clone ID: LIB3059-044-Q1-K1-H6
attgagaccaacaagcaacatataaagtggaatccagtagcaacaatagagcagcaatggcgaccaagatattttccctccttatgctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgtttcaacaatcgccagccctatctttggtgcagtcattggtacaaaccatcagggcacaacagctgcagcaactcgtgctacctctgatcaaccaagtagctctggcaaacctttcttcct

SEQ ID NO: 30932 - DNA, 386 bp, Zea mays
  Clone ID: LIB3059-044-Q1-K1-H7
cccacgcgtccgcggacgcgtgggcggtcgcgtgggcgccgcaccatcccttaagcgcggcagagccagtgccagtgccagtgccagtgaagcagagcagcagcatggctcgggacacagcagcaggcacaatcagcctagcgaggcggtcccgcccagccggtcccacagctccaggtcagagagagaccccagacatggcggcagcagggatcagcacctccaggacggcgccgctgggttgctgcaccctagcgacatgttcatcgtgaagaagaagaggcaagagcgcgcgaggagcggaatcgggtccccttccagctcgggccgaggcgccggacctttgtcgccggccaaccttgggcgtccggcccttgccccttggc

SEQ ID NO: 30933 - DNA, 429 bp, Zea mays
  Clone ID: LIB3059-044-Q1-K1-H9
cagcccaccacacccgcgcctccgtaccatccgtcgccgccggcgcaccgcgatggctgcctccgccacggccgcgaggcctttcgccgggactgccgtcctgctcccgctctcggcgcggacgcggcctgccagggtcgccttgctctccctgattcctcctgctccggccctgcgccttgctctcaggcgcggcgcgtggctcccactcccggagcgcagccggtcggtgcggtgcctggcggctatgagcccggagatgcgggcgacgctggacaaggtcgtaggctccagcaaggtggtgctgttcatgaagggcaccaaggacttcccgcagtgcggcttctcccacaccgtcgtgcagatcctgcgctccctcgacgtgcccttcgagacgctcgacgtgctcgccaacgaggcgctccggca

SEQ ID NO: 30934 - DNA, 315 bp, Zea mays
  Clone ID: LIB3059-044-Q1-K1-G4
cccactcgtcctcatgcactttcccttactcatagacctatatgttccataacaattccactttcaccattgtatgttcataaacttcttatacaacatacactaaactataactaccacactccctaaccctatctacttcaatctacttcaccttaaacccttcacaacaactactcctcaatcttcagatcttatccgatattccaacacacactgacattaatcaacattacaattctcatcacatccctactacctatcaccaactatcacactatctataataatatacaataaaaataacacttttca

SEQ ID NO: 30935 - DNA, 412 bp, Zea mays
  Clone ID: LIB3059-044-Q1-K1-E9
gccctggttcttcaacaaccggcaggcctaatacagcaggtacccttggggcatttggtgggaccaaacataaaggacaacaactacaacaacttgtgctaagaaaccttgctgcctactctcagcaacagcagtttcttccattcaaccaactggctgcattgaactctgctgcttatttgcaacaacaactaccattcagtcagctagctgctgcctacccccagcaatttcttccattcaaccaactggcagcattgaactctgctgcttatttacaacagcaacagctaccaccattcagccagctagctgatgtgagccctgttgccttcttgacacaacaacagttgttgccgttctacctgcacgctgcgcctaacgctggcaccctcttacaactgcaacaatt

SEQ ID NO: 30936 - DNA, 388 bp, Zea mays
  Clone ID: LIB3059-044-Q1-K1-F1
ccggcaaaaaaaaaacaaacacaagaaaaataaattaaaaaaaaacaatttttattttaaaaaaaaaaaaaaaaaaaaaaaggacatggcccaattcataaaatcacattaactacaaaaacaaacctccgctgtaaaaacatcctttatataaccacttgtcctttaaaaaccccacttttaaaatataaaaaacgccttccaaaaaaaaaaatccaaactaacaatacacgtgcatcctacctctaaaactctcccctatttctcacccaaacttaaaaaacttaacctttttttaaaaacgtcccaatttaaaaaacccttactttacttaaaaaaaccgtcattttaaaaaacccttcttttccaacttttattaccctaaaaa

SEQ ID NO: 30937 - DNA, 421 bp, Zea mays
  Clone ID: LIB3059-044-Q1-K1-F10
agaccaacaagcaacatagaaagtggaatccagtagcaacaacagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattc

SEQ ID NO: 30938 - DNA, 392 bp, Zea mays
  Clone ID: LIB3059-044-Q1-K1-F11
gcctggggtgtataagggggtcttggactccgacgctggactatttggtggatttagcaggatccatcacgcagccgagcacttcaccggcgactggtcgcatgataataggccatattcattctcggtttatacaccaagcagaacatgtgtcgtctatgctccagtggagtgatagcggggtactcgttgctgcgcggcatgtgtggggctgtcgatgtgaggaaaaaccttcttccaaaaccggcagatgcatgcatgcatgctacaataaggttctgatactttaatcgatgctggaaagcccatgcatctcgctgcgttgtcctctctatatatttaagaccttcaaggtgtcaattaaacatagagttttcgtttttcgctttcct

SEQ ID NO: 30939 - DNA, 406 bp, Zea mays
  unsure at all n locations
  Clone ID: LIB3059-044-Q1-K1-F12
nccacgcgtccgaaaccggcaggtaatgttgggccggtattaaattggccaccaggggcagaggcttattattggccattaccccaggttattggaaaccttttggcaccagaacaagctttttttggttaattaaaccattcaaatttggttaaaccttgaagacccatttgcacgtgataggtacaaccaatgatttaaagtcgcctagtcggctggtcgaaccctgggactgaccaggcgactagtcgcgattaggcgacgactagggcgactagtcgacccctagtcggtcctagtcggtccctggtcgtcctagactagtagctatacttatataggtatatatataaatatacctgtatacattatataaattagaacaaacaactaggataaacaaagt

SEQ ID NO: 30940 - DNA, 343 bp, Zea mays
  unsure at all n locations
  Clone ID: LIB3059-044-Q1-K1-F2
ggcctagcgccgcacccgccgncgcatcagccatcagccatggcgatggccgctcgcctcgtctcgcgctcccgtcagctacattcggttcaagcagcttttgcgaatggaggtgccactcaagttcgctcctttgccaaggatgcagctccagctgaccgtcctcctgttggtggggatgatctcctgaagggcatattctttgaggtaaagaagaagtttgagacagctctcggcgtccttaaaaaggaaaagatcactattgatccagatgacccagcggcagtttctcaatatgctcaagtcatgaagactgtaagggaaaaggcggatcttctttctg

SEQ ID NO: 30941 - DNA, 412 bp, Zea mays
  unsure at all n locations
  Clone ID: LIB3059-044-Q1-K1-F3
gcacaccaatcgcccacaagagctcgcaggaaaggtcgaacnctaacttttgccgggggggggagaagatgatctacgacgtgaactcccccctcttccgttccttcctcagccagaagggcggcgccgacaagaggaaaatggaggagcataaaccaaaggagcagaggcccaaggctaacgagaacaagcctgtgatgaacgaatgaatatctccagaagctttgttcaatgtgcaaccaagtccgatgtccgtctgctctggtcagcttaaaaccaacgcttccaataatcctattggtgtcttagtttccccttatagtgttatttgctcggcttgaacatggcaacggaaatgaaacttgaactatggtactgtcatcaatttgagacccccatgattgacaacttt

SEQ ID NO: 30942 - DNA, 443 bp, Zea mays
  unsure at all n locations
  Clone ID: LIB3059-044-Q1-K1-F5
gctgcttcgtcggcggcctcgcctgggccacggacgaccactccctccacaacgcctgtgagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggcggcggctacggcggtggcggcggctacggtggcggcggcggctacggtggtggtggcggcggctacggcggtggcaaccgtggcggcggctacggcaactncgacgggaactggaggaactg

SEQ ID NO: 30943 - DNA, 443 bp, Zea mays
  Clone ID: LIB3059-044-Q1-K1-F6
gttcgctctcctagctctttgtgcaagcgccactagtgcgacccatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccattgatgatgcagcatgtcaccaatggtcttgccgagcatgatgtcgcaaatgatgatgccacaatgtcactgcgacgccgtctcgcagattatgctgcaacagcagttaccattcatgttcaacccaatggccatgacgattccacccatgttcttacagcaaccctttgttggtgctgcattctagatagaaatatttgtgttg

SEQ ID NO: 30944 - DNA, 411 bp, Zea mays
  unsure at all n locations
  Clone ID: LIB3059-044-Q1-K1-F8
gagggagagaaaaacccaggccccccgatctcctcctcccactccgatcgcccgaccgatcgccgagcttccctgttccctccccgcccccgcgacgccgcgacgccatggagccgccgcacgccgagcaggccgtcgccgctgtagcagcaggaggagagggcggcaccgcaagcccgggcaccggcctcgaagggccggtgcttaggcggnggctggacggcggtggggaaggggaggacggtgagctgggggcggngcaggaggcgaacgcacggctaccagagcggcctggcgaggcggactgtggctactacctccgcacggccgcctgngcttccgggaagcgtgccggtacaaccattcccgcgatcgtggcggcactgaggtgcgcgcgggcggacgattttc

SEQ ID NO: 30945 - DNA, 278 bp, Zea mays
  unsure at all n locations
  Clone ID: LIB3059-044-Q1-K1-G1
cccacgcgtncgcggacgcgtggggcatggcggaagcagaattattatattttgggccaatcattgccattaacattgtcttcaatgtacactggtattggcggcgagatgacggatcccaatcggcgtcaatctatctgagcttaaacccttcacgacaagaggcacacgatcgccagcgctgcgccgatagtccaagatgcagtgtctcttgctgcgttgntcttctgatctgcangcggttggccgtccgcgttcggcgaaggagctggggtagt

SEQ ID NO: 30946 - DNA, 424 bp, Zea mays
  unsure at all n locations
  Clone ID: LIB3059-044-Q1-K1-G10
ggcgactatcgcctccgcgattcccaccctcgcgagcgtgccgatgctggcgtgggccaaggccaacatcaaccccaccggccaagcgctcatcgtctccacggtggccgggatggcctacttcatcgccgccgacaagaagatcctgtcgctggcgaggcgccactcgttcgaggaagctccggagcacctcaagaacaccttcttccagggcaccggacgcccccacccggctttcttcaagccatgatgagatcagatatatatatgacacatccggcgacctcatcagtcatagaacccaagcagccagtcagtcagtcagcacaagcacaagcaccaaagatgatgccattcaagtctgcatggttgcatttataaaaaataaactgctangctgatgacgcgctctaatataagctag

SEQ ID NO: 30947 - DNA, 348 bp, Zea mays
  unsure at all n locations
  Clone ID: LIB3059-044-Q1-K1-G11
cccacgcgtcccgaatttaatctggcctggcttttgcgggggtcaatggttgtcctggttggctggtggtaggtgctttggttacccattattcggattggaaggccgtttgtaaggggcctggctgaataagtccttagtccctggcttacactgctgtgctaccacatgacatgatgtactcgtgtgtgtgctaggatggtgtgtaattacatgaccatgatcagtaatctgaataaaaaatattggagatgtgcttgcttcctaaaaaaaaacatncgtcgacctaatcaatcatagagcccagccagccagtcagtcaagtaagcacaagcacaagcaccaaaa

SEQ ID NO: 30948 - DNA, 299 bp, Zea mays
  unsure at all n locations
  Clone ID: LIB3059-044-Q1-K1-G3
ttggccggccccttggccttaaagggcccatggttttggacctggttctcgaacgggtccttaaccttcctgaaggccttggaaaaccaattttaacaacaacaatggccttggtggtttgaccgtacttttcattggaaggtccacaggaactaatgcttgatctttggatgttgnttgaagatgaaaacacatcaagagaaaattacgaggacaacaatggttacatgcctncaagttatgaagaaggaacatcctctggaggaggattgagaatgaaactcaaacagtttcacaaa

SEQ ID NO: 30949 - DNA, 383 bp, Zea mays
  Clone ID: LIB3059-044-Q1-K1-D11
tagagagaaggaaaaatatccccaaaccgtagctgccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgtccccggtgtgctctccatggccaacgccgggcccaac

SEQ ID NO: 30950 - DNA, 422 bp, Zea mays
  unsure at all n locations
  Clone ID: LIB3059-044-Q1-K1-D12
cccacgcgtccgcttgtccacgaagaatgggctgggtttgcacctttggaagtgggagctcctcgtgttcgtgctcatctgcgggcgtcttgtcttcggatgggtcattaagattgccgtcttcggtgtcgaacgcaacttcttgcttaagaagcccgtgctctactttgggtatggagtgcccaacgccgtgcaaaacgcgctcttgctcggcctggtgctcgcctcttggcacttcttgtttgacgagaatgtccagcaagagacgaactctccagtactgccctatgtgacgaaggtactattctgctttcttgttgccacgctcatccgccttgtcaagacattgctgctgaaggtactggcctnctccttccatgtctcgacgtactttgatcggattcaagaggcattgttcaatc

SEQ ID NO: 30951 - DNA, 384 bp, Zea mays
  unsure at all n locations
  Clone ID: LIB3059-044-Q1-K1-D2
ctcgggatgaccttcagaaatagtggtatgttcttctaaaggacaagaacatgctaatgacacagcgtcaaatgctgcattcagagagcatgaggttcccaaatccagaacgaatttccaaggtaaagaaatcaatgtgccggataaagcatgtcttgactgagagggctatagcggagcccgatccaaggagatcttcggaaatgaagcggatgataaatgccctgtgattcactcacaggcattctcccttgggacttttgatggtacttattagaaagatctgctgccttctgttgtatctctatcccataagaactgtgagaccaaatcttttcgatgcccatggtatggtagcaaaaattagactntaactgatccgat

SEQ ID NO: 30952 - DNA, 362 bp, Zea mays
  Clone ID: LIB3059-044-Q1-K1-D5
cagaaacacaccaagcgaagcgcactagcaacgacctaacaacaatggctaccaagatattagccctccttgcgcttcttgccctttttgtgagcgcaacaaatgcgttcattattccacaatgctcacttgctcctagtgccattattccacagttcctcccaccagttacttcaatgggcttcgaacacctagctgtgcaagccaacatgcaacaacaagcgcttgcggcgagcgtcttacaacaaccaattgcccaattgcaacaacaatccttgccacatctaacaatacaagccatcacaacgcaacagcaacaacagttcctaccagcactgagccacctagccatggtgaaccct

SEQ ID NO: 30953 - DNA, 167 bp, Zea mays
  Clone ID: LIB3059-044-Q1-K1-D6
gcaaatttcacttgtgctgtcaaagactatcttgtcttatgttatgtctctaggcttttgttacaactacccaagttttgagtttttgagatgtggctatggcatgaactcaaaccatcttatgagggtgaaacctgtttctaatttctatattgttgctgttcatt

SEQ ID NO: 30954 - DNA, 438 bp, Zea mays
  Clone ID: LIB3059-044-Q1-K1-D7
agaaggccttcacagcagcctgagtttatagactatgttccatgagtagtctatagaatgtctttttaattcaaaagaaatctctcttctaggctggtgcttttcgactataatttggagattgttccatgtccgtgcaatcatctgaacatgttactacttattgtaccttgtcgtgcaaagttttgctaagatctctattgtttcatgtcttctgataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggcgccctttttaagggtcccaagtttacttccccgtccttgcaacttcaaaccttttttatggggcccccaaaattaaattcccgggc

SEQ ID NO: 30955 - DNA, 424 bp, Zea mays
  Clone ID: LIB3059-044-Q1-K1-D8
agcaagaagaaggctttcacaaagtatgctctcaaatatgaaaatgatgctggcaagaaggaaattcagctgcagcttgagaagatgaagaaatatgcttctgttatccgtgtcattgctcatacccagattaggaagatgaagggtttgaagcagaagaaggctcacctgatggagattcaggtcaatggtggtaccattgctgacaaggtggactatggctacaaattctttgagaaagaggtccctgttgatgctgtcttccagaaggatgagatgattgacatcattggtgtgaccaaggggaaaggttacgaaggtgtggtcactcgttggggtgtcacccggcttccccgcaagacccacaggggtctccgcaaagttgcttgtatcggtgcatggcatccggctagggtctcctata

SEQ ID NO: 30956 - DNA, 421 bp, Zea mays
  Clone ID: LIB3059-044-Q1-K1-D9
ctaggaagcaagggacaccaccggcattgcagccaagatgcttgcattggtcgctctgctactctttggcagcgcactatgcgaccatattccaggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtcttgccgagcatgatgtcgcaaatgatgatgccacaatgtcactgcgacgccgtctcgcagattatgctgcaacagcagttaccattcatgttcaacccaatggccatga

SEQ ID NO: 30957 - DNA, 342 bp, Zea mays
  unsure at all n locations
  Clone ID: LIB3059-044-Q1-K1-E1
ctcaccaagagcttaccacagaccagagctcgcatggaaggaattctgatcaggagtctgaacccaaccgaatcctcttagttactatccaccacatgatctatcctataacggtggaggttctacatcaagtattcaaagcttatggatttgtggagaagattgtcacatttcaaaagtcagctggttttcaagctcttattcagtttcactcgcgccaaagagctgtggaagcatttggttcttgcatggaaggaacatatatgatggttgctgccagctagatattcaatattcaaatctcagtgaactgcaagtncattacaacaacgaccgatctag

SEQ ID NO: 30958 - DNA, 421 bp, Zea mays
  Clone ID: LIB3059-044-Q1-K1-E10
gaccaagatattttccctccttatgctccttgctctttctacatgtgttgctaacgcgacaattttccctcaatgctcacaagctcctatagcttccctttttcccccataccttccatcaattatagcttcagtatgtgaaaacccagctcttcaaccatataggcttcaacaagcaatcgcagcaagcaacatacctttatcgcccttgttgtgtcaacaatcgccagccctatctttggtgcagtcattggtacaaaccatcagggcacaacagctgcagcaactcgtgctacctgtgatcaaccaagtagctctggcaaacctttctccctactctccgcaacaacaatttcttccattcaaccaactgtctacactgaaccctgctgcttatttgcagcaacaactattaccattt

SEQ ID NO: 30959 - DNA, 423 bp, Zea mays
  Clone ID: LIB3059-044-Q1-K1-E11
gtgacaaggaccaaacctatgacctcaactttaagggggagaataatgatgggtcacagaagatatctggcgatagcttaaagaatgtatacaaatcttttgtgagcgaataccccattgtttcgattgaagatccttttgaccaggatgactgggttcactatgctaagatgactgaagaaattggagagcaagtgcagattgttggtgatgaccttctcgtcaccaaccccactagggttgctaaggctatcaaggagaaatcatgcaatgcccttctgctcaaggttaaccaaatcggatctgtgactgagagtattgaggctgtgaagatgtcaaagcgtgcgggctggggtgtgatgactagtcataggagtggtgagactgaggacactttcattgctgatctggcagttggtttgt

SEQ ID NO: 30960 - DNA, 95 bp, Zea mays
  Clone ID: LIB3059-044-Q1-K1-E12
ggcaggcgttccatcactcgtccggtagggtttttcagagatactccgaaagcatggggcggacatacttacccattgcaatgcaaacagattta

SEQ ID NO: 30961 - DNA, 418 bp, Zea mays
  Clone ID: LIB3059-044-Q1-K1-E4
cgacgggggtttccaacgccggattggaccatccggaaccttaggcccaagattcgttggcattcagtaatgcctttgcctaaatcagacctggggtcataactctttagtagagaaccaagaagatgcaggcatctagggcaaggcttttcaaggagtacaaggaggtacagcgagagaagtcagctgaccctgatatccaattaatatgtgatgattctaacatattcaagtggactgctcttatcaagggcccttctgaaacaccttatgaaggtggtgtgtttcaacttgcattcgcaattccagaacaataatcctttgctgcctcctcaagttcgatttttgaccaaacttttccaccaaatggtccttttcaggacaggtgagatttgtctggatatattgaagaatgcat

SEQ ID NO: 30962 - DNA, 436 bp, Zea mays
  Clone ID: LIB3059-044-Q1-K1-E6
aagaaaaggaaccagatccagagaagaagtggtagtggcgatgccgccgagggcagcgccgtcgtcgtctctcttgccgcttgcactcgccgccgtcgcagtcgtcgtagcacttgccgtttgctcctgttccgcgaccacagatgctccaggcctgggagcgggagcgagagagatggtggcacgggacgaccccaagtgcgaggagatggtgccctgcaccttcaggcgctgcatccagtactgcgtcagcatagggctgcagcctgcagcccaaggggttctgcaactccaagcccaacatgcaggtctactgctgctgcgtcatcccctagcatcatagctcctcgtcaacacacctaaatctgcagccctgctagagaagatacgatctctatgcagattagctgcagcgatatatatagatggatgaatc

SEQ ID NO: 30963 - DNA, 423 bp, Zea mays
  unsure at all n locations
  Clone ID: LIB3059-044-Q1-K1-D10
ctcgtagagagaaggaaaaatatccttaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgnccccggtgtgctctccatggccaacgccgggcccaacaccaacggctcccagttcttcatctgcaccgtcgcg

SEQ ID NO: 30964 - DNA, 322 bp, Zea mays
  Clone ID: LIB3059-022-Q1-K1-A4
gctccttgctctttctgcatgtgttgctaacgcgaccatttatcctcaatactcacgagctcctatagctgaccttcttactccataccttccatcaatgaccgcttcagtatgtgaaaacccagcccttcaaccctacaggctccaacaagcaatcgcaacgagcatcttacctttatcacccctgttctttcaacaatcgccagccctatctttagtgcaggcattggtgcaaaccatcagggcacaacagctgcagctactcgtgctaccagtgatcagccaagtagctctggcaaacctttctccctactctcagcaa

SEQ ID NO: 30965 - DNA, 319 bp, Zea mays
  Clone ID: LIB3059-022-Q1-K1-A5
cggacgcgtgggctgcgaatgacgggatcatccttcgcatccatatctcacgggggcttcggcgccgctttaagggcaagctcttactatgctgatctccttgatttgttcaatgacgttgagttcaagacagcttcaggtcagctgctggaccttatcactacgctttgtgggtaaatcgatctaacaagtgataacataacagttcacggtcgaattgggcattacatgacagtctattattcattgtatctggcagttgcatgtgccctgctgctctatagcgagaatttggacaattatggtgatgtacagaaca

SEQ ID NO: 30966 - DNA, 108 bp, Zea mays
  Clone ID: LIB3059-022-Q1-K1-A8
cttgacgagctctccacgctcctccaagttcctcttgtaatatgaactgtgaacaggggaagcgaagtcattgctgcattcttacctgtgaacgactggactgccttt

SEQ ID NO: 30967 - DNA, 308 bp, Zea mays
  Clone ID: LIB3059-022-Q1-K1-A9
ccacgcgttcgttgccggtcccgaataaagagcagcagcgcagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgcgcgacacctgccgcgagatcgggttc

SEQ ID NO: 30968 - DNA, 321 bp, Zea mays
  unsure at all n locations
  Clone ID: LIB3059-022-Q1-K1-B1
ggtgatctcaagtaattaacagaaaatatattccatcattgaaaatgagttccgttggtgtgggtgctactggtagggagaataagacatcatggcctgaggtggtgggcatgtgcatcaaggaggcaagagagatcattcttaaagacatgcccaacgctgacattcaggttctaccgataggctcgcttgagacccaagactttcagcctgatcggtttagcatagtggatgatattgttggctagactccaacagttgngtgacaaggatatgccttatgtataggccaaataaacaaagcctacttttatgtatcat

SEQ ID NO: 30969 - DNA, 402 bp, Zea mays
  unsure at all n locations
  Clone ID: LIB3059-022-Q1-K1-B10
gttttcacgggtgctccaggaaagtatgtggagctgaaggaaagcgtgaagagtttgcagggtgttttggatgggaagtatgatgacctccctgagcagtcattctacatggttggtggcattgaggaagtcattgctaaggctgagaaaattgccaaggagtctgcttcataaggaggcttcttgcttgttcaaccctgtacaagttccatttttggattttaagcgtttatttatgcttttcccagttaggcatgacgagctggagagtccatctcctgctgagagatgtttggtttacccttctttgcttncttcaacttacacccaaattagcaactgcagtgacgttggttttggctgcacccaaacttccttgactgaagaaacttgtggcctgtg

SEQ ID NO: 30970 - DNA, 411 bp, Zea mays
  Clone ID: LIB3059-022-Q1-K1-B11
acagtttctgccattcaaccaactagctgcattgaactctgctgcttatgggcaacgacaactagtactaccattcagccagccagctgctgcctacccccagcaatttcttccattcaaccaactagcagcattgaactctcctgcctatgtacagcagcaacaactactaccattcagccagctagctgctgtgagccctgctgccttcttgacacagcaacaattgttgtcgttctacctgcacgctgcgcctaacgttggcaccctcttacaactgcaacaattgctgccattcaaccaacttgctttgacaaacccagcagcgttctaccaacaacccatcattggtggtgccctcttttagattgcttatgagttatagttcaataataaagtgtttttgatgaa

SEQ ID NO: 30971 - DNA, 437 bp, Zea mays
  Clone ID: LIB3059-022-Q1-K1-B12
cctttgcctgccttcccatctcctctggtcttccgccatggcccagcccgtattcctgctcctctctccgctcccgcctctgctccgcgccgccgtcgccgcaccatcacctccagcccagccgcggctaccacgtcgagctcggcgctcgcgagaaagcgcttttggaggaggatgttgctttgaagaggttcaaatcatacaagaacagtgtgaaacaggtctccaagattgggaatgttctcactttagctgttgtattcggttgtagctacgagcttggtttgttggcggcaagcatgaagtgaaggaaaacacagccattattccgggaagtgatccatcagcgtagactgtcattctatcacctcgtgtttttagcctgtctgtctctctcttattttgtcgtgcaccatgtataaaataaaactaaacta

SEQ ID NO: 30972 - DNA, 114 bp, Zea mays
  Clone ID: LIB3059-022-Q1-K1-B2
agcacgcgtccgcgcaaattgcaccaagaaatccatcgagaggccatcgacaggggagtgagaggcgtcgtcgtctagcagcatgcctccggcggctcatcctcgcaaccgccg

SEQ ID NO: 30973 - DNA, 318 bp, Zea mays
  Clone ID: LIB3059-022-Q1-K1-B3
gtcgtctgagccagcagcacgggctgtcaagcatgggcgccaactaggtgctcctcggggtctaggcctacgagacgcttagcgaccgcgcgccctacccggccagcttcatgctctgccagctcaccggctcctacgccttcgtgctgttcgacaagtccatccactacatgatagtctgatgcgacccctatgacagattgccgaatttctgggagatcaacgcataatgctgcatcgccttatacgacgacatcgacatactcaaaggctcatgcggcagtgcgctcgcgccgttcccgcaaggctgcttctact

SEQ ID NO: 30974 - DNA, 54 bp, Zea mays
  Clone ID: LIB3059-022-Q1-K1-B4
cgcagccgccgtcctgctctccgtgctcgcggctgccagcgccagcgccgggac

SEQ ID NO: 30975 - DNA, 324 bp, Zea mays
  Clone ID: LIB3059-022-Q1-K1-B7
aattattgaaataaatccttacatgctggggacaatggctggaggtgctgctgatggccaattttggcataggaacctaggaaccaagtgtcgtctccatgagctttcaaacaagcgaaggatctctattgctggtgcttccaaactgttgactaacatcctttattcatatcacgggatgggactgtagataggtacaatgatcgctggatgggatgagaaggatcctggctaggactatgttgacagagagggtgcgcggctcgtggggaacaggttgtctgttggctctggttcactgtatgcttatggtatcttggatga

SEQ ID NO: 30976 - DNA, 317 bp, Zea mays
  Clone ID: LIB3059-022-Q1-K1-B8
agttgctgcacaaacaaaagctattgctgctaagatcaaggtctgtatcaacgtaggggttgcctattatccagtttagtctagggtaactggtaaagttgctcaccccagctcatgctcaggaagtgcacacctccctgaggtattggctaaatgccaatatcatccctgactgagctgcatctactattatcattttcttaagcagtgtaactactgataactgtaaagagctttcatcacattctgatgaagatgaataaatgccagaggagcttctttgaagcctgacttcatcgacatcatcaacgcggtca

SEQ ID NO: 30977 - DNA, 284 bp, Zea mays
  Clone ID: LIB3059-022-Q1-K1-B9
cccacacctactggcacttttccagttttctagacgaacagcacaatgaggggacggtcataactctcaaggcgaagccgaataagtacactgccaacgacatcgcactgaagatccactcttcttccactaacctgtactgcttgtacgctcctcacgccgacctgactgacgcaatacaacgccggtcatgcgaagccttcgtgccacttcttacgcacccctgatcccgacatcaagtccatgcagatccaccacgacgcgcgccaccccaaactcccctt

SEQ ID NO: 30978 - DNA, 358 bp, Zea mays
  Clone ID: LIB3059-022-Q1-K1-C1
cggttcgagttgcaggctcgtcccacgcgtcctggttccgaccgatacctttcttggaactcaagaaggatcttctcccctaccgacctagcgtaatcggcgatggcgactgaggcgatggacatctcgaagcccacgccggtggcgtgcggcgacgaggccgcggcggctgccaaggggaggatcggtagagtgttcttggagctagatcaggactacctgcatgtcattcacgacctgaagctacagagccattagaagactgacatctctcaccattattgaggcccaactgaatggcctcaactcccgagttacaatgctcagggaagagttgcagttgcttcaagagcctggc

SEQ ID NO: 30979 - DNA, 369 bp, Zea mays
  Clone ID: LIB3059-022-Q1-K1-A3
attattgagaccaacaagcaacatagaaagtggaatccagtagcaacaatagagcagcaatggcgaccaagatattttccctccttatgctccttgctctttctacatgtgttgctaacgcgacaattttccctcaatgctcacaagctcctatagcttccattcttcccacataccttacatcaattatagcttcaatatgtgaaaacccagctcttcaaccatataggcttcaacaagcaatcgcagcaagcaacatacctttatcgcccttgttgtttcaacaatcgccagccctatctttggtgcagtcattggtacaaaccatcagggcacaacagctgcagcaactcgtgctacctttgatca

SEQ ID NO: 30980 - DNA, 444 bp, Zea mays
  Clone ID: LIB3059-022-Q1-K1-C11
ggaccgttccttaaaatgaacaaaaccgtaccacagactgcagggcagcagcctgtgcatgtgacttcgcctctgccacagcaaggcggtcgtcgattcggcggcggtggcggatccagctccggcggaaagcgacagaggggagatgatcgtggcagtagccgcaggggctggcaccgtccgtattgatgtttgccatgccgctgatttgcaattagaagttagaacccagcaattagcatatttatcgcagtaccatgctggaaactgtactttgaattatttgtttttcctgtgtgcttcgtaacaggcctgccctaaaaagaatgatagtaccgcaaggggcaaatgtagtggtaatataatctatacatttgtaaccatcttcatcctgcgttgaccgtcttaggttattaaaataaatatatttcctccgttcttttt

SEQ ID NO: 30981 - DNA, 428 bp, Zea mays
  Clone ID: LIB3059-022-Q1-K1-C12
ctgacaataccgtcctcaggacaaggcacctcagaagcccttctcgtccgcgccgcctccttgaccccgctggccggcgagctgctcagcgcggcttttttttgcatccacaatgccgcagcttggcacatgttcattgcctggagctgcaatctatggcacttcaactaggagatttggaggtttggagtttcagcaacataaagttaatcacatctcatttggtcggaaagcgtctgttaaagcaacattgaaaactgtgagatgcaatgccactcaaacacaaagcgtccaaaagaaatcttcaagtgcaactattcagcgtgataagaaaggaaatgtacaagggccaaaactggatgacggaagcggtgggttccctccattccgctttggcaaaggtgggggtggtggtggaagcgggggaa

SEQ ID NO: 30982 - DNA, 128 bp, Zea mays
  Clone ID: LIB3059-022-Q1-K1-C2
tatgactcgtgcatacccattctctagttttgacttaacgcatttatcattttctgagggttcttcactccaagtattaactaatataattaatctttcgatgctccaataaagcttaaatttccaac

SEQ ID NO: 30983 - DNA, 325 bp, Zea mays
  Clone ID: LIB3059-022-Q1-K1-C4
gcttactatgttacatgggcgcggaatttatggatcttgcatggggtgtaatggcggggggtaaatataacgtagaataagatgttgaaagatatggcataaaaccgaaacgacacagaagttgcataaatagtatataccgtttggcgtaaaacgttaagtcattgtgtgtaaatagtgtattatggatattagattgacattgacatcgccataatatcgggactgtttcggaaataatgggtagaccctgtaaacgtggatgcagttacttgtatagtatacgtgatttcctttcatccgaaaaaacaccacaaagcctgca

SEQ ID NO: 30984 - DNA, 328 bp, Zea mays
  Clone ID: LIB3059-021-Q1-K1-H10
ggatgaattaggttcacgatcaagctctattgtgttctaagaaactttctgtgctcgcccaatgttacattattaggaagcggatgaatatgcatgcagttttgttgtttggaactagatgtgtatggaagaaacatgatcttttttctcggaggtttaaaattatatatttagggttagtttgaaaacttcatttttccaagggatttctattttccctaggaaaaatgaactggtttcccaaaccagcccatgatgcatttcccgtcctgagtatcgggcctttttctctgtccaaaaaaaaaaacaaaaaaataaagtttttttt

SEQ ID NO: 30985 - DNA, 444 bp, Zea mays
  Clone ID: LIB3059-021-Q1-K1-H11
caagctcctatagcttccctttttcccccataccttccatcaattatagcttcagtatgtgaaaacccagctcttcaaccatataggcttcaacaagcaatcgcagcaagcaacatacctttatcgcccttgttgtgtcaacaatcgccagccctatctttggtgcagtcattggtacaaaccatcagggcacaacagctgcagcaactcgtgctacctgtgatcaaccaagtagctctggcaaacctttctccctactctccgcaacaacaatttcttccattcaaccaactgtctacactgaaccctgctgcttatttgcagcaacaactattaccatttagccagctagctactgcctactctcaacaacaacaacttcttccatttaaccaattggccgcactgaaccccgctgcttatttgcagcagcaaatactacta

SEQ ID NO: 30986 - DNA, 369 bp, Zea mays
  Clone ID: LIB3059-021-Q1-K1-H12
cggcaacgcatattgcaccaagaaatccatcgagaggccgtcgacaggggaattaagtgcgtggtcgtctagcagcagtcaccgccgcctcatcctcgcagccgccgtcctgttatccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgaactgccggtgcacggcgctgagcatcctcatggacggcgcgatcccggcgggcccggacgcgcagctgga

SEQ ID NO: 30987 - DNA, 365 bp, Zea mays
  Clone ID: LIB3059-021-Q1-K1-H3
ccgacgcgtccgcgagaagttactcaaggtggcaagagcaaatttggagcggactccggaaccgtccttagggtcctgtgtcacagaaatgattcagaggcatcacattacgtgaagaagcaattcaagatacccagctcagctccgagcgcctgattgattgcgaacgaaaaaacagatatcgaacaggacagtgcagccttgctcgtaacccaagaaacggtgctccaccgcccattttcatgtttgtgtaacagttattgttcatcggtaacactaagactttgggtggacgcggcagtaaacatgtatttacacaaatactaacacactggttccgatttgaatggtactagtttttggcc

SEQ ID NO: 30988 - DNA, 350 bp, Zea mays
  Clone ID: LIB3059-021-Q1-K1-H4
ctggattgttatggtgatcctgaatttatcggcaagattggaacggacattgaagagtacaagtgctcatggctagttgtgcaagcccttgagcgtgctgatgagagccaaaagcgcattctattcgaaaattatggcaagaaagatccagcctgtgtggcaaaagtgaagaacctctacaaagaacttgacctagaggcggtatttcaggagtacgagaatgagagctacaagaagctgattgcagacattgaagcccagccaagcattgcggttcagaaagtgctgaaatccttcttgcacaagatctacaagaggcagaagtacggtgctcttggataaacgagctc

SEQ ID NO: 30989 - DNA, 411 bp, Zea mays
  Clone ID: LIB3059-021-Q1-K1-H5
cggacgcgtgggttgatgatggagaaactttccaatggagtaaggttacaagaacagttaacaaccttatccttggtcgagtatattgccatcaccatggcacaatgaacataagtgggaatagacgatattcatgcaaactgacgtttaaagagcagtctttccttgatcggaatcctcgccaggttcaaggagttgtcaacgatgctgatggaagcaaggtcgcaacattgatggggaagtgggatgaaagtatgcattatatcatcaacaatgatgcctccaagaccaactcccatggttcacatgagggttctggtgccactttgctatgggagaaaaacgagcctccagtcaatcccactcgctacaacttgtgcacatttgcaataacattaaatgagttaacac

SEQ ID NO: 30990 - DNA, 344 bp, Zea mays
  Clone ID: LIB3059-021-Q1-K1-H6
cggacgcgtggggccgccgtcacctgctgcagcttctcaaccggatagggagcacgggagcaggtagaacgctgcacaatccccttcgccgccgccaagatggtgaacgttcctaagaccaagaagacgtactgcaagaacaaagagtgcaagaagcacacactccacaaggtgactcagtataagaagggcaaggatagcctgtctgcccagggaaagcgccgttatgaccgcaagcagtcacgatatggtggtcagaccaagcctgtcttccacaagaaggccaagaccaccaagaagaatgttctgaagctgcaatgccagaacttcaagcactacttaca

SEQ ID NO: 30991 - DNA, 366 bp, Zea mays
  Clone ID: LIB3059-021-Q1-K1-H8
cgggattgttatggtgaagaagaaggatatccgaaagtttttggacggtatctatgggagcggcaggggcgtcatcgaagaggagcagtgagcgacagagtagccgaaatgccaggagatgaatatggatgtcgtttgagttgcaattttgtgagactgaatgtgaaccctttttctcattccttaaatagttgactgccagtgttcgtggtttcaaacgaaatttagtcttattaactgaatttgcgtattcaaatggattgcgtggctgcctggttatgttttgaattttgcgtcgcggtccaataattcgatggactggacccaaggaaatttgaatccgaatggactgatacgttgtatttt

SEQ ID NO: 30992 - DNA, 391 bp, Zea mays
  unsure at all n locations
  Clone ID: LIB3059-021-Q1-K1-H9
ngacgcgtccgcacaagcaacatataaagtggaatccagtagcaacaatagagcagcaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcacctgcagcaacttctgctacctgtgatcaaccaagtagctttggcaaaccttttt

SEQ ID NO: 30993 - DNA, 146 bp, Zea mays
  Clone ID: LIB3059-022-Q1-K1-A1
tgtgggcttctcctccccctccggtgcgggttcgtgttcgtgtgggtctgcggagttggggttcgtgggtcagcggatcgagaggtggagtatgcgatgttgagtaccgctgcctcgtagggtgactcgcctgggccacggacgac

SEQ ID NO: 30994 - DNA, 442 bp, Zea mays
  Clone ID: LIB3059-022-Q1-K1-A10
gacgaaaataatgttgataaaagcatatgacctctagtacctatcgattactccactgaagaattacaagctgtacatgctaattcttctactggggcaaatgtcacagcagctgccgagtttgccaagcgcatctcagtttctaattcaaaggaagagaaggctgaagctgagaaggataggaataggagatccagtgaagctcgtcctaatgatgagcgaagagagaagctacatgatcgcgagaaggataagcccaagtcagagaacaagaagattctggatgcaaagcaactaattgatatgatcccaaggacaaaggaagagctttttgcctatgatataaactgggcgatatatgacaagcatgagttgcaagagagaatgaggccttggatttcaaaaaagataattgaatttcttggcgaggaggaatcaactt

SEQ ID NO: 30995 - DNA, 416 bp, Zea mays
  Clone ID: LIB3059-022-Q1-K1-A11
ccacgcgtgcgcgcacgcgtccgcccacgcgtccgcaagcaacatagtattgtggaatacaggagcagcgatagagcaacaatggcggcaaagatattttccatccttatgctccttgctctttcttcatgtgttcctaacgcgaccatttttcctccatactcacaagctcctatagctgcccttcttgctccataccttccataactgaccgcttcagtatgtgaaaacccagcccttcaaccctataggctccaacaagcaatcgcaacaaacaacttacctttatcacacctgttctttcaacaatcgccagccctatctttggtgcagtcattggtacaaaccatcagggcacaacagctgcaacaactcgtgctaccagtgatcagctaagtagctctagcaaacctttc

SEQ ID NO: 30996 - DNA, 328 bp, Zea mays
  Clone ID: LIB3059-022-Q1-K1-A2
ggttgagattgagcgacagatcttgcatgctaagactgatattgaggaccttaagaagcaacttgagcatagcaagattgataggcagcacaaagaagagtgtgaagccatccggaagctgatttgtttgcagcctccacggtcagaaactgaaaaactcattgcagaccttgagaaggagataactgatttgaatgctgagaatgtagcatgcataaggactttgtaactgaggaagaagcagtttgcccttcttctacatgtggttgaggaattgcagatctcgattgaagatgagcagaagagtatagcagatgagctgagaact

SEQ ID NO: 30997 - DNA, 440 bp, Zea mays
  Clone ID: LIB3059-021-Q1-K1-G9
cagctagcaacatagaaagcacaatagtgtaccaacaatggcagccaaaatattttggctccttatgctccttggtctttctgcaagtgctgctaccgcgaccattttcccgcaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttccttcaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgctgcttatttgcaacaacaac

SEQ ID NO: 30998 - DNA, 206 bp, Zea mays
  Clone ID: LIB3059-021-Q1-K1-F3
aagaaaaaaaaaaaaaaaaaaaaaaaatataaaaaaaaaaaaaaaaaaaaaaaaaaagagaaaaaaaaaaacaaaaaaaaaaaaaaaaaaaaaaaaaaaaaaaaaaaaaaaaaaaataaaaaaaaataaaaaaaaaaaaaaataaaaaaaaaacaaaaaaaaaaaaatgaaaatacacaaaaacgctaaattcaattatatcaaac

SEQ ID NO: 30999 - DNA, 401 bp, Zea mays
  Clone ID: LIB3059-021-Q1-K1-F4
ctcgagccacgcgtccggagcaggcagtcgcaacaggcatcttaccattatcacccttgttccttcaacaaccgttagcggtattacagcagttacctttggtccatttggtggcacaaaacatcagggcacaacaactacaacaacttgtgctagcaaaccttgctgcatactctcagcaacatcagtttcttccattcaaccaactggctgcattgaactctgctgcttatttgcaacaacaattaccattcagccagctagttgctggctacccccagaaatttcttccattcaaccaactagcagcattgaactctgctgcttatttacagcagcaacaactactaccattcaatcagctagctgatgtgagccctgctgtctttttgacacaacaa

SEQ ID NO: 31000 - DNA, 301 bp, Zea mays
  Clone ID: LIB3059-021-Q1-K1-F5
cagtcggacccgcagtgcctgtgcgtggcgctcagcgcggacccggcgtcgctggggctcaccgtcaaccgcacccgcgcgctggacctccccgacgcatgcaaggtcacgacgcccgacgtcagcagctgcaagggcggcgccgcgggagcgcctgtgacgacgcccgcggggcagacggcgccggccacggggtccaagacgacgcccgccacgtcgtccgtgcccggtgccgacgcgtcgccgtcgggctcggctggccgtctcgtcgccggcttcttcgtcgccgcagacgtcgtcg

SEQ ID NO: 31001 - DNA, 414 bp, Zea mays
  Clone ID: LIB3059-021-Q1-K1-F7
cggacgcgtgggcggacgcgtgggcggacgcgtgggcaagcgtccacctggtgtctgctgaactgagcagacagtagcaagagccactatgctgttcttctcctacttcaaggagctcgtggggaaggaggtgacggtggaactcaagaatgacctggcgatccgcgggacgctccactcggtagaccagtacctcaacatcaagctggaaaacacccgcgttgtcgaccaggacaagtatccccacatgctgtcagtgcggaactgcttcatccggggctcggtggtgcggtacgtgctgctcccgcaggacggcgtggacgtggacatcctgcacgacgccaccaggagggaggcgcgcggaggctgatcggcatcggcatcgggccccctcacctgtgctgcttctccccc

SEQ ID NO: 31002 - DNA, 283 bp, Zea mays
  Clone ID: LIB3059-021-Q1-K1-F8
cgcggacgggcagctcgacccggtctttaaccccaagctctcctcctcctacgccgtcgtgccatgcaccagcgacacctgcgcccagctggacggccacagatgccacgaggacgacgatggagcgtgccagtacacctacaagtacagcgggcacggggtgacgaagggcaccctggccatagacaagctggccatcggaggcgacgttttccacgccgtggtcttcggctgcagcgactccagcgtcgggggccctgccgcgcaggcgtcggggctggtc

SEQ ID NO: 31003 - DNA, 444 bp, Zea mays
  unsure at all n locations
  Clone ID: LIB3059-021-Q1-K1-F9
cccacgcgtccgacaaacctgaatgtggagcaagtgtttttctccatcgcacgtgacgtcaagcagaggcttgcggagactgattcaaagccagaggacaaggcaatcaaaattaacaagccagaccagggttccgaggcaccagctgcccagcgatctgcttgctgcggctcataagcagatgcacgatggccatagcctttggttatttgacattatttatttcccgcttggctgttataggaaggatttgaagaagccacttatgatataccgatgtggttgtactcgtggttgcttccattctttgaagcaaccacctcttgctgttgacgtagctattgctattgctgggagctattgcactcttgcattgngatccgttggaaaaactctcccctccctacagtgtgtaatgaatgaaatccatatcgntggggttgc

SEQ ID NO: 31004 - DNA, 331 bp, Zea mays
  Clone ID: LIB3059-021-Q1-K1-G1
aaaaaaaaaaacacaaaaaaaaaaaatttaaaattaaacaaaaaaaaaaacaaaaaaagaaaaaaaaaaacaaacaacacttaagttcacatctttctctactcatgcgttcctacttcttctcactcccatagtacctcctcatattaaatacacatgtcaatgcttcttcaacggccgtactttgaataccctgggattacctaacccaatgcgcttccggaataaccccctttttacatatttcgtgcttcctgcagattccctaaccgatctcctttttctactattccacatcctcaatggctaatgggtctttctaatcaatggt

SEQ ID NO: 31005 - DNA, 370 bp, Zea mays
  unsure at all n locations
  Clone ID: LIB3059-021-Q1-K1-G10
cggacgcgtgggcggacgcgtggggaagcatgctgatgaggagggcgtggagctcagcctgggtaacgcgggaacccgcgaggaccacgcttgagctcaccgagctgctgctgcaacgtacaagacgatgcgcgtgagctgattgctgggcgtgaagtcgtatgtagtttagcggttaaacgcgtttaactttagtctatcttattactatctatcttagtatcttattactactactacaaacagtccgtctagtatcttactatccaactagtatctcatcatacatcaccagtccagtcgttatccttccgtatctttttcctttgcgagaaatctatncaaaagaaaaaaaacagacctggcaatg

SEQ ID NO: 31006 - DNA, 406 bp, Zea mays
  Clone ID: LIB3059-021-Q1-K1-G11
agacctccaattccctcgtagcagcagcaccagtagagtctccttcctctccggcggcgatgtctgggcgcggcaagggcggcaaggggctgggcaagggcggcgccaagcggcaccgcaaggtgctccgcgacaacatccaagggatcacgaagccggcgatccggaggcttgcgaggaggggcggcgtgaagcgcatctccgggctcatctacgaggagacccgcggcgtgctcaagatcttcctcgagaacgtcatccgcgacgccgtcacctacactgagcacgcccgtcgaaaaaccgtcaccgccatggacgtcgtctacgccctcaagcgccagggccgcaccctctacgggttcggcggctaagcgcgccctctccatctgggggtgggcctagtact

SEQ ID NO: 31007 - DNA, 420 bp, Zea mays
  Clone ID: LIB3059-021-Q1-K1-G12
gtttccgtctgctcggtaaaatgcggtgcattgggaggacgggatgttgtgtgcgctgctgttagcttcagaccatgcatcgacattcacaaggggaaagttaagcagattgttggttctactcttcgggattcatccaatgatggcatggaacttgtgacaaactttgaatcagacaaatctcctgcagaatttgcaaaatcatataaagaagatgaacttcttggaggacatgttataatgcttggctcagatcctgcaagccaggctgctgcactcgaggcactacatgcatatcctggtggcttgcaagttggaggtggaataaatttgcagaatgcaatgtcttaccttaatgaaggggccagtcatgtgatagtgacctcttatgtgcttagcgatggcaagatgaacattgaa

SEQ ID NO: 31008 - DNA, 361 bp, Zea mays
  Clone ID: LIB3059-021-Q1-K1-G3
attgagaccaactagcaacatagaaagcacaatagtgtaccaacaatggcagccaagatattgtgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacaacagttacctttggtgcatttattggcacaaaacatcagggcacaacaactacaacaacttgtgctagcaa

SEQ ID NO: 31009 - DNA, 395 bp, Zea mays
  Clone ID: LIB3059-021-Q1-K1-G5
cggacgcgtggggtcgtgaggagttccttaacatttcttgcgacatggagtacaaagagagggtggatgcgctagtgtttttctctttacttctcctaggatactttgctgctcatgcgcatgggaacggtcatgtcacggatgatgtcaatgtttctgctccagctgaagaaggaattttgcgagaaaaaagagcacaatgcgctcaagggtttcttccatgcaaagataacaagtgctactgttgcattgggggccgaactcatgattgctactatacgatggctcagtgtagtcatgcatgcttctaatcaaaaattaagatcactgtttttatatacaatgtaatggtaggcaatgctattaataatacataaaggaattttagttttggt

SEQ ID NO: 31010 - DNA, 355 bp, Zea mays
  Clone ID: LIB3059-021-Q1-K1-F2
agtgaaggactccaagacccttctctttggtgagaaggaggttgctgtgtttgggtgcaggaaccctgaggagatcccatggggttcggttggcgctgaatatgttgttgagtctactggtgttttcactgaccaggaaaaggctgcagctcacttgaagggtggtgccaagaaggttgtcatttctgctcctagcaaggatgcccccatgttcgttgttggtgtcaacgagaaagagtacaagtctgacatcaacattggctctaatgctagctgcacaaccaactgccttgctccgattgctaaggtcatcaatgacaagttcggtattgttgagggtctgatgaccactgtt

SEQ ID NO: 31011 - DNA, 384 bp, Zea mays
  Clone ID: LIB3059-021-Q1-K1-G7
attcagaaacacaccaagcgaagcgcactagcaacaacctaacaacaatggctaccaggatattatccctccttgcgcttcttgcgctttttgcgagcgcaacaaatgcgtccattattccacaatgctcacttgctcctagttccattattccacagttcctcccaccagttacttcaatggccttcgaacacccagctgtgcaagcctataggctacaacaagcgattgcggcgagcgtcttacaacaaccaattgcccaattgcaacaacaatccttggcacatctaacaatacaaaccatcgcaacgcaacagcaacaacagttcctaccagcactgagccacctagccatggtgaaccctgtcgcctacttgcaacagc

SEQ ID NO: 31012 - DNA, 449 bp, Zea mays
  Clone ID: LIB3059-044-Q1-K1-B7
cccacgcgtccgcccacgcgttcgcccacgcgtccgcgctttgttgttctacgagggcagtgtttatactattatctgaaatgtacagatctgagcccacaggaatctacactcttatgtgatgttgttgaagtagggcagcttccagactttgtgccagaagatgaaaagacgagatatgcgttttacctgttgacccgtcaagggttgaggtttgaatgctccagtacctccgaaatacaggttgattcatgggtaagagcactgtcaagtgactgcaaattgcaggatggcgctggtgatgataagatgatgaatacgaggagtagccaagtagaagctgggtcatcatggtagacgatgtatggagtgctgtacagtacaatagtcaatgaaatgtacatacattacatgcatgtaaagggagcaacatatgtacgtagtagacg

SEQ ID NO: 31013 - DNA, 444 bp, Zea mays
  Clone ID: LIB3059-044-Q1-K1-B8
attttcagcattcaaaaacacaccaagcgaagcgcactagcaacgacctaacaccaatggctaccaagatattagccctccttgcgcttcttgcccttttagtgagcgcaacaaatgcgttcattattccacagtgctcacttgctcctagtgccagtattccacagttcctcccaccagttacttcaatgggcttcgaacatccagccgtgcaagcctacaggctacaactagcgcttgcggcgagcgccttacaacaaccaattgcccaattgcaacaacaatccttggcacatctaaccctacaaaccattgcaacgcaacaacaacaacaacagtttctgccatcactgagccacctaaccgtggtgaaccctgtcacctacttgcaacagcagctgcttgcatccaacccacttgctctggcgaacgtaactgcatacc

SEQ ID NO: 31014 - DNA, 419 bp, Zea mays
  Clone ID: LIB3059-044-Q1-K1-B9
tgagaaatttaatatgggccacatcgaagcctggaggctaaccggtattggattacctctggagcttaactggtcggccttaaatggtgtggatacagaaattatggatgtacatggacatgttgcaccgagtgagaagcacccaggaagcttattagaaggttttttgcatactcaaattagtaccatggcagtgaaggataatttgttagtagctggtggttttcaaggagagctaatatgcaaacacctagatcgagaaggaataagcttttgctgcaggacaacatatgatgataatgcaattaccaatgcattggagatattcaatacatctagtggagctcttcacttcattgcatctaacaatgactgtggggtaagagagtatgatatggaaagatatcagttgtttaagc

SEQ ID NO: 31015 - DNA, 453 bp, Zea mays
  unsure at all n locations
  Clone ID: LIB3059-044-Q1-K1-C1
cgactcccaaatactccaaggcgcgttatgatgagattgtgaaggaagtctcatcctgcctcaagaaagttgggtacaaccctgataagattgcctttgtccccatctctggttttgagggcgacaacatgattgagaggtccaccaaccttgactggtacaaaggcccgaccctgcttgaggctcttgaccagatcaccgagcccaagagaccttcggacaagcccctgcgtctacccctgcaggatgtgtacaagattggtggtattggaactgtaccggttggtcgtgtggagactggtgtcatcaagcctggtatggttgtcaccttcggtccaactggcctgactactgangtgaagtctgttgagatgcaccacgaggctcttcaggaggcccttcctggtgacaatgttggcttcaacgtgaaaaacgttgctgtgaaggatctca

SEQ ID NO: 31016 - DNA, 430 bp, Zea mays
  Clone ID: LIB3059-044-Q1-K1-C10
ctgattgccccataccttacatcaatgatagcttcagtatgtgaaaacccagctctgcagcgctataggctccaacaagcaatcgcagcaagcaacatacctttatcacccttgatgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacactgaaccctgctgcttatttgcagcaacaactattaccattcagccagctagctactgcctactctcagcaacaacaacttcttccatttaaccaattggccgcactgaaccccgctgcttatttgcagcagcaaatactactaccat

SEQ ID NO: 31017 - DNA, 450 bp, Zea mays
  Clone ID: LIB3059-044-Q1-K1-C11
ccggattcccggtcgaccacgccttcgggggccccttggccggccttcttggcctagcccttggttggcaagctggccattaggggttgcagcctttccgatctcaagaggaaggtgaggagtttgcagagccggtacgccaaagcggtcaagaaaggcgcgccaccgagcaaggatcaggatcgccgtctcttcgacctctgcaagaacgtctggccttctgttagcaatgccaaggcggttaccaaggctgttaccaaggcgtcggctaacggtggtgctgggagggagcctgacgagatgtgtgagctgtacccataccttgcggaggaggtgagggcgcttcagagggcacacccgggcttgttcaagcgggagtttgggatgatcgaagacagcaaggcccgtgcactggacgagaggatcaagaagcagaggcgtgcactgatg

SEQ ID NO: 31018 - DNA, 427 bp, Zea mays
  unsure at all n locations
  Clone ID: LIB3059-044-Q1-K1-C12
aacctaacccggaccggcccggcccggccgccggccgaggtgcccgtacctgccggggatggtcgccggatccatccaccatgggcggtggcaacggccagaagtccaagatggcccgcgagcgcaacttggagaagaacaagggggccaaggggagccagctcgagaccaacaagaaggccatgagcatccagtgcaaagtgtgcatgcaaacattcatgtgtaccacgactgaagtgaagtgccgggagcacgccgaggccaagcatcccaagacagacgtgtaccagtgcttcccccatctgaagaagtgaaaggcctgaacttagcaaccagtgctggtttggtcactacgatcgggccagggggcgttccttgtgttgagggtgttcattccgtgttatcttcccgtcagtcatgcgtnctg

SEQ ID NO: 31019 - DNA, 196 bp, Zea mays
  Clone ID: LIB3059-044-Q1-K1-C3
cgagtgccgaatactcataggagcgatttgaagtgatggtgaacgtcgtcttattctgcctcggcaaaatcgggtatcaagcctgttatgattgccttagtacagatctctgcatttgagggctacaacatgatagagaggtcaaccaacctagactggcacagatgcccgaccctgctacaggctattaaccaga

SEQ ID NO: 31020 - DNA, 304 bp, Zea mays
  Clone ID: LIB3059-044-Q1-K1-C5
cggacgcgtgggcggacgcgtgggtagcaacatagaaagcacaatagtgtaccaacggtggcagccaaaatattttgcctccttatgctccttggtctttctgcaagtgctgctaccgcgaccattttcccgcaatgctcacaagctcctatagcttcccttcttccaccgtacctctcaccagcggtgtcttcggtatgtgaaaacccaattcttcaaccctataggatccaacaggcaatcgcagctggcatcttaccttaatcacccttgttcctccaacaatcatcagccctattacagc

SEQ ID NO: 31021 - DNA, 433 bp, Zea mays
  unsure at all n locations
  Clone ID: LIB3059-044-Q1-K1-C7
gttagaacgagcaagagaacttttccatgaagctgtccaacaggctcctccagaggaaaagaagcccctatatttacaatgggcaaaactggaagaggactatggtcttgcaaaacgtgctatgaatgtatatgatgaatctgtaagagctgttcctggcagtgaaaaaaatggccatgtatgaaatctatatagcacgtgctgccgaactctatggtgttccaaggacaagacaaatatacgagcaagcaattgaatctggcctnccagacaaagatgttctgataatgtgcatgaagttcgctgaactagagagaagccttggtgaaattgatcgttcgcgtgccatctatgtgcatgcatccaactatgctgatccaaataatcctgacttttggaagaagtggaatgactttgagattcagcacggtaa

SEQ ID NO: 31022 - DNA, 437 bp, Zea mays
  Clone ID: LIB3059-044-Q1-K1-C8
cggacgcgtgggcgcggcgaggccaccatgagcactctcaagttctgccgggaatgcaacaacatgctgtacccgcgggaggacaaggagacgcgcaccctcctgtacgcgtgccaaacgtgcgagcatgaggagattgccactgatacttgtgtgtacaaaagggttatccgcaagcctggtggtgagcccaaggatgtcctgaaggatgcagcaactgatcctagcctgcctcgcaccagaagcgtcagatgttacaactgcaaccatccagaagctgccttttttcaggccccgactaagggagaacaagccatgacgctgtacttcatctgctgcaacccaagctgcgggcacaggtggagggactgagaaggatctggcttggtcttcgctgcaaacctgccgtattgttagcctatcacataaatattgga

SEQ ID NO: 31023 - DNA, 157 bp, Zea mays
  unsure at all n locations
  Clone ID: LIB3059-044-Q1-K1-C9
atcaattgtagattcttacactggatttccaggagcttgggccacatttaccattcgaatcgattggagattcttagaaattcttgacatcattggattatgcctgaaatntttaattaaataacgtcactgaaatgacatttgcgttaagaattgc

SEQ ID NO: 31024 - DNA, 443 bp, Zea mays
  Clone ID: LIB3059-044-Q1-K1-B6
ctgaaaactcttgcaatgaccactaatttaattgttctttcaaagaaactcccggagggaaagaatgtggactcaatgctttaaatataagtttagatacactagtacctgcaaagtttgagttcatgacaaggcgtaaagggcactcaaaggtcttggaatcaatagatgctgctgtagaacttgggtatagccctgttaaggtcaactgtgtcatcatgcgtggtataaatgatgatgagatctgcaattttgttgaattgacgagacacaagcccatcaacgttagatttattgagtttatgccatttgatggtaatgtttggaatgtgaagaatctagttccttatgcagagatgttggacaaagtgcggcaaagttataaaggagtagagagactttaaaatcaccctacagacactgcaaagaatttcaagattgat

SEQ ID NO: 31025 - DNA, 407 bp, Zea mays
  Clone ID: LIB3059-044-Q1-K1-A11
cccacgcgtccgcggacgcgtgggttttgttttcaatttccatcccaagaaaacttgcgagggctacaaagtgggatgcgatttgcctgggaaatacagagtagccctggactctgatgctctggtcttcggtggacatggaagagttggccacgacgtggatcacttcacgtcgcctgaaggggtgccaggggtgcccgaaacgaacttcaacaaccggccgaactcgttcaaagtcctttctccgccccgcacctgtgtggcttattaccgtgtagacgaagcaagggctggacgacgtcttcacgcgaaagcagagacaggaaagacgtctccagcagagagcatcgacgtcaaagcttccagagctagtagcaaagaagacaaggaagcaacggctggtggca

SEQ ID NO: 31026 - DNA, 450 bp, Zea mays
  Clone ID: LIB3059-044-Q1-K1-A3
cgacgccacgcgtacgcgtacgcgctctaagactcgctggtcctggtacgcgagctggcgaagactcaagggggggcaggtgagcacgaggatgacgtcagacgaccgaccaggacgagcagcatatgcacgtgcatggtgctcacgaacttcatcctaactgtggtggaggcgggcacggaagtgatactctagcactgggacgtcaagcggtcatgcaacgtctaccgactgaacgtgctcaacatcctaaattcgctccagtaagactccgcacgtgccgccatatgtactggacagtatgcattgaaagagttgcagtcccaagctgccaagaaagactctatgcccaaggacgacaaacattagatgatcttacaccctgtttcttgtaatgcggtagcagtttgaggtccaagattttgaattggtcctttaaaaaaatggatg

SEQ ID NO: 31027 - DNA, 249 bp, Zea mays
  Clone ID: LIB3059-044-Q1-K1-A4
cgccgtccgtttacccctgccgacctgtgctgccggtggtggcgacttcacggtccggcgctagtgcgccgactatacgacttgcctggcgcctgctatctactacctatctgctctgtgtgctgcgcagcgtatgatgctgatttgggacggctaatcaagaaaggatctctgctgactcttaagcagttgggttctgtcagtactaagcatcggcaataaaatacccctagatatgaccaataataa

SEQ ID NO: 31028 - DNA, 395 bp, Zea mays
  Clone ID: LIB3059-044-Q1-K1-A7
cagatttagaggagctcgaggtcttggacttgcagacactagtttcctacataagctgtgcaaggaagtatattcagccacagttatctgatgaagctgcagaagagttaactcgtggctatgtcgagatgagaaaaagagggaatagccctgggagcagaaagaaggtcataacagcaaccgctagacaaatagagagtttgatccgtctcagcgaagcattagcccgaatgcggttctctgaagtggtcgaagtgcgggatgttgtggaggcattcaggcttcttgaagtcgccatgcagcagtctgcgacggatcatgcaactggtacgattgatatggatctgatcatgacggggatatccgcaagcgaaaagcataggcgggagaacctc

SEQ ID NO: 31029 - DNA, 449 bp, Zea mays
  Clone ID: LIB3059-044-Q1-K1-A8
cccacgcgtccgcccacgcgtccgcccacgcgtccgattgagaccaactagcaacatagaaagcacaatagtgtaccaacaatggcagccaaaatattttgcttccttatgctccttggtctttctgcaagtgttgctaccgcaaccattttcccacaatgctcacaagctcctatagcttcccttcttcccccatacctctcaccagcggtgtcttcagtgtgtgaaaacccaattgttcaaccctacaggatccaacaggcaatcgcaacaggcatcttaccattatcacccttgttcctccaacaaccgtcagccctattacaagagttacctttggtccatttggtggcacaaaacatcagggcacaacaactacaacaacttgtgctagcaaaccttgctgcatactctcagcaacatcagtttcttccattcaaccaactggc

SEQ ID NO: 31030 - DNA, 336 bp, Zea mays
  Clone ID: LIB3059-044-Q1-K1-B1
cccacgcgtccgcggacgcgtgggtgatctttctgacagggaggaccatgagtcgagtcaggatcttggaggctcgttaacgaggtctccagatgcagcaatcggtattctcatgcgcatcctaaagaacgctccaggcctcagggaaaggctactgacaggccctagcgccccggttcctcaagaaccttcttcactccagagggtaatgaccgaggaacatggcagcggcgcatcaagctctgcaggggtgccttcttctcttctgaggtcaaggacagcggcggacacgctggaggagctgaacaagtacaaagagattagagaatcaatact

SEQ ID NO: 31031 - DNA, 428 bp, Zea mays
  Clone ID: LIB3059-044-Q1-K1-B10
aggtgtacgacttcaggagcagtgtgttctggtgatgcaattagtaagcatgatgtgcctcatgttgagaactgcaacactccaactgtagccgtgtgcacaactttgaagcgtgtagcggagaaagttgtatcagagctagttggaagtgaaaggatggggagcaacaacagtgctgaattgctggagagtatggaaaaggctgaaaatgtttgttttggtgggaatggagttagtcaaggtggccttccagaagagttagaggtatgaacaaggatacatcgtggaaatcattactgaggatcagtggcgtcaacgacacataattgaaggaagaattgtggagatagataagttctaccgcttgctgggtggaatggtaagtagctcaactcacaagtttccttctggacacagatttgcaattg

SEQ ID NO: 31032 - DNA, 299 bp, Zea mays
  unsure at all n locations
  Clone ID: LIB3059-044-Q1-K1-B2
cccaaatggccccaggaattccatcgaaaggccgtcaccgggggaataaagggcgtcgccgcttaccaccagccaccgccgcctaatcctcgaagccgccgcctgctctcctgctcgcgctgcagcgcagcgccggacctnctgcgtgccggggtgggccattccgcacaacccgctcccgagctgccgctggtacgtgaccagccggacctgcggcatcgggccgcgccttccgtggccggagctgaagaagagatgctgccgggagctggcggacatcccggcgtactgccggtgca

SEQ ID NO: 31033 - DNA, 443 bp, Zea mays
  unsure at all n locations
  Clone ID: LIB3059-044-Q1-K1-B4
cccagcctccggccaagcgttcggccaagccttcgccgaccccttgggaactttggtggttaattaccaccggcaccggttccaacatttaagccggttacttaaggtaaccccggtggccttctggacacacacagttgttgccgttctacctgcacgctgcgcctaacgctggcaccctcttacaactgcaacaattgctgccattcaaccaacttgctttgacaaacccaacaacgttctaccaacaacccatcattggcggtgccctcttttagattgcttatgagttatagttcaataatgaagttttttggatgatgtttgtggcttcccagaaataagaaatgtactttcttacttcttcctggagagaaaaagcagaagacaatacaaagatgtccaagatggcggaggagaaggcggcngcagtgggcggactc

SEQ ID NO: 31034 - DNA, 422 bp, Zea mays
  Clone ID: LIB3059-044-Q1-K1-B5
ctgaaaactcttgcaatgaccacaaatggaattgttctttcaaagaaactcccaaaggtgaaagaatgtggactcaatgctttaaatataagtttagatacactagtacctgcaaagtttgagttcatgacaaggcgtaaagggcactcaaaggtcttggaatcaatagatgctgctgtagaacttgggtatagccctgttaaggtcaactgtgtcatcatgcgtggtataaatgatgatgagatctgcaattttgttgaattgacgagacacaagcccatcaacgttagatttattgagtttatgccatttgatggtaatgtttggaatgtgaagaagctagttccttatgcagagatgttggacaaagtgcggcaaagttataaaggagtagagagacttcaagatcaccccacagacac

SEQ ID NO: 31035 - DNA, 426 bp, Zea mays
  Clone ID: LIB3059-044-Q1-K1-A10
gtgcgacaaggacttcgagaggtgggtgtgtgtgcatgcatgcatgcaaacgcaacgtacagctctttcatccagacgatcacatgatccaaactgacctgtgattaggatggtcttgggtttcttacgcgtcgtgaccacggcacacgtgtgactgacggctgcagggcggagatgtacttcaagcaggcggtggccgccgagccggcggacggcgaagcgatgcggaggtacggcatgttcctgtggcacgcccgcggcgacacgggcggcgcggaggacatgttcaccggcgccattgacgcggagcccgagagcagccaccaccggagcagctacgcgtggttcctatggatgaccggcggcgtcgagacctgcctcatggacaccggcaggcagagcgacggcaacgacgcggattgaacc

SEQ ID NO: 31036 - DNA, 405 bp, Zea mays
  Clone ID: LIB3059-043-Q1-K1-G7
gagactcaactgcatcataggctgcactctcgtgtgcgaactttgggcaccacgctggtcgcactgcttatgctacacgaccgctccgcacgcgctgctaccatgaccatcttggcggaatgcttactggctactatagcggatctacttccggcataactctgaccatcgacgtcaccaagatgtgcattcgaattccatcaacgctacaggacactagatgtagcgacagcactgatcataatgtataggagcgtaagacgtcgaacacatacatctcatactacctcagatgcgtatagagcttatacagacacgttgcatgtcgatgctcagatacgtctactgcagctattaaaccttgctgccttagcatatggacaactggaagctttggcgcaatta

SEQ ID NO: 31037 - DNA, 418 bp, Zea mays
  Clone ID: LIB3059-043-Q1-K1-G9
cggacgcgtgggtgcgcttcttgccctttttgtgagcgcaacaaatgcgttcattagtccacaatgctcacttgctcctagtgccattattccacagttcctcccaccagttacttcaatgggcttcgaacacctagctgtgcaagccaacatgcaacaacaagcgcttgcggcgagcgtcttacaacaaccaattgcccaattgcaacaacaatccttgccacatctaacaatacaagccatcacaacgcatcagcaacaacagttcctaccagcactgagccacctagccatggtgaaccctgccgcctacttgcaagagcagctgcttgcatccaacccacttgctctggcgaacgtagttgcaaaccatgctcatcatcagctacaacagtttctgccaacgctcagtcaacta

SEQ ID NO: 31038 - DNA, 405 bp, Zea mays
  Clone ID: LIB3059-043-Q1-K1-H10
aggcgaccctccctccttcgctccttccgcgccgtctgcgggccgtcgccgccatggtgaagtactcgcaggagccgggcaaccctaccaagtcggctaaggccatgggcagggatctgagggtccacttcaagaacacaagggagacagcctttgcgcttcgcaagttgtctttgaccaaggctaagcgataccttgaggatgttattgctcacaagcaggcaattcccttacggagatactgtgggggtgttggtcgcaccgcgcaagctaagtcgcgccactccaatgggcagggccgctggcccgttaaatcagccaggttcatcctggatttgctgaagaatgctgagagtaacgctgatgtgaaaggctcggatgtggacaacctctatgtttcacaca

SEQ ID NO: 31039 - DNA, 384 bp, Zea mays
  Clone ID: LIB3059-043-Q1-K1-H11
aaaaaacaaaaataaaaaaaaaaaaattaataaaaaaataattacaaaaaaaaatacggaacaaaaaaaaaataaaaaaaatactcacaatatcctggcacccattccaagtctcctaaggtcatgttcacgtatcttctactccacttcactaacatcatgcacactaccttctttctttgcccgttctctttacacattcctaactgatacctccttgatgttaccgatctcaatcacctttttccatttccgcttttctccaactgtctttttccctccgtgccccctaactatcgccactcccatgagctgggccgcttgcccgccaaatgagccacgctcatcctggatcttttaaagactgctgccagtttcgctgct

SEQ ID NO: 31040 - DNA, 285 bp, Zea mays
  Clone ID: LIB3059-043-Q1-K1-H3
cccacgcttccggccacagcctgcgaaagaaaatacggtggtaggtcgcataggcaacggctgcatcttgctactatcgccttgatggcagagacaaaatacagcggtggcgccttctacagctaccaacgcaagctacactatagtacgatgtaactacagctatagctaccctcgcaactgctactgcaactccgacgttaaacagaggaactaatgcgaaaaccctgcgcggtcaaattatactgaacgctaacgagatgcccaccctattacatagggttt

SEQ ID NO: 31041 - DNA, 392 bp, Zea mays
  Clone ID: LIB3059-043-Q1-K1-H5
cggacgcgtggggtttcgcgtataggagggagaacaaaggtcgcgtctcgaaagttcttgccttgttgggaagggatggcgtcggaggtggaggacgacgcggcggtgccgggcgcgccgctggtcgccaatggtgcagccgacgtccgccggaggagggatcaggctaaggcgattttgtccaagcaggccgtcaagatcgccaccaaggccgagcagcacgagcgcttcatctttaaggtcatttccccgaccctgcctccgtttaatctctttattaccgcctttcttgtgcagttgacgtccacaaatcttgccgctcccgtgctccctttcttttgtggaggtcattgtgtgatgtaataagtacctgcacatttattggtcgcact

SEQ ID NO: 31042 - DNA, 337 bp, Zea mays
  Clone ID: LIB3059-043-Q1-K1-H7
caacaagcaacatagaaagtggaatccagtagcaacaacagagcatcaatggcgaccgggatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcaaggcacagcagctgcagc

SEQ ID NO: 31043 - DNA, 329 bp, Zea mays
  Clone ID: LIB3059-043-Q1-K1-H8
cccactcgtccgagcaaagcggcagtgcgtatagaggatcgtcgaacagaacagcatgcatatgggcagggttctcgtcgtgtgcctagctctgtcagctgccatcgcctctgcaatgcacatgccctgcccctgcacggtgctgcactgctagtactgcgctggcgccggcctgactaccatgatggacgcctgcagtctgtacccatacacgtagtacctgatgcagcctcagtgcagccctctgaccgcggcgcactactacaccagccgtggtcagtcaaccgccatgttccatacgctccgggcacagttctgtccacaccata

SEQ ID NO: 31044 - DNA, 315 bp, Zea mays
  Clone ID: LIB3059-043-Q1-K1-H9
gagcaatgcttatacctgatgctgtaactgatcagtcccacaatggatgctaggcgcgctcggctacataagcactaccatatagcatagaatgctattctatgaccatcctacagatcacgaattcatccaaaaccaacttcttgatcctcgtacacccatgggacgcatagtcagtacggctgattatgcttacagaatatcagatttaggagtggctatgaattgatcactgtgttatgaacattaacatcctatgcactatgtgcaacagatcgatgatcatagactcaatgcgatcaacatctacaagac

SEQ ID NO: 31045 - DNA, 425 bp, Zea mays
  Clone ID: LIB3059-044-Q1-K1-A1
ctaattctctctcagatcgtccagtgctatttagttatttacaccgtacctgtctgtgcttcgagttctcagtttttagtggcttattggtgaaaatttgttatccgtttgaaatttctcatgcgaacgaggagaaggagatttgacagtgccttggccgtcgacacaatccgccaacacatttgatcattaccagcttctgcaatatgctctagagagcctggtttgtacaaataaagggagaacaggcagatttttgtacagcctgatggcatagcgttagccattgtatcatatacaaggactggcccgagcgaatacgctcctggagtccttttgcacaacgagagcaccacaggatgcattcgtttgtgattgtctgcaatagaaattgcgatgcttccaaattttccagaccgccagcg

SEQ ID NO: 31046 - DNA, 361 bp, Zea mays
  Clone ID: LIB3059-043-Q1-K1-G5
attgatcgctgcgcttacgtcactgagaccgtccttgctgcctgctacaaggcgctcgacgagcaccatgtcctcctggagggtaccctcctgaagcccaacatggtgactccaggctccgactccaagaaggtgacccctgaggtgattgctgagtacaccgtccgtaccctccagaggaccgtccctgctgctgtgcctgctgttgtcttcctctctggtggacagagcgaggaggaggccacccgcaacctcaatgccatgaacaagctcagcaccaagaagccgtggtccctgtctttctccttcggccgtgcccttcaagcgagcaccctcaaggcctgggctggcaaggtggaaa

SEQ ID NO: 31047 - DNA, 414 bp, Zea mays
  unsure at all n locations
  Clone ID: LIB3059-021-Q1-K1-D8
cgcagctgacggacagctacaacgggctgaccatcatggcgcccaccagcgccgtcgtcgacaagatgaaagcgggcgtgctgaacgggctgtcgccgcaggagcagatccagatggggctctactgcgtgctgccccggttctacaggctgtccatgctcggcacccttagcggcaaggtcaacacgcaagggtccgggcacgacaggccctacaggtacgacattaagcggtcggggaacaacgttaacgtgttcacgggggtgaactggatgctgctgggcagncccggtagcaaggactttccggtcggcatctaccccgtcgacaaggtgccggttccctacgagctgttcgggcccaaagccggccacgcccggttcccgcgccggcacccgcgcccggggccgggca

SEQ ID NO: 31048 - DNA, 417 bp, Zea mays
  Clone ID: LIB3059-021-Q1-K1-D9
cccacgcgtccgcccacgcgtccggttggattgggttcaaagttgggcttttggacagctgtggtgtgcacggcagctctgtgacttgtgaggaggaagggaggaagaaagcggatccatggcgtcgaagcggatcctcaaggagctcaaggacctgcagaaggatcctcccacctcttgcagcgcaggccctgttgccgaagatatgttctactggcaggcgacgattatggggccatcagatagcccatacgctggtggcgtatttttggtcactattcactttccaccggactacccattcaaaccaccgaaggttgcattcaagacgaaggtttaccatccgaatatcaacagcaacgggagcatctgtcttgatatcttgaaggagcaatggagccctgcactgacagtttc

SEQ ID NO: 31049 - DNA, 332 bp, Zea mays
  Clone ID: LIB3059-021-Q1-K1-E1
gccacgcgtccgaccacgcgttcgctacctcccctggaagtgcgagcgcgagcgtggggcctacgagaagttccattacgagcttgttatggagcggatgcttcagattcagaagatccgctaggcgcacgagaccaaggtcaagggccgggcctccattggcctcatgcaagccaccgtcaagctcgactgatacgggtaccagaccgatccgcttgatttacgcctgcctgttggctatagcagcgtccagaggccttgcgcctgtgcaaggatcctcaatgtttgctgtgtgaacagagatacgcgtttgaatttctcataaagctaac

SEQ ID NO: 31050 - DNA, 380 bp, Zea mays
  Clone ID: LIB3059-021-Q1-K1-E11
gcgcacgcgtccgcaattgaaatgaaatgaaaaaagtattgttcattcacgtcatcgagcaaacggccaattgcaacaacaatgcttcgcacaactaaccctacaaaccattggaacgcaacaacctcaacaacagtgtttgccattaattatccacctaaccatggtgaaacctgtcacctacttgcaacagcagctgcttgcatccaacccacttgctcttgccaacgtagctgcataccaacaacaacaacagctgcaacagtttatgccaatgcttagtcaactagccatggtgaaccctgccgactacctacaactactttcatctagcccgctcactgtgggcaatgcacctacctacctacaacaacaattgc

SEQ ID NO: 31051 - DNA, 410 bp, Zea mays
  Clone ID: LIB3059-021-Q1-K1-E12
gatgattatgacggcaacaccaatatcaactgggaagagtttattgctgtaacagtgcccctaaataaaacagaacacaaagaacacttgatggcggccttaacatatttcgacaaagatggaggtgattacatcactgtcgacgagcttcaaaaggcttcagtggaacacgagatgaaaaatgctttccttgaggacaccatttatcaggttgatcagaacaatgacggccagaccaactatggcgagttcgtcacaatgatgcagagcgacagctctgggcttgggtggcaaacaatggaaagcagcatgaacgtacccctggaggaggcacctgaagtttactgatgtctctgtcggtgcaaagatactgttctatttggctgctttcgtggtggttcgtcagtcac

SEQ ID NO: 31052 - DNA, 425 bp, Zea mays
  Clone ID: LIB3059-021-Q1-K1-E2
gccacgcgtccggtcagttttacttgatgtgaagccacgggacgatgagaccgacatggccaagctcgaggaagctgttaggagtgtccagatggaaggactgctttggggcgcatccaagcttgtcccagttggatatggcatcaagaagctgcaaatcatgatgaccattgtcgatgaccttgtctctgtcgacactctcatcgaggactatctctgcgctgagccagtgagcgaatacgtccagagctgcgacattgtcgccttcaataagatctaaatttccttgcaatggtggatggtggacactgtaccagcctaatttataattttccatgagcatcttcaggagtttttctaaagtatcatttggagtcatttacataaaaagcactttctatatctttgtaatcaccaacaacttt

SEQ ID NO: 31053 - DNA, 386 bp, Zea mays
  Clone ID: LIB3059-021-Q1-K1-E3
gaaagaaagctcgtattgggaactacagttccagtactccaaagtgtactccagaagtaaacaagagatgttttgctgctcttgttcgccataacattgatttaatctacttgaagaaatctttggttgtggatctactaagggagccggatacatttggcagcaaagttattggctgttttgtgagaataaagattgatctcaacgattatagtttctacatgcataaaaaggtgcaccaacatagaaagttgtatcagcttggactagtaacaggcaccagtaaatcccctgaagaatacaagataaatgatgtatcaacagatattcttttatgtatttccagcatacctgacatcaaaatttcaagtttgtcagatgaagaa

SEQ ID NO: 31054 - DNA, 426 bp, Zea mays
  Clone ID: LIB3059-021-Q1-K1-E4
cagaaacacacctagcgaagcgcactatcaacgacctaacaacaatggctaccaagatattatccctctttgcgcttcttgccctttttgtgagcgcaacaaatgcgttcattattccccaatgctcacttgctcctagtgccattattccacagttcctccctccagttacttcaatgggcttcgaacacccagctgtgcaagcctacaggctacaacaagcgcttgcggcgagcgtcttacaacaaccaattgcccaattacaacaacaatccttggcacatctaaccatacaaaccatcgcaacgcaacagcaacaacaatttctaccagcactaagccaactagctgtggtgaaccctgtcgcctacttgcaacagcagttgcttgcattcaacccacttgctctggcaaacatagttgcat

SEQ ID NO: 31055 - DNA, 353 bp, Zea mays
  Clone ID: LIB3059-021-Q1-K1-E6
cccacgcgtccgcccacgcgtccgcggacgcgtgggggcttcatcatcaactgagatgtggttcagatatgaccatctctgacactactacatctgaagtcccggtccatgaaatacctccggctgtacttgatgtgcaggaagaagaagagattgtatccgccgctgtgcccgtttctgtgcacgatgtggctcctttgcagcaagcagagataggtaaagatgtaccaaaacatgttgaaaaggaggttgaggttccccaatggctgaagagtcttgctggtgaggaagcacaggactggagagcctttgtccgcactaggatcaatgggcatactgataggacctatact

SEQ ID NO: 31056 - DNA, 416 bp, Zea mays
  Clone ID: LIB3059-021-Q1-K1-E7
aaggaaatgaaggttacggacgtgcagattatttccttgttggcaaggacttccccagctatattgaatgccaagaaaaagttgatgaggcgtaccgagatcagaagttatggacaaggatgtctatcctcaacacggctggctcatccaagttcagcagcgataggacgattcatgagtacgccaaggatatctgggatatcagccctgccatccttccctagaccaggtggatatcaggttctttcgcctatatttctgtgaaccctcaggatcaaggaacagttggtgacgacattaatttgcctcagccccttagcaggaagcgctggtcacctcagttttgtgtagacaaaatctaggcatcgataaatgatgggggactatgcatggtgttttggcagcactgttcagta

SEQ ID NO: 31057 - DNA, 348 bp, Zea mays
  Clone ID: LIB3059-021-Q1-K1-E8
gtggcgggtaccggaccctagctgatcatcagcaagtttacatccacccgagcagtgccctctttcaccagcagccacagtgggtgatctaccatgaaattgtgatgacaacaaaagagtatatgagggatgtcacagcggtggacccaagatggctactagagttggcaccgaggtcgtacaagtcggtggacccaacgaagatcagtaagcggaagcgccaagaaaggattgaacctctctatgatagatacaatgaacccaacttgtggcgcctgagtaagcgccgctggtgatttttcatcatgtcttgcacgtctttgatgtaatgttactgtagtgtatata

SEQ ID NO: 31058 - DNA, 368 bp, Zea mays
  Clone ID: LIB3059-021-Q1-K1-F1
gcgacgcgtgcgcccacgcgttcgcctacgcgtatgcccacgcgtgcgcccacgcgttcgcgggcgcgtgggcaagcccaaggctgcttgatcatagacctttgcaggtacatccaatagaacttttgaagttatgctatgccattggaatgattagtgagtgccgcagttagaatgatgtttaaagaagagctaccacttcagcagataatttgtgacttgcttgcattttttggaccgatttgttcgcgtattaataattttgcagtgacgatacttctgttgtgctgtttataagcttctgaaaaaaattaaaccccttagcaggaaccagcttgtaaactcatttttgcggcaaacaaaatcta

SEQ ID NO: 31059 - DNA, 443 bp, Zea mays
  Clone ID: LIB3059-021-Q1-K1-F10
gcgtgaaacaattttgcctttcgtactctatatccagaaaacattgcgcaggaggcgtttcttaataaaaaatcttgaaaatgttatgcgcaaattcctccaatccttggagttctttgaggaaaatgagaggaagaaactcgccatattcacagcccttgcattttctcaaaagctgtcagggcttcctccggagacagtgttccagccattgctcaaggataatctggttgccaaagggatagtactttcattcataactgagtttttcaaggagtacctgaaggaaaacaccttggatgatttgattgcgcttttgaagaaaggaaaaatggaggacaatctgttggacttttttccatcagctaagagatcctctgaggctttatctgagcatttcatcaaagaaagtctgactaagccttgtgagtacaatgaaaaga

SEQ ID NO: 31060 - DNA, 152 bp, Zea mays
  Clone ID: LIB3059-021-Q1-K1-F11
caacccacttgctctggcaaacccagcagcgttctaccaacaacccatcattggtggtgccctgttttagattgcttatgagttatagttcaataataaagtttttttgatgatgtttgtggcttcccagaaataagaaagtacatttctag

SEQ ID NO: 31061 - DNA, 434 bp, Zea mays
  Clone ID: LIB3059-021-Q1-K1-F12
ccgacgcgtccgcagagaaagtcactccccaggctgccatctgaagaaacttgtccgcttgatgccacctcaaggcagctgaagaacaacaaactggatgaagttaatgctcaggagacaggatcagctacagggcaggtacaaggaagtgagacggaaacagattctgttcagagcgcaactcaagctggagctaaccctgatgaacagagtgtcgctcagtgaacagagtgtcgctcagtgaagatctcggtggccaagccaagtgatttgtgatggatggtgtgccttatctttgtgtgatgttgtgcttgtctactagagtgacttgtggcctgtatcatgctgtgttatactcctgtttttgttttcctgcgattgagcctgtatgttgcttatcaatctagatagcttttgttcataatctacagata

SEQ ID NO: 31062 - DNA, 283 bp, Zea mays
  Clone ID: LIB3059-021-Q1-K1-D7
ccttcgaagctgagcccgagaagctttgcgacgctggaatggaccgttcctgaagacgccccgtcgggcgtttataggttgaggcattttggtgcctccaaaccactgattgggtccatcaaacattttacggggacctctcgggcgttcgcagtgcgttaggtagcacaccgttgcgttgcgttgcgttcgacggcacacctgtcagagaatcgacaccgggtcatatacttactgtgcatacctgccacagtatatggacatgtttttccctatagttttt

SEQ ID NO: 31063 - DNA, 449 bp, Zea mays
  Clone ID: LIB3059-021-Q1-K1-C10
cccacgcgtccgatatgaatcaagacacaacgccgaaaagcatctcgatcgaagatgcatacaagagcatagttcaaatattgaaagaccagctgaagaagctctcctttctagggaaaggagatttctgcctgctgcagggtacatgccgaacccaggcggctcggatttccgctccaggtcgcccgccgaatattcagcacaacgccaacaaatgaggtttgatccattcacaggtgaaccttacaagtttgatcccttcacaggggagcccatcaggccagatccgaaccagcgccgctcaggaagcctgtactgatcagattagttggagcgatatgccagataagaccctgaaacaaagctagatctggataactcttcttcttgtctgccaagtgtctctgtgattttgcttgtgggctacagatcatgtaccccgagcacca

SEQ ID NO: 31064 - DNA, 439 bp, Zea mays
  unsure at all n locations
  Clone ID: LIB3059-021-Q1-K1-C11
cggacgcgtgggcgttgtttcccccctcctgtcccaaatctcacctccttccagttggagctaccgctgctcgcgttgactcgcatcttcctccattcagtgactccttggatcggctcagggacacgcactagcgtatcgtgtcggcgccgaatcttgcgcgcatttcgcgctattgttgccccggaggagtggtttggatccaagaaagtgatcagccttcttggttggatctcctcccgcaatggcggcgctcctggagctgttcctggactcctctcccgcgccggtggactgggaggcagaggtctacccggcgtacggggacttcgccgtactccccttactcgtcgccttcttccccgccgtccggttccttctcgaccgactcgtcttcgaggttntagcacgaaaatttatatttggaaagggacatgat

SEQ ID NO: 31065 - DNA, 349 bp, Zea mays
  Clone ID: LIB3059-021-Q1-K1-C12
gtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggc

SEQ ID NO: 31066 - DNA, 143 bp, Zea mays
  Clone ID: LIB3059-021-Q1-K1-C2
cggacgcgtgggcggactcgtgggctttcgcgttggaaaaaaaaaaaaaaaaaaaggaaaaaggaaaaaaaaaaaaaataaaaaataaaaaaaaaaaataacatataataataaaatataaaaaaaaataaataatataaaaa

SEQ ID NO: 31067 - DNA, 417 bp, Zea mays
  Clone ID: LIB3059-021-Q1-K1-C3
ccgcacgcgtccgcccacgcgtccgcctacgcgtccgcccacgcgtccgcttccattggaccaattggccgcactgaaccccgctgcttatttgcagcagcaaatactactaccatttagccagctagctgcagcaaaccgtgcttccttcttgacacagcaacagttgctgcctttctaccagcagtttgcggctaaccccgcaaccctcttacaactacaacaattgttgccctttgtccaacttgctttgacagacccagcggcctcctaccaacaacacatcattggtggtgccctcttttagattgcttattagttgtaattcaataataaaagtttttggatgaaaaaaaataatttttagtattagttaaactaattgtaaaaccataattaaaaaaaaaaagggccggc

SEQ ID NO: 31068 - DNA, 298 bp, Zea mays
  unsure at all n locations
  Clone ID: LIB3059-021-Q1-K1-C4
ccgacgcgtgcggtcctgggagactacctcacccacgtccgccgcgaggggcgcgcggtcatggtcaagaaccgccagcgcaagctcttcaccaacatctccggcgacggctcctgggactcggacggtgtttggagccacgtggtgttcgagcaccccaagacgttcgcgacgctggccatggacccggccaagaagaaggaggtgatggacgacctggacgcgttccgcaacggcaaggactactacgcgcgcatcggcaaggcgtggaagcgcggctacctnctgtacgggccga

SEQ ID NO: 31069 - DNA, 424 bp, Zea mays
  unsure at all n locations
  Clone ID: LIB3059-021-Q1-K1-C8
cggacgcgtgggcaatctccccagcaatccctagcagaagccttccatcctcactcgctcgatggcccgcacgaagcagacggcgaggaagtccaccggcggcaaggcgccgaggaagcagctggcgactaaggcggcccgcaagtctgcccctgcgaccggcggagtgaagaagccccaccgcttccgccccggcaccgtcgcgctccgggagatccgcaagtaccagaagagcacggagctgctgatccgcaagctgccgttccagcgcctggtgcgggagatcgcgcaggacttcaagaccgacctacgcttncagagctctgctgtctccgcgctgcaggaggcggctgaggcctaccttgtcgggctcttcgaggacaccaacctctgcgccatccacgccaagcgcgtcaccatcatg

SEQ ID NO: 31070 - DNA, 330 bp, Zea mays
  Clone ID: LIB3059-021-Q1-K1-D1
ctgaagaggattggaccgaagtggtttcgcggtgtccgaaggcatggactcatcatgggctggtccacaacaggcttcaagagagagcgcggtgactctcccttggagcttggtcccaaggcggaggatgtcatcaagccattgaatccgatcaccttactcttacgctttctcgtacgaacgatatgtgctgcctactatgttctggtgcctatttacatgtggataaaggaccagatcgtgccaaaaggcatgccaatctgagtgaaaggaatgagctgcatggaatagaggatagccaacgtctgaatcttactcttctgtatatta

SEQ ID NO: 31071 - DNA, 369 bp, Zea mays
  unsure at all n locations
  Clone ID: LIB3059-021-Q1-K1-D10
acccacgcgtcggcggcatgagctgctacgacgtcagcacaatgtacaaaagcggacctagaagtgccagcgctaaccagctgtaatcttttttgaaattggtggttgaacatggtgcagatacagcaggacattgggagatatatagcagacaagatttagagaagctcagattacctgaaagggcactgccttttgacggagggacagtcgctaatcaaacaccataaacagaaagtcagaaattgctgtcagtggacagnaccaaaacaactgagattttgaagcgatcgctcgtagtcaatcacaacaatcttcttaagttagtgtagaggaattcttcttaatgctggcatctgtcaactatgt

SEQ ID NO: 31072 - DNA, 429 bp, Zea mays
  Clone ID: LIB3059-021-Q1-K1-D11
aaatttacgaggacaaggacaatgctaggaaggatgagatcaacactcatcttactgcacccacgcaaagtggactgtttagcaagtactatgaaaggctcaaagagatccgtgaatatcatcggcggaacccatctgcccgctttgtcagtacaactgatgactatgaagagcttctaaaggaggaaccagttattgaattcactggcgaggaaacttttggccgttaccttgacttgcatgagctttataacgagttcataaattccaagttcggaacactgatggaatattcagcttatgttggctgtttctcccagacggacaagatctcacatagtcataaagctaccagaaaatacagagaatacttggaacacattttggaatatctgacatcatttctgtatcgcacagagccattgcaag

SEQ ID NO: 31073 - DNA, 325 bp, Zea mays
  Clone ID: LIB3059-021-Q1-K1-D12
aaaaaaaaaaaaaataaaaaaaaaaattaaaaattaaaaaaaaaaaaaaaaaaaaatagaaaaaggaaaaaaaaaaattaaaaaaaaaaaaaaaaaaaaaaaattttttaataaaaaaaaataaaaaaaataaaaaaatataacatatataaaaaataaaaattaaaaaatataaaaaacttataaaaacaacataccttttattaaaataagcggcccctttttaaaattccccattttttcacttgtttttatttcaataatatctttttttatttgacccccaaattttttttactctttatttttttaaaaatattttttt

SEQ ID NO: 31074 - DNA, 309 bp, Zea mays
  unsure at all n locations
  Clone ID: LIB3059-021-Q1-K1-D2
gagcattagctttatctactccagagcgcagaagaacccgatcgacaccatgagggtgttgcgcgttgccctcgctctcctggctctcgctgcgagcgccacctccacgcatacaagcggcagctgcggctgccagccaccgccgccggttcatctaccgccgccggtgcatctgccacctccggttcacctgccacctcctgtgcatcttccaccgccggtccacctgccgccgccggtccacctgccaccgccggtccatgtgccgccgncggttcatctgccgncgccaccatgccactaccatac

SEQ ID NO: 31075 - DNA, 399 bp, Zea mays
  Clone ID: LIB3059-021-Q1-K1-D3
gtttctgatctggttgctggattgatggctctaatggagagtgatcacattggtcctttcaagttgggaaacccaggagagtttaccatgttggagctagcacaggttgtgaaggaaacaattgacccaatggcaaccattgaattcaaacccaacacagctgatgatccccatatgagaaagccggatatcaccaaggctaagcaactgctacattgggagccaaacgtctctctcagagaaggccttccgctaatggtcaaagacttgcgtcaaaggatctcggatgagtaatcgaggcaatgctacgatactggtgaccggttcgattctgaactatgctgcaaatacagtcagaagctctttatcgattggagccatgcagtacaatgtactgtg

SEQ ID NO: 31076 - DNA, 346 bp, Zea mays
  Clone ID: LIB3059-021-Q1-K1-D4
cgacgcgttcgccaatgctcacttgctcctagtgccattattccacagttcctcccgccagtgacttcaatgggcttcgaacacccagctgtgcaagcctacaagctacaacaagcgcttgcggcgagcgtcttacaacaaccaattgcccaattacaacaacaatccttggcacatctaaccatacaaaccatcgcaacgcaacagcaacaacaatttctaccagcactaaaccaactagctgtggtgaaccctgtcggctacttgcaacagcagttgcttgcatacaacccacttgctctggcatacatagttgcataccaacaacaacaacaattgcaacagt

SEQ ID NO: 31077 - DNA, 348 bp, Zea mays
  Clone ID: LIB3059-021-Q1-K1-D6
catcagagccagagggtaaaacggaatagtctattcccagtagtgataaacaaaacgagagaatcttctctgtcttcgtgcggtgtgcctgccatttccaggcccagctgttcattctcgaggctccttctcttgtagttcgtcgtccttgcgcagcagatcgagaggctgaggggagagggatccatggagctgggaaagcccctttcggcgcacagatgtagctacaccgctacctacacccactgttccataggcttctcccctcgggtcgtccgtaccagctggatccgcgcggcggctgatggcggcgacggcggggcagaccggcgacggaaaggtgccagc

SEQ ID NO: 31078 - DNA, 406 bp, Zea mays
  Clone ID: LIB3059-021-Q1-K1-C1
cgcgcggcgaccacccgattcgaagcgtgcggagagaccgaagaagcgggagagatggctcgtaccaagcagactgctcgcaagtccacgggagggaaggctcccaggaagcagcttgccaccaaggctgcccgtaagtctgcccccaccactggtggagtgaagaagcctcaccgctaccgccctggaactgttgccctccgtgagatccgcaagtatcagaagagcactgagctgctgatcaggaagctgccctttcagaggctcgtcagggaaattgcacaggacttcaaaactgatttgcgtttccagagccatgcggtgcttgccctccaggaggctgctgaggcataccttgttggcctcgttgaggacaccaacctgtgcgccatccatgctaagcgtg

SEQ ID NO: 31079 - DNA, 394 bp, Zea mays
  Clone ID: LIB3059-021-Q1-K1-A4
ggcggcgatccagcattacaccaaagccttggaacatgacgacgaggatatttcttatttgagtaaccgggcagcagtttatattgaaatgggaaagtacgatgaatgcatcaaggactgtgataaggctgtggagaggggaagagaacttcgtgctgatttcaagatgatctcaagggcactgacaagaaaaggaacagctctagtcaagcttgctaagacctctaaggattttgatattgccatcgagacctaccagaaggctctaactgagcatcggaacccagacactcttaaaaagttgaatgaggctgagagagcgaaaaaagagttggagcaacaagagtactatgatccaaaattagcagatgaggacagagagaaaggcaaccag

SEQ ID NO: 31080 - DNA, 371 bp, Zea mays
  Clone ID: LIB3059-021-Q1-K1-A5
cggacgcgtgggcggacgcgtgggctgacgcgtgggggctgggagaggctttaccgtggaggagttgaaggctgcgggcattccaaaaaggcttgctccaaccattggcatttctgtggatcaccgccgcaagaacaaatcccttgaggggctgcaggccaatgtccagaggcttaagacatacaaggccaagctggttatcttcccaaggcgtgctcgcaaggtcaaggctggtgactctactctggaggagcttaccactgctacccaggtacagggtgactacatgccaattactcgcggtgagaaacgctctgtaaaggttgtgaaagtcacagatgagatgaaagcgtttgccggctatggcaagc

SEQ ID NO: 31081 - DNA, 363 bp, Zea mays
  unsure at all n locations
  Clone ID: LIB3059-021-Q1-K1-A6
gagaaaccctagaatggacagactacatgtcgctcgccttcacacagcacgtaagagcatgtagacatcttagcatgcacagcaacggaaggcggtgaaattgacaattaattgactgcatatccacccacccatgcaatgcaatgcatacattcatgcgttcaggtgatcacggagacgctgcggatgggcaacatcatcaacgggatcatgcggaaggcggtgcgagacgtggaggtgagaggccacctggtccccaagggctggcgcgtcctcgtctacttccgcgccgtccacctcgacgccgccgtccacgacgacccgcacgccttcaacccctngaggtggaaggagaggcccgac

SEQ ID NO: 31082 - DNA, 347 bp, Zea mays
  Clone ID: LIB3059-021-Q1-K1-A7
gggcttgcaagtttggcttctatgagttctttaagaagtattactcggacatcgcagggcctgagtatgcccaaaagtacaagactctaatctacctcgcaggatctgcatctgctgaggtaattgctgatgtggctctctgcccttttgaagctgtgaaggtacgtgtgcagacacaacctggatttgctcgtggattgagtgatgggctccccaaatttgtccgatctgagggtgttcttgggctctacaagggaattgttcctctctggggtcgtcagattccttataccatgatgaagtttgcttcctttgagaccatcgttgagcttatctacaagcatgct

SEQ ID NO: 31083 - DNA, 398 bp, Zea mays
  unsure at all n locations
  Clone ID: LIB3059-021-Q1-K1-A8
gcccagcgcaggcaattacaattgaggctgaagaacgtgaagatggcagtcgccgaggcacaagatatgatattgacatgaccaaatgcatttactgtgggttctgtcaagaggcttgcccagtcgatgctattgttgaggggcctaactttgagtttgccactgagacacacgaggaactactgtacgacaaggagaaattgcttgagaatggtgatcgctgggagactgagattgctgagaacttgagatctgagagcctctatcgctgaatctgtcttccattatggttgataaactgggttcttccattttccatattttgctcaactagctgatgaataagcanacgatgtatcataacttangtacgatgtttttgtaccttggcaccatct

SEQ ID NO: 31084 - DNA, 377 bp, Zea mays
  Clone ID: LIB3059-021-Q1-K1-A9
gcaaagcggcagtgcgtagagaggatcgtcgaacagaacagcatgaagatggtcatggttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatgttccagccgctccggcaacagtgctgccagcagcagatgaggatgatggacgtgcagtccgtcgcgcagcagctgcagatgatgatgcagcttgagcg

SEQ ID NO: 31085 - DNA, 187 bp, Zea mays
  Clone ID: LIB3059-021-Q1-K1-B10
caacacaattctctacgacttatgctaaccatcttcttgctattctcaatgaatgtaacctattttgcacccattgtgataccaaaccagctgcttactgtaactattgatgatcaagacgatcattccactcaacaactaatccaaataaatctttcatcttaccatgacatttataggtttttcc

SEQ ID NO: 31086 - DNA, 433 bp, Zea mays
  Clone ID: LIB3059-021-Q1-K1-B11
cccacgcgtccggtcagcccgcaggccgtcggcggcgggcagtgcccggcgctcgggggccccgtcaacctcaactgcgactgccctccccagaaccgcaccgccgagggcgccgcgtgccgcggcccgccggagtacttcaagaaccggtgcccgctcaccaggaccacgcccaccgacgtcgagcccgtgccgcagagctgccgcgccccgggggagctcaaggtcatcttctgccaggcgaccatcgtcacatgcggcggcgaagcagagcgcaccgtcctcgccgacagctagacagatcgagccgtccagctccattcgcctccaggctccgctgaatccttacagtaattgtcatgctttcttttgctccatgtgtttgttagctttggcttcgacgcgcgtgtactccggtggttttattttagaa

SEQ ID NO: 31087 - DNA, 314 bp, Zea mays
  Clone ID: LIB3059-021-Q1-K1-B12
gacgtcgcggagctgcgagcgcggaccagaggcagacgacggggagccggacacggtttacactgaatcgcgcgcgtcgtcgcgtttcgtcccatcgtacaagtcgaccaaacgtccaccgactcacggcacacttgcccatggagtaggacacgcaacggtgaccagccgacttaaccctggctggaggacaaccctaccagcacagttccgtctaactgtacagatacgcgggcgtagactgtccagaccctcattgccgtctgacttaacgccacaggcatgtacgatcaggcatgcaaggtcagttgcag

SEQ ID NO: 31088 - DNA, 315 bp, Zea mays
  Clone ID: LIB3059-021-Q1-K1-B2
attcaaccaactaggttcattgaatggaagaatttatttgccacaacaacaactacggttcaggcagctaccttctgcttaccctcagcaattgctttcattcaaccaactagcagcattgaactctactgcttattaacagcaacaacaactactaccattcagccacttagctcgagtgagccctactacctacttgacacaaaccccttgtgaatgcagactactagcacactgtgattgatgataacaccctatttcaaatgcaccatttgttgacattaaccccattttttttgataaaaccagtacttt

SEQ ID NO: 31089 - DNA, 399 bp, Zea mays
  Clone ID: LIB3059-021-Q1-K1-B3
cgcacgcgtccgggcaaaatggttggtagcaagcccctttatgtagctcttgcgcagggtaaagaagacagaaaggcaaagctacaggcacaattttcacaaatgcgtcctgttgcaatggcgccttcagtaggtcctcgcatgcccatgtttccacctggtgtccctggagttggtcagcagctgttctatggtcagccaccaccagccttcatcaaccctcaggctggatttgctttccagcaacctctgatgcctggtatgaggcctggtggtccaatgccgaactttatgatgcctatggttcagcaaggacagcaaccacagcgtcctgctggtagacgtgctggtggaatgcagcagcccatgccaatgggtggtcagcaacaggtgttccct

SEQ ID NO: 31090 - DNA, 303 bp, Zea mays
  Clone ID: LIB3059-021-Q1-K1-B4
ccggggttcggtttcgtgggtgagcggatcgagatggcggcgtcggatgttgagtagcgctggttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgt

SEQ ID NO: 31091 - DNA, 137 bp, Zea mays
  Clone ID: LIB3059-021-Q1-K1-B5
aaaaaaaaaaaaaaaaaaataaaaaattaaaaaaaaaaaaaaaaaaaaaaaggaaaaagaaaaaaaaaaaaaaaaaaaaaaaaaaaaaaaaagaaaaataatgaaaaaaaaaacaacgaaaacaaaaaaaaatatat

SEQ ID NO: 31092 - DNA, 411 bp, Zea mays
  Clone ID: LIB3059-021-Q1-K1-B6
aggtcgatgaaattaggggtggtgtatctggtggtagtattctcaggggagtcctgggggtgaaccagaagattgaagttcgccctggcattgtcatgaaagatgagactggaaacatcaagtgcaccccaatctactcaaggattgtctcactgtacgctgagcagaatgaactccaatttgctgtcccaggagggcttattggtgtgggaacaaccatggacccaactctaacgcgtgctgacaggctggttggccaggttcttggtgaagtaggttcactacctgatgtttacgtagagcttgagatcaatttcttcctactccggaggctgttgggtgtgaggacgaaaggtacagagaaggcagggaaggtgtccaagctcaccaagggtgagatcctcatgctta

SEQ ID NO: 31093 - DNA, 370 bp, Zea mays
  Clone ID: LIB3059-021-Q1-K1-B8
gatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatgttccagccgctccggcaacagtgctgccagcagcagatgaggatgatggacgtgcagtccgtcgcgcagcagctgcagatgatgat

SEQ ID NO: 31094 - DNA, 360 bp, Zea mays
  unsure at all n locations
  Clone ID: LIB3059-021-Q1-K1-B9
ccggttcggaattgccgcatgcgtccggtagggttaggaaggcggcggccagcggcgagagcgcgagaggaagagcaggaggaggggtcggtcatgacggggaaggcgaagccgaagaagcacacggcgaaggagatcgccgcgaagatcgacgcggcgacgacgaaccggggcggcggcaaggccgggcaggcggaccggctggggcaggacaagggcgggcatgcgaagctggcgtgcccgctctgccgcaccccggcgcccgacatcaagtccatgcagatccaccacgaggcgcgccaccccaagctccccttcgagccggagaagctcctcaacctgcactcctnncgccccgct

SEQ ID NO: 31095 - DNA, 409 bp, Zea mays
  unsure at all n locations
  Clone ID: LIB3059-021-Q1-K1-A3
aattgacggatgcacccacgcgtagcgagcacgcgtccagcggtttttgcagtgcagatcaacttacttcggtgggtgccattgttgatggcgtggtgggcgtacactttcccgatgaccggagccggcatcgcgtccatacgctactgcaccgaggtggacaacaccttcaccaaggcgctctgcctggcgctgtccgagatcgccgtgctcacggtgactgcgctgntcgtcaccacgctggtgcacgcgttcgtgctccggaagctcttccccaacgacatctgcatcgccatcacggaccacaagatgaagcccatcatggagctgcacgagagccatggccaggacagcaacaccaacagcaacgacatcgagaccggcgcccggggcaaacagtgagggacgc

SEQ ID NO: 31096 - DNA, 350 bp, Zea mays
  Clone ID: LIB3059-043-Q1-K1-E8
cccacgcgtccgctcgcatccgcagcctctcgagctctactccatcccctcgatctcgaagcgcagcagcagcagtcaggcggccatggacgccagcgcagcaggagccggcgggaaggcgaagaagggcgcggccgggcgcaaggccggcgggccgaggaagaagtcggtgacgaggtccgtcaaggccgggctgcagttccccgtcggccgcatcgggcggtatctgaagaagggccggtacgcgcagcgcgtcggcacgggcgcccccgtctacctggccgccgtcctcgagtacctggccgccgaggtgctggagctggccggcaacgctgccaaggacaacaaga

SEQ ID NO: 31097 - DNA, 316 bp, Zea mays
  Clone ID: LIB3059-043-Q1-K1-F1
ggcaaatcagagaaggctagtggccgaaacataaaagcaatagtcgcactcttgttagggctctgatctgaatgtctaatcccacaggacacattttgtaaaaaggcggtagcttctttagccttattagactggtaatacactcaactgaatgatgtccagttccatcaacaaggcttcaccgagactgtcgagtgactgatcacgatcatgttttttttttcacagtttgcttctgtgcagttgcctaataaacccattcgttgtaaacaagccagttctaactttaaaaaaaagggcctgtgcatggcgctct

SEQ ID NO: 31098 - DNA, 423 bp, Zea mays
  Clone ID: LIB3059-043-Q1-K1-F10
gtgctcagcgacctcaccggcatcaacaacagcaacggttgcttcttaccgagggagcgcgcgcgggttggcgacttggccggcgcgaccttgaacttggacatgcaaggtgaacgctctctgctgccgctagtgtcagctccggtgccgctgccggtgcccgcggaggacgtgcagaacaggttgctctgctctgcctccgcgtctaccagtggacaccctacgcccagcgtctcgccagtgtctcacctgtaccgacactgcgtcgagattgacgcgctagtccgcatcgagaatgagaggctgcgagcggcgctgcaggaggcgcgacgccggcactttcggactgtggtgctgtcagcggaacgtgcagcggctcggcgcctgctgacagacgatgccgaactggtacgcgccatgctg

SEQ ID NO: 31099 - DNA, 258 bp, Zea mays
  Clone ID: LIB3059-043-Q1-K1-F11
acgacgcgtccgcccacgcgtcccttcacgcgtccggcgtctccttcgacatcgaaggtagcctgggtgctcctgttccgcgtggagagaacgcgagtacccgacccgattgtgctctctcatttgcacccaaacgggccaacgttacatctcactcgcccgatctgaacactgtactccacgcagaacgattggaacatcctgatcgatattacttgactagacacctacactttcgaacgcgattccactatcagc

SEQ ID NO: 31100 - DNA, 266 bp, Zea mays
  Clone ID: LIB3059-043-Q1-K1-F12
cttttttgtccattttaaaaaaaagtactcattattataatttagaaacctgtgccggattaaaagcaacacgagagacgaaaacagagagccagcaaagcaaacccaaggacattgaggtgctgctctgctagcgtacgtgctacggcatgtcacgtacgaggtacacgacgacgacgacgacaggggacactagacgaagtgatcactagtgggtgcatgatctacttctttattataataatgagtacttttttgtccatttt

SEQ ID NO: 31101 - DNA, 225 bp, Zea mays
  Clone ID: LIB3059-043-Q1-K1-F2
tgatgatctcccccgaggacccgtgcaagtgcttcgtcaagcgcgtaatccggatgcacgggtactccgtcacctaccttgtcgaccccggcataagcgactgcttcttcagaaccgctgttgtaccgcaagatcatgtctgggtgcacggcgataatatctttgcttctcatgattccaggcgatttggatccccgccttattggctgattacacggaaaatat

SEQ ID NO: 31102 - DNA, 293 bp, Zea mays
  Clone ID: LIB3059-043-Q1-K1-F3
agtacgtgttgcaggcggaagaagcgctaactgaggagctacttttgatacggacagggatgactcatatagtgcctccactgattccacgagatcgcatgatcgtatctagtcagatgatgagcttgctatgtcgacaacaagactgtctgctaatgcagcgaatacatacgatgctgcattgtacgcataggccgatgctgctatatccataaacgcggacactttctgtgtactgttagcaactgcatgatactagatcagagtatatatacgtagtgtgacatcgtgct

SEQ ID NO: 31103 - DNA, 374 bp, Zea mays
  Clone ID: LIB3059-043-Q1-K1-F4
atagaaagcacaatagtgtaccaacattggcagccaaaatattttgcctccttatgcggcttggtctttctgcaagtgctgctacggcgaccattttcccgcaatgctcgcaagctcctatagcttcccttcttcccccgtacctctcatcagcggtgtcttcagtatgtgaaaacccaattcttcaaccctacaggatccaacaagcaatagcaactggcatattacctttatcacccttgttcctccaacaatcatcagccctattacaacaggtacctttggtgcattcattggcacataacatcagggcacaacaactacaacaacttgcgctagcaaaccttgctgcctactctcagcaacagcagttt

SEQ ID NO: 31104 - DNA, 378 bp, Zea mays
  Clone ID: LIB3059-043-Q1-K1-F5
gatcagcaaagcggcagtgcgtagagaggatcgtcgaacagaacagcatgaagatgggcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagacgagcgccatgtaccagccgctccggcaacagtgctgccagcagcagatgaagatgatggacgtgcagtccgtcgcgcagcagctgcagatgatgatgcagcttg

SEQ ID NO: 31105 - DNA, 400 bp, Zea mays
  Clone ID: LIB3059-043-Q1-K1-F6
catagaaagtggaatccagtatcaacaatagagcaacaatggcgaccaagatattgggcctccttatgctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgtttcaacaatcgccagccctatctttggtgcaatcattggtacaaaccatcatggcacaacagctgcagcaactcgtgctacctctgatcaaccaagtagctctggcaaacctttctccctactctcagcaacaacaatttct

SEQ ID NO: 31106 - DNA, 408 bp, Zea mays
  Clone ID: LIB3059-043-Q1-K1-F8
gtctaattgctgctgttatagctgtttggagcacagctttgcaacaatacgtgagtggtagcatctttaaatgcagatttcttatacgtcacctaaccagtaagattgcttgctacctcctgtttgcaattacctgcaagttcgtcggtgcgctttgagccttttcaaaggacaatatggcacttcagtgacagtgatacttgtttattatggaaagttgttgataattagcagttgtcaaattattcattgggatcaccgcagctttaggatataactccttttttttctggagattatgaatagccactcaccatggccacttgatatctttcatacttgaattgtcagacttcataaatgtgctcatgaatcatgatgccactaatatattgttctttacacaaa

SEQ ID NO: 31107 - DNA, 353 bp, Zea mays
  Clone ID: LIB3059-043-Q1-K1-F9
cgacaaccattgttccgcaatgctcacaagctactatagctcatcttctcgcgagaggcctcttaccagcgtggccttcagtatgtagaaaacctaattattcaacacctacaggatccatcatgcaagcacagcatgcatcttacctttatgcacccttgatcctccaacaatgataatccgtatcacatcagtcacctatgctgcattaattggcacagatcatgatggcacaacatctacaacatctcgagctagctcaccttgctgtctacactcagctacagcagttacctgagatgctaatgatggcacaaaacatgacgacacatcatctacatcatctagtgcta

SEQ ID NO: 31108 - DNA, 427 bp, Zea mays
  Clone ID: LIB3059-043-Q1-K1-G10
cgcaaattgcaccaagaaatccatcgagaggccgtcgacaggggaattaatggcggggtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggactgcgcgatcccgccggtcccggacgcgcagctggagggccgcctagaggacctgaccggctgcccgcgggaggtgcataggggattcgccgccaccctc

SEQ ID NO: 31109 - DNA, 337 bp, Zea mays
  Clone ID: LIB3059-043-Q1-K1-G12
cgcacgcgtccgcgtacgcgtgggctgacgcgtgggcgctactgccgtacccagggcgggagtccggcagcatggacgaggctgcctaagcgtgcgcaatcgtctcttggacagcctactgtccacgaccgctgacgcaatctccaagttcgacagcatagccgataggatcagcatcttctgctcgtccgacgaggctgcggaggcctctatctctaccttgaagaaccttacttgtgactggtaactcgcagctatgctgtaccacagcttatcgtaacactactccgcgcagtctctcagagcgatcaatgaggacgtaagcacgcttgtcttc

SEQ ID NO: 31110 - DNA, 328 bp, Zea mays
  Clone ID: LIB3059-043-Q1-K1-G2
gcgcagcggcggcggagctgctgtacctcgcctacaacggtgacaaggaggtgacgtggagtgaagcttgcggcgttttcggcagcttctgccgtcaggcgcgcaccttcgtcgccatcaccttcggcaccgtcctctgtttcatcctcctgtccctcatctcctcgtaccgccttttcagcgcctacgaggcgcccccgtcgtcggcgctcggcagcaagggcgtcgagatcgccgtctacccgcgctgaagccgctggaggaaggcctcgttgcaaatctctggtatgcgtagtcgatcatgtaataatggcttatcgcatatata

SEQ ID NO: 31111 - DNA, 415 bp, Zea mays
  Clone ID: LIB3059-043-Q1-K1-D11
cggacgcgtggggcaaacacgaccatacatttattgcgaccgtacaaacattgtaacaaaaggcagcagcgagctagtatagctccacaagaaaacatcctcatcctcttcctttcttagtagggctccactggtgccctgaactttgctccggcgtagaccgcggcatcaccgagctcctcctcgatcctgagcagctggttgtatttggccaggcgctcagaccggcaaggagctcccgtcttgatttggcccgtagacaggccaactgagaggtcagcaatgaaggtgtcctctgtctcgccactcctgtggcttgccatcactccccatccggcgcgcttggacatcctgacagcttcgatactctcggtcacagacccgatttggttcaccttcaagaggagagcattgc

SEQ ID NO: 31112 - DNA, 426 bp, Zea mays
  Clone ID: LIB3059-043-Q1-K1-D12
gataattttgtggactacaaagaccggaaaattattctttcttcaggcagtgaaaagaagcttgaagaggctgcccctgggcttattttacggaagagaaagtctgctgacgagtcagttgccagcgaggcaaattcatcttcggttgaaagtgaagcatcagttgctgatgctgtggcccttctgcttaagcataaacgtggtctacaaacctcagaagaaatggagaatgagactgaaccatattctagcaagaccgaagggaagaagtcgaaacaaaaacgtgtattgggcccagcaagaccagatttccttgaagccagacaagactctgaaacatgggtgccacctgaaggtcaaactggtgatgggcgcactgcattgaatgaccgtttgggttattgaaaagctcttccagcaacagtt

SEQ ID NO: 31113 - DNA, 356 bp, Zea mays
  Clone ID: LIB3059-043-Q1-K1-D7
cgagcgctcctttctagccttcacttctcagcacggctgcctttgacccccgactgcggtcgtcagcacgtccatggagcaagccgacatgccagacgttccccgcgtaaagctaggcatacagcggcttgaggtgtctaagctggcgttcggctgcatggggctaacgggcacttacaacacgccactcggcgacgaggccatggccgacgtcttcgcgcactcgtttcgtcgagggatcacctgtttagacacctgctattcctacgggccacggaccaactagaccctactggggaaggcgctcaagcatctgccgagggagcaattgcatgttgccaccaagttcgtgataa

SEQ ID NO: 31114 - DNA, 320 bp, Zea mays
  Clone ID: LIB3059-043-Q1-K1-D8
cccacgcgtccgcccacgcgtccgttgtcacgtgggcttcctctggctctgctgtgaggtgcaagcattgctgatgctgcatgtgtgtgtgcgatcagtgactggctgctggttcatagaacatgaactgaaagaaggatgattaagggctttgtcaatcgccgttacaactgcatcccatgcgcatgctcgcttagtagattgggtataatttggcttggcacacccagcatcattatgtgctgatctgttatcctttactagctaggtcgcccgatatatctctacctttttggggaatggtctactgtgtactgaaa

SEQ ID NO: 31115 - DNA, 416 bp, Zea mays
  Clone ID: LIB3059-043-Q1-K1-D9
cgcaaattgcaccaagaaatccatcgagaggccgtcgacaggggaattaatggcgtcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgcctagaggacctgccgggctgcccgcgggaggtgcagaggggattcc

SEQ ID NO: 31116 - DNA, 313 bp, Zea mays
  Clone ID: LIB3059-043-Q1-K1-E10
aagcgctctatcaacgacctaacaacaatggcttccaagggattatccctccttgcgcttcttgccctttttgtgagtgcaacaaatgcgttcattattccacaatgctcacttgctccgagtgccattattccacagttcctccctccagttacttcaatgggcttcgaacacccatctgtgcaagcctataggctacaacaagcgcttgcggcgagcgtcttaaaacaaccaattgcccaattacaacaacaatccttggcacatctaaccatacaaaccatcgcaacgcagcagcaacaagcactgatcc

SEQ ID NO: 31117 - DNA, 420 bp, Zea mays
  Clone ID: LIB3059-043-Q1-K1-E11
ctactatactatactctaggaagcaaggacaccaccgccatggcagccaagatgcttgcattgttcgctctcctagctctttgtgcaagcgccactagtgcgacccatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtcttgccgagcatgatgtcgcaaatgatgatgccacaatgtcactgcgacgccgtctcgcagattatgctgcaacagcagttaccattc

SEQ ID NO: 31118 - DNA, 407 bp, Zea mays
  Clone ID: LIB3059-043-Q1-K1-E12
cggacgcgtgggcggacgcgtggggaagaggaagaacccgctcaagaacatgggtgctgtgctcaagctgaacccctacctcggcactgcccggaagatggccacccttgctgaggctgcccgagtcaaggcccggaaggagaagcttgattccaagaggaccaagcttacctcggaggagactgccaaggtcaaggctgccggcaaggcgtggtacaagaccatgatctcggacagtgactacaccgagtttgagaacttcaccaagtggctcggagtgacgcagtgaagcggcctttgagacctagttaagttttgattagttgtgtcgctgaactttgtattgagacgaaatagtattttatcaatctgtcttatcctgcatcttcacaacaagttacctatct

SEQ ID NO: 31119 - DNA, 149 bp, Zea mays
  Clone ID: LIB3059-043-Q1-K1-E3
ctgtgctgaaaacagaaattgatggtctgcaacaggaacttgttcacgtgaggactgcttgcgggttagagcagaaggggaatttggaattgctggaacaaaggaaggcaatggagaagaatatgctttctatggcacaagagatcgag

SEQ ID NO: 31120 - DNA, 365 bp, Zea mays
  Clone ID: LIB3059-043-Q1-K1-E5
cggacgcgtgggttcagaaacacacctagcgaagcgcactagcaacgacctaacgacgatggcttccaagacattatccctccttgcgcttcttgccctttttgtgagtgcaacaaatgcgttcattattccacaatgctcacttgctccgagtgccattattccacagttcctccctccagttacttcaatgggcttcgaacacccagctgtgcaagcctataggctacaacaagcgcttgcggcgagcgtcttagaacaaccaattgcccaattacaacaacaatccttagcacatctaaccatacaaaccatcgcaacgcagcagcaacaagcactgagccacctagccgtggtgaacccta

SEQ ID NO: 31121 - DNA, 368 bp, Zea mays
  Clone ID: LIB3059-043-Q1-K1-E6
cccacgcgtccgctcttgcaactccagtgcttctcactgccactgccagcaggtcgagctgctccgcaagtctgctttgctgctgcacctgcaagtctgcaaccgcgcacagagatgtcgacgactgtgagccgtgcgtccctcgaccagaaactcgccctcgccaagcgctgctcccgagaggcgaccctcgccggagccaaggcggcagccgtggcgactatcgcctccgcgatccccaccctggccagcgtgcggatgctgccatgggccaaggccaacatcaaccccaccggccaggcgctcatcgtctacacggtggctgggatggcctacttcatcgccgccgataagaagatcctgtcgct

SEQ ID NO: 31122 - DNA, 359 bp, Zea mays
  Clone ID: LIB3059-043-Q1-K1-B4
agcacgcccaagctccacaatttggcggacgagatggaggccctccgcgcggcgaagggcgacctgtaggagaagctcgatgccgtgggacacgagaaccggttcctgtcctctgagtcccggcgcctcgaggtcctcgtgtcccaggcccgcgaggaggtcgccgctgccgagcaagtcgccgtcaccaacgagagcgaggcctccacgctccgcgcctaggtcgagcgtctccagggccttctagccgcagagaaggccagccatgatgaggagatgcgcatgggcgcatggctcggggaccagctgcagaccgcgtaccatgagaaggccgtccttgaggaggagatcgagaccct

SEQ ID NO: 31123 - DNA, 367 bp, Zea mays
  Clone ID: LIB3059-043-Q1-K1-B5
cccactcgtccgcaactagcaacatacatagtgaagtacactagctacatcttagcggcaatgggagccaagatttttgccctccttgccctccttgctctttcagcaagcgctgctacctcgacttttattccacaatgctcacaacaatacctctctccggtgacagccgcgggatttcaatacccaactatacaatcctacatggtacaagaggccatccaagcaagcatcttacggtcattagcattaaccctgcaacaaccatatgctctattgcaacagccatccttaatgcatctgtatctccaaagaatcgcggcacaacaactacaacaacagttgctaccaacaatcaatcaagtag

SEQ ID NO: 31124 - DNA, 395 bp, Zea mays
  Clone ID: LIB3059-043-Q1-K1-B7
cgcaaacacacggcacgagcagctgagcgcccatggcaggtccccggcgtctgctggggctgctcctcctaccgctgctcgtgctcctcggcgcgcacccgccgcagtgcgggtccgcggaggaggggacgaaggtctccctggagctctactacgagtcgttgtgcccgtactgctcgcggttcatcgtcaaccgtctcgcggggatcttcgaggacgggctcatcgactccgtccacctccggctcgtccactacggcaacgcgcacgtcgcatccaacagcaagatctcttgccagcatggtccgtacgagtgtctgctcaacaccgtggaagcttgcgccatcgacgcctggccggatccggatgtgcatttcagcttcatctactgcgtg

SEQ ID NO: 31125 - DNA, 127 bp, Zea mays
  Clone ID: LIB3059-043-Q1-K1-B9
cggacgcgtgggttcggcttggttgatctctctccttccctctttgcgtcaggaagcggcagcttgcaaacctggtctcagcactgtaattatttcttctgttctaccacatcttttgtttgttgtt

SEQ ID NO: 31126 - DNA, 372 bp, Zea mays
  Clone ID: LIB3059-043-Q1-K1-C1
aagaaagaagggtcccaaggtccttctaggaaaaaggatactggtggaaagatggccgagggttacagtaagcgtcagatgatgaacatcaggcctgtgaattacaactccatagacaacgacattacatcaagcactgacagcactactatataagtttatcatgcaagactattgcatcaagagtgttgctgtctcttgcagcaagagacaacatgtatgtatacgctggcgatcaatagggcaacctgagctctttaccagcagcttcaaccaagttttacgtgcacacaggattggctgacagaattagcccaacggacagctactggaagtaggatccctgaaggttatatcgatttacactttttt

SEQ ID NO: 31127 - DNA, 417 bp, Zea mays
  Clone ID: LIB3059-043-Q1-K1-C11
cggcatctccgtcgactacctggccgcggtggcatccttccccaaccccgacgataagatccgcagcctcgccctcaaggtgcaggggggcggcaacactggcaacgcgctcactgcagctgcacgcctcggcctccgtcccaggatcatttccaaggtagccaacgatgctcaaggaagaagcatcctcagcgaactccaaactgatggcgtggacacatcctacatcctggtcgcagagaacgggaactcacccttcacctacataatagttgatgaacagacgaaaactcgtacatgtatacacactcctggttctcctcccatggtgccagaagagctcacaaaggcaaacttgtcgtccgctttagatggcgtggacatcgtctacttcgatgtacgattgcatgacattgc

SEQ ID NO: 31128 - DNA, 426 bp, Zea mays
  unsure at all n locations
  Clone ID: LIB3059-043-Q1-K1-C12
cgccgtcgccccgccgtgttgctcgccgacaccgtcccgccggcagccaaaatgccggtcaagaggttcgtggagatcgggcgagtggcccttgtaaactacggcaaggagtatggccgcctcgtcgtcatcgtcgacgtcgtcgaccagaacagggctcttgttgatgcccccgacatggttcgttgccaaatgaacttcaagcggctttccctgactgacatcaagattgacattaaacgtgtcccaaagaagactacactgatcaaggcaatggaggaagctgatgtgaaaagcaagtgggagaatagctcatggggcaagaagctgattgttcagaagaggagagcatcactcaatgactntgacaggttcaaggtcatgttggcgaagatcaagaagggcggtgccattaggcaagagctt

SEQ ID NO: 31129 - DNA, 431 bp, Zea mays
  unsure at all n locations
  Clone ID: LIB3059-043-Q1-K1-C2
gtttcagatggtgtcgatccaaagccgtcacagcgtgccagtgagacgcttccagcagtggtgtatctaccaaagaatgggaagcatgtcaagattaatgggaatcttgttattaagtcgattgttgctagtgagaaagcttcattgcagatgtctggcaatgatgggaagcgtcctcaaaaccaagaggaggagactagactggcaattcctggctatgtgactccattgaaagctggagaggttatggaatcaaccgaaggaatgatgaacaatgaactgttggcgttagctcctgcagatggaagcatgtatagggaggaagatggattgctgccacagtggtttagtgaagcaatgtctggccccctgctgagctcangaatgtgcactgaagttttccagttcgatgtgttcccatcatctgctca

SEQ ID NO: 31130 - DNA, 371 bp, Zea mays
  Clone ID: LIB3059-043-Q1-K1-C4
cccacgcgtccggcatattgcaccaagaaatccatcgagaggccgtcgacaggggaaggaatggcgtcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagct

SEQ ID NO: 31131 - DNA, 173 bp, Zea mays
  unsure at all n locations
  Clone ID: LIB3059-043-Q1-K1-C5
gtactcggtctcggaattctccgggttcgtacccacgtcgtctcgtcagatgaagtcttaattgaggggttatctcccaagnggtcgtacctgtcttcgtaaaggaaagtactggtggagttccactttaagtcgtaagatgggatgaaaaacatagtctctatgannattag

SEQ ID NO: 31132 - DNA, 409 bp, Zea mays
  Clone ID: LIB3059-043-Q1-K1-C6
atcacatcgccatggcagccaagatgtttgcattgtttgcgctcctagctctttgggcaaccgccactagtgctacccatatgccagggcacttgtcaccactactgatgccattggctaccatgaacccatggatgcagtactgcatgaagcatcagggggttgccaacttgctagcgtggccgaccctgatgctgcagcaactgttggcctcaccgcttcagccgtgccagatgccaatgatgatgccaggtatgatgccaccgatgacaatgatgccgatgccgaatatgatgccatcgatgatggtgccgactatgatgtcaccaataacgatagctagtatgatgccaccgatgatgatgccaaacatggtttcaccaatgatgatgccgagtatgatgccttc

SEQ ID NO: 31133 - DNA, 352 bp, Zea mays
  Clone ID: LIB3059-043-Q1-K1-C7
gtgaaagctgtctataggggggcagaatacattactacagctactggtgatggggactttggtcttgtgctggaaagtacaagtttctatgctgaacaaggaggccagatatttgacactgggagcattgaggggtcatttggaactttcaatgtgaacaacgtccaagtgtttgctggctatgttctacatattggctcatttacaaaaggttcgaaggttatgtctcttggagatagtgtgatatgcaaggttgattacaaccggctcacactgattgctccaaatcatacgtgtacccacatgttgaactttgctctaagggaagtacttggtgatcatgttgaccaga

SEQ ID NO: 31134 - DNA, 410 bp, Zea mays
  Clone ID: LIB3059-043-Q1-K1-C8
cccacgcgtccgcggacgcgtggggttcgggtgcggcccatgtgagaaggctcgcggtgtttgcttccgccgtcggcaaggaaggaagaagagagcagaaccctagctagagtttggcgagtggtgcggaggcgcggctgctcctgctcgtcgcgacatcgaatttcagcgccgcccgcgcgatccttggtctcttcgcccgtgaggagaggcgcggcaatggctgggaaaggcgggccgaccaacctggagaaggagcagatgtttgggatggcggagaaggagatggagtacagggttgatcttttcaacaggcttacaaagacctgttttgagaagtgcgttgaaaaaaggtataaagaagctgagctcaatatgggtgagaacagttgcattgatcgatgtgtttc

SEQ ID NO: 31135 - DNA, 298 bp, Zea mays
  Clone ID: LIB3059-043-Q1-K1-B3
aaggctcataggggcaccggtcgggccctggccataaacgagatcttctagcgtaacgcggcgacgatcaagaactacggcatctggctgcgctaccagagcagaaccggctaccacatcatgtacaaggagtaccgcgacacaaccctgaacggcgctgtagaacagatgtacaatgagatggcttctcgccaccgcgtgaggtccccctgcatccagatcatcaagaccgtcacggtgcacttcaagctgtgcaagagggacaacacagagcaattgcacaacagtgagatcaaag

SEQ ID NO: 31136 - DNA, 416 bp, Zea mays
  Clone ID: LIB3059-020-Q1-K1-H1
ggacgcggtcagcttccatctctcggtctcctccctctacatcccacggccgctaccacggtccctctagctcacacggccgccggcctctccaaggtctgcacacggaaaaaccttgccacgagtcgccgacactccataccggaagagctaacgaggtgactccccaccgcgcccatgggtgacagccagtactccttctccctcaccaccttcagtccgtcggggaagctcgtgcagattgagcacgcgctcacggctgtcggatccgggcagacctcgctcgggatcaaagctgccaatggtgtagtcattgccactgagaagaagctgccttctattctagtggatgaaacatctgtgcaaaagattcaggcactaacacctaatattggagttgtctatagtgggatggg

SEQ ID NO: 31137 - DNA, 428 bp, Zea mays
  Clone ID: LIB3059-020-Q1-K1-H10
cagagagcgccacagatctcgatcctgaagcttacgagcgagttcttacgtactcctcgcagtcagccatggcccgctgctactggcagtcgcagtcctccgtcggtggcggctgctatagctgccgttgttcccgcataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttacattcaaccaactgtctacattgaaccgtgctgcttatttgca

SEQ ID NO: 31138 - DNA, 363 bp, Zea mays
  Clone ID: LIB3059-020-Q1-K1-H11
cctagcgaagcgcactagcaacgacctaacaacaatggcttccaagacattatccctccttgcgcttcttgccctttttgtgagtgcaacaaatgcgttcattattccacaatgctcacttgctccgagtgccattattccacagttcctccctccagttacttcaatgggcttcgaacacccagctgtgcaagcctataggctacaacaagcgcttgcggcgagcgtcttagaacaaccaattgcccaattacaacaacaatccttggcacatctaaccatacaaaccatcgcaacgcagcatcaacaagcactgagccacctagccgtggtgaaccctatcgcctacttgcaacatcagct

SEQ ID NO: 31139 - DNA, 419 bp, Zea mays
  Clone ID: LIB3059-020-Q1-K1-H12
cccacgcgtccgcccacgcgtccgaaacaatcatatatgcttagaactgctttcatttcaaagtaacttatgtacatctgacaaaatgcaaactagctacatttctatactttgtatttgctttggtttgtgttggcatcagtcaccaaaaagggggagattgaaagggaaatggcctcaatcatttcctataatcgattttggtgtttgacgaccatcacaaaccttatggactaactagtttgcctagttgatcttttctcaggtgcataaagtttatatacacatataaggaaaatgacccttgggccaattctataagtatggggcaagtcaagattgcaccagcctgcatgcaccggactgtctgtgtgcaccggacagtgtccggtgcctaagctgtcgcacccaacgaatag

SEQ ID NO: 31140 - DNA, 441 bp, Zea mays
  Clone ID: LIB3059-020-Q1-K1-H2
cccacgcgtccgcagactacaaggtgcatctataactactatagcagtagctcaaatctaaaaaattgtcatgaattcctaaggcagcagtgcagccctttggtaatgccttttctccaatcacgtttgatacaaccaagtagctgccaggtattgcagcaacaatgttgtcatgatcttaggcagattgagccacaatacattcaccaagcaatctacaacatggttcaatccataatccaggaggagcaacaacaacaaccatgtgagttatgtggatctcaacaagctactcaaagtgcggtggcaatcttgacagcagcacaatacctaccatcaatgtgcggcttgtaccactcatactaccaaaataatccatgcagcagcaatgacattagtggtgtttgcaattgaagaattgtgtctacctagccgttatac

SEQ ID NO: 31141 - DNA, 447 bp, Zea mays
  Clone ID: LIB3059-020-Q1-K1-H4
aaacccttctctttggtgagaaggaggttgctgtgtttggctgcaggaaccctgaggagatcccgtggggttcggttggtgctgaatatgttgttgagtctactggtgttttcactgaccaggagaaggctgcagctcacttgaagggtggtgccaagaaggttgtcatctctgctcctagcaaggatgcccccatgtttgtcgttggtgtcaacgagaaggagtacaagtctgacattaacattgtctccaatgctagctgcacaaccaactgccttgctcctcttgctaaggtcatcaatgacaagttcggtatcgttgagggtctgatgaccactgtccatgccatcactgctacccagaagactgttgatgggccctcatctaaggactggaggggtggaagggctgctagtttcaacatcattcccagcagcactggagctg

SEQ ID NO: 31142 - DNA, 404 bp, Zea mays
  Clone ID: LIB3059-020-Q1-K1-H6
cggacgcgtgggttttccaactattttggtatttggtgctgataaggagagcccattcccctaccagggggctagagttgcatctgccattgaatcctttgcattggagcagttggaagccaattctggcccggctgaagtttctgagttgactggcccggatgtcatggaagagaagtgcgcttctgctgccatttgttttgtatcattccttccagacatccttgattcaaaggcagaaggaagaaacaagtaccttgagctcctgctctctgtagctgagaagtttaaaaagagtccatacagttttgtctggacagctgctggcaagcaagctaatctcgagaaccaggttggtgtgggcggctacggctatcccgccatggtagctctcaacgtgaaga

SEQ ID NO: 31143 - DNA, 437 bp, Zea mays
  Clone ID: LIB3059-020-Q1-K1-H7
caacaacaacagtttctgccatcactgatccacctagccgtggtgaaccctgtcacctacttgcaacagcagctgcttgcatccaacccacttgctctggcgaacgtagctgcataccagcaacaacaacagctgcaacagtttatgccagtgctcagtcaactagccatggtgaaccctgccgtctacctacaactactttcatctagcccgctcgcggtgggcaatgcacctacgtacctacaacaacagttgctgcaacaaattgtaccagctctgactcagctagctgtggcaaaccctgctgcctacttacaacagttgcttccattcaaccaactggctgtgtcaaactctgctgcgtacctacaacagcgacaacagttacttaatccattggcagtggctaacccattggtcgctaccttcctgcagca

SEQ ID NO: 31144 - DNA, 375 bp, Zea mays
  Clone ID: LIB3059-020-Q1-K1-H8
cggacgcgtgggcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagacgagcgccatgtaccagccgctccggcaacagtgctgccagcagcagatgaggatgatggacgtgcagtccgtcgcgcagcagctgcagatgatga

SEQ ID NO: 31145 - DNA, 395 bp, Zea mays
  Clone ID: LIB3059-020-Q1-K1-H9
caaacatgcaaaggaggtacgagagagatagcgtgatgcgaagattagaaatagagaacaacgggaacaagatagtgtaacaaggtcgtatgctcaggatcgtgaggacaaagagagaaaggaaagactagaacaagaaagagagattaagcaaaatgaggaaaaggaaagagagcaaagaagacttgaagaggaaagagaacttgagcgacataaagaaagagaaagagctaggcaagcagtggagagggctacaaaggatgcacgggaaagagcagctgttgaagctcgtgcaaaagcggagagagaggcacgccaacgttcagaacgtgctgctgtgcaaagagcccaacaaggaagcacgtgagagggcagcagtggaggctaaagagcga

SEQ ID NO: 31146 - DNA, 191 bp, Zea mays
  Clone ID: LIB3059-021-Q1-K1-A1
aaggctgcgggcatgccaaaaaggctagctccaaccataggcatttctgtggatcaccgccgcaagaacaaatcccttgaggggctgcaggccaatgtccagaggcttaagacatacaaggccaagctggttatcttcccaaggcctgctcgcagggccaaggctggtgactctactctggaggaacctta

SEQ ID NO: 31147 - DNA, 455 bp, Zea mays
  Clone ID: LIB3059-021-Q1-K1-A11
gctctggcaaacctttctccctactctcagcaacaacaatttcttccattcaaccaactgtctacactgaaccctgctgcttatttgcagcaacaactattaccattcagccagctagctactgcctactctcagcaacaacaacttcttccatttaaccaattggccgcactgaaccccgctgcttatttgcagcagcaaatactactaccatttagccagctagctgcagcaaaccgtgcttccttcttgacacagcaacagttgctgcctttctaccagcagtttgcggctaaccccgcaaccctcttacaactacaacaattgttgccctttgtccaacttgctttgacagacccagcggccttctaccaacaacacatcattggtggtgccctcttttagattgcttattaggtggaattcaataataaaggtttttggatgatgtatgt

SEQ ID NO: 31148 - DNA, 401 bp, Zea mays
  Clone ID: LIB3059-021-Q1-K1-A12
gtgatcccatcgacactctctcaacttccaaatttgaagatattatgtgaagaccaagtaggagaacaactcatggggtgtaagcagattttctagaagaggagagcagcacttgatgactttgataggttcaaagtcatgctggcaaaggtcgagaggggtggtgctatcaggcaagagctcgctaagttgaagaagacacccatgacttaatggttatcttttagtggatgtcatgttagagtttttggttctaagttggatcagcaattcgattgagtgtcgataaagacagaagtactaatatgttccctgtgaatacattttaaactttatcaagcatgggtgtgctctagatattttatcgtgaataatatataatatataaggtagcttgcgtc

SEQ ID NO: 31149 - DNA, 381 bp, Zea mays
  Clone ID: LIB3059-021-Q1-K1-A2
gaagcagcagaagaaactgggcatgaagcccatcgaacaggggagctggacacaaggggcgccggctgatggtacgtacattgggtaaccaccaccaagcacacatctgaggagaaaatccaggagtgaggaaatcgaagctggatgtaacaatagattttactgtttgcaaatgcaacctttgtttttttttttctgggtgttcttcgtgttggaggtttttttagctctgccctagttgtgagttgtgacatctttagttttaggctgaagtctgaacgatatggggtgagagatcatgcgtgcccatggttgtcttgggattggacatgcataagttgagatgttctccttttctgtaagagttttcttttcgatgtg

SEQ ID NO: 31150 - DNA, 414 bp, Zea mays
  Clone ID: LIB3059-020-Q1-K1-G9
caacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattc

SEQ ID NO: 31151 - DNA, 394 bp, Zea mays
  unsure at all n locations
  Clone ID: LIB3059-020-Q1-K1-F5
cggacgcgtgggcggacgcgtgggctttctccctactctcagcaacaacaatttcttcgattcaaccaactgtctacactgaaccctgctgcttatttgcagcaacaactattaccattcagccagctagctactgcctactctcagcaacaacaacttcttccatttaaccaattggccgcactgaaccccgctgcttatttgcagcagcaaatactactaccatttaaccagctagctgcagcaaaccgtgcttccttcttgacacagcaacagttgctgcctttctaccagcagtttgcggctaaccccgcaaccctcttacaactacaacaattgttgccctttgtccaacttgctttgacagacccagcggnctcctaccaacaacaca

SEQ ID NO: 31152 - DNA, 439 bp, Zea mays
  Clone ID: LIB3059-020-Q1-K1-F6
caacaagcaacatagaaagtggaatccattagcaacaacagagcaacaatggcgaccaggatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacactgaacc

SEQ ID NO: 31153 - DNA, 431 bp, Zea mays
  Clone ID: LIB3059-020-Q1-K1-F7
gaccaactagcaacatagaaagcacaatagtgtaccaacaatggcagccaaaatatttggcctccttatgctccttggtctttctgcaagtgctgctacggcgaccattttcccgcaatgctcacaagctcctatagcttcccttcttcccccgtacctctcaccagtgttgtcttcagtatgtgaaaacccaattcttcaaccctacaggatccaacatgcaattgcatcaggcatcttacctttatcacccttgttcctacaacaatcatcagccctattacagcagttacctttggtgcatttattggcacaaaacatcagggcacaacaactcgtgctagcaaaccttgctgcctactctcagcaacaacagttacctttggtgcatttgttggcacacaacatcaaggcacaacaactacaacaac

SEQ ID NO: 31154 - DNA, 414 bp, Zea mays
  Clone ID: LIB3059-020-Q1-K1-F9
cggacgcgtgggggcggagatgcttcgcatatgtggtggctggcaacccacaggaaggccttgaggatgcaaagagagccgaggttattgcatcggactggccgatgggacactacctgcaggccttggcacttcacaacctgggaagggaggctgaaagccaagaagcactgaagaatggcactgccttggaagctgcaatgaatagtagagctagaactgtatagccctgaatttgtgataccctgtcctgcttgtacctagatcgcctccctccaatgcttcgtcaccagtaggggctgtttttggtattccctaacttgtatcggtatttcccctagtttcacaagtcgaaaaaactcctaggggctagtttggatactttgggattagagtgttttgaagggattggag

SEQ ID NO: 31155 - DNA, 425 bp, Zea mays
  Clone ID: LIB3059-020-Q1-K1-G10
cccacgcgtccgattttatctaggaaaaaaggtgacaaaaggtaaaggagaatcagctgaagcagttcttcccagcaaggacgatctgaggaagaccattactgaaatcctcaagaaagttgacttcaacacggcaactttcagtgacattcttaagaagctcggtaagattttgagacatgttttactgattttcagtcgttcatgctagatgcactaacaaactttatcttgtagacaatcactacaaaatggatctgaccccaaagaaagaagccatcaaagttatgatccaagacgagttaaccaagctatcagaggaggatgaagaaggagagggagacgaagacaccgggaagaaacagcagcagcctcaggcgcaggagatcgaggcatgaggatccgcggaaccccgtagctgtagt

SEQ ID NO: 31156 - DNA, 336 bp, Zea mays
  Clone ID: LIB3059-020-Q1-K1-G11
gggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggccc

SEQ ID NO: 31157 - DNA, 409 bp, Zea mays
  unsure at all n locations
  Clone ID: LIB3059-020-Q1-K1-G12
caaattacaaggcagtgcagtcactttcactcactacgctaaactatgagagagcttccatcttgctacaatacttcaagggatgtggtgaagttcttgtgccacggaaggtttcccagcaggaacatattcttccttcttggtcaaactggaggaaactgaacagaattaaactgccacatgagcgtgtgcacttgggtgctaaagcctcgatgcttacacacagtgacatgttggtgattgcaaaaacaagatgccactatgaaaacgcgaactactttntgctggataaacaaggcatcgtttacgttttcatccacaaggaggcaacaccagccgatgttntaaggtccttcgtacacgggctcgtgctagctagctcgacacagaacagcaaacctcagcactt

SEQ ID NO: 31158 - DNA, 363 bp, Zea mays
  Clone ID: LIB3059-020-Q1-K1-G2
ccctctccgaaatcaaggtagcgtacaccgctgcagtttctagagccctctctgccacgcgtgatcccactagtcacaatgcctgccctcgccaagcccgcctcccgcaccgccaagcccgccgcggctccgaagccgaagcctgccgccgccaagccgaaggcggccaccgctggtgcctcccacccgccttacttcgagatgatcaaggaggctatcacggcgctcaaggagaggaccggctccagctcgcaagcgatcgccaagtatgtgggggacaagcacggcgcgtctctgccggccaacttcaagaagatgctttccatccagctccgtgggtccgcagccaagggcaagctcgtg

SEQ ID NO: 31159 - DNA, 441 bp, Zea mays
  unsure at all n locations
  Clone ID: LIB3059-020-Q1-K1-G3
ggatctggcgtcgcccgggccggacggttgaccgctccaccgcggagcacctgttcgaggtgatcaactccagggaggacgtgctcaggcgcctcatccgccgctgcgcctacctcaagtacgtcgaggcgcggctcggagaccgcacgctgtatgccgacgagatactcaaggacggcttctgcctgaacatgatcgagacgccgctctgccctctcaaggtcgtcactaacctgcnagaggccgtctgggatgccgacatcgtcgtgaatggggtgccgtccaccgagacgagggaggtgtttgatgagatcagcgagtattggaaggagaggatcagtgtcccggtgataatttccctcgccaagggaattgaggcctcgttggatccaatacctcgtatcattacacctactcaaatgattagctctgcaactggag

SEQ ID NO: 31160 - DNA, 351 bp, Zea mays
  Clone ID: LIB3059-020-Q1-K1-G5
cccacgcgtccgcggacgcgtgggttgaagaggatgacaaggctgctattgctgaagtgcagagggcaacgaagaagaagcaatgccctgaaaatggtgatgagtctcaacttcaacttgctgtaagaaattcacctactgaatccttggaaagtgaagatgaagatggtttccctgtatcattttctgaatcaaagaagagttctgagattatttcaaacaagaatgtgggaaaagacaaggagactagcaacaaagacctgaaaagaaaaagtggacccatagcgaccgtggtgaatcttcaaggggggtaaaagctgaaaatgaatgggcattcaaggaaaaggaaaa

SEQ ID NO: 31161 - DNA, 410 bp, Zea mays
  unsure at all n locations
  Clone ID: LIB3059-020-Q1-K1-G7
atcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatgttccagccgctccggcaacagtgctgccagcagcagatgaggatgatggacgtgcagtccgtcgcgcagcagctgcagatgatgatgcagctngagcgtgccgctgccgncagcagcagcctgtacgagccagctctgatgcagcagcagcagca

SEQ ID NO: 31162 - DNA, 435 bp, Zea mays
  Clone ID: LIB3059-020-Q1-K1-G8
gtgcgcacctccgagatctccacgaagttgtggtaacatggggctcaccttcacgaagctcttcagccggctcttctccaagaaagagatgaggatccttatggttggtctcgatgcagctggtaagaccaccatcctctacaagctcaagctcggagaaatcgtgaccaccatccctacaatcgggtttaatgtggagactgttgaatacaagaacattagcttcactgtctgggatgttggaggtcaggacaagatcaggccattgtggaggcactatttccagaacacccaaggccttatctttgttgttgatagcaatgacagagatcgtgttgttgaagcaaaggatgagctccacaggatgctgaacgaggatgaattgagggatgctgtcttgctcgttttcgcaaacaagcaagatctaccaaatgc

SEQ ID NO: 31163 - DNA, 438 bp, Zea mays
  Clone ID: LIB3059-020-Q1-K1-F4
cggggttcggtttcgtgggtgagcggatcgagatggctgcgtcggatgttgagtaccggtgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggcggcggctacggcggtggcggcggctacggtggcggcggcggctacggtggtggtggcggcg

SEQ ID NO: 31164 - DNA, 421 bp, Zea mays
  Clone ID: LIB3059-020-Q1-K1-E12
gccgcagctcggatcttatgacggcatattcttcgacacgtacggggaatactacgaggacatgagagagttccaccagcaccttcctaagctactgaagcccggaggcatctactcgtacttcaacggcctctgcggcgacaacgcgttcttccacgccgtgtattgccagctcgtggcgctggagctcgcgaaccttgggtactcgacgcagttcatccctctgccggtcaaagattgcctggcggaggaggtctggaagggcgtgaagcggaagtactggcaactggacacctactacctccctgcttgccagtcagaatcagaatctaccatcagttagtgatgagttatttctagtctgcgtctgaagttggttgtagctaagtacatttttgttcagacatgctgtgttatgaat

SEQ ID NO: 31165 - DNA, 446 bp, Zea mays
  Clone ID: LIB3059-020-Q1-K1-E2
cccacgcgtccgcccggttccgcgtgcctttccccacctactctcgcggctctcgccagccagtctagggtttcggtcccggcgtgcttatccgcccccgccggccatgtcgaagcaaggagggaaggccaagccgctgaaggcgcccaaggccgacaagaaggagtacgacgagacggatcttgcatatctgcagaagaagaaagatgaggaaaaagcactgaaggagcttaaggccaaggcacagaagggcgcgattgggggctcgggtctgaagaaaagtggaaagaaatgagactggtcacccgtctccaatacctagaggatgataaggcagctgtctatctgtgttgcgcttcactaagtgtgattgtaacagtggtacctcttgtgttctgtgttccgcgatgttgcagttgggtgcttgatcgaaagatgtttcaacc

SEQ ID NO: 31166 - DNA, 434 bp, Zea mays
  Clone ID: LIB3059-020-Q1-K1-E3
ggtcatcagagcccgcttgcaggttttacttttgaaactttctaagttttcatgtccatgcttattttggaattttaatctcttctgagttttgattatttataactcttatgtgtggttttccagcaacggcctggcactgatggtactccaaagtactcaaatagctggcatgtagtgaaggaaactgcaaagtatgaaggcgtccgtggattttacaggggcatcacgtccaatctactgaaaaaccttccagctgcgtccctcacgttcgtggtgtatgaaaatgttatcaaactattcaaagcaaccaaggagaagacgtagctactcattaaatccaggagtactatgcatggtctgacatttctgagttcaaacgatgcctataatttccattccacgtcaagcccatattttatccatttaacatc

SEQ ID NO: 31167 - DNA, 443 bp, Zea mays
  Clone ID: LIB3059-020-Q1-K1-E4
cccacgcgtccggtgggcttgagctgcgtgctcgagctcacgttgttttagcaaagtgccatttatccgatctgaaattctcagttctcgaagatcctgaagctgttttggatcctctgaaccaagccactgaagacctgcaagcattggagtaccacgagatggcagcagaggcgtactatctgaaggcaatggcatacaaccatctcggcaagcttgatgagagggaggaagccgcggctcgtttcaaggatcacgtcactgcccttgagaccccgcataacgaagaggactcgcttaagtactgagacccaagaccatttgttattggcaagcacgccccactgccagagactaaagagggcgtggtggccttctggacccgcatggtggcactggcaggctacaatgctacactgaggcgaatggcgtttgctgccatg

SEQ ID NO: 31168 - DNA, 349 bp, Zea mays
  Clone ID: LIB3059-020-Q1-K1-E5
cccacgcgtccgcacacaaagagctcagtcataggacgcccttgaaagctgaagctggaggctctatagaacagtttgtacagtgcggcagcagtctctactatggtatgtgccaataagaggaactccgttccagagtttcgtctactgccaagggcctcgtgtttgtgggtgggttgaataaacacgcaatttgagatgacgctgttttgaccatgaatttagattgaacgcacaacggcaaaaaggattttatgtgaagttgtcgatgggttgaaaaagatgtgaccatctctgacggtctgacctgcttcattcatgaggaattgaggataaagcacatttgaac

SEQ ID NO: 31169 - DNA, 435 bp, Zea mays
  Clone ID: LIB3059-020-Q1-K1-E6
cagaaacacaccaagcgaagcacattatcaacaacctaacaacaatggctaccaagatggtatccctccttgcgcttcttgcgctttttgcgagcgcaacaaatgcgttcattattccacaatgctcacttgctccaagttccattattacacagttcctcccaccagttacttcaatgggcttcgaacacccagctgtgcaagcctataggctacaacaagcaattgcggcgagcgtcttacaacaaccaatttcccagttgcaacaacaatccttggcacatctaacaatacaaaccatcgcaacgcaacagcaacaacaattcctaccagcactgagccacctagccatggtgaaccctgccgcctacttgcaacagcagttgcttgcatcaaacccacttgctctggcaaacgtagttgcaaaccagccac

SEQ ID NO: 31170 - DNA, 392 bp, Zea mays
  Clone ID: LIB3059-020-Q1-K1-E9
ttgttggagccatttgctatagcgctcatgagttatatactcaacaacgacgtcatttggatgatgttcgggcagcgctaaaactactagccttcatgaacagagtcttatacctacaacagcaacaactgatttaatataaccactatagaagagggtaatgcacctacataccatgcaacaacaattgctgcaacagattgtaccagctctgactcagctagctgtggcaaaccctgctgcctacttgcaacagctgcttccattcaaccaactgactgtgtcgaactctgctgcgtacctacaacagcgacaacagttacttaatccactagcagtgcctaacccattggtcactgccttcctacagcagcaacaattgctaccataca

SEQ ID NO: 31171 - DNA, 422 bp, Zea mays
  Clone ID: LIB3059-020-Q1-K1-F1
gcttcttcggccggcgacatggcggagaagggcgcgttgcagtcggcgagggagtgggtggtcgaccacgagctccgggccgtcgggacgctgtggctcagcggcatcgtcggctccatcgcctacaactggtccaggccgggcatgaagaccagcgtcaagatcatccacgccaggctgcatgctcaggctctcacgctggctgccttggctgggtccgcgctggtggagtactacgaccaccagcaagggtcaggatcgaaagttcaccaatatgcaaagcagttcctttcatctgatagcaatagcggccaacaaaaggagtagctagccagtgtccttgcgaaatgcaagcagcggagtgggcgttatttcctgatcaaatattttgcctatggcacattctgtggaaactttgacgg

SEQ ID NO: 31172 - DNA, 420 bp, Zea mays
  Clone ID: LIB3059-020-Q1-K1-F11
cccacgcgtccgcccacgcgtccgcaattgcccaattgcaacaacaatccttggcacatctaaccctacaaaccattgcaacgcaacaacaacaacaacagtttctgccatcactgagccacctagccgtggtgaaccctgtcacctacttgcaacagcagctgcttgcatccaacccacttgctctggcgaacgtagctgcataccagcaacaacaacagctgcaacagtttatgccagtgctcagtcaactagccatggtgaaccctgccgtctacctacaactactttcatctagcccgctcgcggtgggcaatgcacctacgtacctacaacaacagttgctgcaacaaattgtaccagctctgactcagctagctgtggcaaaccctgctgcctattacaacagttgcttccatt

SEQ ID NO: 31173 - DNA, 425 bp, Zea mays
  Clone ID: LIB3059-020-Q1-K1-F12
gcaacatagaaagcacaatagtgtaccaacaatggcagccaaaatattttgcctccttatgctccttggtctttctgcaagtgctgctaccgcgaccattttcccgcaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgctgcttatttgc

SEQ ID NO: 31174 - DNA, 431 bp, Zea mays
  Clone ID: LIB3059-020-Q1-K1-F3
cgggtctggaactggtaccaccacaacatcgggcgcgcggcgatcctgctggccatcggcaacatcttgctgggcctctcgatcgcgcaggagaccagcgcctacatcgtctcctacggcgtgttcgtcgccgtctgggtgctcgccgtcgccgccttcgagatgaagcgctgctacgccgacgacgactgatgagctagcgacacgtaagagtcacagttcggtcccaacagctgacggcgaagtttggtgtcgttaaactgagcgttccacggccagctgggacgtgacagacacacgagcgccgagcgcgcgcgcgcgcacacacacaccattcttgttgttccgtagctcgcagctggacagtgcattattggttcgaggagggcgtgctttggttggctaattaaaaaaaaaatgttttttttttt

SEQ ID NO: 31175 - DNA, 421 bp, Zea mays
  Clone ID: LIB3059-020-Q1-K1-E11
cccacgcgtccgcccacgcgtccgtccatccgccgagggtggtgaggacgaaagcgttgatgacacagctgtgaaggtggttgatattgttgacacattccgtctacaggagcaacctccttttgacaagaaatcatttgtgtcttacatcaaaaaatacatcaagaatctcactgctgtgttggagccagagaaagcggatgagttcaaaaagggtgtcgagggtgcaaccaagtttctccttagcaagctgaaggacctccaattttttgttggtgagtccatgaaggatgatgcgtctgtggtattcgcctattacaaggatggtgccactaatccgacattcctctatttctctcatggtctttaaggagatcaagtgctaggcgtgcggcgaaattagttacccatgttgggtact

SEQ ID NO: 31176 - DNA, 397 bp, Zea mays
  Clone ID: LIB3059-042-Q1-K1-H9
cttggtcaaaggaccaggatttgccaagtccaaccagtcgcagttgctccggacagggtcgagagccgaaaggctctgccagagaagtggaggggcatgagagacgacgaactttcagcagaaaccggcatccctggctgtgtgtttgtccacatgagtggcttcattgggggcaacatgacctacgagggagcattggaaatggcgagagctgctctgaaattctgattcaaccaaagcatattacccgtgttaccattatatcagtaaacacatcagtaacacatgatgcagttgcgctttctccaatgttatcgctgactcgagccgtggctaactgcgactgattcttgcactgatcttctgttatcctcgtcttacagaagaggtcgattga

SEQ ID NO: 31177 - DNA, 398 bp, Zea mays
  Clone ID: LIB3059-043-Q1-K1-A10
attttgagcattcagaaacacaccaagcgaagctacctagcaacgacttaacaacaggggctaccaagatattagccctccttgcgcttcttgccctttttgtgagcgcaacaaatgcgttcattattccacaatgctcacttgctcctagtgccattataccacagttcctccgaccagttacttcaatgggcttcgaacacctagctgtgcaagcctacaagctacaacaagcgcttgcggcgagcgtcttacaacaaccaattaaccaattgcaacaacaatccttggcacatctaaccatacaaaccatcgcatcacaacagcaacaacagttcctaccagcactgagccaactagatgtggtgaaccctgtcgcctacttgcaacagcaggtg

SEQ ID NO: 31178 - DNA, 411 bp, Zea mays
  Clone ID: LIB3059-043-Q1-K1-A12
ggaaactctatgaatatcaagagaaccataaaaggatatatcaatgctggttttgctggaattatgcttgaggatcaggtggcacctaaagcatgtggacatactgaaggaaggaaagtcatatcaagggaggaagctgtcatgcacataaaagctgctgtagatgctaggaaagagagtggctctgacattgttattgtagcaaggacagattctcgccaagctatttctcatgatgaagcattatggagggtgaaagcatttgctgatgctggagcagatgttctatttattgatgcccttgcttcagtagaagagatgaaagcattttgtgcggttgcaccataagttccaaagatggcaaacatgttagaaggtggtggtaaaactcccatattgagccctgctgaa

SEQ ID NO: 31179 - DNA, 159 bp, Zea mays
  unsure at all n locations
  Clone ID: LIB3059-043-Q1-K1-A2
gcggcacaactctctcgcaggcttctctcccctctgcgcccttcccgcagcacccctgctcgcatcggctctctccacaggactgctccgngcgcgccgaccccatcgccggcaaggcggcggtgctgctgcatattctcccgtcccccctccggagcc

SEQ ID NO: 31180 - DNA, 377 bp, Zea mays
  Clone ID: LIB3059-043-Q1-K1-A4
cggacgcgtgggtcaaaccataagctttatctactcaaaaccgcaaaagaacccgagggagaccttgagggtgttgctcgttgccctcgctctcctggctctcgctgcgagcgccacctccacgcatacaagcggcagctgcggctgccagccaccgtcgtcggttcatctaccgtcgtcggtgcatctgccacctgcggttcacctgccacctactgtgcatctgccaccgtcggtccacctgccgccgccggtccacctgccaccgacggtccatgtgccgacgccggttcatctgccgtcgacaccatgccactaccctactcaaccgtcccggcctcagcctcatccccagccacacccatgcccgtgccaac

SEQ ID NO: 31181 - DNA, 391 bp, Zea mays
  Clone ID: LIB3059-043-Q1-K1-A5
cgacccacgcgttcgtgcatggctgtattcaatcagcatcatgttgatggccttgatttgacggtgaatccgcttttgtacatgatgaagtgctatccgggtgtgccggagcagaagttgagggcacatctgggttcgtttggtgtttcgggaagccttgccctccaatctatgtacactttatcaggtggtcagaagagtagggttgcattcgcgaaaataaccttcaagaagccgcacatcattctccttgacgagccttctaaccatcttgatctggacgctgttgaggcgctcatccaaggtttactcatttttcagggaagggtgctgatggtgagtcacgatgagcatcttatcactggaagcgtggacgagctttgggtggtgt

SEQ ID NO: 31182 - DNA, 393 bp, Zea mays
  Clone ID: LIB3059-043-Q1-K1-A6
ctcttgtttgttttttttttttttttttttttttgtttttttttttctttttctggagatgtaacttctaatttctggttggccacatacatgatccaaaaaactttattattgaattacaactaataagcaatctaaaagagggccccaccaatgatgtgtcgttggtaggaggccgctgggatctgtcaaagcaagttggacaaagggcaacaattgttgtaacttgtaagagggttgcggggttagccgcaaactgctgttagaaaggcatcaactgtctctgtgtcaagaaagaaacacggtttgctgcagctagcttgctaaatggcaataagatttgctgctgcaaataagcagccgggttcagtgcggccaattggttaaatggaa

SEQ ID NO: 31183 - DNA, 404 bp, Zea mays
  Clone ID: LIB3059-043-Q1-K1-A7
gtgcgtcagcattcaaaaacacaccaagcgaagcgcactatcatcgggctgacaccaatggctaccaagatattagccctacttgcgcttcttgcccttttagtgagcgcatcaaatgcgttcattattccacagtgctcacttgctcctagtgccagtattccacagttcctcccaccagttacttcaatgggcttcgaacatccagccgtgcaagcctacaggctacaactagcgcttgctgcgagcgccttacaacaaccaattgcccaattgcaacaacaatccttggcacatctaaccctacaaaccattgcaacgcaacaacaacaacgacagtttctgacatcactgagccacctatccgtggtgaaccctgtcacctacttgcaacagcagctgct

SEQ ID NO: 31184 - DNA, 449 bp, Zea mays
  Clone ID: LIB3059-043-Q1-K1-A8
ctccaaccagggaattggcgacacaaattcaagatgaagcaatcaagtctggcagatgttcaagaatatcttctacttgcttatatggaggtgctccaaaaggccctcagctaacacagttggagcgtggtgctgacatagttgtcgcaactcctgggagattaaatgacattttggaaatgaatagagtgagcctgcaccaagtatcatatcttgtccttgatgaagccgaccgtatgcttgatatgggatttgagccacacataacgaaaattgtgaaacaaataccaccgaaacggcaaactcttatgtatactgccacatggccaacagaggctagaacaatagcgtctgatttactggctaacccagttcaagttaacattggaaacactgatcaactagctgcaaataagtcaattacacagcatgtggaacgtatcccacat

SEQ ID NO: 31185 - DNA, 414 bp, Zea mays
  Clone ID: LIB3059-043-Q1-K1-A9
cggacgcgtccgcccacgcgtccgcggtcgcgtgggaaattttggggagccagattgagctatactgacttttgacaaggcgttagctatgaagcctgactacaccgacgcaaaagctgaccgtgaaactgctgctcgcctagtcaagaaacgaggacagctgcatacgtcaggtttaagtgctaacaaaagacgcttcacagttggggagtacccaaaggagggaggtgcagagggtgaagaaaaagggaaagaaacagccgagcaactccaaaagatcacccatgaaaattagctaaattaactgattttgatactgtgtaaaatagatattacaaaaaaatattacattagtgttggtcacctgctttaattcgtaaagggaaccataacacggcaatacaattaacgata

SEQ ID NO: 31186 - DNA, 416 bp, Zea mays
  Clone ID: LIB3059-043-Q1-K1-B11
gaccaacaagcaacatagaaagtggaatccagtagcaacaacagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttcc

SEQ ID NO: 31187 - DNA, 393 bp, Zea mays
  Clone ID: LIB3059-043-Q1-K1-B12
gccgtcttcctagacttggatttctcatttcttgagatgaatccgttcaccatggtggatggggagccatatcctctggacatgagaggagaactagatgacacagcagctttcaagaacttcaagaagtggggaggtatagaatttcctctaccttttggaagagtactcagccctacagaaagtttcatccatgaactagatgagaagacaagtgcctctctgaagttcacggttttgaacccgaaaggtcgcatctggaccatggtcgctggtggtggtgctagtgtcatttatgctgatacagttggagacttgggatatgcatcagagcttggaaactatgcagagtatagtggtgctcctaatgaagaagaagttctgaattattct

SEQ ID NO: 31188 - DNA, 413 bp, Zea mays
  Clone ID: LIB3059-042-Q1-K1-H7
gcacttcaaaaccagccaattgttaatgctgtcattgatggcgatgacatcatatacggagactacgtagacgtcagtgttgctgttggcacttccaagggccttgtggtgcctgttatccgagatgctgataccatgaactttgctgacattgagaaagggataaacaaccttgcaaagaaggcaaatgagggggcgctctcgattgatgacatggcaggaggaacattcactatctccaatggtggtgtctatggaagcctcctcagcacacctatcatcaaccgcccacagtcgtcaattctggggatgcattccattgtgcaacgccctgtggttgtgaatggtgacattctcgcaaggccaatgatgttccttgcgctgacatatgaccacaggctgatcgatggcag

SEQ ID NO: 31189 - DNA, 293 bp, Zea mays
  Clone ID: LIB3059-042-Q1-K1-G10
aaaaaattaatcaccaaattataataaaacacaaataaagtcgtattatctactaactcaacaccttaatcatacaaccactaactttcacatcacatcattactaaatctctttaaaacataccacacttttaattcctctaaccaacattataacatcctctactatacaacacactcatctaacatacctctaactattacacactcatacttctttatatccataatccttcctaccacaataactcctaaacataattacactcctaaaaacattagaacctcatata

SEQ ID NO: 31190 - DNA, 434 bp, Zea mays
  Clone ID: LIB3059-042-Q1-K1-G4
gtaatgctggcttctaccggtgaaggaaaccaaccaggggccttggaacaattcttcggggatggctatgataagcagaccgaggattttcaaccattatgcaccataggtcctggattttctgagcaacagcttgaagaacgttctgcgagccttcgaagtaaagtgatagaaaaaccaaaggcatactatagatttggcgacacaatgaaccccgatgtgtggtttgagccatcagaggtctgggaggtcaaagctgccgatctgagcataagccctgtacatcgtgctgccaatggtatagtcgatccaaataaggtctgtagttcttttttgcattgccattcctccccatctcgattgtatacttctggtatagtatgttggaaggctaatgctgaaatcgaaccaaggtatctctctaagattccctc

SEQ ID NO: 31191 - DNA, 427 bp, Zea mays
  unsure at all n locations
  Clone ID: LIB3059-042-Q1-K1-G5
caggcgctgctgaaggcatggctgaagagaggaaggtatatgcttctgcagcggcatgggtcaccacagcaaggtcgtctcaggctacctctttgcctaacgactcggatgagaacgagtgcgtctgggacgcttcgctccatgcgagtggcaatgttagccctcatagtagtattgacagcatgggtgtcgtcactgctatgagcactgtcaacagctgcacgagcacatatacaagcgcgaccatagctggtgaagcaatgctcaatgctgagaggaactgtgagagtgtcaagggtattcgaagtgacttactagaaagcgcactagctagcatgagtccagcaagtgatagcactggtgatagtgatgacagcagctggtaccacatcactggacgtgccagtangcctcacagggggaatga

SEQ ID NO: 31192 - DNA, 357 bp, Zea mays
  Clone ID: LIB3059-042-Q1-K1-G6
cacactcttccgctagcatcattgaatttacaaatgtataccatcattcacaggcatgatataccacatcattatcctcttaggctacctctcaacctcagcaatcgtatcaaaactactacatctctcacactctcctatatcctactttcaatcttaatacctcataataacattgacattctgtgtgtcaacactcatatgatcactcttacaagctccaacaagcacatctaaaatcgcatcttataattatcaaaccagttctcaaagcatccattaactctattactataaatacctttcgaccatacttactatcaaatcatcaagctaccacaactacaacaacttata

SEQ ID NO: 31193 - DNA, 429 bp, Zea mays
  unsure at all n locations
  Clone ID: LIB3059-042-Q1-K1-G7
aacacacctagcgaagcgcactagcaacgacctaacaacaatggctaccaagagattgtccctctttgcgcttcttgccctttttgtgagcgcaacaaatgcgttcattattccacaatgctcacttgctcctagtgccattattccacagttcctccctccagttacttcaatgggcttcgaacacccagctgtgcaagcctacaggctacaacaagcgcttgcggcgagcgtcttacaacaaccaattgcccaattacaacaacaatccttggcacatctaaccatacaaaccatcgcaacgcaacagcaacaacaatttctaccagcactgagccaactagctgtggtgaaccctgtcgnctacttggcacagcagttgcttgcatccaacccacttgcttttgcanacatagttgcataccaaca

SEQ ID NO: 31194 - DNA, 410 bp, Zea mays
  Clone ID: LIB3059-042-Q1-K1-G9
tcttcaaaagaatcaaaatcacctgattattgttaaccggtttaagggcctgaagttccttcctaagttggaaaaggctccaaattctagggttgtcgactctggtgtcctgaggggaatgaatttagaagacatcaggaaagctggggagcggcttattcttcagggtggctgtaaaaatttctttcagaagattgtaaaaacaagggagatcctcaatttggatatccatattctttcctactgctggtgtgcagagcttataagatccgccttctcatcagccggttgtctagatggtctgaacatacatgcgaacgagttcgcctttgaggaatctgtttcaaccggtgagattgacagaaagatccagtccccgctagacaaggttgagaagttcaagagcatca

SEQ ID NO: 31195 - DNA, 373 bp, Zea mays
  unsure at all n locations
  Clone ID: LIB3059-042-Q1-K1-H1
cgctgctcctggtcctggcggcggcgctgtccatgtccgtgtccgcggccaggctggggctggccgtatgcgccgtggcgctggcggccgtggcggccgtcaacgcacacgacctcgccgcgcacctggctggcgtcgactgccgcgtgggactggcgaggtacgatgcccagctcgggctcgtggagttcctcgtgccggccgtgcacgcagccgggtgcgcgctcgccgccgccggcctggcgctgctggcctncccccactcccactcccagtcccagcagcggcacgcggcgaccatgctgctcgtcgcggcgctgctgtgggtgctgggctccgtgctcaactcctgccaggtgtacgagcgcgccga

SEQ ID NO: 31196 - DNA, 423 bp, Zea mays
  unsure at all n locations
  Clone ID: LIB3059-042-Q1-K1-H11
cgggggtcagtcttgaaggtcacncggttggatcatttgggctcttgctcccaccaggacgacctctggtgggaggcatcaggcatggagtcgcgggtgttgtcgggagttgggttttgcctcctatacagcataaatgaattatattgctttacctgttggtagaaagaaccttgaaagatagggaacgtgtcgttttttgtcaaagcggttcctgtgctgtataacatgttgcatgagtattggcgcaacttataagacaatgtcaaatgggtttttgggagtcccattctggtttcttgagtcttcttcattggtctattgtgtaacatgtacacaggtttgtggttcgtcttgtcttgtctgttgtatttgccaccgttgtctggaagttgttgcatgcttatctagaacagcagtata

SEQ ID NO: 31197 - DNA, 255 bp, Zea mays
  Clone ID: LIB3059-042-Q1-K1-H4
caaggttattggtaattttggccttgttgaaccagaaggcctccagtgggcctgtggttttgttgccattaatgtgaatcctttgagttgcccacatcttatagtcgtttatgcttcattggcatggcatatccatccaaattccaaaataatgttctgatactatgttttactgtgtatgcccatgaaccattgatggataaaaaaaaacaaaagtaaaacgtatacagcaacagaaaaaaatgcctaaccatc

SEQ ID NO: 31198 - DNA, 377 bp, Zea mays
  Clone ID: LIB3059-042-Q1-K1-H5
caaatgatgaggttgagagaatattagctgacctgggacatggtgcctgcctggacagaagttcagcccaaaacagcaaagcgaagaagggagaccaaaatcacatcagaggtatcaccaccacggctgctccatctggatctttggatcccactgcttccaactgcataaaagaagcagaagaaaatgagcttgaatttgccttggcagatttcttaggacggatccatagaaattgcaacaataatggggagttatgtacggagatgaaagccctaatccaaacaaagattgcagagctagataatcctccgtgcacatttgcttatgagcagcaaacttcacggggtgacgaatatgatactgctggtggcaaa

SEQ ID NO: 31199 - DNA, 427 bp, Zea mays
  Clone ID: LIB3059-042-Q1-K1-H6
gacccacgcgtccgcggacgcgtgggtggaacctgtggagaagtgcttgcgcgacgccaagatggaggagagcagcgtgcacgacgtcgtgctcgtcggtggctccacccgcatccccaaggtgcagcagctgctgcaggacttcttcaacggaaaggaattgtgcaagagcatcaaccccgacgaggctgtggcgtacggcgccgctgtccaggctgccatcctcagcggcgagggcaacgaaaaggtacaagatctgctcctgctcgacgtcacgccactgtctctcggcctggagactgcaagtggcgtcatgactgtgctgatcccgacgaacaccaccatcccgaccaagaaggagcatgtcttctccacgtactccgacaaccagccgggcgtcctgatccaggtgtacgagggtgagcgc

SEQ ID NO: 31200 - DNA, 368 bp, Zea mays
  unsure at all n locations
  Clone ID: LIB3059-042-Q1-K1-G1
gggacccttggggaacttttggttggttttggggggaaggagagagagagagaccgggagggagatctagtagagaggctagtaggtggtcctcgaacgaagatgttggcggtgttcagcgggcacgtggtggaggtgccggcggagctggtggcgagcggcaaccggacgccgtcgcccaagacgaaagcgtcgcagctggtggggcgctttctggccgcgtccgagccggtcgtgtccgtgcagctcggcgaccacggncacctcgcctactcccacaccaaccaggcgctcctccggcccaggtcgttcgcggccaatgacgaagtgttctgcctgttcgaaggggtgctggacaacctgggtcg

SEQ ID NO: 31201 - DNA, 317 bp, Zea mays
  Clone ID: LIB3059-042-Q1-K1-E4
ttgtgatttaagtttggccaggggccttgattactacactggtggcatatattaagccggtgtgaaaggtgccacttaaggtggcttccttaccggttgttggtcgtgccaacaaccttgtgggtttgttaagtgggaagcaaatccctgctgttggtgtgagccttggaattgaaagagtctttgcaatcatggagcagcaggagaaagaaagaaatgagaagatccggcctacaaagacagaggtgctggtgtcaattcttggaaaggaccttaccctaactgccgagctcgtgagcgagctgtggaatgcttgg

SEQ ID NO: 31202 - DNA, 318 bp, Zea mays
  Clone ID: LIB3059-042-Q1-K1-E5
attggagcaacaatggcgaccgagatgttttccctccttatgctccttgctctttctgcatgtgttgctaacgcgacaattttccctcaatgctcacaagctcctatagctgcccttctttccccataccttgcatcaatgatagcttcagtatgtgaaaacccagctcttcaaccctataggctacaacaagcaatcgcagctagcaacatacctttatcacccttgtttcaacaatcgccagccctatctttggtgcagtcattggtacaaaccatcagggcacatcagctgcaacgactcgtgctacctgtgatc

SEQ ID NO: 31203 - DNA, 422 bp, Zea mays
  unsure at all n locations
  Clone ID: LIB3059-042-Q1-K1-E6
cccacgcgtccgcaccaacgcaaattgcaccaagaaatccatcgagaggccgtcgacaggggaattaatggcgtcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgnctagaggacctgccgggcttgccgcgggaggtgc

SEQ ID NO: 31204 - DNA, 429 bp, Zea mays
  Clone ID: LIB3059-042-Q1-K1-E8
gcccgcaccatccacatctcgcttgtccccgacgaggagatcggcggcgcggatggggtcgacaagttcgcccgatcggaggagttccgcgccctcaacatcgggtttatgctcgacgaggggcaggcgtcgccgacggacgtgttcagagtcttttacgcggacaggctggtgtggaggctcgtcgtgaaggcggcgggggcgccagggcatgggtcgaggatgttggacggcgccgccgttgacaatttgatggattgcgtggagaccatcgctgcgttcagggatgcgcagttcaggatggtgaagtccggggagaagggtcctggggaggtggtctcagtcaaccctgtgtacatgaaggccggcataccaagccccacgggtttcgtgatgaacatgcaaccttcagaagcggaggtcggcttt

SEQ ID NO: 31205 - DNA, 394 bp, Zea mays
  Clone ID: LIB3059-042-Q1-K1-E9
ccttggttagacccacctgcctccttaaaagccccattatggtcccaccatgggtggccaaataatttggcctcctaatcctcctgggcctttctgcaagtcctgctacaacaaccattttcccgcaatgctcacaagctcctatagcttctcttcttcccccatacctctcaccagcgttgtcttcagtatgtgaaaacccaattcttcaaccctacaggatccaacaggcaatcacagcaggcatcttacctttatcacccttgttcctccaacaatcatcagccctattacatcaattacctttggtgcatttattggcacaaaacatcagggcacaacaactacaacaactcgtgctagcaaaccttgctgcctacgctcagcaacagca

SEQ ID NO: 31206 - DNA, 262 bp, Zea mays
  Clone ID: LIB3059-042-Q1-K1-F1
cccacgcgttcgaaaaaaaaaaaaaaatataaaaaaataaaggaaataaataaaataaagaaagaatataaaacataaaaaaaaaaatggctgccatttttcaggatccaagtttaactacccttgattgcaaagtactaactcttcataatcgtaccctaaattaacttcactgcccgtcatttaacaacttcgggactgagaaaaccttggcgtttccaaaattaatctccttgcagtaaatccccctttctccatatgg

SEQ ID NO: 31207 - DNA, 290 bp, Zea mays
  Clone ID: LIB3059-042-Q1-K1-F2
cccacgcgtcccgccaagccttccgccaagccttccgccaagccttcccaacccttaaggtttggcccccaaaacccaaattttcttccattaattacttgagcccttgacccccaccgaacccggtacaaagccaagaacggggctgctgggcgcaaggctggcggccccaggaagaagtcggtgtcgcggtccctcaaagcccggctgcagttccccgttggccggatcgggcgctacctcaagaagggccggtacgcccaacgcgtgggcaccggcgcccccgtcta

SEQ ID NO: 31208 - DNA, 390 bp, Zea mays
  Clone ID: LIB3059-042-Q1-K1-F3
cccacgcgttcgcagatagcgagcgacagacaggggaacaaaaaggaagggccatgaagaccgggagcccatacgcaagaactgaagctttgacgcgcaaccccaaaacttgcgcgcgcccttttccctccgcggcgtcatcctggaacgctctccgatccaagatgtataagctgggaagaggaaaccgcgacaaggtgcagcagttcatgaccattaccggcgccagtgagaaggttgcccttcaggcactgaaagctagtgattggcacttggaaggagcttttgacttcttctatagccaacctcaagtttctgtggtcaatacgtcgcatcttgaagatattttcaacagatataaagaacctgatgctgatatgataatggtgg

SEQ ID NO: 31209 - DNA, 218 bp, Zea mays
  Clone ID: LIB3059-042-Q1-K1-F4
cggaaagcacccgtgagtactttaggtacccagagcctttgacacttggggctgttcttcgaatctaatttcagctgttgcatggttgttgcccttaagttccggttttccctttttaacaagtggccgtaaggttcatttttttgaatttaaaaaaattgctaaaggccggaattattatggtttttaactggaaaattaaccttaccttaaaaagg

SEQ ID NO: 31210 - DNA, 394 bp, Zea mays
  Clone ID: LIB3059-042-Q1-K1-F5
ggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacagcggtggcgggcgccgtgatggcggcggcggctacggcggtggcggcggctacggtggcggcggcggctacggtggtggtggcggcggctacggcggtggcaaccgtggcggcggctacggcaactccgacgggaactggaggaactgagcggtggtgcccgcgcggccaagttatcctgttcgctgccgtgatgtttaccct

SEQ ID NO: 31211 - DNA, 440 bp, Zea mays
  Clone ID: LIB3059-042-Q1-K1-F7
cccacgcgtccgcccacgcgtccgaccacgcgtccgcaaaagaaaaaagaaaggttatgggaaaataaaaaaaaaaaaaaaaagaaaaaaaaaaaaatgaaaaaataaaactataaaacaaaaaaagaaaaaattaaaaataaaaaaaatacgacagaaaaaaaaaaaaaaaaaaaaaaaaaaaaaccaaataattaaaaaattactacaaaataaattaatccaaaaaaaattagataacaatttaaaattaaaaataaaagaaaataaaatgaaattttaaatttaaaatttctataacaaagaataaaaaaaaattttaattaatctaaagactaaaaaaccgggttacctaataaaaaaaaacgtaaaaataaaaaaaaatatggcttaaaattaaatccggaataaaaaaaattattcaaattaaatttaagaat

SEQ ID NO: 31212 - DNA, 441 bp, Zea mays
  Clone ID: LIB3059-042-Q1-K1-F8
gattactcgtcgaattctgttcatgtatttcacattggaaagctgagaatagggcttcgaaaaggatggtccacaaaagcaagagagtcgtattccactacgatgaagttatgcgggagccgtggtggtggtaatgctgcagctagggcagttttctggcaccctaggaaaggctcgtcctacactctagccttcgaaacagacagggacaggaatgctgcgattatgattgctcgcaagttcgcttcgaattgcaatatcgctctcgctggcccaggcgaccaaggcacctgatgaagtgatcacgctatgttttgacggcgacaacagtacataattagggcgtggattggctgattgggtggcgtgcttgtcttagttttgtcgatttgtgcttgtgagggtagaggttgtacacggcgtgaggcattgtttttggtt

SEQ ID NO: 31213 - DNA, 421 bp, Zea mays
  Clone ID: LIB3059-042-Q1-K1-F9
ctaaggtatttctcgcttactacaacgactccctaatgagaaatgaaacttcaggccgggtggtagctttggcggagttgctaaaatattaggggggctaaatccagattatggaaattctgcaccaaaagtaatgttctattctgctaggggtcctgaccctgaggacaatacactgtcaaatgctgatatcttgaaacccaatctagtagcacccggaaattcgatttggggtgcttggagttcacttggattggattctgctgaattttctggtgaaagtttcgcgatgctctctggcacaagtatggctgcaccccatgttgctggcctggctgctctaatcaagcagaagtttccttcttttagcccagcagctatagcttctgcattgtctacaaccacaactcttagtgacagg

SEQ ID NO: 31214 - DNA, 421 bp, Zea mays
  Clone ID: LIB3059-042-Q1-K1-E12
cggacgcttggccggcggcgtaggtagcggcggtgtgctggggatctcaatctcaagccgaggcgagctcggctccggtcacccgtcgatccacgcaaccatgtcgaggaggaagaccagggagcccaaggaggagaacgttacccttggacccactgtccgtgaaggagagtttgtctttggtgttgctcacatctttgcatccttcaatgacaccttcattcatgtcactgatttgtctgggagggaaactttggttcggatcactggtggcatgaaggttaaggctgatcgtgatgagtcgtctccttatgctgctatgcttgctgcccaagatgttgcacagcgttgcaaggagctcggtatcacagcgctgcacattaagcttcgtgccactggaggcaacaagaccaagacccct

SEQ ID NO: 31215 - DNA, 416 bp, Zea mays
  Clone ID: LIB3059-020-Q1-K1-C9
cccacgcgtccgcccacgcgtccgcccacgcgtccgcccacgcgtccgcggacgcgtgggcgcaaattgcaccaagaaatccatcgagaggccgtcgacaggggaattaatggcgtcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgc

SEQ ID NO: 31216 - DNA, 427 bp, Zea mays
  Clone ID: LIB3059-020-Q1-K1-D1
cgcatctcaagcgcaagacctcctcgcggctatggcgaagcgtctgatcccgtcgctgaaccgggttctggtggagaagctgctgaagcccagcaagagcgccggcggcatcctcctcccggagaccaccaagcagctgaacgccgctaaagtcgttgctgtgggccctggtgatcgtgatagggatggcaagctgatccctgtatctctgagcgaaggcgacactgttctgcttccggagtacggtgggacagaagtgaagcttgcagaaaaggagtaccttcttttcagagagcacgacatactggggaagctcgaggagtagctctggactgttaaaatggagttgtttgaaagtaggtatgcaagagttttgccacggcttatcttttttttttttgtacgggggaacaaatgaaaaacacaa

SEQ ID NO: 31217 - DNA, 400 bp, Zea mays
  Clone ID: LIB3059-020-Q1-K1-D10
cggacgcgtgggcagaaacacacctagcgaagcgcactagcaacgacctaacaacaatggctaccaagatattatccctctttgcgcttcttgccctttttgtgagcgcaacaaatgcgttcattattccccaatgctcacttgctcctagtgccattattccacagttcctccctccagttacttcaatgggcttcgaacacccagctgtgcaagcctacaggctacaacaagcgcttgcggcgagcgtcttacaacaaccaattgcccaattacaacaacaatccttggcacatctaaccatacaaaccatcgcaacgcatcagcaacaacaatttctaccagcactaagccaactagctgtggtgaaccctgtcgcctactttgcaacagcagttgc

SEQ ID NO: 31218 - DNA, 417 bp, Zea mays
  Clone ID: LIB3059-020-Q1-K1-D11
cctttactactcttgccaagaatgctgccttacctcaagaacaagaatccacggatccgagcaaaagcatcagtgtgtttcagcaagagtgtaccacgccttgatgtggtgggaatcaaagaatatggtatggataagctcatccaaattgcggcaacccaacttagcgaccagcttcctgaatcaagggaggctgctcgcaacctggcactggaactgcaagcattctatgagaagtctcaggcctcaacttctgacgaacacgaggtcgaggcctctgcctcgccagatgctgaatcatgggaggctttctgccagtccaagctctccgcattaagtgcccaagccattcttcgtgtgacctctactactacaaaagagtgcgtcacctctgccccaaaagaagggttggctgtg

SEQ ID NO: 31219 - DNA, 362 bp, Zea mays
  unsure at all n locations
  Clone ID: LIB3059-020-Q1-K1-D12
ccaactagcaacatagaaagcacaatagtgtaccaacaatggtagccaaaatattttgcctccttatgctccttggtctttctgcaagtgctgctacgacgaccattttcccgcaatgctcacaagctcctatagcttctcttcttcccccatacctctcaccagcgttgtcttcagtatgtgaaaacccaattcttcaaccctacaggatccaacaggcaatcacagcaggcatcttacctttatcacccttgttcctccaacaatcatcagccctattacatcaattacctttggtgcatttattggcacanaacatcagggcacaacaactacaacaactcgtgctagcaaaccttgct

SEQ ID NO: 31220 - DNA, 445 bp, Zea mays
  unsure at all n locations
  Clone ID: LIB3059-020-Q1-K1-D2
gagcgccctccgcacccggaagcacagttccggcgtctgccagcgcccgatgccgaggctgggcacgtcttgccagttttgaaggtgtagaggagaagccaccaaggtaaaaaacaaatggatgtatacctccgttttagctctggtgtcgtgcaggtgcagcagccagcaggtattatataaaaatgcttgtaggtgtatggagccagtagaagaggttgtccgagaataagatcgtcgatggcacagttgagatgagcttggcttgcaggagagtggtgtgtttgtgcatagtgttttgacatatgagatgcgttgttcttttctttttttccctttttcttttttgtatatagtgagtactcctgccgnctcgcaacaccgggctcgatctcggccgttacctgatggtggtgagtgtgcttggcatcggctgtgttctgtc

SEQ ID NO: 31221 - DNA, 407 bp, Zea mays
  unsure at all n locations
  Clone ID: LIB3059-020-Q1-K1-D3
ggtattttaaccagcagctaagttcgcggcattttagtccctgtaagcggtaagcagctctgtagcgtgagatagatggccaagcgccggtacgtacgtgtagtgtctggtcttctcactgagtgtactataaagagttaatataggagctgaccctgtgaacccgcgtgatggatgcatatgcttagtgcaaacctgcattttgtctctatttgaccatctgtacacgcatgatcgccttgcttgcctggtgtctggtctgctgatggcagcgcaaagcgaaaggcaaatgcattgaagggaaggcaagtggaggttggagttgatgctgncgngtgcgggcgcgatttgctgtncctttncggtgtgcggtgttgactgacgcgcgcgagcacgaaactggggga

SEQ ID NO: 31222 - DNA, 444 bp, Zea mays
  unsure at all n locations
  Clone ID: LIB3059-020-Q1-K1-D4
cagaaacacacctagcgaagcgcactatttacgacctatcaacaatggcttccaagacagtatccctcgttgcgcttcttgccctttttgtgagtgcaacaaatgcgttcattattccacaatgctcacttgctccgagtgccattattccacagttcctccctccagttacttcaatgggcttcgaacacccagctgtgcaagcctataggctacaacaagcgcttgcggcgagcgtcttagaacaaccaattgcccaattacaacaacaatccttggcacatctaaccatacaaaccatcgcaacgcagcagcaacaagcactgagccacctagccgtggtgaaccctatcgnctacttgcaacaacagctgcttgcattcaacccacttgctttggcaaacgtagcttgatacaacaacaaccacagttgcaacagtttct

SEQ ID NO: 31223 - DNA, 435 bp, Zea mays
  Clone ID: LIB3059-020-Q1-K1-D5
cactagcaacgacctaacaacaatggctaccaagatattatccctctttgcgcttcttgccctttttgtgagcgcaacaaatgcgttcattattccccaatgctcacttgctcctagtgccattattccacagttcctccctccagttacttcaatgggcttcgaacacccagctgtgcaagcctacaggctacaacaagcgcttgcggcgagcgtcttacaacaaccaattgcccaattacaacaacaatccttggcacatctaaccatacaaaccatcgcaacgcaacagcaacaacaatttctaccagcactaagccaactagctgtggtgaaccctgtcgcctacttgcaacagcagttgcttgcatccaacccacttgctctggcaaacatagttgcataccaacaacaacaacaattgcaacagtttct

SEQ ID NO: 31224 - DNA, 314 bp, Zea mays
  Clone ID: LIB3059-020-Q1-K1-D7
ctcgaaccttctctgtcttttggccagttgcgtaaaccctaagtgcttggctaccgtgggccgtggcaaggtgatggcgatggacccggacgcggtggcgaaagccttgattgagcactactaccggacgttctacaccaaccatacggagctggtggggctgtatcaggagacctacatgctcaccttcgacggccagatgtccatggcccatccgtcattgccgtcaagctcggatctctttccttgacgtctgcgatcaccagatcgtcaccgtcgtctgacagtcgttggagccccatggaggcatgctc

SEQ ID NO: 31225 - DNA, 436 bp, Zea mays
  Clone ID: LIB3059-020-Q1-K1-D8
gggacacgagcggatccgagcgaagcgaccgcgcgtccgcgccctccgtcgccaccaccatccgctccgccgccgctccatcgtcgtccacattgctgccatccgctctgccgctactccatcgtcgtccttccccgaagcagtcgtgagcgagacgtgaggcgacggtgccctccaccaccgccaccgtctcggatttgtcgtcattcaccgccatctctgcctcagtttgctgtcctccaccaccgtcttccgcggcactatgtacaatacaatgttgtctccaagacccagtacatggtcttctccaagatccagtacaagatcgtctcctccaagatttgaaccccaacgctagtgagagtggaggcaacacatgaaaccaacatggagaagaaaaatgaaatggcattccacatgaagcttgtgaaaaaga

SEQ ID NO: 31226 - DNA, 169 bp, Zea mays
  Clone ID: LIB3059-020-Q1-K1-D9
cggacgcgtgggcggacgcgtggggtgttctaccaacaacccatcattggtggtgccctcttttagattgcttatgagttatagttcaataatgaagttttttagaaatgtactttcttatttctgggaagccacaaacatcatccaaaaaataagaaagtacatttct

SEQ ID NO: 31227 - DNA, 400 bp, Zea mays
  Clone ID: LIB3059-020-Q1-K1-E1
ccgagactgaaaacggcatcagtagcagacgcaggcgaccacgaggagtgacggcatcagctgcggcagcgacgcccaacaacggcacctcatgggcgccgacgacgacgacgctgccgcctgccgctgtggcggcgcgagagagggaggcggagatcgagcaggccatgcgcgcccgcgtctcagacttcaagaagcaggccgactccttgacccttgaaggcgttagaagagcactgaaaaaggacctgggtttggagacatattcacttgatgcacataaaaacttcataaatcaatgtgtagacaaggtttttgctgaatcccatgatgaaaatgcaaatgataatgcttcagaggatcctgaaagccaaagatatttatccaaagaagagaaagg

SEQ ID NO: 31228 - DNA, 415 bp, Zea mays
  Clone ID: LIB3059-020-Q1-K1-B11
cattcttgtgcttctggctcatcctcctgatactgtgtacaatatgcaaaaaacgctagctttttacagctcgacctccaataactcgaagctccacgaataactccattgtggcctcaagattgaccatggttggttgattgccaacccccaccagttcaaggtccctagctggttcctcaacaggaaaaagtactacaaggatggtaggttctctcaggttgtttccaacgcccttgacaagaagctcagcttagggatgactctaggctgaagaagaccaggaaccactatggtttgtcactactggggtctacttgtccgtggccagcacaccaagactaccaaaaggcatggaaagactataggtgtgtcggagaatagataaagtcaatttggtgcctaccttggatat

SEQ ID NO: 31229 - DNA, 360 bp, Zea mays
  Clone ID: LIB3059-020-Q1-K1-B3
acgcaaattgcaccaagaaaccatcgagaggccgtcgacaggggaattaatggcgtcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagct

SEQ ID NO: 31230 - DNA, 369 bp, Zea mays
  Clone ID: LIB3059-020-Q1-K1-B4
ccgacgcgtgcgcgcaagagttcgaaatgagcgctaagaggatgctattgctgcccttgagtctgcagaacttacagattagataggagctgatcatgaaaacggagatcatcgaacctataaggtgaatgaagcaattgcagcatgtaatagagctgaatgacgctggtgttaaaaatcgggatcctatatgtgatggcagtcatcaatacaaagcatctggacacatgatgtacagcaacgcacgctatctgggagctaccactgagctgttaccaaacatttctgcctacctattagcaacaagctgtgagtaggatgtaaccaactgtgtaaactgaaccgtgctgctgatgtgcagcatcaact

SEQ ID NO: 31231 - DNA, 376 bp, Zea mays
  Clone ID: LIB3059-020-Q1-K1-B5
cggacgcgtggggcagctcaggcaggtggagccgcagcaccggtaccaggcgatcttcggcttggtcctccagtccatcctgcagcagcagccgcaaagcggccaggtcgcggggctgttggcggcgcagatagcgcagcaactgacggcgatgtgcggcctgcagcagccgactccatgcccctacgctgctgccggcggtgtcccccactgaagaaactatgtgctgtagtatagccgctggctagctagctagttgagtcatttagcggcgatgattgagtaataatgtgtcacgcatcaccatgggtggcagtgtcagtgtgagcaatgacctgaatgaacaattgaaatgaaaagaaaaaagtattgttcc

SEQ ID NO: 31232 - DNA, 431 bp, Zea mays
  Clone ID: LIB3059-020-Q1-K1-B7
aacacaccaagcgaagcacattagcaacaacctaacaacaatggctaccaagatattatgcctccttgcgcttcttgcgctttttgcgagcgcaacaaatgcgttcattattccacaatgctcacttgctccaagttccattattacacagttcctcccaccagttacttcaatgggcttcgaacacccagctgtgcaagcctataggctacaacaagcaattgcggcgagcgtcttacaacaaccaatttcccagttgcaacaacaatccttggcacatctaacaatacaaaccatcgcaacgcaacagcaacaacaattcctaccagcactgagccacctagccatggtgaaccctgccgcctacttgcaacagcagttgcttgcatcaaacccacttgctctggcaaacgtagttgcaaaccagccac

SEQ ID NO: 31233 - DNA, 434 bp, Zea mays
  Clone ID: LIB3059-020-Q1-K1-B8
cccacgcgtccgcccacgcgtccgctcgtactggtagcccgaaccctagctagcaggtcggaggcgagagagcagccatggcgcggtgcctcgcgctcgtctccctccttctcctcggcctcgcctccgccgcctccgctgccgatgcgccctttgtcgtcgcgcacaagaaggtttcgctctcccgccccaagccgggcgtcgagcgcgtcgccgtctccctcgacctctacaaccagggatccgcgactgcctatgatgtgtcacttaatgacgactcttggccaacacaagcatttgagcttgtcactggagagaaatcgaagacattggaaaggcttgaccctggtgccactgctacacacacatatgtcctggagaccaaaacacagggcaggttccagggttcaccagctattattacgtaccgtgtt

SEQ ID NO: 31234 - DNA, 392 bp, Zea mays
  Clone ID: LIB3059-020-Q1-K1-B9
cagtttcccagttgcaacaacaatccttggcacatctaacaatacaaaccatcgcaacgcaacagcaacaacaattcctaccagcactgagccacctagccatggtgaaccctgccgactacttgcaacagcagttgcttgcatcaaacccacttgctctggcaaacgtagttgcaaaccagccacaacaacagctgcaacagtttctgccagcgctcagtcaactagccatggtgaaccctgccgcctacctacaacagcaacaactgctttcatatagcccgctcgctgtggccaatgcacctacatacctgcaacaacaattgttgcaacagattgtaccagctctgactcatgtagttgtggcaaacccttgtgcctacttgcaacag

SEQ ID NO: 31235 - DNA, 413 bp, Zea mays
  Clone ID: LIB3059-020-Q1-K1-C1
cacaatatagacgaaaaccaatcggagactaatggtcgtcgcactcgcacgagggctgagtcctttccagctcgcaccgcggttgaacagcgtttcgttgtttcctccccaacttccaacacgcctcgatctagatccactcttcccccccttctccttccggtcctccccccgagactcttctattcatataggcgggtaggcgtccgaggcctcgtttgttctcggcttctcgtctccaagggtgctactccgtccgcgcttggtctgctctcgtccttccggaggccgcggcgcaacatggcgaagatcaagccgaaggccttgctcgcgcaaagcaaggtgaagaaggtccccggccaaatcagcgtggccacgatcgtcacctacatgatcctcggcgtcctggtcgt

SEQ ID NO: 31236 - DNA, 340 bp, Zea mays
  Clone ID: LIB3059-020-Q1-K1-C10
aaaaaaaaaaaaaaaaaattaaaaaaatataaaaaaaaaaaaaaaaaaaaaaaaaaaaagggaaaaaaaaaaaaaaaaaaaaaaaaaaaaaaaaaaaaaaaaaaaaaaaaaaaaaaaaaaaaaaaaataaagattaaaatttaattacataaaaaaataataaaaaaaaaataatatttaataaaaacataaaaaaaaaaaaacatgacagtagttaaaaaatttacaactttgaaaaactataatatttccaaattaaatcgtatttgtccatattcccatttggcaatttgccttaatcgcgaataggaccgacccttttgcctttcataaattttaa

SEQ ID NO: 31237 - DNA, 421 bp, Zea mays
  unsure at all n locations
  Clone ID: LIB3059-020-Q1-K1-C12
aaggacatcagggcacaacttctacaacttcttgtgctagcaaaccttgctgcatactggcancaacatcagtttcttccattcaaccaactggctgcattgaactctgctgcttatttgcaacaacaactaccattcagccagctagctgctgcctacccccagcaatttcttccattcaaccaactagcagcattgaactctgctgcttatttacagctgcaacaattgctgccattcaaccaacttgctttgacaaacccagcagtgttctaccaacaacccatcattggtggtgccctcttttagattgcttatgagttatagttcaataatgaagttttttggatgatgtttgtggcttcccagaaataagaaagtacatttntagattcttatgtgcttctagtctccaaatgtg

SEQ ID NO: 31238 - DNA, 442 bp, Zea mays
  Clone ID: LIB3059-020-Q1-K1-C2
cccacgcgtccgcccacgcgttcgcccacgcgtccgcggacgcgtgggctattctgctgccctggtgctctccagtacatcagcggtgtgatcctcttcgaggagaccctgtaccagaagaccaaggatggcaagccttttgttgatgtcctcaaggagggaggcgtcctccctggcatcaaggttgacaagggcaccattgaggttgttggcactgataaggagaccaccacccaaggccatgacgaccttggcaagcgttgcgccaagtactacgaggcaggtgcccgctttgccaagtggcgcgctgttctcaagattggccctaatgagccatcacagcttgccatcgacctgaacgctcagggtctggctcgctatgccatcatctgccaggagaatggtctggtgccaattgttgagcctgagatccttgttgatg

SEQ ID NO: 31239 - DNA, 436 bp, Zea mays
  Clone ID: LIB3059-020-Q1-K1-C3
gttaaattggtcgtggatgacatctcatatgactttgtaaaaggtgccactgtggattatgaggaggaacttatacgttcagcgttcgtggcagaggtgagtatacttatggttggtactcagcaagtgggtgaatatgcaaggtttcaacaaatcctagtgctgttgggggctgcagctgcaagagttctttcatggtgaaatagcttcaattaccttgaagagatcaataattggaaatagcattctgtagcgaatcatacgctttggatctgagtgtacaattgttattttttggtagttctgaagacgtttctttttgagttttgttactgttggaaacatcatcacaaactgtctggttcaatctgtatccctctaacttgtgatagttgtgatatgatgacaagtttatgtacataatcttgtagctatt

SEQ ID NO: 31240 - DNA, 439 bp, Zea mays
  Clone ID: LIB3059-020-Q1-K1-C4
cttacgtcttcgcattcatgttcccaatggggctcggtgctgcagcaagcatacgcgtgtccaacgagcttggtgcaggacggccacgcgaggcccgcctggcgactcgggtggtcatgctcctggccttctccctgggcgtctcggaaggccttgtcatggtgctggcgcgcagcctgctcggctacgcctacgccaacgacaagcaagtcgccttgtacacctctaggttgatgccgatcctcgccgcctccaccctgtttgactgcctccagtgcgtcctatcaggtgttgtcaggggctgtggccgacaaaagatgggccgccttatcaacgttgcggcattctacattgtcggcatccctgtagcgtccgttttcgccttcgttcgtcacctcggtggaatgggtctttggtttgggatcttgtgcggagtagc

SEQ ID NO: 31241 - DNA, 431 bp, Zea mays
  Clone ID: LIB3059-020-Q1-K1-C5
gctaaagctgtggctactgagtgcaaaacaacttttttcaatatttctgcctcgtcgattgtaagcaagtggcgcggtgactcggagaaactagtgaaagtgttattcgaacttgcaaggcatcatgcaccatctactattttccttgatgagattgatgctatcattagtcaacgtggtgaagctcgtagtgaacatgaagctagccggcgattgaaaactgagctattaatacagatggatgggttgactaagacagatgagcttgtttttgttctagcagcaacaaatttaccatgggagttggatgcagcaatgctgcgtcggctggagaagcgtattcttgttccattgccagagccggatgctagacatgctatgtttgaagagctcctgccatatacacctggcacaatggagattccctatga

SEQ ID NO: 31242 - DNA, 422 bp, Zea mays
  unsure at all n locations
  Clone ID: LIB3059-020-Q1-K1-B10
cggacgcgtgggcggacgcgtgggcgccctctcgctccagccgcttcacagcgccggcgctcgcctctccgactgccgcgagaatgccgttcaagaggttcgtggagatcgggcgcgtggcccttgtgaactacggcaaagactacggccgcctcgtcgtcatcgtcgatgtggtcgaccagaacagggcacttgtggacgcccctgatatggtcaggtgccagattaacttcaaacggctctcacttaccgacatcaagattgacatcaaacgtgtccccaagaagtcaaccttgatcaaggctatggaggaagctgatgtgaagactaagtgggagaacagctcatggggcaagaagctgattgtccagaagaggagggctgcactcagtgactntgacaggttcaaggtcatgctggca

SEQ ID NO: 31243 - DNA, 360 bp, Zea mays
  Clone ID: LIB3059-019-Q1-K1-H7
gaaagttatgagtcagttgcaagaactgataccaacgggcctcatcctacacaatacgggcgtacattatccgtctggactaaggataacattacagaaccgaacaggatgactagggcaaacgcgcccaatggctgagaatctccagttgcgatgtgaatggccgtagccaatcacactacatgccgaccgacgcacacggcatcaccaatgaccgtactcatcgtccaaccagcaggcgactggaacgtcatagaccgcgacatcatcactgctcacggcaccgccatagacgtcaactacactgtcaccaacttacccagcgatagcaccttcactgacgacgcgggactgggcctc

SEQ ID NO: 31244 - DNA, 394 bp, Zea mays
  unsure at all n locations
  Clone ID: LIB3059-019-Q1-K1-H8
catggactttccccagttgacgatgacattgcctgatggccgtgaggagtctgtcatgaagagaacaacactggtggctaacacatcaaacatgcctgtcgctgctcgtgaagcttccatttacactggaattacaattgctgagtatttccgtgatatgggctacaacgtcagtatgatggctgactccacctnccggtgggctgaggcattgcgtgagatctcagggcgtttggctgaaatgcctgctgatagtggttacccagcttaactggctgacgtttggcatccttttatgaacgtgctggtaaggtaaaatgtctgggaagtccagacaggaatggcagtgtcacaattgttggagctgtctctcctcctggtggtgatttttcag

SEQ ID NO: 31245 - DNA, 435 bp, Zea mays
  Clone ID: LIB3059-020-Q1-K1-A1
atgccgctgaacaatacgaacaaatctttcagtgggccttcatcgatcgaccctatgtgatgtaaaaaaaaaggaccaaagtggtggttccttgaagatcatcagttcatcatcctatagtaagctgaatgatgaaagaaaacccctgtacattacatggaaggcagaccggctattggctccattgctccaatgtctgctttggctgccttgcctcgatggaccggatgcagtgaggaatccagccgaacgacagtttgaaggataggaaggggagctggaagcagtcacgcaggcagcctcgccgtgattcatatggaacaagctggagtcagtttctgctgtgccactcactgtttaccttaagattattacctggtgttgtgtcctttgctcgttagggctgataacgtaatgactcattagaaaatcatg

SEQ ID NO: 31246 - DNA, 416 bp, Zea mays
  Clone ID: LIB3059-020-Q1-K1-A10
ggagagggttgagctgcttgacggttttgactcggatcatggtgtgcagctctatcagatagagagctgacgtgaggtgtgagacgcggatcgtggagtactactcagtaggagatcaagaggaaggaggtggggaggggaagaaggcgatagccggggaggatggtgcttgtgcttgcgctgggggatctgcacatcccgcaccgggcgcccgacctccccgccaaattcaagtccatgctcgtgcccggcaagatccaacacatcatctgcactggcaatctctgcatcaaggaagtccatgactacctgaaaagcctttgccctgatctccatattaccagaggtgaacatgatgaggatgctcgatacccagagactaagacacttacaattggtcagtttaagcttgggct

SEQ ID NO: 31247 - DNA, 418 bp, Zea mays
  Clone ID: LIB3059-020-Q1-K1-A11
cggacgcgtgggcggcgaccattttcccacaatgctcacaagctcctatagcttcccgtcttcccccgtacctctcaccaacggtgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacatcaacaactaccattcagccagctatctgctgcctacccccagcaatttcttccattcaaccaact

SEQ ID NO: 31248 - DNA, 417 bp, Zea mays
  Clone ID: LIB3059-020-Q1-K1-A12
cgggttcgtgaggttctccggggttcgggttcgtgggtgagcggatcgagatggcggcgtcgagatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggc

SEQ ID NO: 31249 - DNA, 273 bp, Zea mays
  Clone ID: LIB3059-020-Q1-K1-A2
gtcactcgatcaacatcgactgtggacttcaatagcaccattgcgatcccactgtcggcgattatatgttgcgtctccatgcgcagcgcgctctctgcgtgcgtgctgatcccgacacgattctctcactgttcacacgctcctatatcgctcctgacttttcccatacacaccataccagctgtgttcaaggtgtgcgaacacacatttgttacactgtaggcgatacaacgcggtcgcagagctctgctcacatctataacactcgtgtta

SEQ ID NO: 31250 - DNA, 284 bp, Zea mays
  Clone ID: LIB3059-020-Q1-K1-A4
cccacgcgtccgaaaaaaaaaaaaaaatttaaaaaaaattaaaaaaggacggaccttccggggtatccgggccaacctaccgttccctgcaatgcaatagctttcctatagtgtaacgtaacctaaattcactgccctggccttaacaccacaacgactggaaaaaccatgccctgccccaactcaacttaattgcattacatcccattttcctcacctgagctatcgccaaagaggccaggcccgttcggattgcccatcacttcagcagcccaaacggaaat

SEQ ID NO: 31251 - DNA, 432 bp, Zea mays
  Clone ID: LIB3059-020-Q1-K1-A5
cccactcgtccgcggactcgtgggcggtctcgtggggcaacatagaaagcacaatagggtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcacaacaactacaacaacttgtgctagcaaaccttgctgcctactctcagcaacagcagtttcttccattcaaccaact

SEQ ID NO: 31252 - DNA, 182 bp, Zea mays
  Clone ID: LIB3059-020-Q1-K1-A7
cccactcgtccgcccacgcgtccgcccactcgtccgattgctccttttttttcttctatggttggacttgagtgctgttttcgtatttgcactctgcggtgtactgccgttaaggcaaatcagttgtttgcaagtttgagtgctattgggggccgttgattacatacctgtcttttgcacct

SEQ ID NO: 31253 - DNA, 397 bp, Zea mays
  Clone ID: LIB3059-020-Q1-K1-A9
cactgacgccttgcatggtgaacactgttacgtaccttaatattcatagatcaataggagaacctattgaggatcgtacgacgattccaagataccttaatgcacatacagagggatactctcaaaaggcaaacattgatgcaacggtgaaaaaattttcagataacttcacaattatgttgatccattatgatggccggacaactgagtgggatgaatttgagcggtcaataagggctgcccatgtgagtgtcacaaaacagaccaaatggtggtatgccaaacgattcctacatcctgacattggtgcccgctacgactacatattgatgtgagatgaagatcttggcgtagaacattctaatgcagaggcgtacatttagctcgttaggaagca

SEQ ID NO: 31254 - DNA, 444 bp, Zea mays
  Clone ID: LIB3059-019-Q1-K1-H6
cccacgcgtccgcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatgttccagccgctccggcaacagtgctgccagcagcagatgaggatgatggacgtgcagtccgtcgcgcagcagctgcagatgatgatgcagcttgagcgtgccgctgccgccagcagcagcctgtacgagccagctctgatgcagcagcagcagc

SEQ ID NO: 31255 - DNA, 350 bp, Zea mays
  Clone ID: LIB3059-042-Q1-K1-C6
ccccagcaatttcttacattcaaccaactggcagcattgaactctcctgcttatttagagcagcaacaactactaccattcagccagctagctggtgtgagccctgctaccttcttgacacaaccacagttgttgccgttctaccagcacgctgcgcctaacgctggcaccctcttacaactgcaacaattgctgccattcaaccaacttgctttgacaaacctagcagtgttctaccaacaacccatcattggtggtgccctcttttagatttcttatgagttatagttcaataataaagttttttgtctgatgtttgtggcttcccagaaataagaaagtacatttct

SEQ ID NO: 31256 - DNA, 263 bp, Zea mays
  Clone ID: LIB3059-042-Q1-K1-C7
cggacgcgtgggctcgctctgctagcctaccatggctgatcaccaccggcgcgcgacgggaggtggcggtggctacagcgacctagatcgctggggcgggatgcacggcgaggcgcgacagcagcagaagcatggcgccatgatgacggcgctcaaggtcgcgacggccgcgacctacagctgctcgatgctggtgctgtccgggctgatcctgtgcggcaccgagatcgcgcttacggtggccacatctgtgctggtgatct

SEQ ID NO: 31257 - DNA, 341 bp, Zea mays
  Clone ID: LIB3059-042-Q1-K1-C9
ggttcttcttattcctcaaaatccttgtcccctattttagttgcctcctcatatatctgatctaccacatcaacctgtcactaatcattgcttacttatataagaacataagtagtatttgctattgtcaagtgttgcccttcttgatacaagttgtgttttcgtatcattattattatgcactgtcatcttacgtgtatatctcgtatgtgttattgtcaactttataaaagcacactctgtttgcctaaaaaaaaaaaaataaacaaacctatatctggtgcgtatatttatacaaacaatcaatgcattaatatatttatattaaatttatatatatc

SEQ ID NO: 31258 - DNA, 368 bp, Zea mays
  unsure at all n locations
  Clone ID: LIB3059-042-Q1-K1-D1
nctggtttcaccaatcgccagccctatctttggtgcagtcattggtacaaaccatcagggcgcagcagctgcagcaactcgtgctacctgtgatcaaccaagtagctctggcaaacctttctccctactctcagcaacaacaatttcttccattcaaccaactgtctacattgaaccgtgctgcttatttgcagcaacaactattaccattcagccagctagctactgcctactctcagcaacaacaacttcttccatttaaccaattggccgcactgaaccccgctgcttatttgcagcagcaaatactactaccatttagccagctagctgcagcaagccgtgcttccttcttgacacagcaacag

SEQ ID NO: 31259 - DNA, 164 bp, Zea mays
  Clone ID: LIB3059-042-Q1-K1-D10
tataaactacaaccttatatatttcctgcttatattcatcttctacttcatccaacatatcataaatcttaactattcccacctcatatttagtttccaaattaacatcaagcacattattactctacttcatcactatcatctttcaacatattatagataat

SEQ ID NO: 31260 - DNA, 416 bp, Zea mays
  Clone ID: LIB3059-042-Q1-K1-D11
cccacgcgtccgcccacgcgtccggctgcactcgcaagcaatacatctcgtcgttcgactaagatcgaggagcaaatggcggccaccttgaagctcaggatcctcatcgtggcggcggccgtcgccgcgtccctggtcggcacggcctcagcggcagagggaccggcgcccgctccgacgtccgccgccgcgtccatggccgcgccggccgttgccgctgcgtccttcaccgcgcttgtcttcggctacctcttctgaacgccgtgaacattcacgcgtacaccgtgttgccccagccgaattgtttgcctgctcagatttttcttcttctctgtctcgctctcgtgttttggtgtgtataggtttgtaattacgtgttcattttttttattgcgtgaccatggatctcgtaatta

SEQ ID NO: 31261 - DNA, 433 bp, Zea mays
  Clone ID: LIB3059-042-Q1-K1-D3
ccacctccgaagaggtgctgtgtttggctgcaggacccctgaggagatcccggggggttcggttggtgctgaatatgttgttgagtctactggtgttttcactgaccaggagaaggctgcagctcacttgaagggtggtgccaagaaggttgtcatctctgctcctagcaaggatgcccccatgtttgtcgttggtgtcaacgagaaggagtacaagtctgacattaacattgtctccaatgctagctgcacaaccaactgccttgctcctcttgctaaggtcatcaatgacaagttcggtatcgttgagggtctgatgaccactgtccatgccatcactgctacccagaagactgttgatgggccctcatctaaggactggaggggtggaagggctgctagtttcaacatcattcccagcagcactggagct

SEQ ID NO: 31262 - DNA, 138 bp, Zea mays
  Clone ID: LIB3059-042-Q1-K1-D4
tgactctccctgtaacgtcacattatgcgcggcgggtgtcgtggttactctcatcgtgaccgttacacttgtcagtgctctaacgcccactccttttgctttcttaccttactttctcgacacgttcaacggcttttc

SEQ ID NO: 31263 - DNA, 389 bp, Zea mays
  Clone ID: LIB3059-042-Q1-K1-D5
gactagtactagttcgtctgcgctgccattacgacctactactgattcatgatattggggaaatctcctctatccatcactctctatctatatatgtcataatgcagtcagacgacacacattatcatgtgtggtatgaccaatactatatgcatggtcataataaagttttgggtataatgaatctatcggccgcttgatgtctatgatggacaaatcaaaacttctcctgtcaggcatgtaaatatttcaaaatctctattcaggctcaaattcatagcacaaaaatagaacccaacaagaccagatatacttgaagccaaacaagactctgaaacatgggtgcaacctgaaggtcaaactggtgatgggcgcactgaattgaatga

SEQ ID NO: 31264 - DNA, 439 bp, Zea mays
  Clone ID: LIB3059-042-Q1-K1-D7
attacgagcagttgatgatcttttagagcacagcaattctgatcttgctgaggaattgggcaacttgacacaagcctacacgtacttgccgaaagtgtttgatcggtttggaggtgcccaaggatatatgttccttcaagatcgcatggtcttcaattactggaacctcttgaatgctgataaggctaagctctggataaccaaccaggtgaaggaatcttgctcggatgtgcctctacatggtaacaacattgagtggtttgtgaaccaaggagatatgattaaaaaggcggtcatcaattgtccatctcaatatcaagataattacaggagaagtgtacgtgaaaataatctgattcgttgcaacagtgaaatattttacgtacctcaacggtacacccgtgatttctcagatcttgtaaaaagtattgggagctta

SEQ ID NO: 31265 - DNA, 404 bp, Zea mays
  Clone ID: LIB3059-042-Q1-K1-D8
cgggaggttttttgacctagtttatcatgaaaatgcccgtgttctactccatgatgagagcatataccgatttgaatgttgctcaagtccgacaaggttgtctattcagctgatggaatatggtcacgaaaagccagaagttacagcagtatcaattgatccaaatttttcttcttatctttttggcgagtatttatgtagtacgtcagacaagaaattatctgaaggcgtctaccttgcaaggaataagcggaaatattcagataatgatgaaccttcagattttttgaaggcaatggatggtatcaaagttgtgaatggtctcgaatgcaagatatcctgcaagacctctaaggtctcgtatgtccttgacactgaagatttcttgtaccggcttcggaaga

SEQ ID NO: 31266 - DNA, 438 bp, Zea mays
  unsure at all n locations
  Clone ID: LIB3059-042-Q1-K1-E1
ccgacgcgtccgcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatgttccagccgctccggcaacagtgctgccagcagcagatgaggatgatggacgtgcagtccgtcgcgcagcagctgcagatgatgatgcagcttgagcgtgccgctgccgncagcagcagcctgtacgagccagctctgatgcagcagcagcag

SEQ ID NO: 31267 - DNA, 342 bp, Zea mays
  Clone ID: LIB3059-042-Q1-K1-E10
accgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgcctagaggacctgccgggctgcccgcgtgaggtgcagaggggattcc

SEQ ID NO: 31268 - DNA, 413 bp, Zea mays
  Clone ID: LIB3059-042-Q1-K1-E11
agttaaaacatcattttggtggtggggaaatttgtaaccttttcaagttattggcctggttggattttaccccgttgtgtgagaaatctaatactccgcttggatgtcgatattggagaggatggaattgaattgggttgaataccaaatcaggcatgatattgaaatgagatataatttcaattctattgtttggatgtcactgaattggagtttggaattatgcggtctaattctaggcaataccgagggggtgaggctttgtattggaagagggggtttctagttatagtctaatttcagggaattgggcctctgattccaaatctcaattccacatgcaacgaatcatcataatttaggaaagctgattccaattctcaattctgtgattcaatctctacatccaaacg

SEQ ID NO: 31269 - DNA, 428 bp, Zea mays
  Clone ID: LIB3059-042-Q1-K1-A8
cccacgcgtccgactcaggcaaactctgaggtgtctgctcttcttggacgtatggcgggtgctgtgggataccagccaacccttgccactgatcttggaggactgcaagagcgtattacgacaacaaagaagggttctattacatctgtgcaggccatctacgtgcctgccgatgacttgacggatcctgctcctgctactacctttgcccatcttgatgctacaactgtgttgtcacgacagatctctgagcttggtatttatcctgctgttgatccactggattccacatcaagaatgctttctccccacgtgctgggtgaggatcactacaacactgctcgtggtgtgcagaaggttcttcagaactacaaaaatcttcaggatattattgctatcttgggtatggatgagctcagtgaggatga

SEQ ID NO: 31270 - DNA, 375 bp, Zea mays
  Clone ID: LIB3059-042-Q1-K1-A9
taaccaccgtgggctttaacacctcaccactccctgaacctccgggctgggatctgcctgccacgctcaagaagtctgccaagccacctggccgcccatttggctctggccctcctggtgaccgcccaaggggcccaggccgttttgacggcgacaggccaaggtttggtgacagggatgggtaccgtggtggtcctcgtggtgctcctggtgactttggtggcgataagagtggagctcctgctgagttccagccatcattcaggaggcctggctttgggcgtggtggcggcagcggcttcggcgcgggcccaacctcttcttccatggagtgaagttgcccttggtttggacatggtgtttcccttcgcatgt

SEQ ID NO: 31271 - DNA, 189 bp, Zea mays
  Clone ID: LIB3059-042-Q1-K1-B1
ggaacaaaacaaaatatcttgggcatttaacttggtcaaaacaagtagaaaagctggagcaacattgccaactgactcttgggagactacagagcccggttacagctcaagaattcaaagcttagcattgcacaattatgctggtttggtggaaggttttgagttaatcatatctaaactgagttggtt

SEQ ID NO: 31272 - DNA, 356 bp, Zea mays
  Clone ID: LIB3059-042-Q1-K1-B10
cgccagccctatctttggtgcattcattggtacaaaccatcatggcacatcatctgcggcgactcgtgctacctctgatcaaccaagtagctctggcaaacctttctccctactctcagcatcatcaatttcttccattcaaccaactgtctacactgaaccctgctgcttatttgcagcatcaactattaccatttagccagctagctactgcctactctcagcaacaacaacttcttccatttaaccaattggccgcactgaaccccgctgcttatttgcagcagcaaatactactaccatttagccagctagctgcaacaaaccgtgcttacttcttgacacagcaacagttg

SEQ ID NO: 31273 - DNA, 381 bp, Zea mays
  Clone ID: LIB3059-042-Q1-K1-B2
cccacgcgtccgggcaactttggcatcgtgaccaagctcggccaggaaactctgctgaaggtgctcctccgaatttaccttcactacaacttgtatgatcaggcagaaaagcttagatcaaaggcacctcgttttgaagcacattccaaccaacaattctgccgatacttgttctacttgggcaaaattaggacaattcagttggagtacactgatgctaaagaaagccttctgcaagctgctcgtaaggcaccaacaactgcccgtggttttcggatccagtgcaacaaatgggctatcatagtgaggctgctgcttggtgagattccagagaggacttgtttcatgcagaaaggaatgaagaaagctctgacaccttat

SEQ ID NO: 31274 - DNA, 133 bp, Zea mays
  Clone ID: LIB3059-042-Q1-K1-B3
cagaaacacacctagcgaagcgcactatcaacgacctaacaacaatggctttcaagacggtaggccttcttgcgcttcttgccctttttgtgagtgccacaaatgcgttcattattccacaatgcttacttgc

SEQ ID NO: 31275 - DNA, 433 bp, Zea mays
  Clone ID: LIB3059-042-Q1-K1-B6
gcaagatccagaagaagcgccacggcgcggcgggaggcgcccggctgcagggcggtagcccgttcgagaagtccaaggggcagcacattctgcggaacccggcgctggtggactccatcgtctccaaggccggtctcaagcccaccgacaccgtcctggagatcgggccggtcacaggaaacctcaccaagcgcctcctcgaggctggtgtcaaggccgtcgtcgccgtcgagctcgacccgcgtatggtgctcgagctcaaccggcagttccaggggcacctgctctcctcgcgcctcaaggttatccaaggagatgtcctcaaatgtgatctcgcatactttgatatttgtgtggcagacatcccgtaccagatctcttctccccttactctcaagcttctgtcacaccgtacaatttttacgtgtgctgt

SEQ ID NO: 31276 - DNA, 381 bp, Zea mays
  unsure at all n locations
  Clone ID: LIB3059-042-Q1-K1-B7
attccctgaagcacagccttccccacacaagaacttcgctgacgaggttgcctgcctgaatcgcttcttcggtggcctcaagtccggtggcaatgcttatgtgattggtgactctgcgaagcccgggcagaagtggcacgtctactacgccgctgagcaccctgaggagcctgttgttactctagagatgtgcatgactgggctggacaagaagaaagcttctgtcttcttcaagaccactgctgatggttactcgctgtgcgccaaggagatgaccaagctctctggtatctcggacatcatcccagagatggagatctgtgacttcgacttcgagcccttgggctactccatgaatgctgntcatggccctgctttgtc

SEQ ID NO: 31277 - DNA, 380 bp, Zea mays
  Clone ID: LIB3059-042-Q1-K1-B8
cccacgcgtccgcggacgcgtgggattgagaccaacaagcaacatagaaagtggaatgcagtagcaacaacagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgcta

SEQ ID NO: 31278 - DNA, 442 bp, Zea mays
  Clone ID: LIB3059-042-Q1-K1-B9
tttccgggttgacccaagccttcggttccggccgacggcgccgctgcgccattaacgcaggaggcttccaagattgttaagggccgtaatgcccggcagggccgttttcctcttcaagggccgcttctccgccaggaaggcagttatcgtgcgcgtgttcgatgagggcacccgcgaccgtccctatggccactgcctcgtcgcaagcctcgccaagtacccaaagaaggtgatccgcatggactccgtcaagaagactgcgaagaagtcgcgcgtcaagtgcttcatcaagctcgtcaacttcactcacctcatgcccacccgctacaccctcgacgtcgatttcaaggatgtcgccaccggtgggcccgacgcactctctacccacgacaagaaggtcgccgcctgcaagacggccaaagcgcgccttgaggagaggttc

SEQ ID NO: 31279 - DNA, 416 bp, Zea mays
  Clone ID: LIB3059-042-Q1-K1-C11
cgcctacctacaacagcaacaacttctttcatctagcccgctcgctatgggcaatgcgcctacatacctgcaacaacagttgttgcaacaacagttgctgcaacaaattgtaccagctcttactcagctagctgtggcaaaccctgctgcctacttgcaacaactacttccattcaaccaactgactgtgtcgaactctgctgcgtacctacaacagcgacaacagttacttaatccactagcggtggctaacccattggtcgctgccttcctacagcagcaacaattgctgccatacaaccagttctctttgatgaaccctgccttgtcgtggcagcaacccatcgttggtggtgccatcttttagattacatatgagatgtactcgataatggtgccctcatagcggcatgtgt

SEQ ID NO: 31280 - DNA, 424 bp, Zea mays
  unsure at all n locations
  Clone ID: LIB3059-042-Q1-K1-C12
ccaaaggccatcactgcctagcaatgcagcttaccgcagaatacttttcgttagatggcactaaacgtgaattccctaaaagagacaacattcagttgggtggttattatcattatgcgatgttctctgacaatgtgcttgcaagtgctgtggttgtcaactctacaattgctgcatcaaaggatcctggaaggatattattacatattgtaactgacgcgttgaattatcctgcaatgatgatgtggtttctgacaaacccaccaactccatcagtaatccaaatccagagcctagatgatttgaaatggttgcctggtgatttcagttccagattcaagctgaagggggttcgggatccgagatacacttctgcactcaaccacttgcgtttntatttgccagaagtgtttccatctttgag

SEQ ID NO: 31281 - DNA, 206 bp, Zea mays
  Clone ID: LIB3059-042-Q1-K1-C2
attcttatattttttatactttatttttttttttagtttgtttttattattttttttttttttttttttttttttttttttttttttttttttttttttttttttataattttttttttttttttttttttttttttttttttttaattttttttattatttttttattttttttttttaaaaaaaaaaaaatttttttttttttt

SEQ ID NO: 31282 - DNA, 242 bp, Zea mays
  Clone ID: LIB3059-042-Q1-K1-C3
tggccggacccttggccattaatggagaagaaggttcccaactgcaaaggaaggatgcttccttaccaagggaaaaattggttgtatccaaggatggcattactgaccaccaaattaatgaccagaaaagaaccccaaattctgttgcccgaactaccgtgagccctccaaggtcaaaggatgctgacatggatgatgtgaaacccacaagcttaagctctcggagctacctgaaaagtgca

SEQ ID NO: 31283 - DNA, 365 bp, Zea mays
  Clone ID: LIB3059-041-Q1-K1-G9
cccacgcgtccgaaagatgctctggcttaatctgacaagattacgctggaggcagcagagcttttgagagaagattatttggcacaaaatgcattcaccccatatgataagttctgcccattctacaaatccgtttggatgatgcgcaacattattcacttcaacacattggcaaatcaagctgtggagcgggcagctggtactgacggccataagataacatacagtgtcataaagcatcggttgggggatctaatttatcccctaatatcccaaaaattccaagattccttcaaaagccaaaaagcttttgtcggcaagtttaagaaactttattacgaccttaccactgggttccgcaacct

SEQ ID NO: 31284 - DNA, 421 bp, Zea mays
  unsure at all n locations
  Clone ID: LIB3059-041-Q1-K1-H10
cggacgcgtgggcggacgcgtgggtgctactgctgcagctaacagcctcagtcnagagtttggatcaaaacttaaagaacacatgcagtattgtgtggatcaccctgaagaggttagcaagctggccaaagtgaaggcgcaggtttcagaagtcaagggtgttatgatggaaaacattgaaaaggttctggatcgtggagagaagattgagctgcttgtcgacaagaccgagaatcttcgctcacaggcacaagatttcagacagcagggaacaaatgtcaggagaaagatgtggttacagaacatgaaaatcaagctcatcgtcctgggaataatcatcgcactcattctgatcattatcctctctgtctgtcatggtttcaaatgccattaagcacagaccagaatactgatacattca

SEQ ID NO: 31285 - DNA, 448 bp, Zea mays
  Clone ID: LIB3059-041-Q1-K1-H11
gggtgctgatttgaattctatgagagttgagaccaacttcctgagctatgctataggggatgcacagaaatatccataccttgcatcaatgggcatttatgtcttcaagaaagatgcacttttagaccttctcaagtcaaaatatactcaattacatgactttggatctgaaatcctcccaagagctgtactagatcatagtgtgcaggcatgcatttttacgggctattgggaggatgttggaacaatcaaatcattctttgatgcaaacttggccctcactgagcagccttccaagtttgatttttacgatccaaaaacacctttcttcactgcaccccgatgcttgccttcgacgcaattggacaagtgcaagatgaaatatgcatttatctcagatggttgcttactgagagaatgcaacatcgagcattctgtgattggagtc

SEQ ID NO: 31286 - DNA, 418 bp, Zea mays
  Clone ID: LIB3059-041-Q1-K1-H12
gcaagttcttgttgaaattggtgacaaggatccatcatttattggatcttgggaggggatcggagccattgagttaagctttgtcctcgacaaactgctgggcgtgagttgtaaggttatcaatgtgaggtctggcgatgagcttcctgaaaagtgcagagaacttgccaggcattttgaaacccagggaactcctgtgatgattggtggtggagtcttggcttacacccttttgggagttgattataacgaagccagtggagattgtgcatttcttatccttgatccgcactacactggtactgacgatctcaaaaagattgtaaatggcggatggtgcggatggaagaagtctgtcgacagcaaaggccgaagcttctttttgaaagacaagttctacaaccttctactaccccaa

SEQ ID NO: 31287 - DNA, 446 bp, Zea mays
  Clone ID: LIB3059-041-Q1-K1-H4
ggaattcccgcctcaacctacccgtcacgcgtccgcttgatttattcatttgagcattcaacatagggacacaattatttgcactgcacaacaaccaacaaccctgaaagccaagattgaaaggaaaaaaaaatcttaatttctttgctaacgaaaatggttggttcacggcaatgcggccttcaggttcttggcgaactcttctagcttcttcaatccttcttctggagaagcagcttcctccaacgtcttcatcactgcgctaccgataatcacaccatctgcgccccatcctgcaatctgccggacatgctctggagtcgacacaccaaagccaacagccacgggtttttctgtcaccttcttgatatcctgaagaagagattgcaccttgccgcttacatttgcacgtgtaccagtaacttcaacagtgcttacaagataaa

SEQ ID NO: 31288 - DNA, 428 bp, Zea mays
  Clone ID: LIB3059-041-Q1-K1-H5
ctatactatactctaggaagcaaggacaccaccgccatggcagccaagatgctggcagtgttcgctctcctagctctttgtgcaagcgccactagtgcgacccatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtcttgccgagcatgatgtcgcaaatgatgatgccacaatgtcactgcgacgccgtctcgcagattatgctgcaacagcagttaccattcatgttcaaccc

SEQ ID NO: 31289 - DNA, 409 bp, Zea mays
  Clone ID: LIB3059-041-Q1-K1-H7
gctccagctcctcgcgcaccagttgagaaggctgatccagctcctagtgcaccggttgagaaaggtgctccagctcttcgcgcaccagttgagaaggctgatccagctcctcgtgcaccagttgagaaggaagtaactaggaagacttatgcatcagttgttaaaatcccgagggaggacacacagcctaccccagctgccagaccctccaagcccaacctaaatataaagatggttcaaaatacggagaaaaatgtgtcctcaccatcgaaacctgctcatgctactgttaatgccctaccgggcgataagggtgttcctaaaaacaaatcacctgatgagccagggtactcaatttttgttaagaatttaccttttgaagcaactgttgaaatggtcgaacaagagt

SEQ ID NO: 31290 - DNA, 393 bp, Zea mays
  Clone ID: LIB3059-041-Q1-K1-H8
cgacccaggcgtgcggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaagcggcggcggtgggtacggtggt

SEQ ID NO: 31291 - DNA, 229 bp, Zea mays
  Clone ID: LIB3059-042-Q1-K1-A1
aaagcagcgacccgagagatggaccccagggtggtccggcttgaaaaccccccggtgggcgggcttgattaactggttgaccttccccaacggcaacaaggcggccggcgggccaaccgcaactacgtccgcgacgcgcgccgcatggcggccaccccggccgacgtcaaggagctcggcggagcgtacgcgttcgtggtggacatgcccgggctgagcacgggcgaca

SEQ ID NO: 31292 - DNA, 412 bp, Zea mays
  unsure at all n locations
  Clone ID: LIB3059-042-Q1-K1-A10
gccaagcttgccgagcaggcggagcggtacgacgatatggtggaattcatgaagaatcttgctaggatggacgcggatatgactgctgaagaaaggcatttgttctcagttggtttcaagaacactattggagcaaagagagcatcatggagaatcatttgctcacatgagcaaaaggtcgcagctgatcgtcagactggtgtgatgatagatgcctatatgaagaaagttgaagaggaactaaggaaggttcgcaatgaagtattgtcagtcattgctattcactgccttaccttgtccagtacggntgaaaatatcggattcttttataagatgaaaggtgactactaccgttacttggctgaatttatcactggaactganaagaaagctgcctctgatcagtcactta

SEQ ID NO: 31293 - DNA, 258 bp, Zea mays
  Clone ID: LIB3059-042-Q1-K1-A12
gttccttatccgtagagtgtggcgaattcgagctccaacttcagtgggtccacctgcgtggctctaagggtgtatgagaagagttatgagcgctgcctagcttgcactgctcaggttcttcgcttcacattaaagtaatctatttgaactgtagttgtaatctatagagataaaagcagtgtaaaaatagtagaaatcgttatggattaaagacagtcgacccagctcttgctagttgaaaagaacccagctcttgcc

SEQ ID NO: 31294 - DNA, 410 bp, Zea mays
  unsure at all n locations
  Clone ID: LIB3059-042-Q1-K1-A2
gagganaccaacaggaagaattccagctctcaaaattgatttgctctgtaagtgaagttggacggattcatcatatgtgccccctgagtggtagttcagttagcatcttagaaatgtatatgatcaacaaaaccaaaccaatccaaaccaaatcatcttcccaaagagttgaggaactgcaaatgatcaactctgagaccttaaaggccagaattatcaactctgagactttgaaagcaagaatggggcaactgttggttaccacggacatggatgttaaagtagaacccagttgactttgcaatgtacacatttcttgtatcggctcttcatttacgtctgtattatcgcttttatgattggatgatgatgttattcttgagagatgttcggtgtgtttgggggcgctt

SEQ ID NO: 31295 - DNA, 381 bp, Zea mays
  unsure at all n locations
  Clone ID: LIB3059-042-Q1-K1-A3
gcgacatagaaagcacaattgtggtccctcaatggcaggccaaataatttggtttcctgatgctcctgggtctttctgcaagtgctgctaccgcgaccattttcccgcaatgctcacaagctcctatagcttcccttcttcccccatacctctcatcagcggtgtcttcagtatgtgaaaacccaattcttcaaccctacaggatccaacaggcaatcgcagcaggcatcttacctttatcacccttgttcctccaacaaccgtcatccctattacagcagttacctttggtgcatttgttggcacanaacatcagggcacaacaactacaacaacttgtgctagcaaaccttgctgcctactctcagcaacagcagtttc

SEQ ID NO: 31296 - DNA, 415 bp, Zea mays
  Clone ID: LIB3059-041-Q1-K1-G8
cccacgcgtccgcgcggagcaggtgcatcagcacttcgctctgcgctctggcgttactgctcgcaataccagcagcagcagcaccgtgccaacgaggctttgctcccgcgcgtgcgcgcgcgcgctcgtgatggcagcagccccggccgcgtcgtcgtccacgtccgggtcgccggccgccggcgggccgcggtagaggatcgtcgacacgacgctgacgaacgtgttcgtgggcgagatggcgtgggagacgctctcggaggggctccagcagcacttcgagcggtacggcgacatcctggaggccgacctcatcacggaccgcttcaccggccgctgcaagggctacggattcgagacgttcccggagccggacgcggtgcagcacgcggtgcaagacctgaacccgacgatc

SEQ ID NO: 31297 - DNA, 447 bp, Zea mays
  unsure at all n locations
  Clone ID: LIB3059-019-Q1-K1-G2
cccacgcgtccgcccacgcgtccgctactatactatactctaggaagcaaggacaccaccgncatggcagccaagatgcttgcattgttcgctctcctagctctttgtgcaagcgccactagtgcgacccatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtcttgccgagcatgatgtcgcaaatgatgatgccacaatgtcactgcgacgccgtctcgcagattatgctgcaacagcagttaccattcatg

SEQ ID NO: 31298 - DNA, 438 bp, Zea mays
  unsure at all n locations
  Clone ID: LIB3059-019-Q1-K1-G3
attctctgcatactggagaaacaggcaacatcgattctctgacctccctccacccaagcatggatggcattgaaggccaaacaacagtaaggaactcaccatttgtgcaacaagcagatgtcactatggtcgatggtcatgacaccaaggagcagacactcccttccacctctggcatgaccgattcttcgagcggcagcgcctcaagcgagcctactttcaaggggaacccaggacgtgccctcaaagaccgaagcagccctgcactgaccgtgaaagctacctacaatggcgacaccgtccggttcaagtttgtgccagcaaggggctggtaccacttgctggaagagatagcaaagaggttcaagctgacggctggagcattccagctcanatacaaggacgatgaggacgagtgggtgatcctggcgaacgatg

SEQ ID NO: 31299 - DNA, 431 bp, Zea mays
  Clone ID: LIB3059-019-Q1-K1-G5
gcactgcatccgcaccgtgctgcgcgacgaggggcctagcgccttcttcgtttcctacgggacaaccgtggtcatgaacgcaccctacacggccgtccactttgccacctacgaggcggccaagcggatgctcggggacatggccgccgaggaggagtcccttgccgtacacgccactgctggggccgcagcaggggcacttgccgctgcggtcaccactcccctcgatgttgtgaagacgcagctacagtgccagggtgtgtgcggctgtgaacgcttctcaagcagctcaataggagacgtgtttagaacaatcataaagcgagatgggtattccgggctcatgaggggatggaagccaagaatgctgttccatgcacctgcagctgcaatatgttggtctacatacgaggccctaaaagtcatttttc

SEQ ID NO: 31300 - DNA, 446 bp, Zea mays
  unsure at all n locations
  Clone ID: LIB3059-019-Q1-K1-G6
cggacgcgtgggtacaggcttacttcgcagcaaatgctgctgctcaggcctcgaggagatcctcaccccgtgtgaccaatgaagaagtccagaaggctgctgctgctctcaagggctctgaccaccgccgtgcgaccaacgttagtgctagattggatgcccagcagaagaagcttaacctccccatccttcccaccactacaatcggttcgttcccacaaaccgttgagctcaggagggtccgccgtgagtacaaggcaaaaaagatctctgaggaggaatacgtcactgccatcaaggaggaaatcaacaaggtcgttaagctccaagaagagcttgacattgatgtgcttgtgcatggcgagcctgagagaaacgatatggttgagtacttcggtgagcagctctccggttntgcgttcactgccaatggctgggtgcagtct

SEQ ID NO: 31301 - DNA, 387 bp, Zea mays
  Clone ID: LIB3059-019-Q1-K1-G7
gttcgtgaggttctccggcgttcggcttcgtgggtgagcggatcgagatggcggcgtcggatgttgagtaccgatgcttcgtcagcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggacgcgatgcggaacgccatcgagggcatgaacggcaaggagctggacggccgcaacatcaccgtcaacgaggcccagtcccgcggcggccgtggaggccgccgcagtgggtaccgtggtggcacgtggaggcggcggctacggccgtggcgggcgccgtgat

SEQ ID NO: 31302 - DNA, 446 bp, Zea mays
  unsure at all n locations
  Clone ID: LIB3059-019-Q1-K1-G8
cgatgagtgcacacgacggcttgccaaattgggccttgagtatgtggggaagcacacgcatgatagcttgttgtttaaccactacgaggtctggtttgaattccgcaggccaaaagtttagatcttgatggtacagaaagagagagtggttggcttctgtgatgcaattttggcagtttcaagcacagattaagccatgccttgtactgtttgaacactactgggacctgacttgagattgagattgatgttcgctcggtgcctaattcaagcatatgcatatacaccaaaagtcatgattgagcaatgctgtggtgcttcagtgtggtcttcccagtttcattcggtgagtggtggatgaaggctntaagttttattagcaccgattactgtatgttctataacttcagtaacatttctggtagaaactatgtgggtagctgatg

SEQ ID NO: 31303 - DNA, 421 bp, Zea mays; identical to SEQ ID NO: 30937
  Clone ID: LIB3059-019-Q1-K1-G9

SEQ ID NO: 31304 - DNA, 431 bp, Zea mays
  Clone ID: LIB3059-019-Q1-K1-H10
ggaactacctcaacttcgacctcagcaggctggtgttcccgccggagctcacgtacctggacctgtcccacaacctcatccgcggcaccgtgccgctgtcgctggagcgcctgtccacgctgcagaagctggacctcagctacaaccgcctgtgcggcccgctccccaagggccacggcgtcatcaagcacgggtgcaagccgtacgcgcacaaccagtgcagcaaagggaccccgctcgcgggatgccaggacctggagtgagtgagccggtggccatggttttctatactctgctctgctctccctcgccggcgttcttttcgtgtcccaatcttgaaggacgacggtacggtgcctggtttagctatagacaaaaaaaggtacggccgcgtggtggcggtgctaatatgcttagccacgcccacgcgc

SEQ ID NO: 31305 - DNA, 415 bp, Zea mays
  unsure at all n locations
  Clone ID: LIB3059-019-Q1-K1-H11
ctctgttggcgatcctagttctccaggcccttctggtctctacggccgtggccaaaggacctgcagggccgaagaagcagtgctggtgcggcgagtgcaccagctggtcgggcgtgtggacctgcgacgacctcctcaccaagtgcgccgccacctgcaagaactgcgtccccgtctccacggacaagggcgccaccaagtacagatgccgcgacttcctccccgaaaactgcggctgcaagatccactagactcatccacagcggcacagccgatggatccttccatgctcctacgtccgtccgccttgctacaagcaggcagccaccaataagctagctcttgttgnntgtttgcatgtttgattgggtgtcccttcccagtcgagatggaataatgtcaggcgcacgtacag

SEQ ID NO: 31306 - DNA, 417 bp, Zea mays
  Clone ID: LIB3059-019-Q1-K1-H12
ctacgaccgcctctctcttgcgtcggcaacagcagcgcagccagtagcccagtactcgttgctccacgccgccgctcaaaaccggcagaagtaagaacggggagggaagcacgccccaaacgttccgaggtttcgcctctcggagcgcaccaacgccacccggagcgactcgccaccggcgcggagaaggagggcggaggctaggcgatggcggacgagaatgaggctgggaagaaagaggaagaggaatttagcacaggccctctgtcagtactaatgatgagtgttaagaacaacacccaggttctcatcaattgccgcaacaacaagaagctgcttggccgggttcgtgcttttgatcgccactgtaacatggtgcttgaaaacgtgcgggagatgtggacagaggtccccaag

SEQ ID NO: 31307 - DNA, 420 bp, Zea mays
  Clone ID: LIB3059-019-Q1-K1-H3
caagctcctatagcttcccttcttcccccgtacctctcaccagtgttgtcttcagtatgtgaaaacccaattcttcaaccctacaggatccaacatgcaattgcatcaggcatcttacctttatcacccttgttcctccaacaatcatcagccctattacagcagttacctttggtgcatttattggcacaaaacatcagggcacaacaactcgtgctagcaaaccttgctgcctactctcagcaacaacagttacctttggtgcatttgttggcacaaaacatcaaggcacaacaactacaacaactcgtgctagcaaaccttgctgcctactctcagcaacaacagtttctgccattcaaccaactagctgcattgaactctgctgcttatttgcaacaacaactagtactaccattc

SEQ ID NO: 31308 - DNA, 307 bp, Zea mays
  Clone ID: LIB3059-019-Q1-K1-H4
accggtgcggaatatccaggctgtgacccacgttgctttgagagacctagcggcctactaccaacaacacatcattggtggtgcccgcttttagagtgcttattagttgtaattcaataataaagttttttggatgatgtatgtggccaaccagaaataagaagttacatttccagattttaatgtgatattggtctccaagggtgttcgataattacttttcctaagattgggagtaacaagctttaaatcaaaagataaataatataaaaaacaaacaagataaaattgatgcatatgaaggcac

SEQ ID NO: 31309 - DNA, 425 bp, Zea mays
  unsure at all n locations
  Clone ID: LIB3059-019-Q1-K1-H5
gtttgattctgcaaaagctatggccttcagcaatgtgcctactcgtgattggattaaggatgccatctttaagactctgattgcaaatggaatgttcaataatgctcatataaggctcacgctcacccgtgggaaaaaggtgacatctggaatgagtccagctttcaatctttatgggtgtgccttgattgtgcttgcagagtggaaaccaccagtttatgataactctcatgggataaaattggttactgccaccacacgtcgaaattctccaaatagtatagattccaagatacatcacaacaatcttatcaacaatattctggcaaagatagaaggtaatcttgcccaggctgaggatgccattatgctagataaggatggctttgtatcagaaacanacgcaacanatatttttatggtca

SEQ ID NO: 31310 - DNA, 423 bp, Zea mays
  Clone ID: LIB3059-019-Q1-K1-G12
cggacgcgtggggtggtgaaccctgccgcctacctacaacagcaacaactgatttcatgtagccctctcgctgtggttaatgcacctacatacctgcaacaacagttgctgcaacagattgtaccagctctgactcagctagctgtggcaaaccctgctgcctacttgcaacagctgcttccattcaaccaactgactgtgtcgaactctgctgcgtacctacaacagcgacaacagttacttaatccactagcggtggctaacccattggtcgttgccttcctacagcagcaacaattgctgccatacaaccagttctctttgatgaaccctgccttgttgtggcagcaacccatcgttggaggtgccatcttttagattacatatgagatgtactcgataatggtgccctcatagccgcat

SEQ ID NO: 31311 - DNA, 423 bp, Zea mays
  Clone ID: LIB3059-019-Q1-K1-E9
gagacgcattctatgagagttgagaccttcttcctgatctatgctatacatgatgcagggaaatatgcataccttgcatcaatgggcatttatgtcttcaagaaagatgcacttttagaccttctcaagtcaaaatatactcaattacatgactttggatctgaaatcctcccaagagctgtactagatcatagtgtgcaagcatgcatttttacgggctattgggaggatgttggaacaatcaaatcattctttgatgcaaacttggccctcactgagcagccttcctagtttgatttttacgatccaatgacacctttcttcactgcaccccgatgcttgcctccgacgcaattggacaagtgcaagatgaaatatgcatgtatcttacatggctgcttactgagagaatgcaacattgag

SEQ ID NO: 31312 - DNA, 413 bp, Zea mays
  unsure at all n locations
  Clone ID: LIB3059-019-Q1-K1-F10
caaattgcaccaagaaatccatcgagaggccgtcgacaggggaattaatggcgtcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgnctagaggacctgccgggctgcccgcgggaggtgcagaggggattc

SEQ ID NO: 31313 - DNA, 380 bp, Zea mays
  Clone ID: LIB3059-019-Q1-K1-F11
gagatcgcccaggacttcaagaccgacctccgcttccagagctccgccgtcgccgcgctgcaggaggcgtccgaggcctacctcgtcgggctcttcgaggacaccaacctctgcgccattcacgccaagcgcgtcaccatcatgcccaaggacatccagctcgcccgccgtatccgtggggagagggcctaggcgtcgtcccggtggaggtggaagtagtagtggccgtttctgtcatcactgtctggctagaaggtgtagagatgtgccgggttctgtagtttgggttatcggtcaaatcatgatgtagttgggtctaccctgctgtaatttaactatgactatgcaatggcaatgaagttctcggttatcagttcccg

SEQ ID NO: 31314 - DNA, 429 bp, Zea mays
  Clone ID: LIB3059-019-Q1-K1-F12
gcccttgaagcccatgcagctcccaactgcaaggttctggtggttgccaacccagcatacaccaatgctcttatcttgaaagaatttgctccatctattccagagaagaacgttacttgcctgacccgtctggaccacaacagggctcttggccagatttctgagagacttaatgtccaagttagtgatgtgaagaatgttatcatctggggtaaccactcgtcctctcagtaccctgatgttaaccatgccacagtgaagacttccactggggagaagcctgttcgtgagcttgtctctgatgacgagtggcttaatggtgaattcatcacaactgtccaacagcgtggtgctgcaatcattaaagcgagaaagttctccagtgctctctcggctgctagctctgcttgtgaccacattcgtgattgg

SEQ ID NO: 31315 - DNA, 379 bp, Zea mays
  Clone ID: LIB3059-019-Q1-K1-F2
caggaggcccggatcctggtatgcgcttacctgccccctctctctgtctcgtggttctgctgaacgagcactcgcctgcgctcttctctctctcgtggcgacgactgggtgaccgccggcgccccaggcctgaggcctccatcttcgggcccttcactggctacgagcaccaccagaggattatggattggctggggcagaagcgcgcggagatgctgatgcaggtgctgctggtggcgtctgctgtggcggcgttcctggtgggctacgtgcgcgcggacttccagctcatgctgctcgtctacgccggcggcgtcgtgctcacagcgctcgtcaccgtccccaactggcccttcttcaaccgtaacccgctcaagtg

SEQ ID NO: 31316 - DNA, 437 bp, Zea mays
  Clone ID: LIB3059-019-Q1-K1-F3
gaacagttatggcaactgacatgtctcaccgcctggggtggatagatgactccatcagagaacgtgtggttgacatactaaagcaagccaaacttcccattgcacctcctgagaccatgaccgtagagaagtttaaaaacatcatggctgttgacaagaaggttgctgatggtctgttgagactcatccttctgaaaggaccactagggtgctgtgtatttacgggggattatgaggggaatgcactcgatgaaaccctacatgcattctgcgacaactgagaacatcccagttttggacatcacttctgtatgctagtactaggctatgtatcaatcagagaaaatattgtggtgtacattatcttcactgcctcattggtatatttttgtcagaaataatggtatattggtttaagtgctggtttgagtttgtag

SEQ ID NO: 31317 - DNA, 408 bp, Zea mays
  Clone ID: LIB3059-019-Q1-K1-F4
gagcacactaagcgaagcgcactagctcaacctaacaacaatggctaccaagatatggtccctccttgcgcttcttgcgctttttgcgagcgcaacaaatgcgtgcattatttcacaatgctcactagctgctagttccattattccacagttcataccaccagttacttcaatggccttcgaacacccagctgtgcaagcctataggctacaacaagcgattgcagcgagcgtcttacaacaaccaattgcccaattgcgacaacaatccttggcacatttaacaatgcaaaccatcggaacgcaacagcgacaacagttactaccagcactgatccacctagccatggtgaaccctgtcgcctacttgcaacagcatctgcttgcatccaacccacttgctctagc

SEQ ID NO: 31318 - DNA, 400 bp, Zea mays
  Clone ID: LIB3059-019-Q1-K1-F6
ccgactcgtgcgctcactcttgctattttctacaaaccacaatagtcgaggatcaatggcaccaacgatatgctgcttactgatgctgatacctctctatcgaagtgctgcttatgcacacactctggaacggtgcttactaattcgcactgccttacaacatgactcatcactattacctcaagacagttaccaccgagaaggacgagatgattaccattgctggaaacaacggccagacgccgtcgtaaattgatgttcaactcccttaccagtacaacatccagcttgccaagaacatgacttgtatcaagatccttcggaatctcaaagcacattggttgacccacggacatccactaggacctctactacctcattaataatgtcattacgatta

SEQ ID NO: 31319 - DNA, 431 bp, Zea mays
  Clone ID: LIB3059-019-Q1-K1-F7
atcggatccagtcttctcccgggatctcctccggctataaatttccggccccaattcacccaatccagatgcgcaaacatcgaatcgtctcgctcgtggctgccctactcgtgctgcttgccctcgccgccgtttcctccacgcgcagcgcacaaaaggagtccgtggctgacaacgccgggatgttggcaggcggcatcaaggacgtgccggcgaacgagaacgacctccagctccaggagctcgcgcgcttcgccgtcaatgagcacaaccaaaaggccaatgctcttctggggttcgagaagcttgtgaaggccaagacacaagttgttgctggcacgatgtactatctcactattgaagtgaaggatggcgtagtcaagaagctttatgaagctaaggtctgggagaagccatgggagaacttcaag

SEQ ID NO: 31320 - DNA, 275 bp, Zea mays
  Clone ID: LIB3059-019-Q1-K1-F8
aacacgcgtacgctgatagatcgcgatttgacgccaacgttttctattcgtgaaatggggaattatacattgccgatgatcactagcagatcccagcatgaatgcactatacagtttggatcattactatatcggcgtgtccataaagacagatcctagtaatcactgatactcccaggagctctactcatacataccgcgaaactatccagtgtagtcgcatctctgaagtcgacggccacaatcaaactggtattgaactcagatctatccat

SEQ ID NO: 31321 - DNA, 414 bp, Zea mays
  Clone ID: LIB3059-019-Q1-K1-F9
gcgccgctgacgtcaagggggtcccagcagtaccgcgccctgaccgtcccggagctgacccagcagatgtgggacgcgaagaacatgatgtgcgcggctgacccgcggcacgggcgctacctgacggcgtcggccatgttccgcgggaagatgagcaccaaggaggtggacgagcagatgctgaacgtgcagaacaagaactcgtcctacttcgtggagtggatcccgaacaacgtgaagtcgagcgtgtgcgacatcccccccacgggcctggcgatggcgtccacgttcgtcggcaactccacctcgatccaggagatgttccggcgcgtcagcgagcagttcacggccatgttccggcgcaaggccttcctgcactggtacaccggggagggcatggacgagatggagttc

SEQ ID NO: 31322 - DNA, 446 bp, Zea mays
  unsure at all n locations
  Clone ID: LIB3059-019-Q1-K1-G1
cccggtcgaccagcgttcgcgagcgtncggcacgcgtccgccatgcgttcgttctatgtctgaatacctcatgggtgaagaggttccagatgctgatattgctgttgtccgtgtcaccatcttcagtcgaccctaatgccacttatatgtggatgtctttgactctagtgaagacttcatatacctaatgcacacacttgctgacttcgaagcagctacaaagcttctgacacttgcaaaggttacattctgttatgatgcgctacatggtggtgctggagcttatgccaaacacatctttgatgaaaaacttgatgctgactaaaagctaactgaccaattgtgatccagaacatgactttggaagtggtcatgcggatcctaaccttacctatgctcaagactcggttgaactgatacgtcttggaaagtcattctcaaatgtt

SEQ ID NO: 31323 - DNA, 434 bp, Zea mays
  Clone ID: LIB3059-019-Q1-K1-G10
gccagcatcaaggagatgccggtggtgcaggacgggccgccgccgggcggtttcgcgcccgtgcgcttcgcccgccggatccccacctcggggcccagcgccaccgccatcttcctcaccaccttcggtgctttcgcatatggcatgtaccaggtcggccaggggaacaaggtccgccgggcgctcaaagaagagaaaattgctgctcgcagtgctatactgccgatgctccaagcagaagaggatgaaagatttgtcaaagagtggaagaagtgtcttgaggaggaggcgaggatcatgaaagacgttccagggtggaaggtcggcgagagcgtgtacaactctgggaaatggatgcccccggctactggtgagctccgccctgaggtttggtaagggcctgttgcaggcactgaatgccatcatgtcacggg

SEQ ID NO: 31324 - DNA, 361 bp, Zea mays
  Clone ID: LIB3059-019-Q1-K1-G11
cagctcactagtgctcagccgccgcaattaggggggcaggtagctcgagcgcgcgctccacctgcgccgacgcgatgcgggccaagtggaagaagaagaggatgccgatgctcaagaggaagcgccggaaaatgaggctgagatctaagtaggcgcatcttgtgaccgaggatggcgagcttctcctgcaccatggctgtgacgcgttgggatgattggctacctttgtagacgtgctttgctgtagacgtaggcgatgtaaaccgtgctttttgatcaattctagtatgttctgagactgggtttatattgtaatctgaggataatcatatgatgctataaggttatcgatattactgtc

SEQ ID NO: 31325 - DNA, 402 bp, Zea mays
  Clone ID: LIB3059-019-Q1-K1-E8
cggacgcgtgggtgaagcggctctaccgtcgcgcgaccgggcggcgtccgggcgcgggcgtgggccccgtggcgacgctgctcatcgggtccgcggcgggcgccatcgccagctcggccacgttcccgctagaggtggcccgcaagcagatgcaggtgggcgctgtgggcggtaggcacgtgtaccagaacgtcctccacgctatctactgcatcctcaagaaggagggcgccggcggcctgtaccgaggtctcggacctagctgcatcaagctcatgcccgccgtcggcatcgacttcatgtgctacgaggcgtgcaagaagatcctcgtcgacaaggacgatgaggaggaggaggacgaagccggcggcggagaggatgacaagaaaaaggttgaatgat

SEQ ID NO: 31326 - DNA, 440 bp, Zea mays
  Clone ID: LIB3059-019-Q1-K1-D3
gaaggttcacgttgaggctgaccagattgtcgcttggttgaaggagtactttgacagcggattgacgccgttcatgaagtctgagcctattcctgacgtcaacaatgagcctgttaaggtggttgtcgatgacaacgtccactacttcgtcttcaaatctggcaaaaatgtccttattgaattctatgccccctggtgcggacactgcaagaagctggcgcccatcttggacgaggcagccaccactcttcagagcgacgaggaagtcgtgattgctaaaatggacgcgactgccaatgacgttcccagtgagtttgacgtccaaggctactcgaccttgtacttcgtgaccccgagcgggaaggtgacatcctacgacagcggcaggacggcggacgacatgcgcgacttcatcaagaagagcaaggagaccgcatgcc

SEQ ID NO: 31327 - DNA, 448 bp, Zea mays
  Clone ID: LIB3059-019-Q1-K1-D4
gtcactcgcagctggcatcttaccctttttaacctttttccttccaccattatcaaccgggataccggcatttcccttgggtccattaattgccccaaaacataagggcacaacaactacaacaacttgtgctagcaaaccttgctgcctactctcagcaacagcagtttcttccattcaaccaactagctgcattgaactctgcttcttatttgcaacaacaacaactaccatttcagccagctatctgctgcctaccctcagcaatttcttccattcaaccaactgacagcattgaactctcctgcttatttacagcagcaacaactactaccattcagccagctagctggtgtgagccctgctaccttattgacacaaccacagttgttgccgttctaccagcacgctgcgcctaacgctggcaccctcttacaactgcaacaat

SEQ ID NO: 31328 - DNA, 422 bp, Zea mays
  Clone ID: LIB3059-019-Q1-K1-D5
aacaattcctaccagcactgagccacctagccatggtgaaccctgccgcctacttgcagcagcagttgcttgcatcaaacccacttgctctggcaaacgtagttgcaaaccagccacaacaacagctgcaacagtttctgccagcgctcagtcaactagccatggtgaaccctgccgcctacctacaacagcaacaactgctttcatctagcccgctcgctgtggccaatgcacctacatacctgcaacaacaattgttgcaacagattgtaccagctctgactcagctagttgtggcaaaccctgctgcctacttgcaacagctgcttccattcaaccaactgactatgtcgaactctgctgcgtacctacaacagcgacaacagttacttaatccactagcagtggctaacccattggtc

SEQ ID NO: 31329 - DNA, 366 bp, Zea mays
  Clone ID: LIB3059-019-Q1-K1-D6
cccacgcgtccgctagcctagtggttattgacttccaagtagcacctccaagtcctgggttcgattcccctcgggagcgaattttcaggcttggttaaaaaaatcccctcgctgtgccccatccgctctcaggttacgatgtcctgtgcgccaccctccggttgggccgttgcagagtggacagttgacgccggcccgttagtgatggggggccagggttcggggattttctcggccgggaccattgtttcggtctcttcttaatataataccgggagggcggtctttccctccccggccgagtttttagtactataaagtaaaaattaaagaaaaacaacatacacacgaatgacatggacgaac

SEQ ID NO: 31330 - DNA, 435 bp, Zea mays
  Clone ID: LIB3059-019-Q1-K1-D8
cagacacatgggcagatccaggagtgtttcctgtattcgatgaataaacgagagatggggaaccatccatctttgatgaggaattcactcctagcagtgaggtacaaaagaacttggatgatgactatgatggcgattgcatgcaagaagacggtgaaattgagggagattctagctgctatcgtgttctatcaagcaaaacattagcatatgttgtggaagcacttattggtgtctattatgtagctggaggtaaaattgctacaaaccatctgatgaaatggatcgttattaatgcagagctggatcctcaagagatcccatcttcgaagccatataacatacctgagatcataattaaaagcatcaattttgacacattatagggtgcattgtgtatcactgcttagaataaaggcttacttgttgaagcta

SEQ ID NO: 31331 - DNA, 425 bp, Zea mays
  Clone ID: LIB3059-019-Q1-K1-D9
gcctcgcgcaggcaacagcacaagcgtttacgactactgcagcacaagcgcaggaaacgcctgcacggtggagcaagtagagaacctcaagtcagctctgagcgtgatgcccatgtggtcagccatggtgatgtcgttcctgctgcagagctcctcgttcggggtcctgcaggcagccaccatggaccgccgcgtctgcgcaacaaggttccagatacccgcgggctcgatctcggtcttcgagatcctgaccttcacggcgtggtcaagctgctacgacgcctgcatcgtgccagtcctccggaggatgacggagcggcagcgcgtgctgacgctgaagcagcgcatgggagtcggcgtgtccctggccgtcgcctccatggcggtggcatcggcggtggagacccatcggaggcagcacgccg

SEQ ID NO: 31332 - DNA, 436 bp, Zea mays
  Clone ID: LIB3059-019-Q1-K1-E11
ccacgcgtacggagaaccctgtcgactacttgcaacagttaggtgctatcatccaacccacttgctatggcgaacatgggtgaataccaacaacaacaacaattgcaacaggttctgccagcgctcagtcaactagccatggtgaaccctgccgtctacctacaacagcaacaactgctttcatctagccctctcgttgtgggtaatgcacctacatacctgcaacaacaattgctgcaacagattgtaccagctctgactcagctagctgtggcaaaccctgctgcctacttgcaacagctgcttccattcaaccaactgactgtgtcgaactctgctgcgtacctacaacagcgacaacagttacttaatccactagcagtgcctaacccattggtcactgccttcctacagcagcaacaattgctaccataca

SEQ ID NO: 31333 - DNA, 414 bp, Zea mays
  Clone ID: LIB3059-019-Q1-K1-E12
cggacgcgtgggcggttccgcacgacggcacgagtcatcgtcgccttcccctccctcgacacgccaaacgcgaactcccgtgccgtgacctcccgatctcaggcgatggccgcgcggcgcctcggatcccccgcctctaggtggctgcggccgtccgcgctgctcctcctggtcgcttctgctctcctctcggccccgtcgccggcccgcgcgctgcggttcgacctcgagtccggccacaccaagtgcatctccgacgagatcaaggttaacgccatggccgtcggcaagtaccacatcgtcagccccgaccccaacttccccgatgcccagctccccgaatcgcaccgcatctccctcagggtgacgtcgccgtacgggaacagcatgcactacgcggagaacgtgcagtcg

SEQ ID NO: 31334 - DNA, 423 bp, Zea mays
  Clone ID: LIB3059-019-Q1-K1-E2
cacatggttatgacatcattaactgggaagagacatttaacaactttggagacaagctggatcgcaaaacagtggtgcataactggcttggaagtggagttgcagagaaagtggttgctgctggtttgagatgcatcgtaagcaaccaggataagtggtacctagatcacttggatgctacatgggaaggattttacacgaatgaaccactgacaaatatctacaacccggagcagcagaaattggtacttggtggtgaggtatgcatgtggggcgaacacattgatgcatcagacattcagcagacaatttggccacgtgctgcagcagctgcagagcggctatggacaccaattgagaagctggcgaaggacacaagatcggtcactgcaagattggcacgcttcaagtgcttgctgaatc

SEQ ID NO: 31335 - DNA, 439 bp, Zea mays
  Clone ID: LIB3059-019-Q1-K1-E3
caggacgagaacccgccagatgacccatcaacgatagtaggcgagccagactcgattgcaatgctgcataagatcgcaggcaaagtgtccagccagctgaagaaggaggagggcgctgaggtggtcgcggagcaggcgtgctacctgccgtgcaccgccgacgggctgccggtcatcggggagataccaggcgtgaaagggtgctatgtggccacgggccacagctgctggggtatcctcaatggtccggccaccggcgcagccctcgccgagctcatcctggacggcaagtccaagatcgttgatctcgagcctttcagcccggcaaggtttctcaagagaaggagcaggcgtggagtctgaccgtgtgaatgttcagattcaagctcgctactgaataaaacactcttggttctcccgtttgcatgactgatgagtg

SEQ ID NO: 31336 - DNA, 420 bp, Zea mays
  Clone ID: LIB3059-019-Q1-K1-E5
cccacgcgtccgcccacgcgtccgagttccagcagttcggatcctgcggcgtcggcagggtcggcagcccgttcctgggccagtgcgtccagttcctgaggcaccagtgcagtccggcggcgacgccctacggctcgtcacagtgccaggcgctgcagcagcagtgctgtcaccagatcatgcaggcggagccgctgcaccggtaccaggcgacatacggtgtggtcctgcagtgcttcctgcagcagcagccgcagggcgagctcgcggcgctgatggcggcccaggtagcgcagcatctgactgcgatgtgcggtctgcagctgcagcagccagatccctgcccttgcaacgcagctgccggcggtgtctactactgaagaaactatgtactgtagtaataatgtaatggaacccgtg

SEQ ID NO: 31337 - DNA, 194 bp, Zea mays
  Clone ID: LIB3059-019-Q1-K1-E6
aacactcgtgctctaaagcatgatacttatatcattacgtagaccgttcgggtgctggggtcgcttaatatgccgtttgcacttgcagactacccacgaaatgcccacaacagtttggataattagttgaaccgctaatcgcacaatctgatcttaatataaacgcacactctcatatgctcaactacatacag

SEQ ID NO: 31338 - DNA, 317 bp, Zea mays
  Clone ID: LIB3059-019-Q1-K1-E7
aacgctcatactaggaagtgagccactttgaacaaaacgttgacagttctgagcgaccgggacgcctaagatgccgtcggcggaggcaagggcacgagggcgtggcctccaaagctctgatcgtcagttgatccgcgaatcggtctgtctgaactcagcatctactcacactctcacatgctcagctagtacagaccgccacatacacccctgtgtctgaaactcggcggttgtcttttagcttcccaatgcatgtgtagtctgatctctctatcatgaaaacgcgcatctcatttagaatgaactgcagttggaaa

SEQ ID NO: 31339 - DNA, 372 bp, Zea mays
  Clone ID: LIB3059-019-Q1-K1-D2
ctcttggcttaccagcatattacatactagcctcatctgaagcttcttctaatctatcgggctatgatggtatcaggtatggaggacaggtctcggcggatgacttgaatgagctttatggagagtcccgggctaatggttttggtcatgaggtcaaaatgagaattttgatgggaacctatgctctttctgctgggtactatgatgcatactacaaacgagcacaacaggtcaggacactggttaagcaaagcttcaaagatgctttggaaagatacgacattttaatctcaccagctgcgccgtcagcagcctacaagataggtgaaaagataaatgacccgttagccatgtatgcaggagatatcatga

SEQ ID NO: 31340 - DNA, 288 bp, Zea mays
  Clone ID: LIB3059-041-Q1-K1-F2
cggacgcgtgggaaaaaaaaaaaaaaataaaataaaaaaaaaaaaaaaaaaaaaaaaagaaaagtaaaaacaaaaaatttaaaaaaaaaaaataaaaataaaaaaaaaataaaataaaataaataaaatattaaaaaaaattaaataaaattaactaaaaataaatttaaaaaaataaaaattgattaaaatattaaaatatccaaactttaatcaaattgcataataatccaattttcaaaaactggattaatatttgaaaaagcctttaaaatatcaattttaaaa

SEQ ID NO: 31341 - DNA, 407 bp, Zea mays
  unsure at all n locations
  Clone ID: LIB3059-041-Q1-K1-F3
cgatcgacaccatgagggtgttgctcgttgccctcgctctcctggctctcgctgcgagcgccacctncacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcaaggaacctgcggcgttggcagcaacccgatcctgggccagtgcgtcgagtttctg

SEQ ID NO: 31342 - DNA, 400 bp, Zea mays
  Clone ID: LIB3059-041-Q1-K1-F4
cccacgcgtccgcggacgcgtgggcggacgcgttggataggcttcaacaagcaatcgggacaggcaacatacctttatcgcccttgttgtttcaacaatcgccagccctatctttggtgcagtcattggtacaaaccatcagggcacaacagctgcagcaactcgtgctacctctgatcaaccaagtagctctggcaaacctttctccctactctcagcaacaacaatttcttccattcaaccaactgtctacactgaaccctgctgcttatttgcagcaacaactattaccatttagccagctagctactgcctactctcaacaacaacaacttcttccatttaaccaattggccgcactgaaccccgctgcttatttgcagcagcaaatactactacc

SEQ ID NO: 31343 - DNA, 396 bp, Zea mays
  Clone ID: LIB3059-041-Q1-K1-F5
attgaagatctggaggccttcctactcgagaaaaagattatcactcgaggtggcacaaggtttggagtggatgcaagggctgtcagagttagtatggttgacacagaccaagccttcaatgtgttcatcaatcgtctggccacaatgaagtgaaatttcagtgcaaattaataaagcactttgtggctactacaaggatgaccgcgttctagatggaacaatcgatgctttggaaagcttaataatgttttatgttgttgaataattccgtgtgttttcgggtatgttgtgtaatactcaatgtcaaatcctatgcttaatcgatgttgtggtccatcctgttatcagcatggccaattatatatggatgaccgtcactgctcagtctttactcct

SEQ ID NO: 31344 - DNA, 61 bp, Zea mays
  Clone ID: LIB3059-041-Q1-K1-F6
cggacgcgtgggaaaaaaaaaaaaaaaaaaaaaaaaaaaaaaaaaaaaaaaaaggaagggg

SEQ ID NO: 31345 - DNA, 430 bp, Zea mays
  Clone ID: LIB3059-041-Q1-K1-F7
aacactggtgaaaaagacaacatgatgcagagtttcttcctggcagagacgctgaagggcctgtacctacttttctcccctccatcagtcatatccttcgacgagtgggttttcaatactgaagctcacccattgagaattgttccagtaaatgataacaaaggcattggaacaccggtccgacaattcgggagaaaacagggaaagcctgagtaaccttggatatagagcagtggatttttgaatccgccgtctgattctgacctccctgttgatgtgttctgacacgagggaactttctgcctgaagcagtaagggatagaagtcacggcgatagattgtttagagcaaaaatcataggtagaggatgatgttatatgcggggcagtgacctccgtgaggtcaagagccccatagaagcttttatctt

SEQ ID NO: 31346 - DNA, 424 bp, Zea mays
  Clone ID: LIB3059-041-Q1-K1-F8
ccagatctatcaccttgcttgccctgcttcaccaatcttctacaagcacaatgctgttgagaccatcaagacaaatgttattggtaccctgaacatgctgggacttgcaaagagagttggagctaggattttgttgacatcaacatctgaagtttatggtgatccacttgagcatcctcaaaccgaggcctactggggcaatgttaacccaattggagtcaggagttgttatgatgagggtaagcgtgtagcagagacgctgatgttcgactatcacaggcagcatggcattgaaatccgaattgccaggattttcaacacctatgggccaaggatgaacattgacgatggccgtgttgttagcaacttcattgctcaagctgtgcgtggcgaaccccttactgtccagaagccaggaacacag

SEQ ID NO: 31347 - DNA, 451 bp, Zea mays
  unsure at all n locations
  Clone ID: LIB3059-041-Q1-K1-F9
attacaacaacaatccttggcacatctaaccatacaaaccatcgcaacgcagcagcagcaagcactgagccacctagccgtggtgaaccctatcgcctacttgcaacaacagctgcttgcatccaacccacttgctttggcaaacgtagctgcataccaacaacaacaacagttgcaacagtttctaccagcgctcagtcaactagccatggtgaaccctatcgcctacctacaacagcaacaacttctttcatctagcccgctcgctatgggcaatgcacctacatacctgcaacaacagttgttgcaacaacagttgcttgaacaaattggaccaactcttactcaactagcttgggcaaaccctgctgnctacttgcacaactactttcattcacncaactgactgtgtcgaactctgctgcgtacctacaacagcgacaacagttac

SEQ ID NO: 31348 - DNA, 418 bp, Zea mays
  Clone ID: LIB3059-041-Q1-K1-G11
gcgacatagaaagtggaatccaatagcttcaacagagcaacaatggctaccgagatggtttccctacttatgctccttgctctttctgcatgtgttgctaacacgacaattatcccttaatgctcacaagcttctatacctacccttattccaccataccttccatcaatgatagcttcagtatgtgaaaacccagctcttcagccctatatgctccaacatgcaatcatagcaggcaacatacctttatcacccttgatgtcacaacaatcgccagccctatctatggtgcactcatagctacaaaccatcagggcacagcatctgcagcaactcatgctacctgtgatcaaccaagtagctgtggcaaacctattatgctactctgagcaacaacaaattcttccatttaaacaac

SEQ ID NO: 31349 - DNA, 417 bp, Zea mays
  Clone ID: LIB3059-041-Q1-K1-G2
gatcaacgtcgtgttccgcaggacggcgtgcaggtacgggggcaagaacatcgccttgcacgggaacgagggctccactagcttctggctctccctgctggtggagttcgaggacggcgacggcgacatcggatccatgcagctcaaacaggccaactcggcgcagtggcgagacatgcagcacgtctggggggccacgtggagcctcaccccgggcccgctcgtcgggcccttctccgtgcggctgacgaccctgtcgggcaagcagacgctcacggcccaggacgtcatccccaagaactgggcccccaaagccacctacacctcccgcctcaacttcgcgtagaggccttctgccttggcccgccgcgtatttatcgttctgtgcagtttgatgtcgcgtgaaggggataagct

SEQ ID NO: 31350 - DNA, 414 bp, Zea mays
  Clone ID: LIB3059-041-Q1-K1-G4
cggacgcgtgggttcagaaacacaccaagcgaagcacattagcaacaacctaacaacagtgggtaccaagatattatccctccttgcgcttcttgcgctttttgcgagcgcaacaaatgcgttcattattccacaatgctcacttgctccaagttccattattacacagttcctcccaccagttacttcaatgggcttcgaacacccagctgtgcaagcctataggctacaacaagcaattgcggcgagcgtcttacaacaaccaatttcccagttgcaacaacaatccttggcacatctaacaatacaaaccatcgcaacgcaacagcaacaacaattcctaccagcactgagccacctagccatggtgaaccctgccgcctacttgcaacagcagttgcttgcatcaaaccc

SEQ ID NO: 31351 - DNA, 433 bp, Zea mays
  Clone ID: LIB3059-041-Q1-K1-G5
cgcgggtgcaggcctccaggggcacggcgatgggacagcacgactctcttctcggagggaacccaacaaaaaccctcgctcgcctcacttgttcgctcacctcggtgcggcgcgtcgttcggacacggagatacagcggcgattccggcgatggagtacgtgaaccccctcaccggcttccgcgtcgacggccgccgccccaacgagatgcggcaactcaagggcgaggtcggcgtcgttgcgcgcgcagacgggtcggcgctgttcgagatgggcaacaccagagtcatcgccgccgtctacggcccgcgagaggttcagaacaaaggtcagcaagtaaacagcaaggaggctttggttcgttgtgagtacaggatggcagagtttagtacaggagatcggaggagaaaaccgaagggtgacaggcgatcaa

SEQ ID NO: 31352 - DNA, 406 bp, Zea mays
  Clone ID: LIB3059-041-Q1-K1-G6
cggacgcgcgtctccggtcccgtccgtaataacactgatccgatccacgccgggcggggatggagctcatcaagtccagggcgaccgtgtgcgcgctcctcctggcgctgctcctgctctcacactacgacggcgggacgacgacgacgatggtggcggaggcccgggtgtgcatgggcaagagccagcaccactcgttcccctgcatctccgaccgcctctgcagcaacgagtgcgtcaaggaggacggcgggtggaccgccggctactgccacctccgctactgcaggtgccagaaggcgtgctaagcaaagctcttcaaacacccttggcttgccagaactgaactctagtagtactaagtaacacccttggctagctgtgcacaacctacgtaccgtgcatg

SEQ ID NO: 31353 - DNA, 344 bp, Zea mays
  Clone ID: LIB3059-041-Q1-K1-G7
cccacgcgtccgtccacgcgtccgaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaataaaaaaaaaaaaaaatttaaaatatatttattttttttggtttaaaaaaaaaaataatttgggcacgttttaatgttttaaattttactttcattttatttcaattgtatattttttatttagtgtaacttaatttaattttattggcagtatttttaaaactccggtactggaaaaacctttggtttacctaatttattctctttagagaaaatccctttt

SEQ ID NO: 31354 - DNA, 417 bp, Zea mays
  unsure at all n locations
  Clone ID: LIB3059-041-Q1-K1-F12
cccacgcgtccgcccacgcgtccgcccacgcgtccgcccacgcgtccgcgggcgcggggggaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttccattcttcccccataccttgcatcaatgatagcttcagtatgtgaaaacccagctcttcaaccctataagctccaacaagcaatcgcagcacgcaacatacctttatcaccctcgattcaacaatcgtcagccctatctttggtgcagtcattggtacanaccatcagggcacagcagctgcagcaactcgtgctacctgtgatc

SEQ ID NO: 31355 - DNA, 402 bp, Zea mays
  Clone ID: LIB3059-041-Q1-K1-D8
ggcttctcctccccctccggttcgggttcgggttcgtgaggttctccggggttcggtgtcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaagcggcggctacggcggt

SEQ ID NO: 31356 - DNA, 386 bp, Zea mays
  Clone ID: LIB3059-041-Q1-K1-D9
cctggctctcgctgcgagcgccacctccacgcatacaagcggcagctgcggctgccagccaccgccgccggttcatctaccgccgccggtgcatctgccacctccggttcacctgccacctcctgtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcggcgttggcagcaccccgatcctgggccagtgcgtcgagttcctgaggcatcagtgcagcccga

SEQ ID NO: 31357 - DNA, 416 bp, Zea mays
  unsure at all n locations
  Clone ID: LIB3059-041-Q1-K1-E1
accatccttagtgaatctatatcttcaaagaatcgtagcacaacaactaccacaaccagtgggttcaacaattaaaccagtagttgcagcgaaccttgatgcttaccttcagcaacaacaatttcttccattcaatcaactagctggngtgaaccctgctgcttacttgcaggcacaacagctactaccattcaaccaacttgtcaggagccctgctgccttcttactgcagcaacagttgttgccattccatctacaagttgtggcaaacattgctgctttcttgcaacaacaacaattgctgccattttacccacaggttgtgggaaacattaacgccttcttgcaacagcaacagttgctgccattctacccacaagatgtggcaaacaatgtcgccttcttacaacaacaac

SEQ ID NO: 31358 - DNA, 437 bp, Zea mays
  Clone ID: LIB3059-041-Q1-K1-E4
agcagggaaagaagcacaagaaaaatttggagaaattacaagactcaatcacccgtagaccagttataaagcccccaagcaatgtcatcggtccaagtatgccacctgttgctgtatccaactgtgtggtgccctctgtacagccgaagaagaagagcagctcagcagcaacccgggaagatctggaggtgaagaagaggcgagtccttgaggctggagcagcgcagggcgaagtaaaaatctgccaagtgtgcaatgttgtagtgaacagccaaaaagtgtacgagttccatattgcggggcagaagcaccaggccttggtacgtaagcagcaaccgctacgttttgtcacatgatgcagagccattttgctcgtcgtctttcgtctggcctcatgcttgtccggaagttcctctggaacgagaactcacaacatt

SEQ ID NO: 31359 - DNA, 395 bp, Zea mays
  Clone ID: LIB3059-041-Q1-K1-E5
cgcaaattgcaccaagaaatccatcgagaggccgtcgacaggggaattaatggcgtcggcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgcctagaggacctgccgggctggccgc

SEQ ID NO: 31360 - DNA, 433 bp, Zea mays
  Clone ID: LIB3059-041-Q1-K1-E6
aaccgagttccccagtactccgcagtccgcacggccgcatccgtcaagatccgcgaagagcaacgaggcgaggcgaggggagggaaaacaagtgagtgagagagagagagagaggagggaaaatgctgcgccacgccgcccgccgcctcgtttcccgcgccgtcgctccgcccaccgcgcgccgggcgctcgccacggcggaggtgcccgcggaggccgtcgaggactccacgttcgtcgaggcctggaaaaaggtcgcccccaacatcgagcccccagcgacgcccctctccctcatgcagccgcgcccgcccacgccagctaccatccctaccaagctcaccgtcaacttcgtcctcccctacaagtccgagatcgccaacaaggaggttgacatggtaattgtaccagctacaactggtcaaatgggtgt

SEQ ID NO: 31361 - DNA, 408 bp, Zea mays
  Clone ID: LIB3059-041-Q1-K1-E8
cggacgcgtgggttgagattgagaagcatcctatccaagtaactgaagttgcagttgtggacaaatcggtcatcgaagaggagctgcccaagggtcatgctgagacctcaaatgttttgcaagaggcctttgatgatgacatagacgattggttcgaggaggctgatcttgctggccacccaactatccacataggtgacgaggaagacgtgtcttttagtgacttggaagaggatgacgtgaaatgatttatagttgcaattgcaatttgcaaagggagaaatcgacctgtgtattggaaactggacacctctgctgtaaaagaaaatggaggtgaaagttgttcgtagacacctctgctgtgcaagaaaatggagaggtgaaagtttttcgtgaatgggaatgggt

SEQ ID NO: 31362 - DNA, 390 bp, Zea mays
  Clone ID: LIB3059-041-Q1-K1-E9
cggacgcgtgggcgctcctcaactggctgcggagcttgttttttaagccaggcatggagctctccctggatgggttgcagaatgctgggaagacattgctggtcaatgctgttgctacaggtggctacagtgaggacatgattccaaccgtaggcttcaatatgcggaaaatcaccaaggggaatgtcacaattaaactttgggatcttggtgggcaacgaagattccgcactatgtgggagcgctactgccgtggagtttctgctattctatatgctgtggacgctgcttaccgagatagcatcccaatagcgaaaagtgaattgcttggtctgctgacaaaacaatctttaactgggaatcccttggttggcctttgcaaccaaattg

SEQ ID NO: 31363 - DNA, 435 bp, Zea mays
  Clone ID: LIB3059-041-Q1-K1-F1
ccgacgcgtccgcatcgatcacacacactcatacgccgcgaatccacacgcatctccggctcgagtctccagttctccaccttgccagcgtctctccacgtacgccatggacgggtcggcgttcccgtcgctgtcgccggagctccgcgacgcgctcgccaaggtggccgtgttcgtgctcgtccaggggctggtctacctcatcctccgcagctcctccgacgtcttctccaaggacggccggctcaggtccctcagcttccgccccatgcgctccatgagcgtcaggcgcgtgctggcgccgctctccgacgtccccgtcggcacccaacaacgccctttccatcgttgtcgccccgccgcgacgtcgtcgcaccgcaaagctgcccgcgaggattgaaatggccgccacttctgggcagcttgcagttgcag

SEQ ID NO: 31364 - DNA, 413 bp, Zea mays
  Clone ID: LIB3059-041-Q1-K1-F10
cggacgcgtgggcgccgtcggatcctcctgccctccccacgtccacctctcgtccgggaagaatcggcggcggcggcggcggcggcgagcgccttcccttgtcaaaatccacccggcggcagagcagagcctcgttgctgaggaggggagatggcaggcatgaccgatatgccgatgaggccggcgcggccgggcccgccgatgcagcaccggggccctccgccgatggcgcgcctccgccccgaaccaatcgaccgcgagaagacctgccctctgctgctcagggttttcacaagggttgctggtcaccaccaaaatgaagagttttctgtgagagggaaagaaccaaaggatgaagttcagatttacacatggaaggatgccactctccgtgagcttactgatcttgtgaa

SEQ ID NO: 31365 - DNA, 388 bp, Zea mays
  Clone ID: LIB3059-041-Q1-K1-F11
cggctcttgggcacgcaacctccatctccccacgcttgcttgagcagcagcgctcgggcacgccggctgctactcccctgctcagccacgacaagccgtcgaccatgtgccgcgccctccctgctcgtcggccaccaggacggcgtctccacgcgccgagttcctcccatggctatcccaaaccctagccgagatcccctcctgtgttggccactgtctccttcaccaggcgtcctcccctatccacgtgctggcagcacatggcgagctcacccccctgtgccagacgagttcatcacttcccttagagcaacaccttcatccatggtgcccagctgctccttggagtctactgtggtgatctctaaatccctttggtggtttacta

SEQ ID NO: 31366 - DNA, 407 bp, Zea mays
  Clone ID: LIB3059-041-Q1-K1-D6
gcaacatagaaagcacaatagtgtaccaacaatggcagccaaaatattttgcttcctgatgctccttggtctttctgcaagtgctgctaccgcgaccattttcccgcaatgctcacaagctcctatagcttcccttcttcccccatacctctcatcagcggtgtcttcagtatgtgaaaacccaattcttcaaccctacaggatccaacaggcaatcgcagcaggcatcttacctttatcacccttgttcctccaacaaccgtcatccctattacagcagttacctttggtgcatttgttggcacaaaacatcagggcacaacaactacaacaacttgtgctagcaaaccttgctgcctactctcagcaacagcagtttcttccattcaaccaactggctgcattga

SEQ ID NO: 31367 - DNA, 118 bp, Zea mays
  Clone ID: LIB3059-041-Q1-K1-C1
ctgacgcgtccgaccgtgaagcacacctattagctatcgcagcttaacgacgactgcgaccagaccgattatgtcaagctgctgaatgtactgggttccggatcacaacgctaacttg

SEQ ID NO: 31368 - DNA, 366 bp, Zea mays
  Clone ID: LIB3059-041-Q1-K1-C11
ctatctgccgctccagcctttcgctagggtttaaccaccggcggcgcgcgcgacgggggcaagatggtgcagcgtctgacctaccgcaagcggcacagctatgccacgaagtccaaccagacgcgggtcgtcaagacccctggtggcaagctcgtgtaccagtacaccaagaagagagccagcgggcccaagtgtcccgtgaccgggaagaagatccagggcattccccatctgaggccagctgagtacaaaaggtccaggttgtctaggaaccgcagaactgtgaaccgtccctatgggggagtactatctggaactgcagttagagaaaggatcatccgtgcttttctggttgaagagcagaag

SEQ ID NO: 31369 - DNA, 346 bp, Zea mays
  Clone ID: LIB3059-041-Q1-K1-C12
cccacgcgtccgcccacgcgtccgcccacgcgtccgagggcggatggcgcgcgggctgcgcggcgtccgcgacgacctatccgagctggggcgccacctgctcgacatcgcctgcttcctgcacccgctcctcaacccggcccacaccgactccccgccacccacccccacgggccgccgccgcccgcgccgctccccgtccccgcaccccgccgcgccgacgtcaccgtcgctcctcgcgggcatcctctcccacctcgctgaaatcggcggctccttccgcggcggcttactccgctcctcggcggcgccccgaccaccccacccccgacgcgctcgagtcaca

SEQ ID NO: 31370 - DNA, 402 bp, Zea mays
  Clone ID: LIB3059-041-Q1-K1-C2
ggctgaggagcccgggcaacaccaacaacccggcgggctccgcggtgacggcggccaacgtggacaagttcccgggggtgaacacgctgggcgtctccatggcgcgcatcgactacgccccgggcggccagaacccgccgcacacgcacccgcgcgccaccgagatcatcttcgtcctcgagggcacgctcgaggtcggcttcctcaccaccgccaacaggctcctcagcaagaccgtcgccacgggggacgtcttcgtcttcccccgcggcctcgtccacttccagcagaacagggggcacggccccgccgccgtcgtcgccgccttcaacagccagctccagggcacgcaggccatcgccatgacgctcttcggggccaacgccgccgtgcccaccgaca

SEQ ID NO: 31371 - DNA, 374 bp, Zea mays
  Clone ID: LIB3059-041-Q1-K1-C4
agctcatcgactccagattggagaactcgacaccatgaaggtgctgatcgttgccctggctgtcctggcgctcgctgcgagcgccgcctccagtacaagcggcggctgtggctgccagacaccaccgtttcatctaccgcctccgttctatatgccgcctccgttctatctgccgccgcagcagcagccgcagccatggcaataccccactcaaccaccgcagctaagcccgtgccagcagttcggatcctgcggcgtcggcagcgtcggcagcccgttcctgggccagtgcgtcgagttcctgaggcaccagtgcagcccggcggcgacgccctacggctcgccacagtgccaggcgctgcagcagcagtgct

SEQ ID NO: 31372 - DNA, 425 bp, Zea mays
  Clone ID: LIB3059-041-Q1-K1-C5
ggacctcctactgggagggcgaagccacggccccggacgctgcggcggcttctggaggcgaagcagctcccggcaccgcggcagaagcgcctcctgctgctgctccggcggcgccagagatcaccccagccaaagctgacgcctgatcgtcacgctattattcactcacatgtgatgctgcggctgcgactcctaaaccttaaatctagaaatagctggggattgggtttgcattgcatcgtgttcttgccggtctagcaagtgactataagaataatggaataaacgatgacccagtgtgtgtatgatttccgttctgaagaacaacacatcccttgcaggattgttgttcagtagattctacttgtaccgcggctttggagttccgcaaaggactttacttgttcaagaacttcttctctgac

SEQ ID NO: 31373 - DNA, 424 bp, Zea mays
  Clone ID: LIB3059-041-Q1-K1-C6
cccacgcgtccggcgatctaaagcagtagaagaatcattgggtgttgttacccagaaggtacgtgagactattgaagaaaatatatttgttaggagtaaagcaaaagagaagcacatggagtacgaggaagagatgaagtcccaggaggaaatttttcatggtctaattgaggatattcacaaggccacagaggataaagaaaagcagtttgagaagttgttgcaggaagagcgctcaaaggccagacgctttgatgttgattctggaactatgaaagatcgtcagctaaggaaggaatatgtgcagaagttcattgattgccaagtcaaggatgtggcagagtttgaagttgagcgagatgagctgatcaaagtccacgaggacaagaagttgaagctcaagaaggatacatggatctggaac

SEQ ID NO: 31374 - DNA, 224 bp, Zea mays
  Clone ID: LIB3059-041-Q1-K1-D11
ggcacatacaagcacaattcagactcacaatggccgccaaaatattcgcgtcgggtgctccttgctctttctgcaatagctgctaccgtaacctttttcccacagtgctacacaagctcctatagctcgctttctttcatcattcctcttaccagctgagtattcaagatttcaaaacccaatatctcaaccctacaagatgcaatcggcgatcatcacaggca

SEQ ID NO: 31375 - DNA, 434 bp, Zea mays
  unsure at all n locations
  Clone ID: LIB3059-041-Q1-K1-D12
gatgaaaatcgccgctcacatctcatctggcatactatggcggcgcctctcgtcgggcggacctcggcttccaccggcggtgcctagatcggcggcgcccggaccttggcctctgtcggcggtgcccggctcccctcggcatccaccgacgccggccgactcactatctccctccccccgttgatgcccgacatcaatggcggagcaccatcctgatctcatcatatgccggaagcagcctggcatcgtgattggtcgcgtgtgcgagaaatgtgatggcaagtgtgtcgtctgcgacgagtgcaattatggttcgttccagggaaggtgtgtgatatgtggaggagtcggcatctcggacgcttactactacaagaagtatggttctaagaagagatgatcgagatgatttgngctgtgtgtggttctctttg

SEQ ID NO: 31376 - DNA, 418 bp, Zea mays
  unsure at all n locations
  Clone ID: LIB3059-041-Q1-K1-D3
cccacgcgtccggcttggggtggggttggctaggggttgcttgcgtcttcttctttccgtgggtgctggcctgccggtcggcggccaccggcagggaagggaacatgtcgaagaagaacaatcttgccaagagaagagcagtacgagttcgacctncaacgggagaaggaggccaaggagaggcaggccaagaagctgcaagccaagaaatccaagatgaagatagatggtgctgaaaagaaacgtaaaggtggccaatttaaggtcggcaagaaaaaggtgaagacgaaactttcagccttagcaaaagccaaagccgcgcaagccatggaggtcgacaagtgactgcggagcacaagcatcatcaccttaagcgtcgagccagagttggaactctgaattctgtgcccacatgaat

SEQ ID NO: 31377 - DNA, 425 bp, Zea mays
  Clone ID: LIB3059-041-Q1-K1-D5
caccaagcgaagctacctagcaacgacttaacaacaatggctaccaagatattagcccgtccttgcgcttcttgccctttttgtgagcgcaacaaatgcgttcattattccacaatgctcacttgctcctagtgccattataccacagttcctccgaccagttacttcaatgggcttcgaacacctagctgtgcaagcctacaggctacaacaagcgcttgcggcgagcgtcttacaacaaccaattaaccaattgcaacaacaatccttggcacatctaaccatacaaaccatcgcaacacaacagcaacaacagttcctaccagcactgagccaactagatgtggtgaaccctgtcgcctacttgcaacagcaggtgcttgcatccaacccacttgctctggcaaacgtaactgcataccaac

SEQ ID NO: 31378 - DNA, 419 bp, Zea mays
  Clone ID: LIB3059-041-Q1-K1-B9
agaccaactagcaacatagaaagcacaatagtgtaccaacaatggcagccaaaatagtttgcttccttatgctccttggtctttctgcaagtgttgctaccgcaaccattttcccacaatgctcacaagctcctatagcttcccttcttcccccatacctctcaccagcggtgtcttcaatgtgtgaaaacccaattgttcaaccctacaggatccaacaggcaatcgcaacaggcatcttaccattatcacccttgttcctccaacaaccgtcagccctattacagcagttacctttggtccatttggtggcacaaaacatcagggcacaacaactacaacaacttgtgctagcaaaccttgctgcatactctcagcaacatcagtttcttccattcaaccaactggctgcattgaac

SEQ ID NO: 31379 - DNA, 440 bp, Zea mays
  Clone ID: LIB3059-019-Q1-K1-B6
cggacgcgtgggggagcggaaggcgaaagagtagcagcagcaggcggcgccgagtagcggctccccacctcgagcttgccaccatggctagaggattgaagaagcatttgaagaggctcaatgcgcccaagcattggatgctggacaagcttggcggagcttttgctcccaagccatcttctggacctcacaagtctagggagtgcctgccactgatcctcatcatcaggaacaggctcaagtatgctcttacataccgtgaggtcatttccatcctgatgcaacgccatgtactagttgatggcaaggtcaggacagacaagacctaccctgctgggttcatggatgtcatttccatccccaagaccaatgagaactacaggctgctgtacgataccaagggccgcttccgccttcacccaatcagggatgaggatgct

SEQ ID NO: 31380 - DNA, 355 bp, Zea mays
  Clone ID: LIB3059-019-Q1-K1-B7
gggagggcaagagcgtcgtcacaactggccgcaagatcattggcgccaccaaccccctggcttctgagcccggcaccatccgtggcgactttgctgtcgacattggcaggaatgtcattcatggaagtgacagcattgagagtgctaataaggagattgccctgtggttccccgagggccctgctgattggcagagcagccagcacccctggatctacgagaagtaaacatggaaagtttcacatcaaaccttgagagccagaggaagcatgtcaccatttgtgctttagcaatgttttcgaaaagattatgatctgtatcttggaaccttatttcaatggaccaaatttctttc

SEQ ID NO: 31381 - DNA, 338 bp, Zea mays
  Clone ID: LIB3059-019-Q1-K1-B8
cccacgcgtccgcaattcgccgcactgaacccctctgcttatttccagcagcaaatactactaccatttggccagctagctacaacaagccccgcttccttcttgacacaacaacaattgcttccgttctaccagcagtttgtggctaaccccgcaacccttttacaactgcaacagttgctgccctttgtccaacttgctttgacaaacccagcagccttctaccaacaacacatcattggcggtgccctcttttagattgcttattagttgtcattcaataatgaagttttttggctgatgtatgtggcctcctagaaataagaagttatatttcc

SEQ ID NO: 31382 - DNA, 420 bp, Zea mays
  Clone ID: LIB3059-019-Q1-K1-B9
cggacgcgtgggaaatggtgtgtatcataggatccttaccagtgccggtgtgacaatgattgaaggggcaggcagtctagttgatgctcatactgttgaagttagccagcccgatggttcaaagcaaaggtataccgcgaagcacattttgatcgcgactggtagccgtgctcaacgtgtcaacatacctggaaaggatctggctattacttctgatgaggccttgagcttggaggagcttccaaagcgcgctgtaatcctgggtggcggatatattgctgttgaatttgcttctatctggagggggatgggtgctgaagtagatttgttttatcgaaaagatcttcctttaagaggttttgatgatgagatgagagctattgttgcaagcaaccttgagggaaggggaatcaagttgca

SEQ ID NO: 31383 - DNA, 416 bp, Zea mays
  Clone ID: LIB3059-019-Q1-K1-C12
cggacgcgtgggctcctctggtctctagacaaccaagccagagaggagcagccaggcgagccaaagcgcaaggacacacggccagcgacaacctcctcccctcttattccgcgcccagcagcgaggcatggtggagaaggcgaggaccatggcgcgcaggctggagatcccccagtggaaggccgacggccttccgtcgccgacgagcccgctggaccgcgcgtcgccgtcgccccgggggtggcgccaccgcgacgccgtaggaggaggcgtggggctcgggatcctggcggcgctcgaggccgagggcccgccgcagcccgcgccgagggtgtccatcccgcggcgcgcggcgcggcttgaggtgtcggagctcgggtgcagcgggcgctgcgccaccagcctgtgcggcggcg

SEQ ID NO: 31384 - DNA, 412 bp, Zea mays
  Clone ID: LIB3059-019-Q1-K1-C2
cgcaaattgcaccaagaaatccatcgagaggccgtcgacaggggaattaatggcgtcgtggtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgcctagaggacctgccgggctgcccgcgggaggtgcagagggga

SEQ ID NO: 31385 - DNA, 439 bp, Zea mays
  unsure at all n locations
  Clone ID: LIB3059-019-Q1-K1-C3
cccacgcgtccgccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttggcatcagaggccatcatcaagcagattccccgtctccttggtcctggtctcaacaaggcaggcaagttcccgaccctggttactcaccaggaatccctcgagtccaaggtgaacgagactaaggcaaccgtcaagttccagctcaagaaggtcctttgcatgggtgtcgccgtcggcaacttggcgatggaggagaagcagatccagcagaacatccagatgagcgtcaacttncttgtttcccttctgaagaagaactggcagaatgtgagatg

SEQ ID NO: 31386 - DNA, 428 bp, Zea mays
  Clone ID: LIB3059-019-Q1-K1-C4
gtctgtctactcgcctacctacgcggctcaaacctttcccccttctgccaattcccgcgggcgctccataccgtaacgcgacaccatgagggagtgcatttcgatccacatcggacaggccggtatccaggtcggaaacgcgtgctgagagctgtactgccttgagcatggcattcaggctgacggtcagatgcccggtgacaagaccattgggggaggtgatgatgctttcaacaccttcttcagtgagactggtgctgggaaacacgtgccccgagctgtttttgctgaccttgaacccactgtcatcgatgaggtgaggactggcacctaccgccagctcttccaccctgagcagctcatcagtgggaaagaagatgcagccaacaactttgcccgtggtcactacaccattggcaaggaagatg

SEQ ID NO: 31387 - DNA, 426 bp, Zea mays
  Clone ID: LIB3059-019-Q1-K1-C5
cccacgcgtccgaaacttttctcacgctcacccattccacccaccacccaccttccttgcctctctctctgtctgactgtctccctccgtccctcgaagcttctctggtttcagacgcaaccccgcgggtcgcgggatcaaggagccagagagcgggacgcagcgagcgttccgccggagatcgagaccgtagctagggtttgaggcgccgggctgcggtggacgagatgtcgacgccggcgaggaagcggctgatgcgggacttcaggcgcctgcagcaggacccgcccgccgggatcagcggcgcgccgcacgacaacaacatcatgctctggaacgccgtcatattcgggccggatgatacgccgtgggacggtggcacgttcaagcttaccttgcagtttacagaagattacccaaacaagc

SEQ ID NO: 31388 - DNA, 422 bp, Zea mays
  Clone ID: LIB3059-019-Q1-K1-C6
atgacacctggtggccaatgctaacagttctcatgtatcttatcctaccaatgcccgggatatttttcctgggttctgatacttgctccatgatgtccaatgggggagacggctgggtgaacttcacgaaattcttgacgggcgcatcaatagtagggagcatggtcattccgtcgatcctgaagcatgcaggcgtcattggatggggagccctgacgatggagctgtcatccttcgtggtctttggcgtggcaatcctgtggttcctccagatgaacggtgaagacgagtacagcggagtgttctaatccaaacctgctgctgctggttctcttgccagcgtggcactctgtgcatggtagttgtgaactgggctgtactgctacaacaagagaagcattgtcctgtgacctgatttactg

SEQ ID NO: 31389 - DNA, 415 bp, Zea mays
  unsure at all n locations
  Clone ID: LIB3059-019-Q1-K1-C9
cggacgcgtggggatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatgttccagccgctccggcaacagtgctgccagcagcagatgaggatgatggacgtgcagtccgtcgcgcagcagctgcagatgatgatgcagcttgagcgtgccgctgccgncagcagcag

SEQ ID NO: 31390 - DNA, 259 bp, Zea mays
  Clone ID: LIB3059-019-Q1-K1-D10
cagatgcatacaaccgatgctgagtgatatggtggtaggaataattcatcccgcaatgatctgacgctgacgctcagaccttgtgatgctcgtcatatgatgctgcatgagcgccggcaccacgtatgaagttactaagaatgaattcaccgtgggactagcgatcagttgcctgttatacaatcgagaagtcgcgtggaaaactaccataatgacgagctgagctatcagaagacaattgattccgtgatatatacaa

SEQ ID NO: 31391 - DNA, 424 bp, Zea mays
  Clone ID: LIB3059-019-Q1-K1-D11
ccacgcgtccggcaacatagaaagtggtatccagtagcaacaacagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaa

SEQ ID NO: 31392 - DNA, 414 bp, Zea mays
  Clone ID: LIB3059-019-Q1-K1-A12
aaagcttgctcaaggaagaggttgagagatacaagaagtttgctgatcgcttggagcccttcattgctgataccgtgcatgtgctaaatgaatctatcaagcagaagaagaaaatcctggtcgaaggcggccaagcaactatgctggatattgattttggcacttatccatttgtgacttcttctagcccttcagctggcgggatatgcacaggcctagggattgctccaagggcaattggcgacctgattggagtggtcaaagcttacacatctagagtcggctctggccctttcccaactgaactatttggagaggaaggtgatcgccttaggaaagctggaatggaatttggcacaacaacaggtcgcccaaggcgttgcggctggcttgacattgttgcgcttaagcaca

SEQ ID NO: 31393 - DNA, 430 bp, Zea mays
  Clone ID: LIB3059-019-Q1-K1-A2
ggtgggctggcttctcctccccctcttaccaagtccttctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtcccgcggcttcagcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggcggttatggtggcgggcgccgtgacggcggttatggcggcggtg

SEQ ID NO: 31394 - DNA, 431 bp, Zea mays
  Clone ID: LIB3059-019-Q1-K1-A3
accggtgcggagacccacgcgtgcgattccactctgcccgagcaagccgaattgtcgtccgaattcgctcgcggggagcacttgctacctcgcgcccgccttctgtcgcgcggattcgttgctgcgcctggagatggacccgatggacatcgtcggcaagtccaaggaggacgtctccctccccaaatagttgtttaaaatcttctactgctgattgaactttctgctttgcactttagcaacaatgtttaagataattaaggagatgcttcctcctgatgtacgagtggcaagagatgcacaggatcttcttgttgaatgctgtgtagagttcatcaatctcctttcgtctgaatcgaatgaagtgtgcagcagagaagagaaaaaaacgattgctcctgagcatgttatcaaggctctaagtgatcttg

SEQ ID NO: 31395 - DNA, 429 bp, Zea mays
  Clone ID: LIB3059-019-Q1-K1-A4
gcaacatagaaagtggaatccagtagcaacaacagagcaacaatggcgaccaagatattgtccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacactg

SEQ ID NO: 31396 - DNA, 433 bp, Zea mays
  Clone ID: LIB3059-019-Q1-K1-A5
caagcaacatagaaagtggaatccagtatcaacaacagagcaacaatggcgaccaagagattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaaatttcttccattcaaccaactgtctacactg

SEQ ID NO: 31397 - DNA, 435 bp, Zea mays
  unsure at all n locations
  Clone ID: LIB3059-019-Q1-K1-A6
ggactctggaatacaccaggtacctttggtcaggtgttggagtgttgggataaggaaagaaaagaaatggtggccataaagatcatcaggggcattaagaagtacagggatgctgcaatgatcgaaattggcatgcttgagaagcttggtaaatatggtgaaagcagatccaggtctcatcccaatccccaaaggaggggtcctattacaagcagttgcccaagtctagtgctatcaaggtgattgatttcggtagcactacttatgatcaacatgatcagagttatgtggtatcgacgaggcactatcgggctccagaagttatattgggacatggatggagttacccatgtgatatctggagtgttggttgtattcttgttgagctntgcacgggtgaggcgttattccagactcacgaaaacttggaacatc

SEQ ID NO: 31398 - DNA, 398 bp, Zea mays
  Clone ID: LIB3059-019-Q1-K1-A7
cgcatgagcaaggagatcaccgcgctcgcgcggtcagcgatgcgccctggcaccatgggtctgactgctgtgcacgatggcatcttgaaggatgttgtctacccagctgagattgtggggaagcgtgtcagataccgtctggatggttccaagattatcaagattttattggacccaaaggagaggaacaacactgaatacaagctggagacctgcactgcggtctaccgcaagctgtgtgggaaagatgtggactttgagtaccctatgaccgaatatgcataaatatgatgccctctggatatctccactctatttcgttgattctgaatgttatgttgggtctccctatgtacttcaaaaaacatagttgtgatgctaaagttgtctaggaattt
